United States Patent 9,487,797 (GENOMIC PLANT SEQUENCES AND USES THEREOF) - sequence listing, part 16

SEQ ID NO: 37268 - DNA, 1091 bp, Oryza sativa
gccgtcgacccggggtgagccgtgaaccgcccatttcgtttccaccatccctcccctctctcggccgccgctccgccgtgcctatggccgccgccggcgaccatcggggcgcgggcgcgccgcctcccgtcggccgtgccggcgaggccgccttcgggcgcgccccgcgagctgccatgtgggcccggccgtcagccgcccgcgcccgcgggtgcggctgacgcgtgggacccacggcgccggccggcgtcagccgtgtgcacccggtccaccgtggaccgagaggctgacgcgtgggccccactcccgtggacccggtccgcgcgccctctccctcggctgacgcaataaatccggtttttaattaaaatttaaatgaagaaattcgtaaatatccatttaaagagcatataaacttcaaatggccatatcttggccatttgaactcggaattggaccgttcaagtctctaatttttccttaagaagtcaagaacccatttttgtgctttgtttctgctgttatgtggagtttattagagtaaaagccttttcttttccgttggtcgtgtagacgctgcagcttcggaagatccgctcttcgtggaagttgaagccgacgtttgggaaagcgagcaaggcaagtcacatcatctttgagcatattgaatcccagtttataaaattatgttgatttaaattattgcattatcgcttcatttaaattcccgcgttatcactgttttatttagccatgcctatttacctttgttatgaccttattattattgttattgttattattaccttgttcaccctagattaaacaaaaccccaactagtggacactctactcatggtaccactagtataattttatgtagatgcttcgcaatttaattaggtaacattaggcggttttacaactctagactttgggaatattcatatcacctggacactttggaatggtttggttattgtggaaatggcttcacaccgccccctctattcaaaatccccaaaatggttttaggctgggctcggggtgcatggttttgatagtagcacctcggccatataaggaccggt

SEQ ID NO: 37269 - DNA, 572 bp, Oryza sativa
ccccctcggctgattcctggacgagggtttacacacatgtaagcgtttggaattttggatagaaattccgggcatgacaagttggtatcagagctcccttgaccctaggttatgccaaatggttacccatagaagccctctaaaaatattggaaaagtagaactattcttctccctttctcttttaattaaaccaaactaatggcacatgcacttcataatctcttttaatggttctcattcaaaatttattctagtgttattagtactgtacatctattactgtactaatggctcattttccagcaaaagttttacaatgttgtttcatttaatcttgctgcaataaaataaatttagcaagttgattttataactttcttttatttcttttggaacctgttattcaaaagtataaaacttgtaatattgtttctgacttttcaaacttatcttgcaaacttggtttactttatttatttaccttttactttgaatttctaaaattaatccaaaaacttgtgctattaattggatagatgtcttaactccctcctttcacttgtctttaga

SEQ ID NO: 37270 - DNA, 173 bp, Oryza sativa
ttgtctgaattccattttctgcttctcatcagggacaagattaaggtacaattctttttaaaaaatctatactgttttcactgtgattcattttgctttctgtcactattttgtcttacctgttgttttatgtattcctttacaaagcaaaagcataacctgtgatttttagg

SEQ ID NO: 37271 - DNA, 376 bp, Oryza sativa
gcacctccaaactaagcaaatcacatacttttatgtagaggaatcaccacagcaggttggtataaatagacaatatacatggaacacattttttctcgaaaacatctacatggaacatatagcaatcatgattcacaaatacaagtcaagaatgaaaggactaacatcacaacaatttccaggttcacaaatcactagttatgaatacacaccatcgctattgacaagtatagcaaagaataactaaggagggaagagaactacgcattcgacaaaggaattgacgaaacactatgctgaatgatgatacatccaaaccataaattgcttggtacataccacatactactcatttctatctgataactttcacagt

SEQ ID NO: 37272 - DNA, 1501 bp, Oryza sativa
aatacacaccatcgctattgacaagtatagcaaagaataactaaggagggaagagaactacgcattcgacaaaggaattgacgaaacactatgctgaatgatgatacatccaaaccataaattgcttggtacataccacatactactcatttctatctgataactttcacagtggtcgaaatcagatcaaattagtgctaatcatcgaatatatctttctcataaatcccgcacaccacacctgctggcttaaacgaaaaacaactcgaaacaccatcgcatcgcatcgcatccacagagtattgaagcactctccagattacaatagccgctggacgttgcggccggagtaacgagttctaaccaagcaccaatccaacgaacaagcgcaaaggaaaaaggaagaagaaaaaaaaaagaaaactcaaattggatcggtggactggaggaagggaagcgggcggcgtgtcaaaggttttagggttggggctcgctcgggaaccaaccgtaccttcacccggaggagcttccggccgccggcgagcgtggaggagggagtccgcgtcgacgtcgaagtcggcgccgcccgtacgcgcgttgttctcacgcagcagtccgaatggacttctcactttctcagagcatccgcaggcaggcagcggccaactggttttgaacactgcggaaatggaacaagcagatcggcctcagttctttttttcccctcaaaagctttacatatatataaaaaaaaacttacaaatatttccgcacacccatacacatcattacacacgcaacagcacacttaccacctgacgaatatgttccctagcataagttcaaaacaacacaaccataatctcacaaaaattctattgaaagaccacttatttatggatactaggatttaaaccctgatgagttgtgcatgtgcttttaaaaataacttacaaaaactcactgtcaaacttctttttaacttttagcagccgttagctgcttactactccctccgtctcataatataagagattttgactttttacttgtactgtttgacgatttatcttattaaaaaaattagaattattatttattttatttgtgacttactttattatctaaagtactttgagcacaacttttcgttttttatatttgcacaaattttttgaataaatcgagtggtcaaacagtgcaagcaaaaagtcaaaatcccttatattatgggatggagggagtatgtctttaggacaattttgaatttcacagcttaattttaggaataatttaggtttgtttttcttccattgctcatctttagcttcaagagagtttcggctaaaactagtaccgattaaacattcatcaaatgacaaacggatattccatgatagaatacaacggatggagaaatggcttggaagcacatggaactgattgttgctttattgcaactcaacaaagttcatcaaaaatacattgcacatctcccaca

SEQ ID NO: 37273 - DNA, 360 bp, Oryza sativa
tacacggcgcaggtggattccggcgatccgtgcgtctccatcaggtcggcgtagaagcaccacagcttgagagaccgatgcagctttgtttggacgacggtctcgccgacgccggcggcgacctgcctcctgacctcgagcgacggctctgatacacatacctctagtaattgtttcatgaatttacaaaacttctaggtatgattttcatgagtttccaacatttagctcgttttcactgaatgtctgaatatgtcctcatgttaaatgggaaatatgttagaaattggatgtttgcgaattgtagttttcagcagtactattgaatacagagttatttcaggtgagcaatcttatcga

SEQ ID NO: 37274 - DNA, 1501 bp, Oryza sativa
gaaagaagtcacttcagttctgcatctacacaaagaaattctgtcaaggctgtcttccttttatgtcaaaaagatcacaactaccaaccgatttagcctttgattgcatcaccagtagtcattgcaagaacatgacctggtttcttcctactactccatccgtcccaaaatagaagaacctagaattgaatgagacattttttagtgcctcttaagattcattatactaggaaatgtcacatccggttttaggttcttatattttaggactgtgggagtaactgattctagcctttgattgaatcaccagtaatcattgcaagatgggagtaactgattctagcctttgattgaatcaccagtagtcattgcaagaacatgaccccatcctgaagtggtggaacctgttgagatccctgacaacgaactccctctccacaatggcactgatgaccttaaacgcttcatggcagtcacggcacatcctcaggttcttcatcaccctaatggccatccccttggggatcaccagcaatccaagccccaatgccagcaactcactgtgcactccaaccatcacacctctgccttcctgatgatgatgatttccatcctcttcttcatcagcatcaaggactctggcactgccaattctccccttgtaacccttctccctcatcttgccctccaattcatctaacagcagcatcacctcaccggcccttgagccggcaggcgataccatgccagcgtagaacacgtaggagatgtcctttatctcgatccagctgcacccgggatccttccgaatgccgcgccgcctcatgttcgaccacaccgcagcagcgtcgtcggcttgaccggctgaagcgtatgcgttcgacatgaccaccagtgcgccggccacatcttgggtgaactctgataccttctgcccagccatggttgctaggtccaggcgcttgtggttccggcaagctgacagcaatgagctccacagcatgagggcgtcattgccattgacctgtgcttcgtcggccagctcgaatgccgcctcgagctgacctgcacgaccgagcatgtcgacagcacaagtgtagtggctggcacatggatcaatgccgtactcgcttcgcattgaacggaggagctggaggccggtgtcgaccagacctgagtggctgcaagcgtgcaggacgccgagcagtgtgacactgtttggctgcacgcctcggccaaccatgtcactgaacaaagcgagtgcgcacctgccgaggccgtacttcgccgtcgccacgatgatggaggtgtaggggatgaccgacggctggttgatcctgtcgaacaccttctttgagtactcgtagatgccacatttggagtacatgtcaaccagagccactgcaaccacgtcattgtcttcgtgcccatggtggaggaccatgccgtgaatgcacttgccgatgccaagccgcccgacgcccgcgcacgcgttcaccac

SEQ ID NO: 37275 - DNA, 1501 bp, Oryza sativa
ggatagattgttaagattaatcttgactcttccagtgtcaactgcaactacagagagctttttcagctatgaaaattgtgaagacacgtcttcgaaataaaatgggagacggctacccatcacatcacatccaagagttggtgcatctcaacaagagatccttcactagcatacccatgaagcagagtaccgtatgtagcactattaggcttgtggcccctcttgaccatagaatcaaagatctttctagcttccatggatcttccattcttgcagagatagtccatgagcatgttataagtgactacattcggttcaacaccatctctgcacatttttctgaaaatcccaatggcctctttgggctttcccgatgagcaatatccatgcaaaagactattgtacgtgatgcaatcaggcataacaccattcttgaccatcctagtaaggacctccctagccttttccattgcttgagccttggatagggtagcgacgattgagctgtaagtcacaacattaggcgacatcccctgatccagcatttcatcaaacaggcaataagctttgtccagttgaccctctcttcactctctctcttaattaatatagtgtcacataagctaaaagttatatatggcaatgtagttaatgccatagacaccatcctaggtggagggttgagactgcccttactccgatgttttatctggttgtgttttagttcacaccaaaattaaaagtttaattgaaattggaacaatgcgacggaaaaaattaaaagtttgtgtgtgtaggaaagttttgatgtgatggaaaagttaaaagtttgaagaaaaagttgggaactaaaccaggcctctctttttctcggccattctcaatttctcatctccttacatttcctttttatgggtatctcgaacaggatgggatggaatgatggaacagtgaagagtagcaagaggatgacgacaatgacagatcgatatcactgtgttgatgtttcaggatgttcagtcttattagtagttgggtttcttcttgttttgaagttttgatggacctctgatcttgggtcttcttgttgtagacacaaaaaaaaatttcctgttgacatacccgatatcttcatgataagatgttagcgctttgttcattctgcctggcctgggacgctgggtttgtctttgatgttaaggtttgctagcaggtaaagccagcgctgttacttgtaacacacatgattagcttaaaataaaactgggtgatgcgcatatcctctgctgaaacatgttgcaagcagtcccttactattcgccgcctcccagtcccagaatcgccggcatccaacacttgcatttgatgtttctgggacaacttttgcttagttcaacttttgccctaccagatctgacggtaacgtcagacagagtgtacatgaataccaatcaaaatgagctgaacatgttaatcgtatttttcagacagctaccatttc

SEQ ID NO: 37276 - DNA, 1501 bp, Oryza sativa
accctagccaatacaaggtaccagatttctcaaaattctcagggtaggacaatgtttcaacttatgaatatgtcagccgattcttggctcaatgtggcaaggcatcggctgttgacgccttgagggttaggttgtttcctttatctttgtcaggatcggtattcacatggttttcatctttgccatataattctgtcaatagttgggctgatctggagaagcagtttcatagctatttttacagtggaattcatgagatgaaactgtccgatttaacagcaatcaaacaaaggcatgatgagtctgtgcaggattacatccagaggttcagggagatgaggaataggtgctatagcttgtctttaacagattcccagctagctgacctggctttttaagggttgatagcaccaattaaggagaaattttcatcccagactttgagagtctatcccatcttgcgcagaaggtgattttacatgagcaaagatttgctgaagctaaaaagaatttcaagaaaatcaatcatgtatatccttatatgtatgattctgaagaatatgatgattctgaagtagcagcagccgagtgggtcagaagcaaaaaagtcataccatgtcaatgggtgagaagttctggaaaagaagagaagtttgactttgacatcaccaaggctgacaagatttttgatttgttacttcgggaaaaatagattcaacttcctgctggtcatgtaatcccatcggctgaagagctaggcaaaaggaggtattgcaagtggcacaattctggttctcattctactaatgattgcaaagtttttaggcaacaaatccaagtggccattgaggggggaaagatcaagtttgatgattcaaagaagccgatgatggttgatggtaatcctttccctgttaatatgacgcatacatctgggaggacagccgatgggggaaagaatcgaaattttcagatgaactcggctagaattattaataaataccagagaagatatgagaagcagcaggagaggtattatgaagaagaaaatgatggtggttttgatcctcattggaactgtgactttttcagattttgttggaataagggtatgaggctgccatcgattgaggattaccctggatgcagtgaagatacagggagttcaagccgatcctataatagaggcaatcggctgactcagaagagagtacctgtccatcagagattgggcccagtaaatcaagattattaccatgatgaggatgaaagtaggaaagcacaatggtgctctacagttattttcaccaagaaccagaagagaagggttcaaagattgaggaacagggaacgttttcaggaggtgcaacaggaaattagccatcggctgaggaaaataaagaccaagcaagagtggcgtgttaagagcacggttacaacagccgatgaagttgaagccgacaaggcaaaaaggttgcttaaaggcaaggtactgcatctg

SEQ ID NO: 37277 - DNA, 1501 bp, Oryza sativa
ccgagccgcacagtgacgagcccacgaagaaaagcccatcactgctcatttcggcccagtgaaagaataagaacagctccgccgttcacagaaggcgaaagctgcaaaacattactaacaacagaaatacagatacatgcactgcacgcgttctttgcaggattccaatgttagtttcggcaggagcatcggtcgaaagagggcgcctcataccataccacatggtttgcacggtctcggccgaagctcctatctcacccttgcccgtgaggggcttgttggcagtatgtcacgagacccttcgaccagacctgtcgaaaccatgcaaccagctagggttcaggctcaaggcgtcaagcttatcagggcgaagctccatggcgaagactatgcggcgaagacggcaaaggatgaagcctcatggcgaataccgtgcatcctaggcgaaggtcgaagggcgaagggtatacgccgaaggaggatgacttcgccatatcgaggccagctccgggaaggcccaaggggacatcccagccgcttcggcccgttggccattgggccagcgatcgccaatttggcccattagaggcccatgcacctcaattacactgtatgcccaagtaaatgtccctttcataagggcaaccatgtaaattcccctgtaaaacctaaacccaaatagggggcctgtaatagggttataaatagacccctagggccacgtaaagggaggatttttcgaagaaaaactctcaatttaatacatttttactgctttccaaccactgttgagtaacacgtccttcgacgtatgcagttgtcatttcgacaacaggtagtatcggggtttcagccgatcttacctgatttagccttatgatttatatgcttaattgttatgctaaatctgccctttatgttaagatcctattgcatttagatgtattaagctttctgtttgatatattttacttgccttaatatcttgatgtagagcagtatcaaagtattagccgatacaagctagatctatctgatcggctatgctgtaaacatctataatcttcttgttaatatatatttcgatctaagtgatttatactgtctcggcatggcgaccgatctatcccaatcacttgatttaagtatatatcgacataaagattatctactattaacatctacagctgatcgagtagatttagttttaatttacttattcacaattgccgatcgattcacatatgacatcggctcaaaggtaaatgatatgtcatcggcaactagccgatcggctatcatttgtggattaaactacaatctttttgtctttatttcttgttgattgcaggatcaaatcagctggcacgctcatgaacctaaaaggcaagattttggacctgcactggagttaagcagatctcctaggcctcgtgtttttcgaatcaacacgcttttggcacgcccagtgggacacgagttttcaacgacttcttcacga

SEQ ID NO: 37278 - DNA, 1501 bp, Oryza sativa
cccatttcgcccctgccaatttcgagactcgggcggagcttatcccttttgttgagggggtgagcaacctcgtcttcccggctggtagctcgagcctgttcatggagctaaacgagttcgatgagggctgctctgccattaagagcttggcggttcgggtacgtagcttgactgtgttgtgttttttttaatcgtcgtttttcgacagcttgtcttaacattcgtcctatctctcttatcttcgaaccagatcctcgcggcccactgttcgaccgaatgaaccatgcgggctcgtcttgacagtttgaagaatcgtcttcgagccaaggacgacgaacttggctacaagagcttggaaatggaaggcctcgcccacacccttaaagagacaaaggccgagaacaagcggctccaggctgaactggaaaaagggagtgaggcgaaggcggagattgagcgcctcaaggccgagctcaaaaaagagcaaactcattccgccgctctgaccgactactacaacctcaccgagccgaagatggaggctcttcggcaagaggttagccaagcggaggcaaacgccgagaaggaggcggaacggttcgcgcgggagatggcgaaggccaccgagtctgcgaagaccgcgtgccaaacgctctgccttgccctttccgacatgggggcgagggtgcgtggagtccctggcgaatatgcttccgcctttgacttctcggagtggactcagcaggccggcggtgcggtctcggactgcgccagtgcatacggtgattgctgtgcacgcgtgtcggcggccttcactatgggccttctgcagcagttcggctgcgagaacgttgccgagttccctaactttgcgaagggggactgggaagttagtgcgcaggacgtttcgtgcctggcggaaacagttctggcagagggatggccgatccactgccaaggcgcgtctccttgagcaactagcgaaggtagaggcggcggaccagggcgaaggggaagatgctacggccggagagggtagaggcgatgccgaagatcacccagaggtgtaaggccccctgccctctctttagattttgtagttttcttttggcgtttgccgtggagggcgaacgatgtaaatttggccgatggccttctccccttcttattgtagccggaaacagcctttttgatatatgatgaatggatgactccagtttagtcaactattgcgttatcttcgccttattttcgcgtgcgaaagggagtctactcttttcgcccatttgttcgtgtcttaaccttgcgcttttccatttacctttctagtgctgattttagcagggtattcgctatcatgcctagaaattcacaaaccagaatttctaagctgaatgtgcattaaacccctgtccaggaccagccagggtacacaaatgacaattgttgtcatacagacccacgtcttacaaaaatataaaagattacaaatgcagcggaa

SEQ ID NO: 37279 - DNA, 1501 bp, Oryza sativa
acattcgaaaacaatgcatagttgaaataaaataatagctttaaacgggatcaacatgctcaaagggttgtttgggatctgtctgacttgccttgggcttccacaaacgcttcggaacctttctcaacggaacgctttcctccgaacgtcggaaacttaagcattataacaaaatcaacaaaacagttcaaaaacaagcataaacagtacatgtggatatttttaacatgtagatcttgattttagaagaattagaaacttgaccacctaaaacggatctaccgttatttagatatggatttccgaagttttaatctattagaaaatcgggaaaaagaaaaagaaaaggaaacgatgacgtcagccctagaggagatgacgtcagccctggagatgacgtcggcatgacgtcagcaacggcggccggctcgggtccgcgagctcgccggcgctagagcggtcgaccggacgattggaggacacctacgcgtagaggacaacgaggcgaacccgttggtactcaccacgtcgtcaaccgatgcacgatggcggccggcgacgagaaggaaggcggcggcggctcgggtcgacggcgacgagagggctccggtgatcggcggcgaaaaaggaggggcggccgagcttcctctcaccacggcgcacctcttggcgatgacggcaagcgacggcgacggcggagacggcgcggcgacgacgccgaagacggcggcggcggcggcgaacttggaacacgtcgcggcggcgctaggaggcacgggagagctcgggagagggggcaaacggaagaggacaacgagaggaagctatatatggcattggattgaagagatcgagctccaaacgagaggaatcgattcgggaagaattcaaactcggttttagggataaaatcaaaacgaattcgattcggagagaaaactcaacgattcgctttgattcttgggggaaaagaaagaggagaacgagaggaacaaaacccctcaaaaacccggaggaatcgggctcggatttgggcggaatcggaggtggaagatggcggctcgggctcggtctcggcggcggccggaggttgaagaagggcctgacatgtgggccccacatgtcagtgtcccgagagagaggggcgcgggcggcggcggcttgggccggcatgggccgcgcgcggggagagagagaaagagagagtcgggccgaaaacggcccaacggcttagggagggggatttttgaacttttttgaataaaacaatttgtgaaatgttgtttcaaatattaaaaatacttcccttgctcaaataattcccagaaaaattctctaaaatagaggagcaagcatagtatttaataaaattttatctagctcatttttatgttgaaaattttcctagaaaattagggtttagctggtaggcttttaaaataatttctaaaaatgatttaaaatctgcatttttaatttagtcgatttttagggcgtgaca

SEQ ID NO: 37280 - DNA, 1305 bp, Oryza sativa
ctcgaacacagcacctgcaggttacaaagttcatgcactaaccaagtcattaacgtgacaatcttgaaggtaaatagatagttttttttatattgcaactctgcaaacatgcgttctgtagcagttctcttcttttttaatctaagactgaatattaaatatttatttttttgtccaaataattataatattattataatggtatttgatgatgacgattaggatcagtgtgtttattttcttctttctctatataaataattatatattatctaataacgatgacacggatataataaaaacgtctcaaaactcatttctacacatgagatgttccaaaaacgtctcaatattcatctctaaacgatttaattttgtgctaacctgtaaagcgtcttaaactatatcctcaactaataaagcgtctcaaacatcgtccctattttaatttcacttataaaaaagagacgacttatagaatgacttaagtgaaacgtcttaaaacaatggttttgttgtagtgaacatcgagacgaacccgatggtactcaccacaacgtctatcgacgaacggtgatggccggcgacgagggggaaggcggtggcggagctccggtggtcggcggcgaaggaggacgggcggccgagcttcctcacctccgtgcgcacctaacggcgacaacggcaagcggcggagacggcggacgcggcggcgcgacacggccgaaagatggccggcggcggcggcggctaaatgcacgtggcggcggtgctacggtgcacgggagaggacgagagagggggcaaatggaagaggacgacgaggggaagctttataaagcattggattgaagagatcgaactccaaacgagaggaatcgactcgggaaaaatccaaactcggttttagggataaaatcaaaacgaactcgattcggatgaaatcctcaacgattcgctccgattcttgggggaaaaggaagaggagaacgagaggaacaaaacccctcaaaaacccggaggaatcggagtcggattgaggcggatttgagaggagaaaggcggcggcaaagcggcggctcgggcggctcggccggaggtaggggatggatccgacaggtgggccccacctgtcggcctccacgagagagggaagcgggcggcggcggcagctgggccggcttgggccggttcggccgcgggagaggagggagatgttgggccgaattcggcccaacgaccaaggagggggatttttttgaactttttaaaataaaacaatttgtgaaatgttgtttcaattat

SEQ ID NO: 37281 - DNA, 473 bp, Oryza sativa
  unsure (1)..(473): unsure at all n locations
acatggattnnnattnnatnnnttctcccttcttccttccnnnnnnctctttcttccttgtcgaaaagatgaaaatgcctcatacacatcatcgtccatgtcatcgtcttttcataaaagagaaaagagaaggaagaagagagaaaaaataaaaaaaaaccatgtcatcgttcacgtggcgtgccacgtaggcaagactacggtcaaacgcgactttggaccgggatgatacaataaaccaagtttaggggacctcgatgtgcgctttataagttcgtggacctaagtgaaacctgctgacaagtttaagaaccgccggtgcattttactctatacactaaattatagagttggtgctaatagttctttagcagatcaagtggactatttacaaaaacaacaaagtgaggtcaggtccaccacagtattggggctgtgcccttcttttggaatcttcatctagtggtacaaca

SEQ ID NO: 37282 - DNA, 1029 bp, Oryza sativa
tgcttgtgacccaagccaggctgcaagccacttatcccttctttctataaatttaaggccaaaagctcaaacctcgtgcttccacgtcatcatcaaattgtgaaccattggatgaatgcattagatcgcttctcagacgttggatggaatgcagcatagagcctaacccatcagtcaccgggcgaagtcttcgcctcctcagtgccaaatgtagcccatataaacacattggcccatctctacacacatctacatgtatccaggtcgtcaatctgtataaaatagctttatggctgaatgctccttcagttgacatgtgctacctaaattatctacaaattttggatagggctgctaaaaaaaatttcttcaaaaaagctatttgtttcttttgtttcttcttgagattatacctcctatctaacaaattgatgttaaccaagtctcgcagcaacacgcggggcatcctctagtatactcaaagttttgagccatatacgcaacgttcttactcagccaggaggaaccctgtatacgaaatcttaggtgggcccgaggccctccaaaaagggcccctattgacgtcaccctagggtcttctttttattttcaaagacattctgagcatgctgtttatttaataataattcttttaccagataaatgggtaccctggtttccatttcaccgataagagtctatgtgaaattttagttcagatttttttccctatttttttaatatgtttgaaattttgcatgtgttttttagatttttacgagttataagtaaaaattatatgttggaataattttttttgttcaattggagaattataagtaacaggttataggggagtgataactgataagaactattgaattatcacccaagggttaaaaaaatgactgaatctttttcaaacttcaggcgcctggaatcactcccaatttttcatatgaccatccctgacattttttttatccatggaaatggcagcaattacaagttgagcgacgcaaataacta

SEQ ID NO: 37283 - DNA, 1501 bp, Oryza sativa
tagaagtgaggccagacaatgagacatgtgctgatctggctgaagttaattaatttcagtgtttatggaattaacttcattttaatgattatatgtatcatattgaaaaaaaagtagtaaggaaatgggactgtataaactctggtggataatgtaaatgtcacaagatcatttattacatgcaaggaaacatttcttctctccatatttcaattagtaattaatagtaatagcctttaaataaatgataatatatgagatcttaccacccaagaggtaagaaaaatattggcccttggatgactgtagaatgaatggttcacaaagttttggtgtaccacaaaaaaatcccactagatcatttatacaagatatatagaaataatcattacaaattaaaacttttaaatttgcacctacaaatgagtccggtcgttttgactataactaattataagttgtaacgcttattagcgaccaaaatataatttatgggcaaaaattttacatatgtgttgttagcatctaaaaagccaatactgaaaataaaatatggtaaaaaaaatcaaaatcaactctaaagttaagttttgaaattcaaatgttggttgtggatgataagctaaagagcaaataacccacataattcacaggggagtactagaggttacatgaattcgacccagatgatagaagaggtgtacatgaataataataaaatgtataattctcctgctctctctctctctctctctctctctctctctctctctctatatatatatatatatatatatatatatatatatatataaaattctaggaaattagatcaaaatatatacaattcatcgaggatacttgtaggcctctatggacaggtccacacttgataaaaaggatgcatgggtaaataaacttttctcaaagcattaaaagccacaaataaaatcatgggtaccacgaaagagcgggaaattaagaagagggagtggaaaatcaagttgtgcaaaccatgaaagaagaaaattaaggggaaaacccatacacattcaagacattaaaggaactatgggaaccagaaagaaatgttggatagtgacagaggcagctggcagcttttgataatgctgcaatcagcaatgggcccattgcattagagccctcataataaaaaaccattgtggtttaatcaactaatcactgttgatgaatttgttaatcccttgtgcatgctttacatcagagtatatcttctttaattaggtccaaaggtgtgttatcttctctggagcctctagctagagcaaaggagaatgcttcgttgccacgcaccaatctatactccctcttgtagtagataaagaatgatgttatctgtttttcaatgttgacaaaacatatctttgaacactatatattctactttttatatattcgaagagggacaataacataaaaaacacaatttattgatgacaaacttactctgtcacatcca

SEQ ID NO: 37284 - DNA, 1501 bp, Oryza sativa
atatatatatatatatatatatatatatattgtgttctgtttgaatttacacaaaagaaaggtgattctgtaaaaagccttagacaaagcaaacagaacggaagcttatcgtttgatattttgatgccacaatatgttgtgccaatagttatttagcagagcaagtggactatttgcacaaaccacaaagtgagatcaggtccactacagtgttaggctatgccctttcttttggaatctccatccagtggcaaaacatgactacactccgtccaaaaaaaaaaaggcaaactctggatttccgtgtccaactttgactgtccgttttatatgaaatttttttataatttgtatttttattgttgttagattataaaacatgattaatattttatgcgtgacttgtctttttatttttttcataactttttcaaataagacggacagtcgaacgttggacacagaaaccagggtttatcttttttttgggacggagggagtagtgactaagtgggagttcatggagggagatattttgcgtcacagagtactttagctttggaatttatgactcttttcttttttggagaactatttaggacacttcgaaaaattgatcaaattgatgacaaaagcctatttgtggggtctaaagcctgttgattcactcccaacatctaagcagtcacctgctttcaaaatcttgaaatctccacgaactgagcgtagatactggttattttttttggggggtggaacctgttcacctatgtattttacttagcactgatgatcatatttatgagtaataattcttttatttttatagggatgaatatatacgtgggtatataagtgtctacatacattgtttcgatttttttttaaaaaaatctcctacaaacggataggcggcatctaatttcttgtaaaaaatacaataacaagaaggtagacagtcagactacttgaagagactgagggcctcgtcttttcgcttatgcttatgcttatcagccaaaatttgaattttcaaccttaaatttggagctgattttgaggtttttttcatcgaaatttatttttcagccttttgcttttagatcgctaagaacacgtatataaaaattttattcacaaattactttttgtttggaaatatgttgtttcgcttattccgcgaataagcgaataaacgaataataaataatgcacaaagaaaccatccatcaattcatctacttagactccttcaattgtaccttcctctcccaggcttccaggaagaggccaaaaccagagttttcataggaaatatttgtcatttggttcagtggaatgagccatactttgaccacaatctccatcagaaattcataattcagacacatgtcaatttcagttccttggctgctacctgctagaaatttagaaattcagacacatgccagtttcggttccttggctgccaagacagccattcctctctgctgcatcatca

SEQ ID NO: 37285 - DNA, 1501 bp, Oryza sativa
acggtacatgaatccatcacataacaacatccagagattggtgatgcaacaaaaccgtcatatgaacactgatggtaggatagaatcacctgttgaccaagttcaacataatcaggcaattccctccacatccattgcaaagagtacagattcaggtagcccaggtggtgtttcatctataaaccagcggagacaagagtcatctcatgatccaactacagttccatcaacctcgcagttagctagctcgcctcaagatacctttgttggaaatgaaatgctgttgtcagtgtctagccaaggcatgttgcaaaggcaaatgtcaggtggcgtgcctatacatgggcatggtattggtgggcagaggcagcagctgcaatctcggcagcaacagcagcagaagcctgctgttcaaggcagtgtgtatgctcatccttcaaattcaggaccaggatgatgttgaaattaggctggtagcttttgcagaaaattcttacccctttgtaaagttactgtacaggtatgccttaatcctagtcctaacatattcccaaacgctggcttatgcatatggcaagattttacaccctccagtcataaatatttgacatttaggacaacataagtcaaacctaaaaaattccgaccattaataatttctcaaatacttagtttaaaaacaaaacgaatgatatacatagatctgcctcgaaaagtactgtcataatatcataaacttgttagattttacaaacttgctatggtataaaattgattgccataattttgaatgttttgaccgatactcattctacatcaaaatcaaatatttgtgactttagggattgcttatgcacactagggtcttgaagaactgcacgagtcattgtattaaaaaacatcaaccatctctcctgttttctgatctctggcatgttttcctttgctaggtgttcgtgctgtggaagcggcgcgggtagcggtttcttcatttccccaaactttgagctaattgtagtctcaatgccaggtagataattatttccgcgccattttggctccacctctcagcttggttagattctagattgctgagggagtggttcttgtaacggcaaatttcttttgttgtcaaaatgttaccccagtgtgggcccggttgtatattttgtccgcgaggtccacgttgttggcagccgtccttttgtataagcctgtatatttatctcacgagttggtgaatgcaaaagccattgttcacgtaaaacaactcacaaactgtttaatcttgcagcatccccaacagtcatattcttcaaggatgtgccatcaattggggatgatcgcaaatgtaagaaatggctgcaaattaagggaatggtttacatgtttgtgcttgtccctaactttccagattttgctgccatgataatctcttcttgcacatgcacaaacttaggtgaccacttttaactggtgttccatttattattattccatt

SEQ ID NO: 37286 - DNA, 220 bp, Oryza sativa
catggctatacgaatagttaaactctgatcagaggtgtacaaccgtacccacaagacacaggcccacgacacgtttctgtgcaccgacataccaacacgacataccggaaagaggccgtgacaggacccttcacataaccccctctaaccaatcgcaccacacctcaggtttcacccccactcctcgcaagggagcggacagtcccctctcatgccacgg

SEQ ID NO: 37287 - DNA, 1501 bp, Oryza sativa
tccaatgcagatgcttcgggtaaacatttccttccattctgtgttatgatatatatctttcatcatgtcttgtgctctccattggctggtgtgtgtgctagaggcatagaatatcgtgtattccgcctaccttctgttctaatcatatggatgataacatagtttcaaaaccagtcctaagtagttataatatgtactgattgactgaacatatatgaacttcattcaagctactggcttgtatgtgttgtgggcaagcaaacttagctgctgtgaaaatcggtgatactggtcaatttgcggggttcctctatctaactggcaatttaatattctaatgttattctattaactagcagtgcatgtgtgctgctgcaatggttttcagattagtaagtatcacatactctgatcttataaaatgcaaaagtatttatcttaattttccaattaaacaatcatatcaacaggctatatctacacgtatgcatgtgtagtggacgcaattatttatttattttaggaagtcctacaatacatcaatacgacacacttgcctacattgatttatcataaaatatcaccatagagtatgcaccgcatccattaccaacttctctctttaagcggtagattctattcagatctgatgtatatgttattttaaactttcatatctgaccaaactgctcgtacaacaagcagaaacatttgccatgcagtccattgcttatacatgctttgtgggaagactggatggaacctggaaatttgagtccttcctgctgcgaatttatataattattcaagtattattttcaaactctaggcccaaaattcacttaatactcaggtcccacttaggatgggcctatgcacaaacctggttaatcattagtgtcgcacattcttcattggctaggcctactgaaagctaaaatactgtagccaactccctcagttttctggttagaaatatcaatcgctggatggttagcaggtgatagttttaaagtatcatattacaaatctgaaagaatcatagctagagcacgcatgttgcttttttgtgatgttattacatcccatagttaatgatgcatgcatcgatctatccattttttagctcatggacatacttacgatatccaaagcttaatttaatcagtaaaaagctagaagctgtccttttttgctgttatgtggttgctgatgctatgcattctttgatgtagcctggccagaacatggaagaacataggcagatgatgcagggagtttcagatgcaagtatcgcagggaaataaccagtccattcatttcagtggtactccattttccaatgtcggagcatcttcacctggtcaaccttttccagttcagtcatcccaaccacatcagatgccacaacaatcacacgtgcttggaaatacacatcacccccatattcaaggaacaacccagtcaagcccacagcagcaggcttatgctatgcgcttgg

SEQ ID NO: 37288 - DNA, 1501 bp, Oryza sativa
agtggagcctcaggtggtgagaggggttctatttcactagagagaagttaataaagagtggtgctgcatgactaagattctcacatcactattgtgcttgtatatatgcaatcattcatggctacatcaatatatgcatcatgcatgcatgtataccatatatgtatgtatttgcaacttgctagggaatatagaactttagacacctagattttggaccacatatatacactttgacgaatacattatacatacaagcctagctacttggaacatagatattttgcaagaagcaatgcaatattacatgatacttcttttagagagagagagagatagatagatagattttgtgtaatttgggaacacaaaatagtcagtaaaacttgggaagttagtcaatatattctgtcatttcaattggagtcagtgaaattagaggaatctccaaattgataattgtttccaaggtataaatgtagcaggatctaaattgggtcttacaaaggaaaatgagaaatgttatagtacttatgaaagaaggtaacatatggtatcatcttttctaatataaatttggttcattatgatatacaaggtcctggaaggcttcaaattttatgatgcctctcaaatattgtaaaatcactcaaagaaaataactgaaaccataagagtttactattatatgcacaagattaatgtagtgcagttttcttccatgtaatcgacaaaataagtagtgcatgcagtttggtgtgtcatcagcatggagtagggaccgcctcatcaaacatggcctgagttaggatcaaaagtgtcatacaatgagcaagctagagtgcaatttgataatttattctactaccaaaaagaggccaagaactagttaaacataacaattactcaattaggtcttaagataatgctggatgtctcattgtgatggttgcttgttgatcaatgactagatgcggcctcagaagccgacgcaggcagatgagaggtgaacatttttttctgtgattttggtgatgagatttcgtgtgcaaaagtgataagtgctgagcacaatagaatttggccatctggctgcaccattcggcgattccttgcatttgatgctttataaattttgcaacttgcgttactgaagaggcaccaggtgacagattcaggaaacttgcaaattctcgcatgaattaaactgttaatttaacctttcaaaaattcaccagtctccagtggcagattcagggaattaaacatattaattgtgtcgagtgatactatgattggcattattttaggtcaaattagcaaagtatatgtttaatttagcctaacattcaattttattttttcttcagaaggttattttttttaaaaaaaaacgcttgatagttatacaactgcactaattggttgtagcttcgttgaagtaaaggccagaatatccattttattaaaaaaaagatgacgtcacatgtgtatgagctcc

SEQ ID NO: 37289 - DNA, 1501 bp, Oryza sativa
gcttgggagcgtaacaccctgcttttatgttcttgcttagttacttagtttacataatgttcttcaagcttttttgtgaccactagaggggagtctctctttatcttaggttttgaaccactttttggaggcattagtcctccttttattaaggtaaggggataccatagtgcctggacacacacctacgtacaggagccggtaaccttggtcttgcattggcccttctggagggccctgtttgatgtgaacacctactcccttctgacgcatggcacgtgatggaggagggtgtcctgggtgtcatagggcccaactgtcaagcactgagactaggtagaagaccataaactagcggaccaggacaggcagcatggtataaagccgtgccacctggcaacccgttcatcacccttttttaggggcgacatgggcaagtggaagatcatacgccctattccgttgtacacgatggcccacgattctccacaggaaccacgtcattccaccattaatgtcggatgacatgataaggccagtcacaatggctagtgtcattgcacggctacccaaaatattataccatcttctctcaaatgaaatcttttatgaaacaatccccacagtggaggggtttcactttgacgtttccaagactaagcaaagcatttaattgatacaagttgctgggatcatttgtacccaaaatccggcgcggcgcgggagaatgcggaggtcgcacggcggaggcggacgcaagagatccggtgaatgaaacgaatcggcctcaacgggggtttcactctgttaccgaggacttggaaacgacgctgacgagtttcaccaggatgaaactctttccttctctctcatccccatttcatgcaaataatcattttttattcagtcttacccctattaaatgtgcatgacacaccagtgaaacccccattgtgactggcctaatagagcacatgcggccgggtcatatccccttaattgtggtggcgtggctgagaaaggcttctagccccaaggccgacctcaaggccctggcccattgactggcagtcaaagcacgctcgagttggcactgttcttgaggcacccttcctacatcggggcaacctctgagccagcacacgtggacgaccttccttcagaccttgaggcaatcggtggtcgcttcgtggcgggcctcatcatagcggtggcgggccctcatgtgcccaaataaccgaggacgggggactttggttcccacttctctggcagcacattttgccaaaacatatactccgatatcaatacaaacacactacgcacacacgtacctatatttgaaacatgagaaaacagaaagagaactccaggcaggacacatgataatgattcataaagccaaccatgtttattggatcaatttatacgcggaaagcgataagaggttccatgagattaatctaaccatatgcaataatcctgtcatcaaccgtcgata

SEQ ID NO: 37290 - DNA, 1501 bp, Oryza sativa
gagcaggggttccgcacagcaatttggcagtgagtgacacccactaggttggccacatccttgatccattggccccccaggagtgccactgccggcccgatgtggcggatgacgaaggagtgccttcgctgcaaggagcacaccccagtgtggtagaatcaaagttgaggtagcactacaccgaaatgcgttgtgtcctttcacttgggacgatggaagcggtcgtcgccgagctagttgggcactccctagccccttggcgagcgagaggaccgtcaccgctcgtgcaatgaggtgatgatgatggttggtctgtcgagggcacacaacgcgtctcgacgaagaatgcgacaggcaagacggagtttgggcgacactgaaaggctcgctagccgcttccttatccctggcttcaccctcataatcgacatgacgatgccctccaaccatggcatccctttggccctttggcgataatggaggatgtgagaacgcaagctcaaacatgttcatcccaacctggcgcactagttgttgaagcacgagctcctctagcaggaaggaaagataccccccctcttgagatttggttagggtgcaagtgttcgaggttggatgtgaatcgcatgtacaagcaatggacaagtgatattgacaggtttaggtcgcttgggagcgtaacaccctgcttttatgttcttgcttagttacttagtttacataatgttcttcaagcttttttgtgaccactagaggggagtctctctttatcttaggttttgaaccactttttggaggcattagtcctccttttattaaggtaaggggataccatagtgcctggacacacacctacgtacaggagccggtaaccttggtcttgcattggcccttctggagggccctgtttgatgtgaacacctactcccttctgacgcatggcacgtgatggaggagggtgtcctgggtgtcatagggcccaactgtcaagcactgagactaggtagaagaccataaactagcggaccaggacaggcagcatggtataaagccgtgccacctggcaacccgttcatcacccttttttaggggcgacatgggcaagtggaagatcatacgccctattccgttgtacacgatggcccacgattctccacaggaaccacgtcattccaccattaatgtcggatgacatgataaggccagtcacaatggctagtgtcattgcacggctacccaaaatattataccatcttctctcaaatgaaatcttttatgaaacaatccccacagtggaggggtttcactttgacgtttccaagactaagcaaagcatttaattgatacaagttgctgggatcatttgtacccaaaatccggcgcggcgcgggagaatgcggaggtcgcacggcggaggcggacgcaagagatccggtgaatgaaacgaatcggcctcaacgggggtttcactctgttaccgaggacttggaaacgacgctga

SEQ ID NO: 37291 - DNA, 474 bp, Oryza sativa
gcctgaaaaatttgcaaattgagctcaaacactccgtgtatagttcttcaaattgatttgcgctggcacgtaagatgtttatattccccagcccgcttccgtcgttcatttgacgtattccttgctcccgcctccgacgccaccgtacatcgcacggttgttgatgtaccggatgcatgaatggcttggtcgctctccctctctccatttcaacccaactgcgtgaactaaacttaatttgagcgcgtcagatatcaagctcctacttgatatcgagccggttagcggcaaggcgttggcgtggtggccgcgcgttgaaggtgtacagttagtggtggccactgttttcagaatgcaacggcaacacgagaaggcagattacaggcacaagtccaaccttgttgggccagcaacggcgatgcctacatacactgctttcccattggggcgtttttacgtgaactttctcaacca

SEQ ID NO: 37292 - DNA, 1501 bp, Oryza sativa
cgaggggctcttgtctacattccaaatagaatacctagtgatagatttcgtcacgatcatgcttttactaccggtaataagaatgtcggcctggggttcgatccactgatgcaggggcatgtcatttctatcagtgaagaaacttcaaaaccttgtcgttacaacataacatgctcgctttttacctgtaaatcgcgtcacacgtgtgattttttacagcccgcctctgcctgtgaatgacatgcctccggcttacttggctggatttctgtactggatgagtgagccaaggttgagccagagtaagacaagcgccattctctcgttcgagatcgcgaccaagacatttgttgtcatccagtgcccttcgtgtgctctaacaagacacaacagaagcccttgcgaatcatttgtggtagagcttgaaggaatgctttgcgttgttctcgctaatccgtttgaagaggaattggatatttggaagatggagcatggtcaatgggatagagcatacagagtgtgtctgaaaggttggcctggttattcccttggagctaatgtcgtggttccgatggctgttgatccgaaggatggaaggattctgctcaacacagggagtaaattgggtctctatgatccaacgaagcgggttatcgaaaacctgtatgatcttgatgaggtgctgcgtgtcaaacagacagatgagacgctgcatgtcgaagataaagaaaaatcttagcagatccaagtccatgatggttcccagttaaaatgtcagcattctgtcaggaagtttcgcatatggctgtcacctctagaacatgacaggttctcttatgatgcgcctgcacccgcttcatctaggaagaattctgcttgctccaatgacactgagattatgccctttgttcctattttgtatgaggatagtcttgcgggttatcgccttgacatcaaaccaaggtgcttatttcgataagccatcacacgttcggtgccagagagtcttgttagccatagtcttaaagttcgatggcgctggtacggctggtttctttatcgatagagttttctgcggagcagcgactcgcggcctgacgctccggaagaaagcatctggattttctttgaagttttccggcaagttgaaaccagtcatgcactaccctgttttcacaaaaaaaagtgaaaacaaccaatgttagcatgcaaaggaaaatgattatacagaggtaaatataaagtattattgcaggtaatctctattatgaatcttccctggcaacggcgccagaaatgcttgttggtatttcttaacgtcattactagaaatataattcccagcaatagcgcagaaatacttctgttattttatggttacagagttcatccgcaagcgcacggatataccattgtagcatttcacccgagagtattccaagggtatcgtatttattttatcccgtgggaagatcatgtagagagaacttgactaataatt

SEQ ID NO: 37293 - DNA, 1501 bp, Oryza sativa
tggcataatagggtttcatttgcaaaagcagcatttagcaaacatttgagaatttaataaaacagttaagtaattaaacaatattaatccaacgctatacaacataccctgttgcataggcccaaccattctgaacaaccatcccggctgcacagttctatctccaaaccaggaatataccattccaaaccaggagctaatcaaattttaccagttatagcatcttctattatggtgagaagggtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtacctcggaaaggagttgtgacaataccccttgcacaacacaatccactacagcgcacctttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacggttaatgtttcacaaccgaaactcgtgaaccggtccttaattgtcatgagcacgaccatcaaaaccatgtgctcacaacccaccattaccaggttttagttggcacattaattaattaactaatcacgattgaccatcgtgaactatcattaagccatcattaaataaagtgagtcataagttatcccaatagtgagctaatgtttctaagcagggctaagcaattatatctaatatctagttgaaccaatacataaagctcaactagtcaagttataataacccaaggtatcaaggaataaagtaatcaagaacaaaagggctataacaaacaataggttaattccacccaatggcattcgaaaataaatgcaatagttgaatagaaacaatagctttaaataggatcaacatgctcaaagggttgtttgggatctgtgtgacttgccttgctggccttggaactcttcaaattcttctccggcgaaaacggactctccggaaacgacggaatctaagcagaaaagaacaaaatcaccaaaacagcacataaacaagcatgaacagtacatgtggatatttttaatgtgtagatctcaattttagaaaaatttagagacttgaaccaactaaatcggagctaagatgaattagttatgaatttttaaagattaaatcggattaaaacacttaaatcggtttaaattgaattatgacgcaataatgaattatttttgaaaaggaaaagaaggtttattgcgtcagcgggctagggtttgcggtggaccgggcgcacgggcggcggttcacgcgaacggacggccgagattcgatccaatccaaacggacggccgagatcgatcgggtccacggcggctcacggcggacgaccccga

SEQ ID NO: 37294 - DNA, 1501 bp, Oryza sativa
atagtagggtttcatttgcaaaagcagcatttagcaaacatttcagaatttaataaaacagttaagtaataattaaacaatattaatccaacgctatacaacataccctgttgtataggcccatccattctgaacaaccatcccggctgcacagttctatctccaaaccaggaatgtaccattccaaaccaggagctaatcaaattattaccaattatagcatcaaattattgtgagaggtgtgagactaatcacgaaagacattgttagacccgtccataaccgcgggcacggctattcgaatagttttactctgattagaggtgtactactgtacccacaagacacagccccacatcatgtcaccatgtgcctcaataccaccacggtacctcggaaaggagctgtgacaataccccttgcataacacaattccaccgcagcgcacctttcgtggatcataatcaccaccttataaacaaggcatggactccccagcgacccccgtgggcttatctccgccacttctcagtctggtgccccgcaatgaaccatgctatacaaaagataaagccgttgcccatgctggcttgtggttggcacggttaatgtttcacaaccgaaactcgtgaaccggtccttaattgtcatgagcacgaccatcaaaaccatgtgctcacaacccaccattaccaggttttagttggcatattaattaattaaccaatcacgattgtccatcgtgaactatcattaagccatcattaaataatagtgagtcataagttatcccaatagtgaactaatgtttctaagtagggctaagctattatatctaatatctagttgaaccaatatatataaagttcaactagtcaaattataataacccaaggtatcaaggaataaaggaaccaataacaaaaagggctatatcaaacaataggttaaatccacccaatgacattcgaaaataaatgcaatagttgaaaagaaacaatagctttaaacgggatcaacatgctcaaagggttgtttgggatctgtgtgacttgccttgctggccttggaactcttcaaactcttctccggcgaaaacggactctccggaaacgacggaatctaagcagaaaagagcaaaatcaccaaaacagcacataaataagcatgaacagtacatgtggatatttttaatatgtagatctcaattttagaaaaatttagagacttgaaccaactaaatcggagctaagatgaattagttatgaatttttgaagatttaatcagattaaaacacttatattgattttaattgaattatgacgcaataatgaattatttttgaaaaggaaaaagggatttattgcgtcagcaggctagggtttcggtggaccgggcgcacggcggcagttcacgcgaacggacggccgagatcgatccatccaaaacagacggccgagatcgatcggtctacgaccggctcacgggagagggcgacga

SEQ ID NO: 37295 - DNA, 178 bp, Oryza sativa
cttgcataactcactcattttaactcggattcgaatgaaacttgaacctaaatttatctaaaatcaagatctaactgttggtaccactttctcgatttaatttgtaatttttgaatttttggtgattttatttgaattctaattgaattcaaatcaaatctttcgcacgtaaatttag

SEQ ID NO: 37296 - DNA, 1501 bp, Oryza sativa
tcgcattgccatctcgtcgcccctagctgagaccgttggataatgcgatgtttcttccccagctagtactccctcttctgaaaccctatcggctatcgcataggcaatcatgcccgatcgatgcattgaacccgaatcataggtggaggaaagcttagccgcgtcaacctccctaaacctaggccgtagacagccatcgagcgcgcctgtcgtcgaccttatcctccatgccattatggcttatccccaagccaaacccccataaaaaaaaacccatccctctctaccttcttcctcaaatacatttcatcgaacaccttaggtgcatgcgtagccgaagccggcgtagctgaccgcgggaaccgtggctcgggccgcctctgttgctgctgatgccttcgatcaacgccgggtgccgctggagcccgaggacctgctgtcgaacgcctgtgcgctcgccgccgtcggcatcctctgcttccttaccgcctccccaccgcgacgccgcgtttcgccgactcgccatcccaccttagcgtcctctaccctaatattagcacccatggccgtgccggcccggctgctgttccgccgccggcgatgtccccgtggacatgctatcccggaggcttccccttccatcttgttagaaaaacggaaccaccatacactgtagaagcttgcgcacccatctatttgggtggaacctagccctaccgccctgtccccttgcaccccggagctcggccatggcggccatgccgcgccgctcgcccccgcgccgtactgcaccgttgttgccggcgggaggtcgctggagattcgcctcatcctccccggctgctgctgtgccggcctcgcaccgtcccggcatgcgcgctaggcgcatggcgcggctgcctctgcctggcgagaggtagaagacgacgggaaaaagaaagggacgagagagagaaaccgtgtggggcccacatctagtttgcgcacagtaatcctccacctaatggtgattaacccactcaatgacatgtggggtccctattattaaaatctaagtaaacttaattatagattttgttacaatgacaggcgggacccaccggagattatatggccggcttaaccacagtcaaaaaggggccggacccacctgtcaatagcacatctcatttcctttgaaagaataagataaagaaaaggaaataagaatggacccacctgtcagtcactaccacatacggttaatgctggaataaaaataaatcaattatgaatagtaacatttcacaattattggaattaattcaaatttgaatctttaaacttgcataactcactcattttaactcggattcgaatgaaacttgaacctaaatttatctaaaatcaagatctaactgttggtaccactttctcgatttaatttgtaatttttgaatttttggtgattttatttgaattctaattgaattcaaatcaaatctttcgcacgtaaatttag

SEQ ID NO: 37297 - DNA, 407 bp, Oryza sativa
ccaacggcaatgaactttgaaaccacctaatgaagtgaaccactgcctccctgatgagttctcagttactctctcagtatatgttatatatacagatgaagctacacacatgttgcatgcaatttaactgcaatgtagttatatatgtgcatgagtaacctatactcccatgtcctgacgtgtagttttctagtacaaagtacagaatcactgcctgcactacgccggaccaggtcatctctgacgggcccaaaccctcacttttgatgggtttggtcttggtcagtgattagtggtcactgatgacaaaatcacctgtgacggatgaaacacccgtcacagataacccatctctgaccggtatataactcatctctgacgggttaaaacttgtcacccgtcacaga

SEQ ID NO: 37298 - DNA, 1501 bp, Oryza sativa
taatatttggtgaatgtatccccatcgtatgggtgtgatctatgaaacataaggtttaagacaagagagaatctattctataccacttagtgtgttcgagttcaatgatttactatagacattgtctctttttataatatatcaacgacttttattaattgttctacagtacaccattggctgaaacttctattcaaaaatacccaaaatacccttagagacatacaagattaacaattgatttatctcatcagaagttttaaaaaaatatgaaaatttttatgtggcctctttacacaatttggaagtttgtatacaagtttcaagctttttcaagtatatttagtttttagaaaaaaaacatttttaagtggtatatgagggagaatttgcttatacaagaggtaatagcataaaaatatcttatatagtgaatgaaagatgatttatattgaaaacaacaataaaaaagtattttatatagcatataacaaacaagttatattttgttaaaaaaataaaaatttagtaaaaaacttgaaacttctatataaatttccacgttgtgtaagaaagccacataaaaattttcatatttttttaaacttataatgagataaatcaattgttaaccttgtatgtccataagggtattttgagtatttttgaaaagaagacccaacataatggcgtattgtagaataattgataaagtcaccggtatattatagaaagcaacaatgtcgatggtaaattattgaactcgaagaaactcaatggtataaaatagattctttaagagacaatccatacacttatatagtcagttaaacattatttatggcagtgttatggtaaccaaacgtacgaagagtaatatctttactattataaaaaataaatatgtttttgtcagtactttgttacgtcatccgtatataagtcgattttgaagttcgttcgtttttggaaatatatatctgtatttgagtttgttcgcttttgaaaataaagagggagtcatataaggaatattttaaaaaaacctgcatgctaacttggaatgatcggactcctaattatagctcatgatttttttacaaaaatatatatatccaagcgaattctcacaataaaactattataaaaactgaggatgtttttactgctactttggtacgtcatccatatatgagtcggtttttaaattcgttcgcttttgaaaatacagatctgtattttggtcgggttctaaattcgttcacttttgaaaatacaggagcaattgtataagaaatctctttaaaaaaaacttacatgctgatgattagactcctaattgtagctcatgattttctagaaaaaaaatatatctaagcaaattctcacagtgaatctcaccttcactaaaccatataacaatagtcttcccccgttgcaatatatgagtattttttctagtaatatagaatattacgattattgcaccaggctcttaaga

SEQ ID NO: 37299 - DNA, 1501 bp, Oryza sativa
gattatgagggtgaagccagggataaggaagcggctagcgagcctttcagtgtcgcccaaactccgtcttgcctgtcgcattcttcgtcgagacgcgttgtgtgccctcgacagaccaaccatcatcatcacctcattgcacgagcggtgacggtcctctcgctcgccaaggggctagggagtgcccaactagctcggcgacgaccgcttccatcgtcccaagtgaaaggacacaacgcatttcggtgtagtgctacctcaactttgattctaccacactggggtgtgctccttgcagcgaaggcactccttcgtcatccgccacatcgggccggcagtggcactcctggggggccaatggatcaaggatgtggccaacctagtgggtgtcactcactgccaaattgctgtgcggaacccctgctccggctccatgtcgacgtcccatgtggcgccgagagttgcacagtcgcccattctatcaaaattaatttatgagaagacataaatccaaatcaagaaattcatgctgaataaaaatccaatggatagagtataaaaatacacaatatcaccgatttggatggcgacgtcatttctatctaaatccaatctgcaagatatcaaaacatcaatgagtacaaatccaaatgccaagactaatgtaggatagaacatatataaattagaataaatttagaaacataccgattattcattactaggatagcatggcgtctatgcctctatataaacaccagcaaagaaccatatatataatgccaatgagcaagacgaaggagagaaaaggtaaagagaaattcagaaatactcgatcgatttgcagcctcctgtcatggcacctgtcaagatcaacaagtttatcactgctactttcttcatggttcttgtgatcatgtcttgcgccctcacatccacacttgcttgtcgtaagttgctagtctatccgttccaaaacataactatcttgctaatttaaactgaaaatgtagctaatttaaactagaaagttaactatattttgagagatggggtactctttactcttctatgtttttaattgttttctcgatcacataaaagatgcaaaacacaccaccactagatgtgcacacatataatatcatctctttactagcgagagataaatctgcaaacccttatagaatacttatttaattaatggggttgctattgttatgtgcagagggtgggacggagtgcaccgttgaaacgccacactgcacgatggattcgtgcaatgcaaaatgcaaggcagaggccaccagccgcaagtgcaacagtctgactgttagttgccacaaatatgctacacttgagaagtgttgctgcacttttcatgcaaattaatatcaacaatgacatcaacatagtaaaatagtactagtggttgatgataggattattgccgatgtttagattaatctcatgtaaccccttatctatctttattgcttcc

SEQ ID NO: 37300 - DNA, 1501 bp, Oryza sativa
gacggaaacgttagaatacgacttctccgtgacagctcagcagctcattctccctcttctggtaggattccccgtcagcatgtgggccccaccgcacgccggtgcgccacgtcagcggatgacagttgcaactgacataactgcccccacctgccgtcttctcctccccccccggcccgtcctctccacggtgggccccacgtcgggacagggtcaaagtcccgctctccctcgtgtgtgatctgacggaaatgccccctggtgtttctcgaaggagtaggggtagtaccgtaattttccgtggacgctgtcttggtctggggaacgtgggctgctcgccgtcgcagactcgcgccggggtcagccagggtgggacccacctgtcagagtcccgcgttcccagcgcgtcgcggccgcgtggggtccctctcttccccccgttagccatttgttcccattcggttttgggcttttggctaatgcgtgattagtcagactaattcgtgattagtgtgtgtattatgtagctgatgttaccattagtgtttttggatctaagcgtgcaattaatctctgtgccttgctttgtagagcaaaaatgcaactctttgagaagccttacacattaatgttctttgtctaattattgactagaggaatatggttttttttccctcaacgattgcaagacttactacttcaaaaagaataaaacagttgcgggtttaggattttctattccaatctgttagagaattggatagcaaaagtggtatttggagtaatcagatgatcagctacaaagcaccacacttgtaccttacatggctcatgtgtaattgatctgtttgatgggctactataattagtagcagaaaatgcaatgtacttttatatgaaagatttcttcaatcctttcctcaattggtccattgggaatcctcatggccctttagcagttgggacaaacccacaaacccataataatggaaacatgtcaattgtcaaagctcacaactactaatcacatcccccacaaaaagcaaaagcatcattaatcataacaaagaaaaaacctccaataagttgagagcaactaactagtgacaagtactaattaattacccacatctcccaaggacccaaatgcaaaacaactcaacccctccacacacacacacagaaaaacgtgtaccaaaaaaacattccaaaaccaaaaataattatcagcctataaatttattattatttatgtcctccacacacacacaccacccaaaatcatccgattaattaatttgatttaatgtaatgtaattagggtggtaatctaaaattaatcacccctccccctcctaatctcacgccctcatataaaactccccacccgctgttgcttccgcatcacccattccctttttcctttcttgcgccatttcccaccgccgccgccgccgcccgcgcgcgcgcgagatctcgccggcgatctcgccggaggcga

SEQ ID NO: 37301 - DNA, 1501 bp, Oryza sativa
tttacttttctgaaacggcacattttgtggttcgtttttcggcgcccatgtttggtacgcgagaatcctttctccgtgttctccacatgattcgagtagcgcaggacttgttcagattgatgttatttcaaatcataccattatttagtaaaattgttaattatatagttatatttagtttgttaccaaattttggtaatgtctatgaaattttgacaatattatattgagcaaatcctattaaacttgataatgttgtcaatttaccaaaaagttaatattatcaaaatttggaaagattcatcctgtcatcaatcggacgctgaattttcccgttcaaagtccctagtgacagtgacactacaccagggaaaaaaaaaggtacggcgtacacgcactattctcatctattgggtggcaggatttttcatcgttttcttttctttttgatcgaaactcgaaagattggtaccgtactgtaagctccaagtaccagcgcgaaaattcttttcttttgtttattccgtgtccgtcttcgttctcatctcatcttctcatcttctcttgtctggacgacgagagatgtgtcgctgtcaggctgcaaaaatacgcacatgccaatcatgctgtcacctcgtcccctggggcccacccgtactaaaaataaagcgaaggcgtatttgtaaaacccgcttccacgcggaggaaacgggtttcgcgcgcgcgtgctcgttacgacggcgctttccgggaacgcgcttgatggcgccaggggagccactgacgagtggggccgaggagcgcgcgccctaatacacccacctgctgtaccccgtccagctacggccataatcgcctgtccactcgctaggctccacgtgtcagatactggtccatggcccactgacacgtgggctccactgtggcgggattccaccggggcccacatgtcagtgagtgcggcgggctattaaaatccacccccgtgacgtctccttgctttctcaccagctcccccccaccgccggccaccgcgcgcttccctcccaactccgccgcctccgatcccgaccgccgccgccgccgccgccggtgagctgggccccacgtgacagcctccgcgtggcctgctcctgccgcctctggcttgggcttccactggccgccgccgcagccgcagccgcagccgtcgcctcccgatctgcgaattttgccaaccccactgaggagtgggggccactcctccgccgctgaagcgaagggtctacgcgttggcatctagccgccgccgccgccgtcgccgccgtcgtctggagtagggggtttggagattctagagactagagttggaggaagaggcgagaggcgagaggggatcgaggcagggatgcgcggatcggggcgggcgaggcggcgcggggacgtcgcgccatgttcggccgcatgaggtgcctcgtcggcggcggcgtcgaggacagcccgcgcggggcggtcaggaggg

SEQ ID NO: 37302 - DNA, 1501 bp, Oryza sativa
tttggcttagaaatcatttatatattatgaattaataataccatttggatcattttagttgaaaacttacccattaagagtctaactaaaagaagaattacaagtccgtatattacattggttatattataaagctgggttttttccttgaacaaataaaacaaacattgtggttttcactcgctttagttataaaggccactctagcttattaacgttttttgatgagacaaatttgtagtttaaatagacttttgacatttcttggaaaaaagatttttgacttttatattggagctaaaattgtatgaaactcccaagaacaatcaaagagctcaagccaaatagactaagaaaaaaaaagatattcaattagctttgacatcatggacggctatattatccatccattatatgatgtcagcaattaccaagcctaacacatagtagtttatattatctaattaaattattagaaaaagagagatcaataaatttcgtggacaacaaagagatcaatagcaatagatatgagtataacattgctatttgccatgtcacccgttgatagcacgttcactgtaaatttatcgtgcgcatataaccacacccctcagccctctctctcgtctcgtcagttcgtcttcctcccctcaagcctcaaccccttcccctaccaggcgcggctgccggcgattgcttgatccctccgcctccctgcctcgccgccgcgcgccacctcgccgtcgaatcgaaggtacggtactctcctctcctcccccatccttccccttcctcgtgctgccgacctcgccgtggagttgagatccatctcgagccggggactgctgccgattgctcttgactttgctgctcggattgcgaggattttttttcgggggggtttgatttgatatcggggaatcgaatccaagcctccatctccgtatagcggcaagcgtaactggcactgcgccctagtcgatctccccctttgcgacgagttcggcccctccgcctgcgcccaccaactccgatctcgtccggcgagcagcgtcgccggcgtccgttcgtctgtcgcatcctcgccggtgggacgacacgtcctctttactcgtccactacccgcatcctttttctcgtagacttaatcctagcttcttttttggatccggaggcttttctctttgccttattaaccttagtagtactactagctgcaggttaggtttgtttccaaaaaaagtttggctgaacccccatgccccacgttaggttcggccctgattgggggtaccttgtgtaaaatgatggcaggattatttctaccttaatattttgaattttatcagcatgtgaactatacaggctgaatttttcaatagctgaatatttgcagcttggcttgatatatattcatctatagtaaaattgaagttctatgccactgatttgtaggctataagctgctccggttttagataaattaggcatctttcaa

SEQ ID NO: 37303 - DNA, 610 bp, Oryza sativa
ttcctgcagccccacgggaacaccagtctgcgctgcgtgcgatggagagctgcatatgccgggatggtggatggatctgtctcgtcaccattagagcatatataatagcagactattagccagatataaacatattttaataagataagtgatcgcgggctatagatatgtagccagctgcagcacgaacttcaagacacaatatatgtaatatgtgagaccatatattaataatatattaaataattattgtacgaattagctattaaattggttatagatgaattaaagctagtagtgaactatactattatactattaaacttgctcttacggccgtggttacaccgacccgacagccgcttacatgagcccataaaatacggctttttcaaaaccccctcgcttcccaactttttaaaaactcttcagacactgtgcgggagctcacgctactgtacggccccctgcgctgcgccccccctcgtcgcgcacacgcacacacgcactcgcactactcgaaccacgcgaacccctctctttctctctctctctctctctcgcttaaatgccacaaacctaatcatttccacccctcttgcgctctctc

SEQ ID NO: 37304 - DNA, 426 bp, Oryza sativa
tttttttgtcatattacatttgtagctatgttttgcacgcttttttgtctccaaaattttgttgtaagttgatgagggagaaaatttgtgtggggaagaaagaatatatagaaatttagttgatttgctaaagaaggttttataaaatagttgagaaggaaaactattgtgaaagttaatcttgaatactagaaaaaaaaactaaaatgaaaattaaaagaagtaaaacacattaaaattagtttaaaactttagaaatagtaaataagaattatttggtgtaatattttatgatttttgtatgaataaagatatgtcattattgtatgactgttgaaacagtttgtaattatcttataattattgtatgactatcattattgtaagaataattatttttgtacgattttttttgactcatgtaga

SEQ ID NO: 37305 - DNA, 1501 bp, Oryza sativa
ttagcctgaggtgtcattctgaaagggaggtgttgatggaaatgctgtcaaatatgaatatgtttttattgttcttgacagatttagtactggtgttgaggtacatgtcatgtgatccatgttcaatcttggaaagggtacatgtcatgtgatctatgttcaatcttgtaaaaatctgtcttttcatgaataggaagaaacctgaacaagaaagagatgacaattttttttttcagttttgtgaattcaattgagtcttttatgttgtggagcatgaaaatttgtggagtattggagattatcatccagttctgtcaccaaggtgtaggtggctagcattagtttgattgtttctacagccatgtgatcctgtcctgtttttttaagacaaacctgttcaattagttagttagctgtccatttctccacttttatactcttacctgtttcgaagcatgtcttgccataccggtaatagtcctctagatagtcaatgccatgaaaatcacagcggcaaaactgttcctgctttgaaggcatcactaaactgggaggaatgtcttcatcttcaagcaaaaggttgtggatttcagctgaattagtactgcagcaaaacggtatcaattgggttgcgcaattcttcgttccagttatatcttctgaaaatctattttctgcaatgtttagactacttgatggtctccgtctctttgagcgtgtgttaaagactcgcacctacaagtgcgtgcgtatgttgtgcttttgtggtggtgcattttgtgtggggtcttccatgtgattaattttttttagaaaaatgaatggtattttcagaagcttctgttttgtttgagcatgcatgacaattcagcagccacagatccctgtggtcacacagcattgtgggtgctgttatacctgtgacacagagttgttgataactgatacctactgcttatgctgagaacctgtctgtctccaatgtggtggtaggctcctcctccagttgttgctgcaataacagcaacagatcacactgaaactcccctatcagcaacaggaggaagaagaagaagatgcttcaaggaggtctcccccctgtcttcgtcggcggcgatggtcccggctcaccggcggtgtcacgtcgctggaggtcggcacggcgactcggctcatccatggtgtgaccttgaaaggccttgacccagtagtggtagtggtggtgatggagatggaaatggcagctgagctgagctgatgattcaacggtccaactgaattgttccacacgttggtcatcaggacagggttcagacgtgcagccaacacggcagcatgtcttgcccacaagggacattgcccatgagagggacaggataggatcatacagctttcaagtttgtgcataataagtgcatccagcaattgacctggtaccaggaaaaaaaaaagagtgatttcactcgttcactcatcaacttgatgtttggaacttggaagg

SEQ ID NO: 37306 - DNA, 220 bp, Oryza sativa
tcctgcagccccacaaatttggtaaaccagagagcatcagttagatagcatgcacatggatctcacctctaaacctaagaacatttacaattcctgaaacaaatgaagaaaaatgtttctcgccttaagtggagatgatcagcgacatacttgtcccatactttacccagcttctacgctgaaatgcttcaagttatttaacccaaaaaaactatgagca

SEQ ID NO: 37307 - DNA, 1501 bp, Oryza sativa
ctacagaagatagcagcattagtattgatgacttaaaatccaaatttcataatatgaaattatgaatgcgaactcgacaatgtgcactgtatcgaaagcactatatatagggttacaaagtatctgctcacccatctccagcgttggggcatatatcagctcaaatttcaatataacagatgaagctgctgggcccttaaataaataaagcagatccgctgattaggcaacagcaaaattgattgagaaaggaaagggggtattaaagtgcccaacctcttcttcactgttgaatatgttaaaagacaccataactgatagataaatgtcttgtctagcatatttgattcgaaatggctgcgtgtagaagctgttatcggcatcatctattttccaaatgcccaatgcatcgtccgcaccaacatcagaagctgcacaatccacctagcatgtcattacctatcagctaatgattggaaattttacactttaaaatatgtatgtactttttttggactaaaaatttcttcagcttttgagtgtgttttattccctttgtaatctgtaaatatttctttaattctataaaatcacactgttgggcaaatgcctgacagtaatttacttcaaaaaaaaaagcatagacaatttttgttgagtgagaacacatattttacagtattataccgtgttaaacactgtagcacacagtttgtcatggtcaggggctaacgatcatcctttagttgtaccctcattgcccatcattgttttgcaccaaaaagggcaattatcataaagctaggtgccaaacacaatttgaccaatgagctcatccataaggactatatgtatttctctacagacattctgcatgacatcgtaattaatagaaacaagaaaaatgatgtatgacaagtctgtatggtaactttccgtatacagctcaacaacctctttgatgttatattaagcatgattcaatggtaacaaaacaggcttggtaatttaataccaacgagatagcactgaaaattgtaacaaataccctcccccgttttaccagttagaattattctcttttcaccatcatatggtatatgatacacacagtcaattattggcagtgatcaagcggttcacttttatcaatatggcagtggctgttactactcatcaagcacatcggttgtaaaggtccaagtttcaccatacatttccatcacaaagcatcttgaaatcatgaaagtagtagaagtagatgatgaagccttcatattcaacatcagaaatgatggacgcaccttcatattgcacgacccttgcaggtgaagctggcgtcttggaaccaccttcctcccacgttgcactaatcttcatttggtaccacctgaacataacacaaaactacccgttagagaatgaagcgacaaaacaccttggcataatcaacaattccatacaattacacacaaacattcaacagaagccaacatttgca

SEQ ID NO: 37308 - DNA, 1501 bp, Oryza sativa
gccctggtgattaattttgtggatgaaatatatgctactgctgttatatggccctgctacagtgctactgctctgctgtttattaattttgtggattaaaaataatgactctgctgttatatggccctgctactgctcttattgtgcctacttgttctttttttttatctacaattgtttatatacatgatttatataccactgctgttgttgcccctgtacttcttattaaatggccaatgatgaattgctcaataaaattctatctatacctgttcttttctttatggataagaacagactatctacacttgttgatttatatacccttgctgtcaaggatgaatttccctctgctgttgctgtttatgtgaatttccccctgttgttgctgtttacgtgaatttccccctactgttgctacccctgtggcatatatacccctactgctgttatatggccatgctactactcttattgtgcctacttgttcatttttttatctacaataatatatgcatgatttatataccactgctgttgttgcccctgtacttcttgttaaatggtcaaggatgaattgcttaataacattctatctatacctgttcttttctttatggataagaacagattatctacacttgttgatttatatacccttgctgtctatgtgaatttccctctgctgttgctgtttatgtgaatttccaccctgctgttgctgtttatgtgaatctccccctgctgttgctgcccctgtggcatatatacccctactgctgttatatggccctgctactgctcttattgctactattatatggccatgctgttgctactgctctaatttcctgcacttgctcttttctttatggataagaacagatgaactacacttgttctattttatggataagaacagatgaactacacttgttctattttctttgggttgctttttcctcctagtagctgatttcctctttttatcccttcatgcaaatgattataattgatgcatatttctgagcaaaactgaggccatatctttcatagtataccccgtattacattggatctaatgctatttagtataatggtaggaaatttataagctttttcgcgaaaattagaccatgtcaacgcccggcgcaaacccgctctccccaatacctgcgaggatccaggaagaagcaaacccagccacggagacagttgccgaaggtcatcccgcgacaacggcggtccaacaacccaaaattcatggtaatttataggataaattttcaccacatgaccacataaattttagctagcaccccttagcaaatattgccttctgtttgtgctgcagaattgccacaggaacaacatacatcgatgtcgggcgggacaagtgcaagtaggtctagtagaaatccctagtcacaaaatatatggccgaccatagtgcaagttataagagaggttgacgctagtggtaggcccaccgcgccca

SEQ ID NO: 37309 - DNA, 158 bp, Oryza sativa
tttttgaagttaaggtttttagtactaacactacataaccactgcgcaggcgacatggattctcctagtcatcgtacctaagtggagtagggttacctaccttaactccaataagtccaaagattatgatttcagtgaaatcaccaaggccttaaata

SEQ ID NO: 37310 - DNA, 1501 bp, Oryza sativa
gatggcataatagggtttcatttgcaaaagcagcttttagcaaacatttgagaatttaataaaacagttaagtaattaaacaatattaatccaacgctatacaacataccctgttgcataggcccaaccattctgaacaaccatcccggctgcacagttctatctccaaaccaggaatataccattccaaaccaggagctaatcaaattttaccagttatagcatcttctattatggtgagaagggtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtacctcggaaaggagttgtgacaataccccttatacaacacaatccattgcagcgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacggttaatgtttcacaaccgaaactcgtgaaccggtccttaattgtcatgagcacgaccatcaaaaccatgtgctcacaacccaccattaccaggttttagttggcacattaattaattaactaatcacgattgaccatcgtgaactatcattaagccatcattaaataaagtgagtcataagttatcccaatagtgtgctaatgtttctaagcagggctgagcaattatatctaatatctagttgaaccaataaataaagcccaactagtcaagttataataacccaaggtatcaaggaataaagtaatcaagaacaaaagggctataacaaacaataggttaattccacccaatgacattcgaaaataaatgcaatatttgaatagaaacaatagctttaaataggatcaacatgctcaaagggttgtttgggatctgtgtgacttgccttgctggccttggaactcttcaaactcttctccggcgaaaacggactctccggaaacgacggaatctaagcagaaaagaacaaaatcaccaaaacagcacataaacaagcatgaacagtacatgtggatatttttaacatgtagatctcaattttagaaaaaattagagacttgaaccaactaaatcggagctaagatgaattagttatgaatttttaaagattaaatcggattaaaacacttatatcggttaaaattgaattatgacgcaataatgaattatttttgaaaaggaaaagaaggtttattgcgtcagcgggctagggtttgcggtggaccgggcgcacggcggcggttcacgcgaacggacggccgagatcgaaccgatctaagatggacggccgagatcgatcgggtccacggcggctcacagcggacgacctcga

SEQ ID NO: 37311 - DNA, 1501 bp, Oryza sativa
cacaatctctgcctgctcacctcggccagccgcacagagcgccaccagcaatgcccggtacaccacaacatcttcgtcgcatcccttctgcgacacgcgccacagcatggagtagagaacgtgtgtggcctcatcgagcatgccagcatcgcagagcgcaggcacgatcgcgcgataagcgtccttctctggtgcgaggcactggttagacatttcatcaagcacctgcagagcgagttcaggtctccgcgcacggcacaatccagtgatcaacgaggtgaggtcttctgacgctagagagacttccggcctccccgcgaagtccgcaaagagacgggccgcttcgggaagcaagccatcggagaggaggcggcggaggagggcggagaaggatcgtgaccaagacggggcgagggaggatgggagggaggagcggaagacggagactgcggcagcgggagggaggtgcgggatggaggcggcgaggagggagtcggcggagggggaggacgggaggatgcggcggaggagggaggggaggagatcggaggaggatgcggaggccgcggcgaggagcgaggagtggacggcgtcgttgtggcggtaggaggagcgcgggtagcgccgcggcgcgtcggcgtagagatggacggcgtcgagggggctcttctgccggcggatggcgccggcgaggtgcgccggagtcagcacccgcggccaccgcacaggcgtggcgaccatcgccgtcccggacttccagcaactttggagtggtcgtgcacgcgatggttttcgtgctactcggcccggcccaatctggtagctgactcgactttgctcagcccacctagtacaatattgtacacgaacttggtgggcccagttgtaatatggaccgagagcctgagtaggccttaataccgtccaaactccagagtccagtctgttaacacctccccctaatgtaaaatcgatttgaatccctggagataatatgccttccaaaaaatcaattgctttcctacaataaatctgatgactacagtttccatgaagaaaacctttctaaaacattggacgcagctaggtatcgggcgtctgactagtggcgaaaaaaaaataatcaaacgtcacatgatcaaaggaaactgtctatccattttgtcgggtgatttctctctagtgaaaaaatcacttgtaagatgtatagcaaaatcgttttagtaattgcaacgtcacaataaaatatctgttgaaatatttcactgtccggtataaaacacaatattttaaccatctaaacattttttattagaatataattacatgatattttgtactagtagagatttaattgtaacaaatagggcgctgtattcggattacatattagataagtataatttaagataaaatatcatttaaagttcgttaatgaagtcgttcgttgcatgaagaggagcgaggatatggagcgcaagagagagcatgtaacatggga

SEQ ID NO: 37312 - DNA, 1501 bp, Oryza sativa
gtactcagtcttgctctcttttcccccacaccagagttgaagttcttctcagatggagccgtctcagagaggttggtttcgtcgctgccgtcaaggtttgcttgtggagtggagtcgcccgctgctgaagtcaagcttcccggtttagctcgcttttatctttctcgctgcatttgtaatcttttatatttttgtaagacgtgggtctgtatgtcaacaaatgtcgtttgtgtaccctggctggtcctggacagggatttaatgcacattcagcttacaaattctggttcgagaatttctgggtgtgacactcgctcttcgttctcgcgacgttgtgaagaaacacgatgtcgggaatgattctcattgtctcgcgtgcgtcgtgcttctcggcggccattcagatggtcgcggagatcgccggtgctgcgaggtggatgggtagctcatctaggtgacgtccgctgctccggtggttcgccgttggcagcgccagctatcagtcgctcttgttgtgctctggtagcggcttcctcgaacgcgttactgagattggctaccgattcccatagtcgttctatccatcgtgcgagatcatcgttaagaacggggtcatagggagcttctctcagtactgcattgatggtgccgagatgttgggccggcgtgaccgtctggttctccgcccctgcgttagcgtgtgcagacgtgctagtcccaccgatggcaaacatgtcgcgtggtgtactggaagatgatgagccatagtcttcgagcaagtgtaggactgatggctcgtggggatcaatgtcgattactccaacaaatcgatccgaggtcaacgtcgctccttgttccttgtttgtgcccttacgagaggttcctacctgctggaccttaggaagcgtcgttttcatggcgtggagaaagaccttgtagcttgagaagtcgtgattcttcgtcttgtgaataggacaatagacatcatgagttggagaagtacgctggattccacgctctttgcaagcacgaattttagcttgtacgttgagaaaaacccagcaagcttgcaagttgtgcttcctggacttgtggataggataccaggacttttttacctcagaagttgtccttgtcggctcggagttcttgtcggaaggacaaggttcggccacactaggaaccttctcgggctcgtatgacgtcgatgttccattctctgctacggcgggaggatccttagacgcgggatcgtccggggttatagccacggcgttctcgtttccgataattgatggaccagccgagattggcaccgtggtgtaaaccgggaagatgatttcgccaacttgagtccacaccagcattgttcaagtagggactccatgaatggggccggtgctgacgccgttgtcgacgaagcttgatgtcatagtagtagaaccttgagcaccaaagctccctacgtggcgcgccactgtcgacgatgggtacccataga

SEQ ID NO: 37313 - DNA, 1501 bp, Oryza sativa
caagtggcttttactttagttaccttctagtactatcatgtgattgacacaaaccttttttgagataagctgagcctttgcaattagcttttcttaggataatagcaacactcacacactaccctttttgttcaaaaagcttaagtagtgcatttgtagaacacttggagcttattaatcgagattaaagttggactgtaaatttcagggagatctagttgaacttgactgcgatttttttcctaatctaattataatcttttgtttgtgctgcagaagaagttgctgaggaatttgctaggagggtgccttggcgtgaactgcatcgcttgaaaaacaactagcctcaataaatttctcccaagggtttgggtgttagaaagagatgtatgtacattgtgtgctgatatggaagtaatggaaactgattactgtttggactcgattgaatgtgatgatgtccgttcaaaaaaaaatgaatgtgatgatgataataataataataaatacgctttccattatgcacctccactgatcgtagctcgttataaatcttaatcgaaatcttgtcaagatagcaaaattaggaggcatcagaacagatcgaataggatacgcgttgcaaagttaaaggaagggcctcacgatacctaacgccttaacggtggtgtgggctcaccggactatccggagagaggtgctttcgatcgtccgttttcaagaccgattttgttatacatttgtcgacaaatttttctccaaaaatttgacaaatgtaattacagtataattgtagtgtaattacactgtaacttgtatgtaattacagtacaattgtagtgtaattacactgtaacttgtatgtaattacactgtacctatagtgtaacttgtatgtaactttcaaaaatctctccgtaacatgttatttcggtaaaatggaggtcgtgggaacaaattctttcatatatgtgtgtgctatgatttgttttcttcctcaccaaaacaaatcgtgtaatagatctaacgattcaaaattatgtgacacttacatataagttacactgtagttacatgtaagttacagtgtagttacatataagttatagtgtaattacactacgattatattataattacatctgtcaattttttggtgaaaattttgtcgacaaatgtataggcagtccctttgaagacagatttaaacctcattagcacaagcattaataattataagcttgaaactaacaaaaaaaaatgaggaagttgaagtttggggttagaactgagccatagtcgcacaggcaagggtgagcctggagccgagtacagggcgccgtctgatccatatacgtgatctgcaacaaaatccaatgcggactcagattttcgccgatacgaagtccgaatcggactgggataatgcgcacgtactaccacataaaatccacccgtcgtctcctcgccatcgagatcgatcgactcccgtctccagcga

SEQ ID NO: 37314 - DNA, 1501 bp, Oryza sativa
tccctttgtaatttgtggtcatctccatataatcctatatcaactggattagggctattacctatttaggggcctgaaccagtataatctttgtctcttgtttccttcatgtcgtactacgttgatcatcgtaccagtgtaccccaataccctctatatccggtctatgggtacccatcgtcgacagtggcgcgccacgtagggagctttggtgctcaaggttctactactatgacatcaagcttcgtcgacaacggcgtcagcaccggccccattcatggagtccctacttgaacaatgctggtgtggactcaagttggcgaaatcatcttcccggtttacaccacggtgccaatctcggctggtccatcaattatcggaaacgagaacgccgtggctataaccccggacgatcccgcgtctaaggatcctcccgccgtagcagagaatggaacatcgacgtcatacgagcccgagaaggttcctagtgtggccgaaccttgtccttccgacaagaactccgagccgacaaggacaacttctgaggtaaaaaagtcctggtatcctatccacaagtccaggaagcacaacttgcaagcttgctgggtttttctcaacgtacaagctaaaattcgtgcttgcaaagagcgtggaatccagcgtacttctccaactcatgatgtctattgtcctattcacaagacgaagaatcacgacttctcaagctacaaggtctttctccacgccatgaaaacgacgcttcctaaggtccagcaggtaggaacctctcgtaagggcacaaacaaggaacaaggagcgacgttgacctcggatcgatttgttggagtaatcgacattgatccccacgagccatcagtcctacacttgctcgaagactatggctcatcatcttccagtacaccacgcgacatgtttgccatcggtgggactagcacgtctgcacacgctaacgcaggggcggagaaccagacggtcacgccggcccaacatctcggcaccatcaatgcagtactgagagaagctccctatgaccccgttcttaacgatgatctcgcacgatggatagaacgactatgggaatcggtagccaatctcagtaacgcgttcgaggaagccgctaccagagcacaacaagagcgactgatagctggcgctgccaacggcgaaccaccggagcagcggacgtcacctagatgagctacccatccacctcgcagcaccggcgatctccgcgaccatctgaatggccgccgagaagcacgacgcacgcgagacaatgagaatcattcccgacatcgtgtttcttcacaacgtcgcgagaacgaagagcgagtgtcacacccagaaattctcgaaccagaatttgtaagctgaatgtgcattaaatccctgtccaggaccagccagggtacacaaacgacatttgttgacatacagacccacgtcttacaaaaatataaaagattacaaatgcagcgag

SEQ ID NO: 37315 - DNA, 1501 bp, Oryza sativa
acatattgatctattttattattttttaaaatatttttgtaactattcaggtgatataataatcaacgggtggatatccacttactagtagtgattaaaagagttttccgtccgggaatgggacatggaccgggccaagtgaagtaaaaagtaacctatctgcattcctgtgaggctgtgacagtttgttggcctggcctgagtgctagtggttataatcttaggccctgtttagatgggactaaaacttttaagtccctatcacattgtatgtttgaaaattaattataaatattaaatatagactattaataaaacctatccataatcttggactaatttgcgagacgaatctaatgagcctaattaatccatgattagcctatgtgatgctacattaaacattctctaattatagattaattaggcttaaaaaatttgtctcgtgaattagcttttatttatgtaattagttttgtaagtagtctatatttaatactctaaattagtgtctaaagacagggacttaagttaagtccctggatgtaaacaccaccttagacgtgaccaattctgattttttttatgttctttctgatcaccaaactatattatgtcttcttttgtttgagtgggagaatatgcacaaaagtcctattttggctgtgacactttgcattacagaattattataatcatatcttggcatgatgaaatgcctgtcaaactcatgattactaaggcagactgatctaactgatgaatgtttggcttgcaagttgcaactgatgctctgatgctcactgtaactactactccactacagtattgtactatactgctaggatttgtgtctctaactatgcagatgcagttctattactgttactgtttgataacctggtgacttagaactgcattgcagcctctgcagattaataatcggttacactgctacagcttttgttcaaacttcagaaccgagaaaaccaaaaacgaaagcagggggttgcatcacagcagtggtcccggtgccccatgttatgctctgccatggaatggacaacaagaaagtcaaattgaccatgtctattacctacacaaagtagggtagatgagaaccatcagaagcttaattactgttagctacagctgcctgcagcagctatagctggcaagaaaagcagatctagatgtcacttgtgacactctgcactgtcactgtacctaagattaggaggcctacccatcaaaaagaaggtaaaaaaaaagattaggagagggtacatcaaaagcctaaacagagaggctgtaaacttttaatcaaaaggaggagaagacatgttaaaatttggagaaagataaagtggaaaaagaaggggaagaagatgttgggtagctatatatgtgggccgtgaagtataaaattttcgccaggttcctaagcacctgtctttgtcaaagcagattccgaaaggttcttagctggcccaacaaaaag

SEQ ID NO: 37316 - DNA, 1501 bp, Oryza sativa
cgtcacgtacgatcgatcgtcatctccttcctctccgacgagatcgacgcggcgatttacttaccttctggaaggggttgtcgcagccggggaacttgggcgagacgccgtcctcgaactccgagtccgcgccggcggcgcccggcacgcgggacgcgagcaggaggacggagacgaggaggtaggcgaggccgcggccgcggcggcgaggggaggaggaggagggtgcagggaacgccatggcgtggtggatttgccggcgagcggcgcggcgcgagcgagcgaggtgaggaggccggccgtcccgtcgtgcgtgcgtgggcgcgtagtacgtcggggtcgtacgtcgtcttccccgacgagggaagctgcatgcgtcggtcgcctcccgcgctcattgcctatactataactggggggtggctgtggattcatccggcccctatgttcccgcgccccgtcaactctaaatcgaagcgtctttctctcgtctttcaacgtgaacaccgtaaagtactctaacatccaagtttgcactgtggacatcgcgcttaaagatatacaaaccaacgataaattcctgacttcattgagggtttgtatccaaaataaacctcgatgatattattaaaatttcgacagaattttttatgtagtatttatcaaagtttggaaaaaaattaatgtatgtacatcgttgacaacttggtatgatttgaaatggtattaatctgaattgtccctaaatctatattacccatgtaaacgtgcgggtttatgagtttcgtacaaattccgcaagaatttcacaccaaacaatccatcttccgtatatctactatgtaaaataatctagtgatgatgatgaatctaacatcatctagagttgatatgattttttaaggatggataaatggtctttttgtgcatgtggcttaaactttttggttggatatttgcttgtaattctatatgttttttttctgagtatttttaagctaacaacttaagacatataattagaaatccgttataacaagcaggtattttattagtcaatgcaaagtctcacattataatcagggctaattctctagatggaaccatgaaattcacagtattctcactagaatttgacataaatcagttttgttttctataagaaccaacagcgattcatacactctgaatggaacctgatcctctaatctactggctactgcccttaagtactccatccgtcccaaaatgtaaatatttttagctatgaatctgaacaactgtgtgttcagatttatagctaaaagttgttatattctaggacggatgtagtaaactttaagtagctagcagtaacatttacacatgagagtgcagcatgtccaccactaccatttttgaatcaagaaattcaaaatgaaccataattgcccttcttttcggcccaactgatcattttaggtacggcccatctggaaaatgacccaggggccgaggctag

SEQ ID NO: 37317 - DNA, 1501 bp, Oryza sativa
gacgcggcgcggcggtcgctccgttcgcacggcctgcacgtcccgccgtggcgcaagacccggtacatgctcgccaagtggctcggcccctacaagaggtcgacggccacctcgccgtcggccgccggagcaatgccgatgcccgccgccgccgccgggatggacgtcaagtgccgcgccgtcgggttcttcacgccgccgccggccgctccggcggcgaggatcaagtagactcggcgatgaaacatcataatcaaggcattaattaacggtgtttgtagatgtagagattaattagagcgagagttcctttcaactttgagttgctctcgaatttgttttgtacagatatttttggtcgagattaattattaaggagcaaattgttcttgcaaaaggtgatgatatattattgtgtagcatacttgaacttgatctttagctagggaaaagattataatatgaagatcttgcaggaaaacaaagcaagaaacgatgtacgcggcgggtgggtgtggttgaattagcgtggattgaatggtgccacggatgtttatgctttactaatggcgcttgtcggcgacgatatgtttaacaataataatacaatcagcctaatcatcctctctcgttgctgtgatctgcgtacgttattttttttctctcttcaagattcagcatcgtggattgtcgatcatatgatacgcatacttgctcccccttgatcacctagccacgaaatactctttaaatcctgagtaacgagttgcttgaaatttaaccgaaaattccatttcaaacaaacaagaataatccactataccatttgaagttttttaattttaaagcggataaggaaaagggcgatcagaggagaaaaagaatttgtcagtggtccaggaccatcagattattacggataataaataatagcgtggggcccacttgcaaggagacctgtcactcgaggctgcggtgggcccgccgcgtcctggaccagatatccacgtggcaacgaggagggcttgagcttcttggtgaaaccaccaaacgccgccacggctagcgaaagggaccttgtactgggcgtgtcgcccagtacacacgtggactcatgtaccgttgctatctctactccctccctactactcctactagatgcatcttccagctttgcttgtgattttgctccaaactttgcaaattctggccaggtaaatgtggtgtcgtactgtcgtttcaagccacatgcattcagatcgagagagatgtgtttttcctttttttaaaaaaatgagaaaattgagagagatttggtatgagactatgagccggccacggaccacctggtctgattctgatatactgcgattacaagcactcatgctgggcacagcttgcctgagttgtatacagtatacccacggagatatctctctcttctctaccacaaaactagggagatttaattaagtgcaacacaaatataaaggcacgtgta

SEQ ID NO: 37318 - DNA, 1501 bp, Oryza sativa
taagttcagcgtcagctcaggaccagggggcaagtaaaaaagtttcattaaagaaatgtcatgccgtcaacagtgtagatactcctggaaacagttgcgtacagctgaacctggtagggccccgatcgagatcgagacggagacggggcgagaagagagcgtcgagatagagattaggaagaggcgatcacagaaacggatatggattatcgagtctagtggcgagaccgagacgatcgatcgagcaatgggcagcatagtcgccatccatctcgtgctcttgtccctcccacggcgaccccgcggccgcgccaagggccaaacacgggggcgcccccacctgctgctgacttggcccaatcgacgtcgcccgagccaggttggggggcccgcgtgacagtgcggataggacaaagcctcgggatgccacggcatatcctcgccacgcacggcacgcacgcaggcggcagcaacacacacacgcaatagtgcaatatgccaacacaccgcggcgacccggtttttcgagaaagctttttactgtttttatacaggtgaaaaaagcgtcacgtttgaaacgggggcttaaggttaaaaataaataaagtgatttggttgcataatcgtatattcgtatagtgcgtgtggattataagcttgcttttccacgctatttccctccattccctggacgtttcgtggtcaaatgctgtagtagaaaacagcatatatacagtgcgaacgccagctctctcgtgtgagtagtattctacatggttgaagatggaagataatttttaaaagatgcaaataactcgtccattgattcggaaacaacttaagcacgtgctaacagctgctaattactgtacacctgtcacctctggcagcagaaaatgcactgtaacaacattaaccctgtcagtatggatggacctagaaagaaaacagagataaacatttatacatgtcagccatcgagccatcaaccaacacgctctatctgtttactctctcccgtttcattttaattaacgatttagacaatgacatgatttataaaatatatccttgacattatttttctattataatatatataataaataaatatatgtttatgttttgaaagacaaatctatatatgttgttctaattttttggaactaaatatttttaaagttacttatggttaaagttataaaagtttaacctcaaacttgtttaaaagatcaattaatatagaatttaaaagatcaattaatatggaatttaaaagttcaattaatatggaactggagggagtacatggcagcaccaaattagctttgatatgtaattttttttggcgcactgcttttgcctaccatctctcatcaggaaagcatattccatggttaacttcctcaaattcgttgctcctaacttaagcgcccccactaatcactaatgatccaaaggaataaacccttcctctctctcgagttcgcctcatagccaa

SEQ ID NO: 37319 - DNA, 1501 bp, Oryza sativa; identical to SEQ ID NO: 28738

SEQ ID NO: 37320 - DNA, 425 bp, Oryza sativa
gtagccttggtcaagctgcctgtggagtggagccgtctgcgccgtttattttttttttccgctgcttagatttttattgattgagaggaactatctacctctgtaatgacattttattcgcttattaattagagtaatatttgtactctattatcaatttgttattgtgtgcctcggctgattcctggacaagggttcacacacatgtaagcgtttggaattttggatagaaattccgggcgtgacaggggcccacctgtcgggcccgtctccctcctcccgccgatcccggcgcgccgccgcgcccgcaaccatcgccgcgcccacgtctccgcctcccccgggccacgtcgaccacgcccgcgcgtgcgccgaatctcccgcgcccattcccctctctctcccgctcgcgcccgcgcccgaga

SEQ ID NO: 37321 - DNA, 1501 bp, Oryza sativa
actatttcccatggcttgctgagtactcctgtactcacccttgctctatataaataatcccccccagttgctgaagaagatgaagcggatctcgctgacgaggagtttttccaggagcaagccggctacgatgagttttagggtttcggcctagttcccaagtcgcgcctgtgttgtttggcccaagtcttggcttccgcttcccttttataatgcagttgtgagcttgggatctgtccgcagcccaacatgactgtactcctactctataataaagagacctctgttgttgtgatattccgtcttcctgtgataccagcactgtttcctgggactggtatcgattaacaggttaatttagagcgtcacgggctagttccggtcggtactagttcggggcgtgacaaagaacgagagggaaaaaaaaaagaaagaacagacaatctccgcgatttgggtatggtactagctagcaagattagattgtggggaagaaagagtaccagcacgtagcagcaacaaaccgattcgatctgctttgcggtaaatccagggagcgtccggcctgctgcaggataaagatggtatcacaacttcacaagttgtgcaaatatcaaagatgaacaacgagaaaatgaagaataaattggctttccaacggagaggataaagatacaatcagatgtagcagcagcggacctggggcgctcggttggaaggggcacggcgtagctccccagtgcccggccggagaaggagatggggatggatttctaggtctggacgtctggagtttggacgcctcgggactatatagtaaaaaacacagataaggtcatcagatgtagtaaaataagaagagggaaattaagattcaatgaaaacgagaggtggcctttgcgaaattgtgagcaagaagagagtacctgtaacctgtcactactactactacgtacgagcacagcaccacgcagcagcaaattaaaccgaatcgagcagcaagcaaaggccgtggctctcaccggtggccggcggcaaggatggcggcgcggaaggggcgagggagatgggtataaacgaacgaacacgttgtccgtggggccgcccgagtgggcctgggctaagtaggttaaaggaaacggcttcatgggcctttttttttttttctggtttcttagggtggtggtccgtacttttctaacctggttgggaagaacagataaacgactagtatatatgcttttgaagtgtactggagatacgttgaaacaaaaaggcaacagaactaactatatagtgatatcagtctagttattgccaagagctgaatgctgatatgccaacttggctcagagcaatcttttgctattctaaatttctaatctgtactgccaatgatgtcttattttctttgtacgtttccattagctgtggagctaggcaggttaaatgtacgagtaataactgactaattattgtgttatgtgggacagatccacaa

SEQ ID NO: 37322 - DNA, 1501 bp, Oryza sativa
cagtactcctgggcatggaagacgtcggaaattcagttgccctcgatcggatgccatgctgcttggcgttgctctgcttggagcgccgcgcttcaacagacagcacagcttgtgcaacgtctactgcttcctgggtgtttcagctcagcttacctgctcgtgcatcacacgcagagcactgctagttacgtagaatctgtagttcgctgtctgattctagcggagtatggctccctctagagatgatgaagactctagctctgcttggggatgattggatcattggactgatctgatggtttgttctatctttagctgtattttgactgttatgtttctcctgttgagtttacacgacggagaaaataacaagagagacgttgaaatgggaaaaaaactaataaagcaagttaagtgaaattaatttgaccaacaacttttaccctgatatggtagtaaaaatgaaccttttctcttgaacaattttatttttctaaaaagaagtactgaacaaattagccgatatgtccatttgttctcgctcatttgttacattccagcttttttttattactatgcataagaacagcgtgcaataattgtgctacccatatgtaatataaaccaacctaagccaccaacaaggaaaccgagagcttggaatatatttgggcctgttcagcaagctggctgcggctgcggctgcgccgccgcgtgcgtgtggcattgttggtgccgtctgtgccgcagccgtaaaacaggcagctgaacaaacccatatatagtatactcctcaaatttacaccaacagcaaggaagcatgcaagtttggtatgagaagcatcaggagctccattacgccgtgtgcttgtttaggttctcgtgatcacggaagcaagtgagctgcggaaagcatgaacacaaccgccgaacatcttccagcgtcttctgaaccctgacagacagcagtgctgagagctaagcatctgagcttcgacttgacccaaatgtccatcctttctgctactccatcagctgctatagtcctgatcagtcgcagccgtgttctatcctcccattccagttatagcctacaggcgagatgacaatttaatttggctaaagctggagacaatgcaccaaaccattataacaaactttttatcttcaagggagcaactttttacttgttttcttttttggcagtcaatctcttccttaatttgacttctgatcgacgatcgagaggagacaaagttagccactgtaggtaggtaagcaaaaacaaaagctcgtcgtctaaaaatgattgcagttttagtttaaagatttataattaaaaagttgtatttttagaataggtctacttgacctgtttaatactatattatctttttttaaaatcaaaggtgtttttgattattattctatgatgaacaattgggcattggagattattggttttgttatttggaatttattcacgaagtggttttggaga

SEQ ID NO: 37323 - DNA, 171 bp, Oryza sativa
aaacaatatcagctaacattttttttcatgtggcaacaaatacggccgtgaaaaataatgcaaaccttgaggaagcagcggcgatggcaatttccgtaggcgggatgctagtatctccttccccaagagcatgggactatggtgacatgagcttgctctattgctgccagg

SEQ ID NO: 37324 - DNA, 195 bp, Oryza sativa
tcgtcgttcccctcttctctcgccgccggtggccgacgccacaatcctccaccgacgaactccctccggtgaatctgatccgttgactcgtctcccctcgtctcgtacaaccacccggtgtgctcgctctctcctgtatcgccgtggttcgccccgccgttcgtagccgccgtccgccatccgttccggccgaca

SEQ ID NO: 37325 - DNA, 241 bp, Oryza sativa
attgacctctaagtgtgccattagatagatctgagatttgaggaattttggaagttgaacggagtcaaacggacttacggttggaagatgttgaatttctaagattattggatttttgatctaaaggaaaaaggatttaattaaacccttttgaaaaagaaaaaaaagagggaggaggaacggacttcacgggcggcttgagcgcggcccgagaggggttggcgcggcccggccttgccat

SEQ ID NO: 37326 - DNA, 1501 bp, Oryza sativa
tgtaagcaggcttctttagatcatctaaaggatcagtatagttccactaaaaaacaaaaaataataatctcgtaatacaaaacagttatgtttatattttaattaagagaaaatatcttgtgtacccctgaaagttcacctaatcccttctgtacccctgaattttgctcaatcccttacatacccctgaattttagtttggatcccttccatgccctttccgctagttgaccgttagttgaccgttaaattcttatgaaaaagtccattttgcctttggtataaagaagcatatatataaattaatagagtatattgttgaagtatagaaatttgttatatgaaactattatgtttatgagatagttatgcaccatattatttgcgagaaatataattttagatatgacataaaaaattaatacttatttattagttattaaaatattttttagcatatgtattctgatagtaataaacaaatctgttgtattactatgaaaatacatatgctacgtaaaagaacttttaataactaataaataagtattaactttttatatcatatgtaaaagtaaatttgtcacaaataatatggtgcatcacatactcataaatataatagtctcatccaataaatttttacattccaacaatatacttaattaatttattatgttttttcatagcaaagggaaaaatggactttttcaaaagaatttaacggtcaactaacggtcaactagcggaaagggcatggaagggatccaaactaaaattcaggggtatgtaagggattgagcaaaattcatagaagggattaggtgaactttcatgggtacataggggattttctctttaattaacatgtactctctccgtaaaaaaaaatcatcccctcctaattaacaaatctggagattcattgtactaggagaggtgtctttttttcctgacggagggagtataagcgaaactgatgttcgaactagagacacatgtcagaggggtccagatcccctagagttgagtacaactccaccgggtgaattttactaaatctgtgacatctattgcttcctacggctgagatgaagccatctattcttcctatggtttgaatgggaattactttatttttttcatgttagtaatggttaagtttatgcctaccaaagtaacaaagtatacacgttatcttctttcccaaacacaagaagctacgttcatgtacagaaaaaaagtgttaattaaccacatggtacatgcaaacatacataaaccatatacatgcaaaaatagaggcacatgctcagtacggtctttataccatggatgaatcaaaaaatttgggttatgcaagtaaaatttatattctcagattctctaaatatatatattgtagtcggtgatttgttattgttacaagattatgaggacttatttttctttttcaaaaaagactagtgggaagtgggaactaatggcttcatcccaactg

SEQ ID NO: 37327 - DNA, 1501 bp, Oryza sativa
gctatatgagaactataattttgcagaaaaatttaaagatttgttaaaatataagaaattcaaattttttttggtagtaaatgatttcaaatgaaaaagttgtcaacaataaagttgtataactcatcaagatctataacttttactttggtcttttttctatataacattttctgaacagtttgaatttgaatttaaaaatatgaaaacttcaaacagtattttcaaatattaaataatttcaactgaaaaaatcatcaacaacaaagttgtataaatcatcaatatctataacttttattttggtcatttttctatataatatttttttgaatagtttgaatttgaatttgaaaatatgacaacttcaaacaacattttcaaatactaaatgctttcgactgaaaatgtcatcaaaaaatcaaaaataaagttgtataactcatcaatatctataacttttattttggtcatttcttcatccgacaaagtgatactaacattgttcacaaaatcacatatccctcatctggttttataaactataacacagatttgtgaatcttgtgaacaatgttattaacactttatcggatgaagaaatgataaaataaaagttatagatcttggtgagttatacgactttgttgttgatgactttttcagttgaaatcatttagtatttgaaaatgttgtttgaagttgtcatatttttaaattcaaattcaaactgttcaaaaaaatgttatatagaaaaatgaccaaaataaaagttatagatattgatgagttatacaactttgttgttgatgactttttcagttgaaatcatttagtatttaaaaatattgtttgaagttgtcatattttcagtgagaaaataatcttatttcctgattttaggttcaaacattgtgtttttcagaacatccatgaataggagtgaagcatctgtgctggtaatgattgctatacaaacttctttgcaatctcaagcctaaagtatttacttttcctttttcatttatgctcttttcagtgtcattgtgccttttttattgacattctaaaaagttgctcaagttacattgttgactgttcttgaccatattgagataatgagaaatcagagatatatagtaatgtgtggcttaatttggcttatattagagcattgctactggtaaaagtacctagcgacaaaaattgctcatggtaaactacctgcacaatttcactagtaccttttgtgatgcagtagttgtttgtgcactaaatggtggcctctgttcctgaagatccagtcctatatttttgctaggttgatccaaatatgctcatgttcttatttccatctatataattgagcatttggtcttatttcccattaattgtactatgtttgggtttagcatgtaatatagtccaatcttgatattaattcagtttctagctatattgatcttccagtttcttacaagcttatcacaattgcaggtat

SEQ ID NO: 37328 - DNA, 1501 bp, Oryza sativa
cctgagtagcaccccaaggtcctgagttcaaatcttcataggagcgaattttagattgggttatttgagggctaagttccctgtttgataagttaagttcctaatttaaaatggctgtacatatccgattgaatattgagtctgggaaaaaaaatacccttctctgcaaaaaagatatgtccacgttgttgggcctggtggtattcatgtttggtaacggatttgctcctctagcacgttaactttgtgtgggctactgggcttctttctctcgtcgtagctgaacccgaagcaccgcttgtccgcttcacctcctcgatcgcgtcggtgagactcggcgagcgttccagccggccgccgccgccgccgccaggctttggcctcgggtctcctactaccaaccagccatggcgcaggtctttcgggcgcggcggcgaggcggaggcggcagggaggagccgatcgccctggtggtgcggtgacggtgtctacccctcgtcagcacgaggcgttcgtggaattgtccgtaagcgcgcggtctcttccccgcgaagcaaggatgtggatgttctttttgcagaaaaaggatctggcccatcgccttttccgtgtgcatatgggacacgagcagaaggtgttcgtgcaaatgcggcagacagcacaggcagacagttcttgttttggatgtgttgggatcagagtactggcgttttacaagtttgctgatgccgcacgattgcagtcaacaaggtcatttcactggatttttgtctcaacaatatcgggatactgagttctccttatcaccgaaattttagcagttcaagatgctgagcctaaggccatccacaatcggtgtccctgggtcgtccccccgctcacaccgtccgccgtccgtccgcgcagcgtgtctctggagggaggcgcgacccccacgcggggaacccctctagctccccagctcgctttttccagagacactcccttgaagctacgtgttgcggcgacccggtgccccatccctaccttctctcctggtgtttccccttcttgcccctcaccggcggcatggcgacgagagagagagaagagagagaggcgacggcgacgaggatccacgacggtgacgaccagatccggccaccagctggcgacgggctcggcttccgcgacggagacgacgacgaggactggcgatgaccaccagccggcgacgggctcggctttcgcgtctgccacctcgacgccaccacgccagctcaccatatctgcccgcctcgcagccggatctgcctcctccagctgccgccgacactggaaccgacgctggaaccacttcggtgacgacggcgggacgcggctggcggagggaggaggaaggcagctgctagagggggtgaggagggaggcgccgcggcggctggggagggcgagggggaaggccgcggcggcgggaaccgccggcgacacgcctcgcgctcgacacgaccggcgtcgcctt

SEQ ID NO: 37329 - DNA, 607 bp, Oryza sativa
actctattatcaatttgttattgtgtgcctcggctgattcctggacgagggtttacacacatgtaagcgtttggaattttggatagaaattccgggcgtgacaagttggtatcagagctcccttgaccctaggttatgccaaatggttacccatagaagccctctaaaaatattggaaaagtagaactgttctcctccctttctcttttaattaaaccaaactaatggcacatgcacttcataatctcttttaatggttctcattcaaaatttattccagtgttattagtactgtacatctattactgtactaatggctcattttccagcaaaaattttacaatgttgtttcatttaatcttgctgcaataaaataaatttaacaagttgattttataactttcttttatttcttttggaacctgttattcaaaagtataaaacttgtaacctggtttccaactgtttcaacttatcttgcaaacttggtttactttgtttacttaccttttactttgaatttctaaaactttattcaaattaatccaaaaacttgtgatattaattggatagatgtcttaactccctcctttcacttgtgtttaga

SEQ ID NO: 37330 - DNA, 539 bp, Oryza sativa
gcaggtcgactctagaggatccccagatgcattgatcttttttccttagaaaataggcatgagagacgttgggagttcttttaattttttcattgctgcagtttctgtcctggctggctgttactactatggtgaattgaggcatagagcgacactgcagacctaaccactatggtgaattgaggcatagagcgacactgctgacctaaccaaattttgctacttactctaacttttaaaatctatctttctaaagatggtcgtctcgagccatcccattaggccacatggcagtgttaaactttgagataaatctaaaaaaactatacataaaaaagtagcaaaaaataaaagacacaacctagagacttcccaattatctatcctttttagataaatatagaatatttataaaaaaatttatctatcctctttgagataaatctagaatactcatacaagaagaaataccgagaagcaaacaaaatatctttcccctttgcatctatctatctcctgttgattggtttcatgccagc

SEQ ID NO: 37331 - DNA, 1501 bp, Oryza sativa
gatgcatgtttttgggcctcatcttcgccttcttggcatgttgtcattttgtgtcggtttgggaatttgactagtaggttatttagaatctttattattattattattattattattattattattattattattattattattattattattattattattttgagatgaggttattcagaaacttgatactaccattcacgagcctgtgaaatttgttctcaaactcaaactctcgaagcaagatagttagtgcaaaaagaaaatgaacctgattgcattggttcactaaaccttctacctgtgcatttccgacaatgagcaaagagaaaatatccatgtaatacatgatactactcattgtgacatctggcatttacctacaatatctcaggaatattcctctgttttttttccaagccagaaacgagcagtccacaattattgttcaatatctggcggctggagtttgactaacgagattgtgtcgagtagggtagaattcgcaaaacgtggcgatgatgctgatgtgtttgtgcagctggattggcttttcgctagagacgctggtgattttttttttcttttcacgtggtactgattctttgatggtacagtgcatttggaacacttgtttgttcactgctcaaagggaagacatacaaatagtagaaaacgatgctgaattgctgatgtgtttgtcatagactggaaataacccaaaaaaaacgagataaatatctgttatagcatctactcgagctgttaaattgtatcaagcatgtgctggagctgtaaaattgtataagaaacatatcccgttttcaacaaccagaaaaggagtaatactatggtttcactgttaacataattcggctagttaaaagtctacactgtcaacataattcaattactatggtttccaagtaatactggcccagcatcatgttggtaagttcacaacgctatagcgcctaactccaattcaaccactatacaacacaaccttttgtgtgcagtttctaatctttacttcattagggtctctagcaatctaacatagcatatgtgtaaatgtaaaaggatctatgacatctatgatactgattccatgttaccgtcaatcgtgaggccatcagttccagacacaaagagccatctacaaatgttagacaagctctctcctccatgaaacctcagagatgcgcaggcaccacacaacccgatctttcagataccggaaatgccccatcccacagaaagctataggtggagtgccaccacaaaagtgcaggaattacctggggcagccatgtcatttccccgccaagaaactatctccactagaaaggctatgaataccgccaagcaatgcaagatatcctttcaagctcaccactcatctgccgctgccgctgctgaagaaaaacgcacatccttccttcctagcaccaactcgccacccaattaggccattaccttccaaaattctcccatccaa

SEQ ID NO: 37332 - DNA, 1501 bp, Oryza sativa; identical to SEQ ID NO: 28727

SEQ ID NO: 37333 - DNA, 1501 bp, Oryza sativa; identical to SEQ ID NO: 28726

SEQ ID NO: 37334 - DNA, 1501 bp, Oryza sativa
atcgaatttaaaacatcaaatattctctgtctcggtgtggtgtctctcctctgacggcgatagagtaagagggagagataataagggaaataaaaggaaaaccgtagaaaacaaagaacgtggcttatgtattctagtggattttgcttctagcctacatgtaagttagatttcgtgggtaaacgggcaaagcgggcatgggtagtgattacccatacccatgcccatttacccatcaggcatagcttttaacccaataaaatatctatgggtataaaatggagaacaaatttaatcctaatagggtttttaaccacgggtaaatagaaaaacgggcacaattgccatccctagatgccgccatggactgtctccatccaaacctacgtgtatcttcaggatgagacacgccgacgcgtcatgccgcctcaaaggccgcggaaacccaaccgcccgtccgccagcccagccgctgtgacgtgctcactgtttcggcggacggacgcatatgtgtccgtttcgcaataaacacacgggagcaatcgcatcacgccgacccaaaaaaaaccgtcccgtccgctccgcggcgcttgacaacgcgtggtgcacccaatagctctagcgtgacaagactcctacgccgtcacgcacccacgcacgcacgcacgcacgcatatatgtgcagtgtagcgtgatgtaccacttctaccaactggtggtagtagcattgcctactttcacatacgcgcggcgccgctggtgctggctggctggcgcgcgcaccggcgggcggagagcgaggtttttcgccggtgttttggttggcctccgccgttccgcgcggtggtggtggtggtggttgctgtggtagcgagggtacgctttggagacggagatggagatcggcgccgttgagaacgggggtgtcgtcggtggtgaagttgtggcaggcaagagggggaagacgccgcaaggttggaagtgcatgccattcatcataggtgaggctcccgttccagtgatttctttctacgttttgcgatccgtatagtatgttaacggccctttgaatcgtaggattaagaaaacataagaataggaaaaacgcaggattttaaaaaggtatataagtgtaaaacagaggattacaaaacgtaagaaaaacacatgaattaccgtttgattgaaccgcaggaattggatgagagagataaactcaaagaaaaattaccaagaggttaaagctcatgctaaattttctctaaaatctctataagattgtgcattccataggaatttcaaagaattggataggatttaatcttttgtttcaaatggcttcatagaaaattttcctatagaattgaaatcctctaaaatttctatgtttttcttccaaatcaaaggggccctaaaggagcgaaggcaggcctagagtagttagggcttgagccttagacttgtcttcagaattatggttaaattatcttaaaccaccatg

SEQ ID NO: 37335 - DNA, 1501 bp, Oryza sativa
tgagacatctgaatcaagcccaatcttgactgaataagcatgtgcactctcacacaatccaaggtcaccacaaccagcagaagcctgagcaatgctaatcatagtcacaacattatgaactggtccaaatgaaaacagcaacctcttgaaaaccagcaatgcttcctcaaacagatcgttgtgcactagaccagaaatcaatgcattccaagtaactataccaggatccctcatttcaccaaacaatgcccaggccttcgtaggacgtccacatttcgcataggaatcaagcaatgcggtccgaacaaaaggattggattccaacaggctcttcatagcccacccatggatgcactcagcaagcaccaagttgcccatcccagcagctgctattaaagcaccaaccaatgtgaacgagttggggctcacccccaccctcatcataccaacaaacagcctgacagcctcgccaaacaacccgctcttcgcatgccggtagattgcagccgagcatgcgaccaaatccctaacaggcatttcatcgaacatttggcgaggtcgcgcgcgagcggaacacccacttcctcctccgagccgtttcatcgaacacctaccgcgcacaccatctgaaccctcccccagtcccccaccgacaaccactcaataggttattctctagaccctgaaacgaaactgtttcaagtgacaaaaggtcgcgattcggggattaccttcggtgacggtgccgaaggaggagaaggcgtccgtcagcgaccgctcgtccgcggaccacgacaaccctacgcccgcgcgcgcaatcgcgcgagagagaaagcgtagcaaagcaacaaggtgagaaccatggaacagagtggggattggattgcggggaaggaaacggaggcgggagagcagaggctttaccggcgacgaagagcttcgagttggagggcggcgtcggtggcggtggaggatgcggaggaggagggggcgactcgtcgggtggtggatcggcggtggcggcggcggagagagcgcggccgaggtggcggtggtggtggtggctgagaggagcgaagcggaggcgggagagcagcgcacgagccgccatggcggcggcggagactgcagctgcgacggctgggttaatcgcgagcacggcggcgccgcgatactcaaagtgaaccacgtcagggtcgggagaggaaagaggcctcaaggctgcgtgggctatagcctgagccccgaggactcaagtttcgaagcccaccaagaatcctagcagaccttggctgctatccggaaaaagtatactttgactccctcaactatgacacgagtatgattcatgacctccaaccataaaaccaggtatatcgactccttcaactatcaaatccaatgcaaactatatccttgagtggttttggaagcggttttggctgacgtggcgcctatatggcggtgttgacccggttttcgtctcatgtgtcgcttatgt

SEQ ID NO: 37336 - DNA, 1501 bp, Oryza sativa
gctagttaccccttcagggtttctcgggttttgttagattaaagtttagccattgctacttgcttgcagcgcgcgtgtcggctagaccgtccgtctgcttgttcttcggaaccccaacttatcatttgtattaaattcctatttgcaatatcagattgcttttatcttgttcttgcttgtttcttcgatttgcttgcaggaatagggttgatctgcaccggcaagatcagcaacccacggagaggtgtatcgatcgctaaggcgcaacacaacgtctcgtacggttgtagtcggatcgtcaacgtttctcccaaatcgtagttatcacaactcaccgaaagatcgggccaacaacagccttgagtgtcgagaggaactcagggttcatcacatcgtctccggcaccgcgagatggccaccgcagaagctaaggctgaagacccggggcagaggaagggagtgcggcgcccacaactgcgtcaaatggataggtcggagaggaagtgggaagagagaaaagatatagtgaaagaaggacgctgactcgtgggtcccacatgatgacttagcaaggtggactaggtcaacatgccacgtcagcgaaaaccaccctcaaaaccaccgagggagtaattttgcactggttttactagtttagggttaagatatctggtattgcggttgagggatacgaatcggattgtagggtctatttggcacaactctagctccagctccacctctcgtggaattggagcatagccaaatagtttcagctccatctaaaatgggagtggagcttggtgagcgctctcacaaaataaagtagaaaggtggagttgagtttagactgttccacaactctactccagacccaaccctcggaattaaatttaggagttggagctctaccaaacgggtctgtacttatatttgagggagtcaaagtggcttattccttttgcagccccaaaaatgtgaaaaataatcattgaaagaaaactagcatggtccatggtagcccaaggtttggcatcatcatcagagaaggcaatctacatcacaatatttgcataattagtggatataccccacacgttgcaaccgggaatttagaaatattttaaagaaaacttgtatttttttaaatcgtgtactcgtaatacctaaatggacaatattttgagctctatatagtaattgatgtgaaattgcaattttataagtgtgagagtaatctaatgattattacttttctaggtgtcatggttcaatgtacattaagccttatggcaataaacgtagtggattttaaattcatatggcatatgaatggttgacatcaaagcataggatggatccaaaggctggtattttctatgtgatgttatggcatatgaatgattaagataaaagcataagatggatccaaaggacaatattttatagatgatgtggctcaatgattgttaagcttttggctccaactatgtagtgtagg

SEQ ID NO: 37337 - DNA, 1501 bp, Oryza sativa
taggtggagatattagcatatatgtccaatgtcatgcagtcatcgaacgtatatgcaaattacataaaaaccagtttgcaaaatgcactagtatttggtttatgtatgatattatatagttcggagggttgggtatttggtttaatagattagggtgccaaatggactttcaatcaaagtttcttttgggcggggtgtatttagacttttctaaacttatgtaatatgtatctatacgttagtttctattgtatccaatcttgagtattagtttctttctatgttagattatgattgttccgaagtattttttaacaaagttctataaagtcttgatatctaatctatacctaacattgataaaatatttgattttaagtgttgtgaatccataaaataattagcacaacataaaactaattggctgattccaacttgtcaacagcgctccaattactgcattagcattttgttctaaaggagtaaggttggtttctgcatcaaaggattgcactatccttgtttgggacacaagagcatggcaagttattaataaaatagaaaacaaaataggtaagtctacatgaagtccattttagttcacttttgttctttctgaaagggtcacttttgttctttctgaaagggtcacttttgttctttccgaaaggttcttattttaacattttttttgccttgtcatttcgtcactaggtgggcatataacaaatttgctagtctttccaaagcgagcgatctcaactgttcatcaagaaagaaatttccgtcccatcaagttccctaaattagagaagatatgcaaaccaacaaatgaaacaatggcatttttggtgccatctcaattctccaaagatgtcaattctagcatagtatctttcaatagttccaaccttctggctgagcaactcttggatttagaggtaagacttatatgtattattattatttctgaaaagaaaattatatattattatattaaaaattatgtaaagaaaactaattggaacactttctactatttactaggaaaagagaacccttgaagcagtagagatgattattggagtgaacattcaagaccgggtgaagaaccaaaccatggcaaaggaattgactaatatgaatatgctactgcagggacaagtatttgatgtgatggatgttggtgcagatgaggattaagtcattgatttgttgtttcatccagtatgtgcaatgaacataataaaatgattgaacatatatcacagtagaaagtgacataatccaagtatcagaaagtgcaatcttgaaaatcatatttatctgaaatgagaatgcctattttatttggtattgttgtcctgttaatttatctttgagataattcgttgtatgctgcctattattttattattctattacttatatacaacttctaagtttagctcgatatcatgtatgccaatatgtttggctcttcattccatgcatacctttt

SEQ ID NO: 37338 - DNA, 1501 bp, Oryza sativa
ggaggaatcataagcatccttagctgaatattgtcttaaattcatagtgcaaaaaactggactggtgagtgacctggatgaccccttggtgcacctgtccgacggtctgaccggtggactgccggttgaaccgtggttcaatagcaaatatatacggtgtgtatttgctctaaaatacaagggaacaagggtaggatggctagagccaagcgctctcaatgcacaaacccagtttcgagtccctataccacaagccttcctatgatttttgtaaaaaaaaacagccgcgtgggcctgaaggcaatggactgggccttaatttggcccatttatctccttttacccggttgtaccaaagtggtttagtgcccggtatagtctaaacctagtccgttcagttgttttttatccgggtcgaatgcatgtccggtctttaagctcaaccgaaccatggagatctaaacccggtcggttcagtcgtttctattcgggttgaatgcatgtccggtctttaggctcaaccgaaaattggagacctttggttctagttttttcctgttgaaccaccagcccggtccgtttttttccactatgcctaaagttgagaatctccatctatgaatatccttcatgccgagctataaaacaatcttagaaagcatatctcatagattgagaaaatccgctaggactccaccagaaatagcaccttgaatgtcctggatccaaccatgatctatcattattgcccctcactagaaacccaaagaaagaagacaccctacctagatcaaaaccacacctagtaactattttctaattttgaaaaaaagaatcaagaggatgaaattgccaaaaatacataaattttgtaattttggtattttctcactggattttaaatttaaaatcattttcttgtcccattaaccgctttggcattgacccaatgaattacaaacagatttgaagggaagcaccgaagcaatagtaatttgtaaaatgatttattatcaacaataaaaataaaagtgcccaaccaaaatagctagaagttaattttcttgactaaaaaaggggtcaaaacaggccttttcatacttattagatagatcaggcatctaagggaaaaaaaccagaactcagaggtatatagagaattgagcaaaactcgcaggtctagaagggattagtaaaaaactgcaatacgtaaaagtaatttctctttgccttttgtgatgtatttggtcttgcttatgatcttcacccaatttttatatacgagcataggcttgagaaaactatgccttaataacattttaaaagaataacatgtcgattagatgtaatttattctgcaaacaaataatgaagggataaataacatggatcatgttttacaataatataaaatatcacaaacaaagatgtgtagactccagttggcgaggctttggctactccaaattaatcttgacgattattatgaaaataataaatg

SEQ ID NO: 37339 - DNA, 1501 bp, Oryza sativa
agaaccctttgatagcagagagaaccaactatagttaatatagctggcatatgtgattgatggccgttctagtccctgggtgaattgccattgtcatcactagatatactgtgatgttggcgtgaaggcttttcaggtagaatgacttgatggatttttagctgcagactgatgagtcgaaatcttggtatcatctcatattctgagctgttccccttcctcacaagtagaagagaacaaaagatataccttgttactgaagctcgcaatttggtcagagctggtatttgggatctgctcatcagtgctcctaccgtcctgcgctgctagactgctactgagcctggagaatgctggttcatgcaatgactgaatactaagtgggactctggacagaaggtggtaggactcccagaagcaacatggctgccaagttgagcaactgatcatacatgatgagctcgaaggtccaagttggtggcagatggctttgatatgaggatgatcatctacaggtatttttcaattttcagctcagaaagatcgtatacctaacataccaatacaaaatgaataggattttatgctatgtataggaatggtggccagtaatgctgacctgcaatgattttggtagcacaatagcaacaagatggccatgaattttcaatgttttcatgctgaacagtgagcactgagcactcgtgcatagcaagtggtctaagtggagtgaaggacacaatagatttggattccttcaacattgaatggattagtgttaatgatatcctattgaatcgcttttcatgtcatctcattttccttcgactacagtagtgcataggagttgatcaaggaaatagctcaagaatatgctgtaactctggaagaattgcttggatatccttaattatcacctgctgattgcccgcttacagaatttgtagaccccaatgttgataagagatataatacatataacatcttgctgaagcatgtagactatttagtagtgctcattctagcttagaaaaacttattaggattttcctcttctgtttaatcttttgctgcatgaaacgtagtgcatcaggtgtaattcccttttaaggttgttgctgtatataaatcttacaagctgctccttattgatgctctgtttgtaacccttgtgtaaataatttgatacgttgagaagaacagtaacaaaactagaattcagaagcagagagtacaaaaatacacgtgcaatatcagtatcctggtgagaattatttctctctttccattatatgtactctttatattcctgatcatgattattagttgtatgtagtatactttgttttagtgtcattttctatttccatgctcttatttttgatcctgctatgctaacatctgttcttctcattgggcaaatgctgacactatagggctcctgacaacatgctggcctccgacctcattccagctcaagaacccatagttgccaatgtaa

SEQ ID NO: 37340 - DNA, 291 bp, Oryza sativa
ggtcaggttgaggacgccgccgcagtcgccgccgccgtcgccgtcgccgccggcagccgggagacggaccatcggaggggagcgagatcgagtccgaacgagtttctggggattcgctatcccgagatccccgctgcttagttcgtttctgacgaaaaaaagaggacgaaatttcgcgacgaattcgtcagatattttccgtagttaacactcaatgaagattttttttttttcgtttttgggttttgcgtgaactaatcgatttttttttcttttttgctgctcctcagc

SEQ ID NO: 37341 - DNA, 1246 bp, Oryza sativa
atcaaaaaacacacaaactcgatcaattccacacatgtagcaaaataagggattcgactgctcacaggctatacagcacggagcgaactaggacgaaatggaagggatcacccgaattccgcgacggatcaccactctccgctcctctccggcggcgccgcggccgccgtgggctcgccgcgacgggaggagaacgacggcgaagtcggaataatgcgaaactgcagccgaggcgaaagccgaggggagagagatcccctctgtcgccccctatggcgccacacggacggccaggatcaaccgatcgccgagatcggacggtccacattgcaccgtccgcgacgaacgggcgtgatgaagcggaggttgcgtacacgggccgaggacccatgtagatccgtgatggcccggagtttgggccttattgggcttgaggttttgtggcccgtaaagggaggggtgtatctgcatatttgacacccgcggcgctgcgctataaagagtggctcactagggtttacctccgcgccgccgcatcctccttcgcaagcctcgcctccactccccgcgccgccgccgccgccgccgactcgccggtcgtcaccctcgccccgcagccatggctgagcaggtaaggcccggcacctcctgttcttccgtcgagcttctccgtcgcttgctataggagtcagttctaggtgggggcacgttgccatgtgatgcgcgtgttgcgatgtgagactcgatttctcagttctcgtgatttgggctggaacgctagcgatggaaagttagtgtgatagtgtcatgaatttgttgaggtcttcttgttagatgtggatttgttgaacggtgggtttgttatatccgcactcgtaattctctcgtgttaaattagcaatagaagttttgggttactggatcgaagttttgctgagatatagttactggatcgaagttttgctgagatgttccaatagattaacgcaaccgtggatgtattcgatgtttgggttcattaccgctgccgtgttcatggtaacgaatgataggtctgtgcttaatattcgtgatgctgcagttgtgtgtttgtcacgttttaacctcttttatggttgatgtggagcttatctgctactgaattagatacagatttgtattcttgtttcccatttgttcaatccaaataagtgatgcaagtggttctagctatgttgtgtagagtgttgatgtttttcatccattt

SEQ ID NO: 37342 - DNA, 1501 bp, Oryza sativa
cgagtttcggttgtgaaacatttatcgtgccaaccacaagccagcatgggcaacggctttatcttttgtatagcatggttcattgcggggcaccagactgagaagtggcagagataagcccacgggggtcgctggggagtccatgccttgtttataagggggtgattatgatccaggaaggtgcgctgcagtggattgtgttatgcgaggggtattgtcacaactcctttccgagataccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacacctctcatcattgtaaaagatgcttaaactggtaataatttgtttagctcctggtttggaatggtacattcctggtttggagatagaactgtgcagccgggatggttgttcagaatggttgggcctatacaacagggtatgttgtatagcgttggattaatattgtttaattacttaactgttttatcaaattctcaaatgtttgctaaatgctgcttttgcaaatgaaaccctattatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttattttttttttccgcttagatttttattgattgagaggaactatctacctctgtaatgacattttattcgcttattaattagagtaatatttgtactctattatcaatttgttattgtgtgcctcggctgattcctggacgagggttcacacacatgtaagcgtttggaattttggatagaaattccgggcgtgacaagttggtatcagagcccttgaccctaggttatgccaaatggttacccatagaagccttctaaaaatattggaaaagtagaactgttctcctccctttctcttttaattaaaccaaactaatggcacatgcacttcataatttttttttaatggttctcattcaaaatttattccagtgttattagtactgtacatctattactgtactaatggctcattttatcagcaaaagttttacaatgttgttttatttaatcttgctgcaataaaataaatttagcatgttgattttataattttctttcatttcttttgaaaccagttattcaaaattacaaaatttgtaacttcgtttccaactgtttcaacttatcctgcaagtttggtttactttatttacttaccttttactttgattttctaactttattcaaattaatccaaaaacttgtgctattaattggataaaggtcttaactccctcctttcacttgtctttaga

SEQ ID NO: 37343 - DNA, 312 bp, Oryza sativa
ttagcattatttgacatgtagaatccaagaaaaattccacatgccgattccgattattatttgcatttattaattagggaattagctctaggttaattaagataatttcttcggacgatttatttagccaatttttaaagcaagcaaaggggggaaaacttcagggcgtgacaaacctaccccccttaaacggaatctcgaccccgagattcggaagagctggcgaagaggtgcgggtgggtgccttcaactcatcttctctttcccaagtggcctcttcctctgagtggtggctccactgaaccttgcaga

SEQ ID NO: 37344 - DNA, 352 bp, Oryza sativa
ttaaatattagaattggtacgaatgctcatatttacggctaattatttcttcggtaatatgcgatatacgtattgatatcgagatatttgtgatgattttgttaatctcaaaatataatgatccgttttttaaatatgtttataaggataaatgtacgtgtgttttgagcatttacgtttgtaataaggactcccaacctttcaatcaccaacagctcaagaaaacagatcgtggtggcaaattaaaactggcaaggctttagcttttgctgatgcagaactccgctacttccgaacaccatacgccggtgtttaacatcatctgctacagtacccccttatcacttgtagc

SEQ ID NO: 37345 - DNA, 366 bp, Oryza sativa
caaatctgacagacagaccttgcaaaggcccattaaagcacaattaactgggcctgaaaagcccagcccgtccactctgacgattctacccctctaaccctacaccggccagcgactatataaaagcggacccgtctcgagccgctagggttcttcgatttctccctcgcgccgccgcctcctcctcaccctccccgccccaggcgcaccctacgcttggagctcgtccgatccgctcggcgcccgccatggtaaacgcgcgaagctctgaatccatcctctgttcctcgcggtctcgcgtgcgtgccgtgctgcttgctggttgatgctaatctcctcactcgcgtttcgcctgtttgttgttgc

SEQ ID NO: 37346 - DNA, 1501 bp, Oryza sativa
aagatatttaacttaaaacaaacctgaaataacttataacatgaaatagagaggaagccacatttatgaagtttgatatatccaaatggcgacgagttggcgggaagcaagttcttgagtgcagtggagctgcaagatcgattatcagatggagtactcaaccgaaacttaatggaacaggatgagaataatgctagctacacgatatggtgtactaaactcaatgtttccagagattatcctgtctttgatgtgaagctcacatcaagcaagatcagtggtgcccccacaaacttttacagttttacctgatgattgctcattgctgcagaaatgtgcagggaattttctcatcattgatagttttcaggctagcgatcgtcgtcaggaactaaaatccggcacacggccctgaaggctgaattcagtttggcgtgcaacctgaactattattatctctgcaacaattttctccagtcattttcgtggctacagtcaccgtcagctttgcagtcaacccccggtcgtcttcctcgtctccatctccgtctgcggcggcggcgaggagagtgcgcgctgcgcatttgcggcggcgacggcgacatgcacgcgcgcggccgtggagcacgaggccggaaaggagcacggaatgggtggaggcaactcggcacaaagactgtgaagcagccaagcagcagcagctcagcccagcctgagtgcagcgtccaccaacacagcctgtgcttcttttttgctcttccctgctgcaatcagtttcatgtggtcatatcaccaattcatcaccaagataatatttatcccaaaagcaaaactttacctttcgaacagtggcattgcttgactcgccacagttttacacaacctattcttcattaattaacgagtacattattaaaaaaatgatattgcttttgtttttttgttataacagcgagagcaacttttacggtggtctaacattccaacaaacgtttctattataactagcaaaatatttcgaacagcaaccacaaactaaactgggccacgctgttcgtgatacgaaagcgaggataatttgctactactactagtatatgaaatggaggcacaccgaacacgatacgtccgtgcgaagcttagtgttcgaccctgtgaaaatgattgcaatgtcgacgaacatgcatgccacccatggatcacactggccatggcttattagctagtagctcactgtcttttcacttcctttttcttgctaaactattattatcatttatcttaagaagattcttaattagtgtagctttatgtcgatcgccttcgatcaaagagcgagctcaaataccatggcctccatcgatggacatggacgactccaatatgtatataatgtatccggtccattgccaccatcgccatgaacgagtgcaatccactcgtgtcatccactcactctcgttgctcttcttaagaggacgaagacgacgacgtcgaacac

SEQ ID NO: 37347 - DNA, 1501 bp, Oryza sativa
ttaaagtagatgtggcatatagatgagttaaatttacatatatatctcactttgattactttccatccttattattttatgctccgcatgcagacaaatggcttcagacgactaccgtctccaatttacttccaacctggagagtccccttttcaccggctgtcaaataaaactggaggttcggatgatcaactccgatggaaatgtgatcaaatccggtccactctcttcagcaaaaatcgagcttttggttctacgggacgatttcgcttgcgacgtcgttggtaactgcaccacggagcagttggacgaaaaggaagtgaagacccgagatggacatatttctgtattgaaaggagttgttgctcgcaggcttgtcgagggaacttgctccttccctggaatccagtttagggaagggagcttgagaagaaccttcaccattgcagcaagagttaataggaacgaggccactggaggccatcgggttcaagaagcattcatgggtcctgtcgttgtgcaaacaaaccgaaacaagcgtaagttttttgagaaattttacgattattgagaaagtatctctaggtaaaaatttttgatgtggaatatattgataattatatattaaatattataaaaataatggatagatatgttgatatattgtgaaaatgatgtgagctgtgttaattggatatacttacatgttgatttgtagaattcaataaattataaataatgttgcatgctcgtatgagatttgatatgtaattattcctagtgaataacgatgtggcatggtttgcatgttaagttttagattcagtgggttgtaactttatagaaagtatagatcatgggaacaccaatcttaaaaggtcactgcgtagcaaaagattccactgatccacgtgttattataagtttataactggtgttaaacacctttaattcttattatagtagtatatatatcttcagctacatattttttttcttgcagcaaatgcaaaaagtaacgccccaaaattcgatgatgagatatatagactgaagaaaattgcaaagaaaggaatatactacccgaagctccgatcatagaacatcacgactgtcgggcattttctaagggcttacaacaaaaatcctgaagagctcaatgatgtaaatatcccattttatgtttctctgcattcttatattatagtcggaatctaatgcatctactcttttaaagaaatgttagatctacaaccttttctacttatatatattgaaaaattttacagtttttaagaaagtgcctgctgatactaagattttacgctaaaaattttggtattaagttttacactagaaaatatgatgcctctcaataccttctcaaatatgataaaattatccatatatattacaaagaggacaagttttcctatgcggaagtatttttgtgctggtagtatatagacatcctcacataaaattattaattaatatgatt

SEQ ID NO: 37348 - DNA, 1501 bp, Oryza sativa
cttggaatttattgttcgattaacgtgataatttatatcctttagaataaatatggcacattcttttcgagttgtcttaataataaagatttctatgtttcttaataatatatatagataaatatacatatttggcaaagaatatttacatatttattactggtattacatttttattctaaattttatttttaattgtatcgcttaaggtgcgcacctggctagctgctgtgcacatgccatcgttccttctgtttgttaacgtgcatcgtccaattcctgctcatcgtgcagccgcggggctcgacccgctgctgtagatttccgttgctactatacattatagcctaactaatctagaacctaacttaagtttaggaaattggacaaaactattttgagtccgtttgcatgtaaaggtcctggttagagattgattctaatgcagttaacatgtcaagtttgtgttaaatctcacacattgaaatctatgcctcttacaatccaacggtgtaaataatttatatttttttcgattaacgtgagaatttctagcctccacgataaacgtggtgtctttttttgagctgtcttattaatataatagataaatagatgtgagaaagttttactagctttttttgaagaactaaggattcttgtaggtgttttgtgtttgtttataagatgatcaaagttaacagattttatggaccttgtaatcgttttctttaatgaaaatgggagagggctctgcctcctctttctcaaaaaaaaaaaaaaaaaaaaaaaaacaattggctcgtgcgggtgcaagggtccgatttttggggtcagatcgggcgcccacattggagcattttcgctgctgctggccactaggtggaaatcacatataattatataaaggaagaacttttaaagaggagtgctcaaaacatttggtcaagtcaagaaaaacaggattcatcaggctacttcgttatatcttgtcacttttaaccatagcatgtatatctacgtacatttgttttcatgtgaaaatataatatatattacccttcaaaaaaatttaaacgtataattctagaccacaaaatagccagtggtggagaaaatagtaataagggttattaatatgggaaaataggaaaacatgtatcaggaagcatgactcggcaagtatttgtgtgcaaataatgcgatcaaaagtgacaacaaattgtaaaccgggggagtaatatataagtatataactatctacacatatacgattgacagaaagtgtctgtgtgcttttcatgccactactcagtgatattcccgtacatattaatctatctaaaagccggatcgttggaatattaggggcgccacacaacgattgtgcatcttgcatttttattgatgcactagttgttattactcctgaatggaacctccaccgagtatacaagacagacacatagacaaagagactaggaggaggagaagaagagga

SEQ ID NO: 37349 - DNA, 1501 bp, Oryza sativa
tatattactcccccggtttacaatttgttgtcacttttgatcgcattatttgcacacaaatacttgccgagtcatgcttcctgatacatgttttcctattttcccatattaataacccttattactattttctccaccactggctattttgtggtctagaattatacgtttaaatttttttgaagggtaatatatattatattttcacatgaaaacaaatgtacgtagatatacatgctatggttaaaagtgacaagatataacgaagtagcctgatgaatcctgtttttcttgacttgaccaaatgttttgagcactcctctttaaaagttcttcctttatataattatatgtgatttccacctagtggccagcagcagcgaaaatgctccaatgtgggcgcccgatctgaccccaaaaatcggacccttgcacccgcacgagccaattgtttttttttttttttttttttttttgagaaagaggaggcagagccctctcccattttcattaaagaaaacgattacaaggtccataaaatctgttaactttgatcatcttataaacaaacacaaaacacctacaagaatccttagttcttcaaaaaaagctagtaaaactttctcacatctatttatctattatattaataagacagctcaaaaaaagacaccacgtttatcgtggaggctagaaattctcacgttaatcgaaaaaaatataaattatttacaccgttggattgtaagaggcatagatttcaatgtgtgagatttaacacaaacttgacatgttaactgcattagaatcaatctctaaccaggacctttacatgcaaacggactcaaaatagttttgtccaatttcctaaacttaagttaggttctagattagttaggctataatgtatagtagcaacggaaatctacagcagcgggtcgagccccgcggctgcacgatgagcaggaattggacgatgcacgttaacaaacagaaggaacgatggcatgtgcacagcagctagccaggtgcgcaccttaagcgatacaattaaaaataaaatttagaataaaaatgtaataccagtaataaatatgtaaatattctttgccaaatatgtatatttatctatatatattattaagaaacatagaaatctttattattaagacaactcgaaaagaatgtgccatatttattctaaaggatataaattatcacgttaatcgaacaataaattccaagccgttagactgtggtggaaccaaattagaatggtgaagattgataacagaaatatatgtaatataagtgtatctttagaactaaacaatggtatatagaggagtaagtgacagcatttgatgaaacttctaaatattataaaaatgaaacgaaacaagataataaactctaaaaagtataaggtccaatttttaaaggtttgggactttagaaagtaaaaaaaacaatgataataaagttccaatttaaatcacaa

SEQ ID NO: 37350 - DNA, 1501 bp, Oryza sativa
gcaaaatataggctcatttgcaaaagcagcatttagcaaaacatttaagagaagtaaaacagtagagtaattaatcagaaattttaatcaacactgaacagcacacccatgctgcacaggcccaaccatcctgaacaaccgtacccggctgtacaaatctaactccaaaccaggagctaagcaaattattaccagttaatcatcaataattattgtgagaggtgtgagactaatcacgaaaaacattgctcaactcgcccataaccgcgggcacggctattcgaatagttttactctggccagaggtgtaccactatacccacaagacacaacctcaacatcatgtcaaccatgcgtcgcgatactggaaagtacccgaatagaggctgtgacattaccccctacataacacaactcaccacagtgcaccattcgtggatcataatcaccccctctacaaccagaggcatggactccccagcgacccccatggacttctcgcctcttcacagtctggcacactataatgttcatgctatacaaaagataaagccgttgcccacgctggcttgtggttggtacggtaaatgtttcacaacagtagctcgcaaaccggtcgttaattgtcatgagcgcaaccatcaaaaaccatgtgctcacaacccaccattatcaggttttagttggcacgttaattaattaaccaatcacgattgaccatcgtgaactatcattaagccatcattaaataacagtgagtcataagttatcccaatagtgtgctaatgtttctaagcagggctgagcaattatatctaatatctagttgaaccaataaataaagcccaactagtcaagttataataacccaaggtatcaaggaataaagtaatcaagaacaaaagggctataacaaacaataggttaattccacccaatgacattcgaaaataaatgcaatatttgaatagaaacaatagctttaaatatgatcaacatgctcaaagggttgtttgggatctgtgtgacttgccttgctggccttggaactcttcaaactcttctccggcgaaaacggactctccggaaacgacggaatctaagcagaaaagaacaaaatcaccaaaacagcacataaacaagcatgaacagtacatgtggatatttttaacatgtagatctcaattttagaaacaattagagacttgaaccaactaaatcggagctaagatgaattagttatgaatttttaaagattaaatcggattaaaacacttaaatcggtttaaattgaattatgacgcaatattgaattatttttgaaaaggaaaagaaggtttattgcgtcagcgggctagggtttcggtggaccgggcgcacgggcggcggttcacgcgaacggacggccgagattcgatccaatccaaacggacggccgagatcgatcgggtccacggcggttcacggcggacggccttgatgacgtcagcaatgatgtcac

SEQ ID NO: 37351 - DNA, 333 bp, Oryza sativa
tctagagtggttttctttaggaacattggcattgttaatattttgcatacatgctcaagccgattacttacatttttagtttattggaatatatgcatgtgacacatatgactttggtgattcattattgattatgcttcaattggctaagtgttttgatgtcatgatgattattgtttcaaaagccaattgaattagtattcatctagacatattagttgaatgttataatttttcatatgtctatagagaaggaattttggtccaataatttgatataccaagcatctagctattatgtgaaaaaaaaaattatatactaaaggccgatgc

SEQ ID NO: 37352 - DNA, 629 bp, Oryza sativa
cctgtaattagacttatcatataagattgtgtagtgttctaatattatttgagttttaatataagattactttatttgtaattagacttagtatgtaattattgactacggaagtggtgcgacaagtagcaattgactattgtagtcttaattagacttagcatatacgcacgaaacacttagcatacatgactattttagtcttagcatgtaatattatttgagttttaatataagattactttatttgtaattagacttagtatataattattgactacggaagtggtgcgacaagtagcaattgactattgtagtcttaattagacttagcatatacgcacgaaacacttagcatacatgactattttagtcttagcatgtaatattatttgagttttaatataagattactttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacaga

SEQ ID NO: 37353 - DNA, 1501 bp, Oryza sativa
gcgtcaactttcgccttcttcgttgcccttgtgtgggcaggcgatggagctggggggggcccttgactttgaaggtgccggaagaggagcttgcggaggagtaggtgtaggagcccgaggaggagtcggtgcaggatcctgaggaggagtcggtgctggcggagcatgaggaggagacggtgcaggatcttgaggaggagatggcggagccggaggagatggtgcacgagacgccgcttgtcgcccagggaggatgatgtaccgcctgcgccatagaataatggcatggcttgtgtctcgtagatgcgtctcaccgtctcctccagggtaatccagctcgaggtcctcgtacgcgccttcgaccaagtcaacttcgaccttcgagtatcctgctggaatcggcctgcagtggtaagtacctgaagggtccgttgggatggccatgcccgacgccaccttcatgttgtgagagattatttattagtaatcaacatatataagcagcaactagcggaatggctaaatcttacctttattgataagttcttcaaaggaatatgcagctcacatggtgtccgctgagtgatgtcatcaacgggacaggtcgattcgtcctgtgtttgcatggcgtccatgctctgtgatcctacctgccccgttgaggcgcagctgctacggtttcctgacgggctcaccattgcaggaggaatggtcggctggggatcatgggaccgatgtgcggccatgcgttcatcaaccttccttgccacctcctcttgcatgttgagttcgtagctcgatacccggaactctaggtctgcaatcttcgcctcggtatctctcttgctcctcatccgactcctgtacgtgtggatgtcctccttgaaaccaatcttccaaggaatcacccctttccctcgtgttcatcctggatgctctggagtctgcagggcgagtgtcagctcgtccctatctctgtcgggtcagaacgtgccctgagaggaggcttccactgcatctgttagtcgtcgcgcagcctctcgtatctgaacgccgaagaccagtgagccatcagctgggttgagcgttccaccgtgagcatagtaccagaacttcgatcgttccggccaattggctgttgccggttcgatacccctctcaatcaagctagcctccatctcctcccacttcggcatcgcgacgctatagcctcctgaccccaagtggtgatggtacttcttcttggcggcattttctttgtttctttccatcatcgcctgcccttgttcacctgtcttatatgcaacgaactcgtcccagtgatcccttagctttgggaatgtgtcgaagttcggtgtctgccccttcagtatatacttctggtacagatctcccttgaagctctgaaactgttctgccattttcttcagagtccaccttttcactttgtcctctgtacccgcaggaagggtgaatgtctcgagcattgtggtccacagca

SEQ ID NO: 37354 - DNA, 1501 bp, Oryza sativa
atttaaaagtaaatgttataaagcaatctataaaaaaaccataaaatcaactccaaaattaaaatttaattttggcttctaggtataagcataaacgaaacaattggacttaaaaaaacattgtcaggcgagtttttctttagaaaaaagaaatgctgcatgacagcatcccattccgacgggatgacacctcatcttgtccaaatgtccaaatggggtatcaatcgatacctactggatatcatacgatatttgcgaggtatcatcccgttaaaatggggtatcagttgatacctactaggtatcatacgatatttgtgaggtatcatcccgtttgaacgagttatggttcaggagcatttttcgaaaaaaagaacatgggcaggagcaatcacccaacttcctggaagttgcagccttgcaggtgacgcggctagatgggcccggagggagcacgcggcgcagcctctcgtggacgaacggcccatcgcacgaccagagcccacagggatacccggcgcgcaggccggttaacagagatgcctcgaacgcaggtgcaggcctggacttgtgttgtagccctgcagcccgcaccggaggactagcgattagcgaagccgcggtcacgcacgccacgcgttcgatcgatcgatcatcgatcgcgaaaaccctgccactggagaaatcctattcattatcgcctagaaattcgattgttaagcttttatctgctaaatggagtatatgactactgcatgcgtcaccaagataagcataacgtacgtgtgccgcttcggtgctgctgcgttcgcgaaaaatcattgcgttcgtttcggtgctatgctgtgtacggccattacggtgtaccgtcgccgcacatatccacccacccagcacacagacagcagcgacacaagttacaacaatatccaggtgagctgggggccatgaacctacactccctagccactctcacgccagcgccgcgacaaccacccaagtttggctagcttcccaaccctgacgtcacgtaagcttttgccaattccgccaacgcccacgcccatgcgcgcacccgtctacgcggcaccgcgcacgcgccacccccctcgacgtgtcctcacaccacctcgtccctatccatgatcgcgtcccgcccgcgcgccgcgcgcgcgcgcgcgtccttccaaacaccaacccgcgagtccttgagtcctttccgttccgattcccccgtataaatccccgcgccaccgtaccacgggctcccgcatccatcgttctcgctcacttctcacaaacacaacaaaaaacatcgtcgcagacaaaaacatcgtgcacgttggttgcgtgtcaatggcggctcgttgtccggtcggtgtggcctctgtgctgctgctgatcgtcttggtcacggtggcgtccgcggcgtctggcgcgcgatccggcggcggcggcggcgggggcatacgggagttgcggggcggcggcgcggggagga

SEQ ID NO: 37355 - DNA, 1501 bp, Oryza sativa
gcagtgaatgccgttgcactgcctgtctgatgtacgcctagctagcatctctgcataaaatcaatctgataatatattggagttggattggaaggcctcctcagccttgtcctactgctgtctctatctctgggtacttatcatacagctcaaaagcagccacaaatccagtcccccagctcacaacttgattgttccttctgtccatgtccttttacatgaactatcttctgggataaacagattctaaaattcaacttgttttctgacccctcaagtactaaaccagaatttgcatacagtgaacttcagcatgaacacatctcttccgagtgaaaaaaaaaatgaagttcagcatgagcacaatgcacaaccaagaagctgaccattcttcagaggggaaaaaaaggggataatttcagcttaaggagatcgatccatggacaggaagaaggatcttaaagatatatatcagctacaaatataatgagaatacaaataatgatattacacgtcgtccctctctgcttgagagggtaaaagggtctgaatgaagcatcatatactgcacccgacttatgtacgatcttgtagcatacatatatatactacacccgactaccgtacatggtgcgtttcatttttgttcaaagaatcattacaccaagatgggaaattagaagctaaaacactgctagggcccaacattgttagggttgaatctcagagtgctgccgcggcaagctgacttctctgtatgtacaatgggcgtcagagctttggatcgaacctttatttggtcatgtcaaagctccattttcatgtggactgtttgcaacgatcctgatccatagcagtttacacatcagaattcagttaaggtgacgttaactatggcatcaggtaataggatgaggaaacttgcctaccattgtagctattggaagaggtggcgatctcctgactttgccccatatccatctgaacaacactttggagatcatcttgccagaaagcaccaacctgtaaagcattcattcctcatattcagcatcgattcattcgaacattttgtgagatcgagacattggtgtgcatttttacctgagaagccgcatcgctaaccccattgaggaaaggatggtgcgagcccattggccggcaaaatgccgggtccaatgggtgcatagaaccctggttgtccatgccgttcgtcaggccacaaccgagagggttcccttgctgaggctggttaatgtagggcagcggcgcacctgaggtctctagtggaaaatgtgagctctgtaacgggctgcatgactggtgcatctgatcagggagaaaatcggaaacacgaggtaagttgggaactgtatgattggcacaataagagaggaaacaaatgtagtaatgagatcgcataagcttgccctcacatctttagcaaggaggttaggcaaattgttgaagtccagctggggattcacagtggccaacttca

SEQ ID NO: 37356 - DNA, 1501 bp, Oryza sativa
attgaactaaaattttggcctatacacatgtattgaggcccaccaaaacgaggcctgtctgcgctttgggatgagagctttgcccactgaacacagtgggccgagtattgctgatcagtggattgtgctgggccgatccgggccgtcatcgaatacgtcaatttaaaatgttttgggattgttattgctaggatggagttgtcgtgtctttatcgacaaagactttaaaataaaaaaaacgatctaaataaagttataaacattatgcatcttgagtgcttattggaaaaggacagctgaacattttctcggcgtattgatctcatgttgttgctaatataaaggaaaaaagaattcgtattactgcttgtactcgatataaatttcataaaaaccttatacattacttagtactatgttcgtttcagattacgagacgtttttacaaatcaaactgttttaagtttaactaagtttgtagaaaaaatagtaacattttttaactcaagacaaatttattaagaaaatatattcaattattgatttgatgaaactaatttagtattataaagagggtgtgatcggtaccctcttttcccaacccctctctctcgttttccgcacgcacgcttttcaaactactaaacggtacgttttttttgcaaaaagtttatatacgaaagttgcttaaaaattcaaattaatctttttttttaaaaaaaaatagctaatacttaattaatcacatgctaatagatcgtttcgtttttcgtgcggaaaggattagttcccatccaaacacaaccttagtcaaacttgaaacagtttaatattgactaaagtcaaaatattttataacctgacacagagggagtagctaatataaaggaaaaacaactcgtatattactgcttgtactcgatgtaaatttcataacgaccttatacattactacctcgaaacattgttcatgaattaacgtaagtcacaatattattctcttaaggattacagaagcctaagttttcttggaggaaacgtagaggagtttttaatcaaggtttccttttcgttacgtttcgtgcgcagcgcgtccaagtcgtataaccttttcgttacttaaaaaccaacgcaaccccacaccttttctcctacccaccacccgtctccgcaacccacacatctccattgcgccaaggaagaagaaaccctccccctccctctccccaatccaatccaatccaatccggcgagtcgcgtgagtttccgctcccctcttccgtcgattcggcatcgggttcgccgatcaggggggcttccttgtccgatttggtggttgattcgtgtttttgctcgtgttctccaggaccagctcagtctctcgtaagggtttgatcgagttgttgtgtttcgttgcgcgattggcttcgatcggtgtgtttctggtggttaattttttggggggcgctgatttggtgattgtgtgcaggaaggagcgcca

SEQ ID NO: 37357 - DNA, 168 bp, Oryza sativa
ctgattcaatcaagcaagccatacaccgctgatgacatacatgcattaaaaatcttggattacaagccaggtttatcgttttaaattctttcgcaaattagattaattcacagattactaattattgtttgatctgttattgtttatgcatgtatgtcggctgctgtc

SEQ ID NO: 37358 - DNA, 359 bp, Oryza sativa
cagcaagccagcaacagcaacgaacattctccgttttcagttagatggtttctgattacaaaacaagagttaaaaaatgtactatttttaatatatcgcatttggtctacagtatatacattattttatttatatttggtacttaatttaagcctcacttagacctttgtacatagccttcaaatttgacggcccagtcctgctaccaagtagctagtagctagctaggcggctactagctgctgcgtggctactggtgtccgcccggcgtggcgaatccggtggctggggtcctaccacgaggccgtcgttcaggcatgccgatgttgatacccccacagcgcgaggcagcgcagcga

SEQ ID NO: 37359 - DNA, 1501 bp, Oryza sativa
caaaacatagaaattttgaaggaattttaacataaggtctaacctcttgaaaaaaaaaatcatttgtgcttattcttctctctttttgattccaacgcttttcccgtgctccatctaaacagtcattcttgtagtttttttttgaactttttcaattcatatggtttgaagtgttaggaccttccaatcttgtatttttcatttacgtattttgaaaatcatatattccaaacgagcccttagaatgctaataactttcacctatgcgaccacacgtatatgcattacaatttttactcgattatatggatttgttttttttccttcaactctgtcccctttagaacaaaggaatttgagaaaaaatttgatagattggatcctatgtaaccatttggaacaaaggaataattgctcaaattcctttaaattcttttagattgtgtcaagtcataggaattatgaaggattatcaacatgaggtgccacctcttgggaaaaaaaatttctgtgtctgtcagtctcgtttgattcctatgtttttttttctactcaatccaaatgatcatttctactgtttctttgtgtttttttctatctgtaggatttaagataacaagacacttgaatttaaaggagccattaagctgatgcgttccaaaggagccattaagctgatgttaaaaggatatttttcatgcattcgtattattttgtgtgtacatgtttttatataattggtcaaaaacacttggaaaaaagtagccagcaaaaattatgatatagttttttaagcaggatgtgcaatttatggcaatttttgtttaaccagaagataaagacaagtgcacccttaaaagtaataatagttttaaagatggaagcaactatgtcatcaatgttgcatttttatcttcttttgtatgaaaggacacctattaataacaaagaaaatctagttgcgaaatcggtcatgaaaacccatagagtataaattattgtgggtcctttcttgttgtccctcttgtcctgtacgtaccaacaaagaaaaaacctgccttgtgctgagttggagagctcacttcatttgtctgcctcttgatttcgaaaccgttctaaatgctatgcttcccccagcaagcacacttgggacatgagggtacatggtggtccattcataaccatacaaatcgatgcaatgtatatgcatctgtaaaggtagttatggcccatgttcaacaattttgatttgtgcttgcctcatttttggtttatacctccttgacggagcgtggggctcctcaccgggagaccgcgcaggcccccctttgccggttcggccgggggcgctaagtgaggttcttcgccctcgatctgaggaacgtcagcgagagaggaaatgcacaagacacgggcgacgtagacaggttcgggccgctgagaagcgtaacaccctactcctgtgttctggtggatctgtgcgtgaaggaatacagagagc

SEQ ID NO: 37360 - DNA, 1501 bp, Oryza sativa
acacggcggcctgggagatctgcttaactccagtgcaggtccaaggctagcctcgagtgtgtccagggcgtgctagctgatttgatcctgcaatcagcaagaaaaaataagggcagaatcagtcagccgatagccgatcggccgaaatgccaatagagtattgttggtggtcttagccgatggagtcagaccaaatcggctatggattgagtatatcaaagaatattaagctctaaacatgcctaatcggctgtaataccatctatcaagtttaataaattggtttaagacaatattatgaaaataatagatgtgacaatgtttagagcaagagagataatgcactagctaatactctagtacaaatctatataaatttactctaaatagattgatccatataaacacatcaaatagaaataaggcatgagggtgcaaggatctagctgatactgactaaaacttgatatgcttatataaaacgatctatctatataagtggcgaatatacatgaaacaggtattgaaacatgcatattaggtatgatcagctgaaaccccgatatactatcctcattatgcctaattgcaggctagtttgcacggttcaaagcacgactagggatgatgcatctcaaagtatgaaaagaaacatgcagtctagataatcaagcaattaaacacttttcaggatgatagatgccttagctaatctaatctagcaagacaatttagccaaaaccagcataaatcctaaagcgagaagcagccgatagagctaaattgagaagctaataatagattaactaaaacatatgaagcaatgactcacgatatcgagcctaacacgtctaaagcgacattttagcctcgatagaacgggccattgagatgggttatctcttgcgaagaactcgccaaaaacgagaaaagtaaaagggtggcgatgcaccgaagttgtattggattggcccccatattataatgctatggggttcatatttataccccgagtacaaacttagtctattatggacacgactcaaacctttctaaaattaaggtacaaacaagaccatatacgacggtctcttgccaaatatctaacaaacctactcaatatcctaactaatagatacaattgccttatccgagctctatctctaactggcaatgatgtttatcccaatctaggcccaagtcgagcccaagtcatgttgtatcggccgtatcggccatcagacttctcaacttgttcagtcttcaacttctatttccagccgatacagtatccagccgatgcgcaatccaatactgagtccaactcgattcaacaccaaatctgtttcaatcttccttcttcttctctgaatttgatgcaaaattccgttgttaacagtaatagaccagacaactttccgctaggcaagtaacatcccccacctcagaccaacaacagggcaaaaagtaatattcaaagttcaggcttaaggtgaacagg

SEQ ID NO: 37361 - DNA, 406 bp, Oryza sativa
atagccgagccctcggttatgggcaagccgagcaatgtacccaagttagtgttttaattcttaaaacttgctcaacaactaaaatgtggaatggttggcctgggttggcttgggacgagctgggacccagggtcgggttgccagttcggtctgaatcatcataggccttgggttaaggcaggttcgtgtgggttcacggccttgattaataacattgtgtaactctaggatcgtccttataaaatggctttgggcaactaagtgacttttaaatgctgtttactgcaaaacttaacccctatattattaccccttgtacccccttgcattaatcatgcatctgccggtgtggcttgctgagtactgtggttgtactcattcttgctcaatctttcccctcttcagt

SEQ ID NO: 37362 - DNA, 403 bp, Oryza sativa
ggagggggaagatgggccgagagggattcggcccatcgaacccgagggaggcaaaatagacttttgcggagggattgatttgggaaggatttggattcaggattgaactcgacgatagattgtggatttgagatctgagatggcacggacactagacagcaagcaaagaaacagatttcgcaaatagggtttttaggagatagttttcccgctaggcgccacaacggaacgggcgctacagaatgatagtaaattaaatgttaaaaactctaattaacatatgaaattgccacctgcgtgatttaaaacttttaaaaattgtaagtatcgcatataactagcatacacatgatttaaacttgttaaaacctctaataatcgtgcgtaattaacatatgccata

SEQ ID NO: 37363 - DNA, 799 bp, Oryza sativa
atgcagtgccgccaaatctttaaagcatgtatttttgtggtcaattccagaacgtgcgtggggtggttgccttcatggggacgcaactgccgtgaagcataagaaaccactttgccatcctgcatcaacacacattctagcccctggggagatgcatcacaatagacctggaaatctttcgtctgatcaggcaggattaagactggtgcagacaccaaccgccgtttgagttcttcaaaactcctattgcattcagcagaccagataaacttttcttccttcttcaatagctgtgtcattggcttagcaattttagagaagttctcaatgaaccggcggtaataacccgcaagtcctaagaaactccgaacctgagtgactgtccttggtggggtccatttggtaactgactccacatttgctggatccacagctactccttgagcattcacgatgtgaccgagaaactgaactttcttaagccagaagtcgcacttgctgaacttggcatatagctggtgctcttttaacttttcaagtaccagccgaagatgctgctcatgttcttcctcggacttggagtagataagtatgtcatcgatgaaaaccacaacaaacttgtctagaaattccataaacaccttgttcatcaaattcatgaagaaggcaggtgcattagtgagtccgaaagacataactgtgcattcgaacaacccgtaccgagtgatgaatgctgtctttggaatatcctcttcgcggatcctcaactggtgataacctgatcgcaggtctatcttag

SEQ ID NO: 37364 - DNA, 1501 bp, Oryza sativa
ccaccgcaagcatgtttcatgtttgtatgtatgcttcttttttttttaaagagaagtttgtgatgtggatgcatgatgcatgtacttggtcattagattgatgattaatgattattctagctatcagccagcaactaacttcctgatatgtatgataattgactatgtctctgaaggaattccgtaattgactccttgaatgatgaatgggagattaagtacactgcgtcctacaaatataatccactcgagtggctgagatggccacatgtttcaaatactagacaattcgtgtacatatttcaagactctgccagtatgagtgtgttttgtccctgtgtaggcacatcataatttcagtgtggtacctgttgtgcatattttgcaggaacatgaaagagagaatctgacgatcgaggctttttctttcggttgtggacaaggctagaaccagacaggtatcgcaaacgtctttcttcatgttcaggttcagttctgaatggacaattccggacacagaaaagttgggattcagaagtggtctactgaaattaagtcggaaacatgtcgtttgaattgcaacagataacggatataccagatcaagcctttggcagctgcgagataaagactatacatatactaccagtagtacatacagaagtcgtcttttgtcatcggcgagatgcgtgcatgtatattggcaccatttctctctctccatcacctattccaccaagaatgatctgtctgaactcgtcgttagttagccgatgaaactctccacattatattaatacggctcataattatagccaaattatttttgtttaaagaacgtgtcatcacgcgagaaaatggcaaaaaaaaatcaagccgtggtctccagcagtttttgccaaattcaaaccgtgttagctcctacgacagaggccggccggaccaccgaaacggtcactgctctgcctcgacgtccgtaccaccaccaccggtcccccctcactcttcctcctcaaacgcgcaccatgtcacaaggtgcgcgaggcggaaagacgaagcggatggggggcgcgtgtgcgtgcgtgagtgaacgcccgcattgccgcgtacgtaagcaggtgacggcgacgccgcccacgaattacgatttacgatacaaagccacacacaacacaacgacaaggccatccaataccttgagagacaggggggcaaatattccgccacttgccttgattctgcttgctgcggctgctgccccgttgcttgacgtctacagcactgggagagcaccaaccgcgcatcatacgcatcaagagcagagagcgcgcagagggagaggggtgaggaggagatggctgcgaagtggcaggaggcgccggcgccgggtgtgagggtcctcctgttcgccgtcgcggccgccgcgctgctgctggtcgtgtcggcacggaaggtacgtacgcggtacgcgcgctgtttaattagttggaggggggaattg

SEQ ID NO: 37365 - DNA, 1501 bp, Oryza sativa
tctacgatatcaccctatctcaatatttggatcccacaatttatactactacatatttacatcatcctccaacaagttcttttccgtttcagtgttggttatcacctaaatttcaaaatcacctacttgttcaatataaaaataataattacatgtgattgacttaatatgttagaaactcaattagctttccgctgcaacatatgggctctcggctagtgtagcagtagtgtttatttgatgccagaccgccagtgtttatttgtggttgaggtataggattcaaccaaggacaagagccgagggaggcaaaatagacttatccttctttctataaagtgaagaccaaaagctcaaacctcgtgcttccactcatcatcaaattgtgaaccgtttgatgaatgcattagatcgtttctcagacgttggatggaatgcagcatagagcccaactcattagttaccgagtgagtctcttcgcctcctcagtgccaaatatagcccacatgaacacattggcccatctccatacacatctacatgtatttagcctgtcaatccgtataaaagagctttatggctaaacgccccttcagttaacatgtgctacctaaattatctacaaattttagatagggctgctaaaaagaatttctccaagaaatctatttgttttttcttgagattgtacctcctatctaacaaatcgatgttaaccaaatccagcagcaacacgcggggcatcctctagttactagaacaattttgctatatatttgttgataaattttctcccaaaaatttgatagatgtaattacagtacaatcgtagtgtaattacactgtaactataatgtaactttcaaaaatttctccgtaacatattatttcggtaaaatggaggtcatggaaataaattctttgacatatgtgtgtgttgtgtttttttcttcctcaccagaacaaatcttgtaatagatctcacgattcagaattacgtgaaacttacatactccctccatactcacaaaggaagtcgtttaggacatcgacacggtctccaaaatacaactttgacttcttgtttctataaaaatattcattgaaaagtgatatatgtatacttttatgaaagtatttttcaagacaaatctattcatataatttttacattttcaaactcaacaactttagagttattcatgatttatattctcaagatttgacttaaacattgtcctaaacgacttcttttacgagtatggagagaatacaagttacactgtagttatatgcaagttacaatataattacattacgattgtactataattacatctgtcaaatttttaggacaaaatttatcgataaatatataggtggtacagtaccgttacggcccaactaattacatgggcttcactaactacagtagattattatttaattcaatttagtccagtataagttgtcactgtcgctgctaatccgatcgcccgaa

SEQ ID NO: 37366 - DNA, 252 bp, Oryza sativa
tacccccattctcgatcgtcgatctgcacggaaacagtggaacggctctactcgatgtcaacaagattctgtcttgttgatcaccgcgataagattattaagatctggcagtaaaaagtacagtagcagtagcagtaatcagttgcaaagcacctgaagctgatgatctaatctgaatcaacaatcgagcattgccagctcacagatcagcagcagcctgcaaaaacgttcatctcgtcagaaatctgaaca

SEQ ID NO: 37367 - DNA, 175 bp, Oryza sativa
gatcgagtgccgccgcatcctcccgtccgcccctctgccaactccctcctcgccgcatcctcttcgatggagagccagacgaggccaacgggcgcgaggcgggagaggagatccggccgacgacgcggtgacggccgcgccccgctgctcccccgccggccgccgctcgtgcagc

SEQ ID NO: 37368 - DNA, 1501 bp, Oryza sativa
tttatattgggaggagtatacgttatgttgaataattgaactaatgtttatgttgccttgatctatgttgtggactaaaccctaaaccttaaactcatgtctaaagcatgccatctccagggttatccttggtctagtttctcttatcagttaaaatttgagacaacccgagcatatgcttagcacttcctattttaggatgaatgtatttatcttttttggatcacggtataacctttgtattttaacaataaatagtacatatcattcaaatcactttagctattttgtgaagagaataatataccaattattatttttgaagtaagataatatatcaattttatagtctcttactctcttttgcctcatttatcatctaaatgtataagaacgcaaaatttctgttaaacatgcatgtaccaaccgtagactaaatatgatatacatagcagatgaagcaattcgattcggcagcatgcaaccttgtaaaattataatatgaaatataatcatgtttagtggatatatattaagatttgagatgaaagactgtagtatcccttgtgagtgggagggtggttgatgcgataagtagtactattttagtaatgcttataatgtgtataaattctgaatcctaaaaatgcttatatttgagctagctgtgcgattgtgcagcatgcaaacatgtactgttgtttaatttttgttccgtgcgcatgcactacatcggtcctagctacctcaaagtatgaaaactgaataggacataaattcaagcgtctgatctcagacataccaaatgaagccatccaaccgtatgttgcttacatactcctcgtttcaaaataactgacatagattaaagggtggttgggaagaaatttaaatgaggtgattgaagggaaaaatagtattctaggattgcttttttgagacaagatttaaatgttacaataattgttttgggacagagaggtagtccatgaatagatggccaagattttttttttctttttcctgatttaatctgagtatttctttctttttcgatcaatatgggaatttctagatttttttttccttcactagattaatgtgaggatttttaggagagccttagtatatataatgctattgaagagtccaatagttcctacattttcaaattagagttagtttggtcccataaaaacaaacgttgcatctattttcttattactaagcactgaaaagtgcaaattcttccttcaattcatatcaatgagttcattgaaaaccattcaagactcaagcatcaaattagatattaagttagtctagtataaatcaatgtgatcatctgcactgtaagtttgttaaccgcaaaaatcaatgtacattatccaaattactcatgttgtgtagattctacaggctgcactgaacttactggtttcgtagcggcccagagggtccatgttcctaaccaaaagagcaacaccataaagatacagtc

SEQ ID NO: 37369 - DNA, 1501 bp, Oryza sativa
gtggcagagagccttggtaggagaagggccaaagataccacctggaagcatccaactagacaccacaagagagttgttgccccatcaccagagcctgcacagtcactagcagcaacatcgttgaaggacatcattgtattgctgatgggcacttgcaaggcacaatgtttctttaaccacattaatattccattaattgtttgatcagaattagccaaaaccgacacaagggactagatgcacttttagtcacggatgagtctacttgattgggaatgatcagacatatttcgagcaaatatgaacgaaagggtagccactagtcatcacaagagatagttgaaaatatccatattgaagagagaaagagggagaaagttgctagtaccatgagtgtactactttttttgaattgtgtacagtacatttttccatgggcacataatggcttttttacatggttccaagtgtgcatcatgtatatgtaacatacacttttaaaagcagcatgcatgcataaagtatagctatagaactaagcaagtttatcaactttgtgcagaaatgccactcgtaatttcttggctaaaatgaacaattggaagaacacatatcacgtgctcacaccgtaacataggttagccaacctttgatcctcaaatgtggcaacgccagtttactccaaaaaaaaaagaaaaaaaatattggcacaacacatcacccatactggaccttcctcactaccttctccttggtcagtgacttcggtcccctcttctaatcacttcatcagtgaacaagtgagtagtaacaccgtgtgtagacttgtgtgagaatggaggaacagatgttctccttctattcattgatgcctccatgtcatgcttgttgacaatgacacaaaggccgtgagaagagaacggttcgaaccactcatcaatgaaaagagagtagtgcatagctagcaatgtgtgattgtgtacatctctattggttgtggcggtggaagaagagatgctctccttctattccctggtggcctccatgtcatgcttgttgatgagacataaatgccatgagaagagagtggttctaatcactcatcagtgaaaagagagtagtacatagctagcagtgtgtgattgtgtacatctctattggttgaggcaatggaggaagagatgatgtcattcttccctggtggcctccgtgtaatgcttgttgatgatgacacgaatgccatgagaacacatcggttataatcactcattagtgaaaagagagtagtatatagctagcagtgtgtgattgtgtacatctctattggctatggcaatgaaggaagagatgatgatgttcttccctagtggcctccgtgtcatgcttgtcgatgatgacatgaagaccgtgagaagagagcggtctaatcactcatcggtgaaaagagagtagtacatagctagcagtgtgtgattgtgtaaatctctattggttgtggcaa

SEQ ID NO: 37370 - DNA, 406 bp, Oryza sativa
aaaactttttccaattaaaataatcacttaaatgatctttcaattgttaaaaatacttccaatgctcaaataatttcaagaaaaatcctgaaaatacttggacactaaaagtacttaacaaaattataattagaccatttaatgattaatttaatatgtgggtaattactgaaatgctctttgtatgattaaaattaggaattgagctccgaaaaatccgagaaaattccagagagtataattaaccacggagaatttaataaaaattaaatccatccatgctttatatttaggaaattttatttcccacatttaacttcacttgtaaattaatgaacatttaatataaattctattaataatttattaaataatttataaatcctaagacgaaaatcagggtgtg

SEQ ID NO: 37371 - DNA, 392 bp, Oryza sativa
tcatctgttgtggtacgtctttgttcgttgagcgcatcacgccggtgtctttttcctgaatccactaatatgttttcatctgtcgtgtacgtctttctccatcgagcgtgtcatgccatcctccttgaatcccagttgttctttgcatactcagaatcggagaaaagaaaaccaactcagaataggagaaaaggaaaccaagttgtatccgttaatacaacaaaatcctcgtaaagtttcatagcttcaatatgaccaaatcggataacaccataagccaaaaacaagaaccgaagcttaagaaaacaaacccaaaaatttcataagaaaacaatatttgctctacctctagccgcctgagggacttcaccctcttcttcagtggctacagg

SEQ ID NO: 37372 - DNA, 1501 bp, Oryza sativa
ccatcctccttgaatcccagttgttctttgcatactcagaatcggagaaaagaaaaccaactcagaataggagaaaaggaaaccaagttgtatccgttaatacaacaaaatcctcgtaaagtttcatagcttcaatatgaccaaatcggataacaccataagccaaaaacaagaaccgaagcttaagaaaacaaacccaaaaatttcataagaaaacaatatttgctctacctctagccgcctgagggacttcaccctcttcttcagtggctacagggtgggctgctggattaggcacctccgaactcactgtcgctagatctgatagccacaaggtgatgctggccgagagaaagcaggaggaatcgaagaggacatctcggatctggatactttgagcggcggcggcagcgtcgctggcctcatctgcctcctctcctcaccgtctttctcgtgcccttctgtccctgatgaggctaccgaagctacggggtgggtggggatagagacatcggcggtggaggaaagtagcgagcggcgtggctagggacggagccagtgttaggagcgaaaaactaaaatggagttcagagttcagaactctgaatggcggagtggatggcgccgcgtcaggctacttacgccgggtcggtggggaccgatggagagagagagagggggggagggggactgagagagagataaagagagagagccaagagagagagagagaggagagggtgcagtggaggaaaaaggaggagagaataatgacagaagagagagatgagaagaggagaaggacgggaggccaccggtgttcggctcgactcgattttaggagtgccttttttttaaaaaaaaattccaacacctataatatattagggttgtcagtttttaattaatggtcacctataatatattaaaggttctattttttaaaaaccattatctcagatgccagtttttctttagaaccaatacatataattatttaaatgtgtcagtttttgtattttcaatccacagaggtgagaaaaaaaatatagatgccgatttttagcactttcggtacctatagtgccgatctctatgtgcttttttttaagtagtggcaatccgccgcgtcctttccgatataagcctgttcggttgagtacgagtgatgatgcacacaaccatcagaataatttatccgtgttgacgtgctaaaggcaacatcaatgcatatagctaaagtagtacatatagatgggacactttaactattgcaatattcacaatgtatacaggcagtaagtagtaggaagaggagagaggaaatagagacaaatgacatattttattctatatgggcagctcatatgcttatggatgactttggctatttttctcctatgaactacttccacaatgtggttaggtagctgaatgtattattttatagaaaaagtatgaattaccccccaaactatcgcggcgtctgaattacccccct

SEQ ID NO: 37373 - DNA, 1501 bp, Oryza sativa
aactttggaaggaactaaacacagccatagttcctttccttcacattctgatggagaagtagtaactcgttgttctcgtaataagataagtactacattttataaaggagtggttattgagatattttgtaaagatgtagagaaacgttaacgtagaaatacgaatcaagatcctctgcattacatgttgtaatggagaggatttacaatatccggtattagggggaatggagaccgtccaaatcgtgcgtgctacagtaaatctaccgcaatactcaatagtgctatacaatgtgtttcgttattgttgctacaatgaatcgacattgttcactgcattgcattactgtactcctcacataaacagtgcccctatgcattactatagaggatctgatccgtaaaaacacatatatgctattttgagaccatgcttaaatattgatcaattttgacatgagaacaatggattatttttaagaaaaactcacatgacagcctcttggtgaacctatagtgtactgcagtagatcacacacccaaaaatcgtagacagtttttttttgttgcaacatcaagagagttgataacaaaacaaagccgtgcgtgcatccaaaatctccccatccatttaggctctgtttaaattctaattttttcgtcacatcaaactttaatacacacataaacttctaactttttatcacattattttaatttctttaaacttccaattttattttaacatggaaccaaacacagccttacccacgttaaaccgcggccaggcccagatccgtccttccactatctccacacactccccaaaaactccacacctcccctctctagtttacttctccccaccaccaccccctctctctctctctaatttacctcccgtttcccaacgcctcctcactagccaagtagccagccacccccaacgtctctctcccgtccctgcttctccgctctcctctgctgttcagctccactgcgtgcgcgtctctctccctgtcttgtctccgagccgatgccgccggagcgcgctctccacccgagccgcaccctccgtcgcagatgagctccaagcaccgctccgccgccgccgccgctgctcctgcggcggcgccgccgtctgctgtccggacgcctcgaaggctgcggaggcgcccgctgaagacggcgtcggggtccggtggcggtggcggtggcggtggggggcggcggagcgggcccgccacgccgctgctcaagtgggatgtggggaatggcgcggagaaggggggtggcggcggcgagaaggcaggtggcccgtcggagaaggcggctgcggcgcgggatgtgtcggtgaggaggctcgcggctggagtgtggcggctgcggccgccggaggcggtggccgggggcgccgccgcggggagcggggagaggaggagggttcacgtcggcctcgaggtacgtgcacggaggcttaaaccctttcccctttttcgtt

SEQ ID NO: 37374 - DNA, 1501 bp, Oryza sativa
ggcacatacatttgccaacatttgcctaacttgtggccaagaatttcttagccacataaattgtggcatgccacaccttagctatagaaatttggtaaactgaagcaagcatccaaacagccccgtagccttcctttctgtcgttgtccgtgatgccgtcggggtagaagcggaggttccagtcgtagccggcgacggagaaggtggtcgagctcacgaacttgccgacccccatgccttcgagcagcgagtagctcgtcacctccaagttgtgcgtcccggtgacgctcgccgtcaggcatctcgacgatgtcgaactgctagccatgggtggcatcgaaaggaaaggaacaggcgggcgggtcatatcatatcgaacgcttccggtgcgggtatttatggactattcgcattctcgcactacgtattaattcgagaattctttacgtcgtttaacccgcccatattccaagctagtagtatgcgaaacaaaaatgaaagctccgtgcatcgatccaagtcatccaactaccgcgcatgccgctacgcgtgacgcaaagccaagaggaaataactcctctataaatcctttagctagctttctaatctgattcatatctgacgttggatgaaccctaggtcaacactatgtaggtgtcacacctctaaatcgtcaagtgagtcaaattgcagcggctttaatagttgagtgttcaaaatatccggtagttttttaggcataccacttgttaagagagtataagtgaacttattctaagccacgaaacgcatgatggtgggccaaacctggtctggtgttcacatatctcagcctttcagcccattaaaatagaagcccacgtagattgagcccatgtaaatagaagcccacgtggatagagcccaagcccatgtaaacggaagtgaaaccctggtctgtctttcatctgctttcccccctcccatcccggccgccgacttcttctccacggcggcgaacgcgcgcgactcgcgccgctgcccgctgctccggcgaccggacgcgactccccttcttccacgagcacccacttcaccggccgtcctcgcctcctccgacgacagcggcggctcgccgggtcctctcctcctccgccgcggggggtctcatcccgttgcagctctataccctcccttaaaccctacccttcgattcgcttaaaccctaccagctcgattccgcattgtgctcgcaatcgctcgccgggagacaaactccgatggactccaccgccgacgttggaggtgaagacgagcatgaaatcgtccaagaggatttatatctcggtgagcacctctagctaccaaaatacttcccggtttttggtgaaatttggtgtaaattcggttcgatttggtgcggatttctcgatggaacactaacatgctcactgttttttttaatgaatcctagatgacgacgacgagcagttcgatgttgatctcaatgaagacaatgaga

SEQ ID NO: 37375 - DNA, 1501 bp, Oryza sativa
gtaaggaaaaggattcggctctcacattattcttagcttatcggtaggacctagggtcctaggcttccattgatgggtgagtttcttgtgaaaatggaacacacctcattgatgtttgataagctacaacggacattgttttcaaaaaaaaaaaaaaaaaaaaaaaaaagctacaacggacatgacttgcccaattcacgagcttggaagccaaaaaaaaaaagaaaagaaaaagagaaaaaaggttaacaatgaaacaagcacaattttgcactccacccaacttgaccaaaacacagttggttgtaaattgaatcgcttcctgcattgttctcttctgcttctacttggccaacaaatcaagcacacagcagctagctaatatacattccaatattaatccatcatcccaggccacaggcaagagcaaccaaaaataagatcgatgcagcagattgatccctacaaaaccccaggaaaaaacaatcaggattccctgctcgcggcgcagcttcatcctgacactgcacacattgaatgccagtgccaggatgaagaaccaccatccaggctctgcgaccagcaacagaacccaaacgcagtaaatttaaggacctcgtgccggcgaccttttccatcagcagctgctgctgctgtcggtagagccaggcaggcaggcaataaagcggcaacagcaaccagattaatgacacactgagatctagattgacctcgtcacagcaacggtaaaagttaagagaccacaagagaacacattcaccagagccacaattacttgggagtattatcaagcagcgtatatatgttcagaacaactgagaggatcttggcattactactattagagtttaaagatttgccacgaggtaagcaaagaatatacacttgtttggcaagtcttatttacaggagttgagagcgatattgctgccgcgcctagagcagcccaaaggtgttctcgccactgtaggtcatgtagaggaacccatcctcatccttgttctcctcgtaaattgcggacatcagagcagctgcaaatccaacaaagtgatgaaatgagataacatgaaccatgcaggttctttgagatactgggatcataaaccatgcagtagtatactattcgaccaaagtccttgtgttttcaaaggaaaatgattcaagggattttcagacctgttggtggaagagtattcttcacaaagatgaagattgctttctcaggactgagcttgatccgcttccgaacaacatagacaaactgcccaacggtaagatcagcagggaccaggtacctatattagaaaatcataagctactaaggatgatacggtaatattgattgatacttgatgtaacatgtattaaagtttcagagcaacaaaagtttcgagcttgaatgccatagccataccggcatccttgcaataataaattgaaacacagtcagctgcttttggaacatagagttaggacttta

SEQ ID NO: 37376 - DNA, 187 bp, Oryza sativa
gaacaaccggaatccacgatccacacgttctccttccttgccaccaaagcctacacacaagcagaagtcgaagcctcagtactgaggttagatgataataaaaatttaggaatccagtactgagacacacgaccagaagatccaataggcatatatccacgtgcaaaatcaattttgaatttttaga

SEQ ID NO: 37377 - DNA, 779 bp, Oryza sativa
aaagagcttcgtcgagatctttttaaaaaggagtacattaaatttgagatgaaacctgaagaagctttggatgactatctttctaggtttaataaaattttaagtgatcttagatctgttgattcttcttatgatgctaattatccacaatttgagatttctcgtcactttttgaatggtctcgacatgtctatttgggagatgaaagttacatctattcaggagtctgttaacatgtctactttgactttggattcactttatactaaattgaaaacacatgagatgaatgttctttctcgcaaagttgattctaaatcaagtgctttggtttcttcttcttcttctttggatgttgatgcttcttcatctaagtcgtcttttcttgctgtttttaatgccacatccgatgatcaactcgaacaaatcgaggaggaggatttggctttggttgctaaccgtattgctcgagctatgaataatgccaggaacaggaaaagaggtggttcaaatcgttgctttgaatatggttcaattgatcatcttcgttcgcattgtcctaagcttgggagaggcaaaagagaagacaaagatggtgagaagaccaacaaacaacaagcccaacaacaacaagtcgaagggttctatccaagggaggaagacggagaatcttaggaaggcttttcaacaagtttgcgccgccttcgagccactaagtgatgtagatggtgaaagtggagatgatgacaagggaaagaacgtctccgatatttgcttca

SEQ ID NO: 37378 - DNA, 773 bp, Oryza sativa
accgtgtcgctgtccaaaacgacttcctttatgagtacggagggagtagttgtactattatatattatatttcccatgttttaaaattaatcatttgagctatgaatctagtcatctagacaaaattgctatattttaggactaatggataaaacaatttcaaggccataaggattgagttatcttgcacgaaaatcttgaaattgttcttgaaaagcttatacatgctttaaattaactttttagtcatgatataaatatttttataaatattttttataaatatttgatctaccttctttcttactagtaatatacatccagaaaatcgagtggcttgctttctttcactgctgccattcacaaattggcaagattttccactaagaaatgcacactaaaaccttccaaacacactgtcatagtgatgacatgattacttatttaatcacatactgaaaacaaccaattccaaaggtacaagcacctctgggaccgttcaaagatcatcaccggagaaagaaagaaaaataaaagaaaagaaagccgcgcaggaaaccgctcgatgtggccgttcaacaatcaacaacgccgctttcgctttaaataacaaaaaaaaaaagatgagcatagaaagcaaggggtgcaaagcgacacgcgacaagtgtgagcccgttataaaaagccacgcgggcatcacgtggccactcctcctcctccgcctcagagtttgtgacattttttttcgctctcgcctcccccctctaccgcca

SEQ ID NO: 37379 - DNA, 343 bp, Oryza sativa
cccggatccggtccatcctcagatctgagacatgcgccccccgatcttcctccaaaatcccctcctctcctccccggattcctcccccaaacctcaccaccaaacaccacaagatccaaccaaaatcaaaatcactccgctaagattagagagaccctcttcctctcgctacaaatcccctctctctctctctaggctactcctactactctggctctcctctcctctcctctcctcctcagctatggtggtggcctcctcttcttctcgccgctgctctctcgtcttgtggcctcctcctccccctctctgccttggccttccgtctggctcgctttctagg

SEQ ID NO: 37380 - DNA, 1501 bp, Oryza sativa
catcaagaagccgccgtctggtgcggcggcggcgcaagcgcattagattccgcccggagcagcaggcctcgcagcagcagttgccgcctcgggtgtcggctccggcggccacggcgagaagccctgctgagcctggccgctctctcctcacgcatgcacgcactgctcgcttgcttcctcaaatcttctcctgggccaggcagagaggcagagaggggacggagaccagtgaatgccatcgcccaggctccactgcaggttgtcgtcggcgagcacgtactgatacgagcccatgaagtagcaccaccgcacgttgatgcagcagctgccacctcgcgttggcgtcgtcatcctcgccggttgctgcggcgccgctgcgctgcgtgctcttgaaccagccaagccgctggtcgcggccttattggacaccgccgcctcctcctgcggctccacattctagtcctcgacagtcgacatcgggctgccgcaacggcggcgagggcgcggcgcggcagagcgggcacgatgcgggtgtccgcggtgatggcggcgagagcggcgacgacgcgggcggagagcgcggcgcggcaggagctggagcggcgctgcgtgatggcaaggcgtgcgcctgctacgacattgcgctgcttgtgctgctgtgcgcggtcggcgtcgtcagggccatcgacgcccaggcctcgttcacgtacgagcccgccggagcggcggagaaggatggcgtcggcgccgcactgtgcgcgatgcgtctcgttgggaggaagaggtcatgaaaatagatgagagactgatatccttggcccacatagggcaatttagtcttttttgattgtttctctcttcatgttgttcggaaataataaaataatatcttcggtgtttaatagctaattatcactcttttgcaatgtcctatagacaattcacatctttgtgatgtcatataactaattatacgttttttaagtgtcctgtagcaaattttacataaataaattgatgatgaaatttccatagtaaataatagttatagtgaagcttagttcgggctcaaaaatttttctagctccaccactgaatccagacagcgaagaacacagcgtttcacgcccaaatgcagctgccggacgacgaagaacaagaagccagcaacggcgaggcagctgccgcagggcattctaaccgcgtccaatctagcctagggtttacaaaaccgaacggttattatgaggctaccatgcacagtaaccttttcagtggattctggcattaggtgcaaagttttaaggcctccttcagtggacatgaattcctttttcaaggtttgtagaaattaaatcgaatcgatcctgatgaaaaaaaagttatacaaaattcatgcagtcagaagaaggcctagcattccctgcattctgcacagaacttccggaaacccagcatagaagccacatgtgacacagaattttgtacagtgggagactta

SEQ ID NO: 37381 - DNA, 1501 bp, Oryza sativa
gtgtagtttactagacataaaaataccaatccccaatcaaacagaggatgcgtcctatttatataggtgttgacgaaaaattcgcgttcggccgatggtgccggaactgtgttggcgcaaactaaatcaatgaacacaacggcatgagagatatgcttagctccagtgtaggtccaaaaattgatgagatgcggatgtgccagtcagtttgatcctgcaattgacaagatatgtaaacaacagatcaaataactgatcggctgacaagccgatagagtagttccagccgatgccgtaaggttttgagatgtcggttatatgaccaatgtagataacaatataaagacaatcggctgatgataatgtaatagaacaataatataatccagtagaaactaatcggctaaaattagtatgatagaataaatattgatccgaaggttaaaagtatacatcggctggaggttcgatgtcataaaatccacacaattagatgattagtgaaacctttgtttcaatcggctaaaactaacttgtatacaatcctagtaagccgatgcaatgtccagataactcatcggctgaaatcccgatgaaacccttattataatcaaagacaggctagccattatgattctaatagcacgactaaggatgatgcattacaaactattttaagaagcatgaagtctaaaaaatcaagtatttgactaattttcacggtggtggatacattagcaaatctaatctagtaaagcgatttagccgataccggcaaaaaccctaaagcagatcccagccgatacaagtaaatcgatctaccaaactagattaactaagatatataataaataggtaggaaaatatatcaaccaaaccagagcgatgcaagagatcaaagcgatgcagccttgaacaacaccaacgtagcagatacaattgcctaggccgacggaacgtaggacttacccttcaccggagatcaaaagccgatgcagccccatgtcaggtgccaagttccgtcagatgataagtaaaaacctcaataaagctggtaacgatgcgtcaagagtagttgtattgatctgtgagatagtttataatgacgatctgtgagatagtttataatgaccccgggtgtacatatttatacctatgggtagatataagtgcttattggacaagaacgaaactttcctaaaaactttcctaaagacaaaagaaaaacataaagtccttatctgacactaaacacactttcctaaagataaaaggaaactactaaattaagcctaaccaatatatagaattatgctgccatgccatagtcttcacgattctttcataaacttggtctcatggataagtttccatcggttgattgtgctctttccttaacccaatccactaaagaatcttaccaaattttgtcgttaacgataggccccaaattacaaaaataaaattacaattatgacctaatggagttacacaacatcct

SEQ ID NO: 37382 - DNA, 1501 bp, Oryza sativa
tggtgcaaacttgtactcggatatacagtttcttggttgttcatatgcgggtgttgcttgagaccataggcatgtgtgcaaagggatagaaatatctacaaccagggcttttcttcgagacaattcaattgcttagagatctccagaacaacaggcaattcactaccttttttttggatgaaaagacaattcaattccttagatctctaggagtttatccaccacaattaatccacataatgcgtctctgcaattagatcgaagaagaaattgtgaatcatccaggcaaaatcaatccctagagatagaccttataacaataaagacattgcttgtgatatacattagtccccattgggaatatatgttgttggagacattggctgtcgcgaacctatctgtacagttcgtcacaattagtttggtcgcaaattaagtcagatgcacatgttaatcaggtgaagcttcatttgcattatttctgatcagattgctttcaagatgctggattataccccctttgtttcatattataagttgtttaactttttttctagtcaaacttaataaagtttggtcaaacttaataaagtttgactatgtttataaaaaaaattagtaacatctaaaatatcaattagtttcactaaatctaatagtgagtatattttgataatatattttttgttaaaaatattactatatttttctataaatttggtcaaacttaaagaagtatgattaagaaaaaaattgaaccacataatataaaacagagagagtattaaagtagcagcacagttcatacaaattggagaaggggacaattacacctatgcccccactttgaactctaattaatgttttactctcacattttaggctttgcatttttgctctctctttatgaaaacgaaccaattgtttgccctcacttttgacgtctagtttaacggtgttagttttaaaacaaaaggacattgatatccttagttgttgttgcttttttgctcaacttttagactagccgcaccggaagcccctgcagctcctgccttcgctgcgccggaagcctcctcatcgcctgcctcgctgcgttggaagccccatggccgccacctgccatcgccgtgcaagggagtgggaagcctgcgactacccacctgactcaccgtgcaagggagatcggggatccggttttaccagaacaacacaaagtcacaccgtgcaagggagatcggggatccggttttaccagaacaacacaaagtcacagagcatattgcatactgatcagaatatcatatcactcatctccgataccaaatgcgcccacataaatcttacaatgctatctacacaaatgaaggaacatagcatagacaactacggggagaaactatcctgcaagacacgcgacgggttaagcgaggatgagcagagcaactgctcgatcagggagggatcggaggggacgctatgtggacaccccgagtattat

SEQ ID NO: 37383 - DNA, 1501 bp, Oryza sativa
cctgatggaagtgatcttacttgtgtgatttgttcatccggagctagggaaactctgcaacatttgttcttccattgcactttcagttcgcaatgctaggcgcaatttggtttagtttgggacttatatttattctttgaagatatgttacaacatgcaagaggttcttattgatcatctcattttgtggagaagattttatatgcggcttggaatatttggaagcagcgaagtaattggctatatttttgataatgtgccatcctcagtctcctcttggatgacattctttaagaatgatctgtcgcttcttgttttttttttaaatgcagatgagagatcaacatttatttcctggttaaaccagttgtaaaactttttattttattttcttaatatataattttactttgggggaggggggttccctcacagtgctttccctcaaaaattaggatatggtctgtgtggctcataagagctggtctgtgtggttcatgagagctgtgtatgcatgtttagtaccacattgctagtttagtaagagtgaaacaacttataaggtcttgtatctccaaccatatcactcgcgggctaacccttctacacgaagcgaggacgaaagtgcaatggggtggtatgtgtaagtgggcctactcatcggttgagttgggctgtgagtttgtagagggcgggccattacatttggcatgccttgacgaggcagtttcgtcaagaatcagtgaaatttcgtcacaaggacataatcgcagaagatctgttcctctgtgttttttttcactagatccacttgtttcactcttaggccgaggttagttccaaaatttttctttaaatttctaacttttccatcacattaaaactttcctacacacacaaacttccaactattccatcacattatttcaatttcaaccaaacttccaattttggcgtaaactaaacacacccttaaaaaaatgaggatccagtagtgctttgtttgactcttactccaccagataaggattccaaagtggagtcctggcaaacagattctttgctcaaaatgtacacttacctacaaccatttatacctagacacttgttgggggttaggagtacacccctggcgcataataccctccaccttcagaggggagtgcagcgccaggaaggctagggcagaggccatgtggtcaaccatggggcctactacaagggatgcccaaaaagggtttcctatgccagcctttggcttcgaaagataatgcacaaggatagactacaacaggaaaactaagaccatgtttagatgggactaaaacttttaagtccctatcatatcgaatgtttggatactaattgtaaatattaaatgtagactattataaaacccatccataatcttggaataattcgtgagacgaatccattgagcttaattaatccatgattagcctatgtgatgctacagtaaacattctctaattatggatta

SEQ ID NO: 37384 - DNA, 153 bp, Oryza sativa
gaggtttcgccacacgtcacacccttcaccatagtaccaataaggtatggcctcaagggttgggggcgaacataagttgcttccaagctggggggatacgaggccaccatagcctctataaactttcgccccacccacaaccttcgccacagt

SEQ ID NO: 37385 - DNA, 1501 bp, Oryza sativa
accggttcacgattttcggttgtgaaacattaaccgtgccaaccacaagccagcgtgggcaacggctttacgttttgtatagcatggttcattgcggagcaccagactgagaagtggcggagataagcccacgagggtcgctggggagtccatgccttgtttataagggggtgactatgatccgggaatggtgcactgtggtgagttgtgttgtgcagatggtattgtcacagcctctattcgggtactttccagtatcgcgacgcatggtagacatgatgttgaggctgtgtcttgtgggtacagtggtacacctctggccagagtaaaactattcgaatagccgtgcccgcggttatgggcgagttgagcaatgtctttcgtgattagtctcacacttctcaccataataaatgatgatataattggtaataatttgtttagctcctggtttggagatagatctgtgcagccgggtatggttgttcaggatggttgggcctgtgcagcatgggtgtgctgttcagtgttgattaatattgatgattaattactctattgttttataattctcaaatgtttgctaaatgctgcttttgcaaatgagccctatattatgctatcctttggtatccatgtgtacttgcatatttgttgtgtggcttgctgagtatgtcatatgctcaccttgcaataatcaatcaaacctcaattgaagacaagttgcaaaggagaagacgtttggcttataccccagttgagctgcctgtgggagtggagccggagcttcgctagaccgtaattccgctgctgttttcttttcttttgtaagtatgtaacgttattattatgatggatttgtatattaaattgtcagtttgtgtacctcggctgattcctggacgaagattttatgcacaaataagttcggaaattactagtgaatttctgggcgtgacaagttggtatcagagccatcttgactgtaggatgagccaaatggtcaaaccttaaggactaattttccgaaaacatgatttgtgaaaattttcctttcttccttctctagaattctctataaatcattttatcatcctctcccctcctgctttcaacttgagtagttctgaaactagttgtttaaactagaagacgttgatgtggtcaacctatggaggtcagtcaagtggatcgaggatgaaccgaagtgccaagtggtcaagatggaatgaagtttggatcctaccttagaacctatgccgccaaactatccttgaaggacagttagtagggtagaacgtttgttgcttgcttgtgtgtaggtatggttgcattcccatcattggtgttgttcagtgatgagcgtgtaactatactgggttgcttgcttaatcaacttgaacaatataatggtctacacacatcagatcagtgttaacctggttaaggtcttgtctttagtgtaacctctctgcttccatcttctccaatatgcaacaga

SEQ ID NO: 37386 - DNA, 1501 bp, Oryza sativa
ttctcctgactcgtcggaggagaggtaccatatagcaaaagcaggcctagtggtaagggaaacaccagtgctgactgatctcgatgccttacatgttgagtttgtgaaacatatgcatgcccacataatcaacaaagtatacattatatctagttgattattaagtctttagtctagatttggtgcagcgtatgctctctttctgattgtcaggttcaaatgcgagacattcttggttgatctgcgaaaggagttgaggcccatatggttggatttcacatgttgctctgtagtctattcgtgtctgcgttggcatttctccatgtgttcttcacctgctagctgatttacttatgactggttaaggaactagttgtctagttcttatgttaaactaataatgttgtgttaaatgaaattgtattgcgaaactgttgttagatttcgttgtaatcatgtgatgagttcctttgggtatctagattcctctgttcatccctccgttttgctggctggctgagcactttgtgaagaagcaagaccaagcgcgtcacaactcaagtcgtgcaccatgatcacgacgtgcgatagatgtcgttgttgtctatggcgtgtattaatttaggacatactggccccatatcgattttgttttcaaatggcaataggaaaaaccggaaatgcttcaacacaaagatcggtggttttttagttcatcttttgtgctgccaattcacgcaagtatgtggaggtgaaacttgaaacctaatcaatccatgaaatggtgagcaaatttcaactacagcgttatgggagcatgttttctttggcaatacctctgctcgaaattcatgggtttatgtgattactaacaacactgttgcttataacactaattgttgcatatgaatattttgataacatagaggatgaaagctggctaccattaattcatttctacaaacacaacgtttcattcaccgaggaagcgaataagtaggtaggcttcacagctggtgcacctagaagacatagcaaagggcgtatgactaactaggggtgtgccctagaaccccttcttcgcagtaccatgctggcaggatgtgcatgatgtcacagcctgaatttcgtttcaggatttataaattatctaataaattaataatagaatttatattaaatgttctttaattttcaagtaaagttaaatgtgggaaataaaattttctaaatttaaagcatggttggatttaattttattaaattctccatgattaattatactctctgaaattttctctgattttttctcagagctcaattcctaaatgatacaaagaacagttcagtaattagtaatcaattaatgatctaattataattatgttaagtacttttcttgtttaaaatccttaatttataaattgttgtctaaaagggaattattagaaatgatcttaaaagcctagaagagaagatctaattttaatttgttaaatct

SEQ ID NO: 37387 - DNA, 1501 bp, Oryza sativa
tctagagtttgtggtctgcgagtaaaacaattaccacattactctcgatatagcccatgatctcgtgccaccatgtagtattatgttaaccgatgtgttcaatacacaatataagagaattattaatttgtatcacaaaatagcagtacaaatgaaaaaatttacaggctcaattacacacgagtgataaaattactcataggtgaatcaaactagaaaagaaaaaatgattcagccaaaaatccatcgtgaagctgagatcctggtaggattgttagatcttgctatatggatggagaggctagtctgtgtcttgtgactcgtagtggagaggacaaccgggtggcgagcgttagttgacgatggaatcaaggaaggatgtaatgttgtggtatagagatgagctcggcgttacacagtagcaaccatccatcatctagcaagcacaaaaatatgcaaaaacattcttgttcatgtcatagagacgacgagcaaaagaaaaatagcaaacaacctccatgatcggcggactctaccctatcctttacagctagccacatggagtacgatctacaaatgtagaacttttgtagcccatcaattctgatcaggtaatattcgagattgcacattaatttgatttgcaaaaagaaattggggttgcatgcatgaaggtgacggagagtatatatatgcaaataggagtatcatttgcttacttgcttcttctgtcaatgccaccgacatggagcagccgacggttgttgctcttggcccaagtgaacacctccttgctggttaaggtgttgcccgatgtcttgccgcaaggtccgaagcagcgccttcgattcaaccgctagccatcggcgtcaaccgccacggtgccgtcgtcctcctccatggcgcgtcaccgatttctaggctgcgatggtggattgattcatatttggaaaaaaaaggaaagaatgaagtgggggcgagaccggttgggagcagaatgacaggacgtggagtgaggcgggtctgggttgatacatgtttggtactcagaagtcggaataccagtacctctagtaatcaattatttctttcggtatattaactcctaaaaaatgctaacaggttaagccacatcatcaacacattagagccattggatcaaaagatcatctttgttcgaatgtgttaaatatgtgatccgaattttgggcccacaatatattcggattagtttcctagtaggagtcttattaggtgtctttcttttatcccctatatatatactcttataagccgtacgggaaggggtgacgttcccattgtgattcccctacgtttgtaatcatctcctctatagtgatcattgccggtcggcgcccgtggttttttcccgcaagggttttctacgtaaaattcgtgtctccgttgtgcatctattttcataacaagtggtatcagagctttggagatcgatctacacgtcacgcagccgccgccgatt

SEQ ID NO: 37388 - DNA, 1501 bp, Oryza sativa
tagatttttctgctatgtatgtgtaccacgcataacatatctattccaaaccgaaaaacggttagcattatgaatttatttccactggagtcaatttgatgttgttcttagatttgagatgtaaagttctcgatggtacgaactgataaaaagaaaatttgaaacattcaagcactagcatagatagataatgtttccagattccttgcacaactcctaacaatttcatgcagccatagccttgctagacataggactacaagaaataggcggggacgttcgatttctgacagaccaatgaagctgcaacttcatatttacacctttgtgatccgaggtaacagcaattctctcagcaacattgttgatcgatattactaatactgtaccaagctatgaaaattatttactcttcatttctgtgaaataaataactgtcaccctgttaacgttgttacaacttgcaaaatggaatcttaaatgtaatgaggcttctaaataaaaagcagttctctgttcaatgtaacggaactgttctaaattacagattgagtggatttatggttccttacagaaggtatactcagtgaattcaagatgcatgcatgaggctacaggccaatcttgcacgtaaagcccagctttaagtgatttcaaagctttggttcacagttggttttgctgaaattattttggatgtagattttttttagccaagattatgttgatcttagtgatatatatttggtcaggacttaaacattcttagatatctcaaaatagaaatatcacaaatacctctacaattaccatcaactgattcatttttattccatctcatatatacacttataccatctcatagagactcatttttattccatctctaggctgcgttctttaccgctggttcccaacccatctctctcgtttttcgcgcgcacgattttcaaactgctaaacggtatgtttttttgcaaaaaaaagtttatatatgaaagttgcttaaaaaaatcaaattaatccattttttaaaaaaatagctaatactcaattaatcacgcgctaatggatcgctccgttttccgtacggagatgataggttcccaaccccaactaacataataatctgataaaattatacatttatacaacattttctagtgccaacctaaatttggccctgtacacaaattctcctatccagttgtccatcttgagcagatgattgcaacgcatccagtttttcctctttcttctgctcgcgtgcatctccattgtcacccctacttcttgttgcacatggttccttttctggagacgaatcaatagccgtaacgacttacgaaggccaagaatcaagatatgttgcagatcgtttcttgattatagcaccatgcagtaatatgcaggaacatcttttaacacaaacaaaaacatgcagacaaacaatggccattgagtactgcagcagcattgcagcatggggagaaggaagata

SEQ ID NO: 37389 - DNA, 1501 bp, Oryza sativa
gattgacgaacgatacagcaaatcagctcagcgaaaaagcagacgaagcacgagcttctagtgagctcaccagcactgcaacgcatatttgttgggggaaaaaatcaaaaacgaaaaaggggaaagggtttaagcctccgtgcacgtacctcgaggccgacgtgaaccctcctcctctccccgctccccgcggcggcgcccccggccaccgcctccggcggccgcagccgccacactccagccgcgagcctcctcaccgacacatcccgcgccgcagccgccttctccgacgggccacctgccttctcgccgccgccaccccccttctccgcgccattccccacatcccacttgagcagcggcgtggcgggcccgctccgccgccccccaccgccaccgccaccgccaccggaccccgacgccgtcttcagcgggcgcctccgcagccttcgaggcgtccggacagcagacggcggcgccgccgcaggagcagcggcggcggcggcggagcggtgcttggagctcatctgcgacggagggtgcggctcgggtggagagcgcgctccggcggcatcggctcggagacaagacagggagagagacgcgcacgcagtggagctgaacagcagaggagagcggagaagcagggacgggagagagacgttgggggtggctggctacttggctagtgaggaggcgttgggaaacgggaggtaaattagagagagagagagggggtggtggtggggagaagtaaactagagaggggaggtgtggagtttttggggagtgtgtggagatagtggaaggacggatctgggcctggccgcggtttaacgtgggtaaggctgtgtttggttccatgttaaaataaaattggaagtttaaagaaattaaaataatgtgataaaaagttagaagtttatgtgtgtattaaagtttgatgtgacgaaaaaattagaatttaaacagagcctaaatggatggggagattttggatgcacgcacggctttgttttgttatcaactctcttgatgttgcaacaaaaaaaaactgtctacgatttttgggtgtgtgatctactgcagtacactataggttcaccaagaggctgtcatgtgagtttttcttaaaaataatccattgttctcatgtcaaaattgatcaatatttaagcatggtctcaaaatagcatatatgtgtttttacggatcagatcctctatagtaatgcataggggcactgtttatgtgaggagtacagtaatgcaatgcagtgaacaatgtcgattcattgtagcaacaataacgaaacacattgtatagcactattgagtattgcggtagatttactgtagcacgcacgatttggacggtctccattccccctaataccggatattgtaaatcctctccattacaacatgtaatgcagaggatcttgattcgtatttctacgttaacgtttctctacatctttacaaaatatctcaataaccac

SEQ ID NO: 37390 - DNA, 1501 bp, Oryza sativa
gggcactgcttagatacacgtgatccggatcgaggcagcccatcagggggctccaaatggcgtccatagaaggggcagatggaccatcgacaggtttccatcgttttcgaatccaaatgctactgaagaacttgttccccttcaccacaattgcggtggacctgacctgttattagcttgcggagttgtggtatcagtctctcttcgaactttccagattttcttcctctcggcaggtgatgtacgtgtgtcagtgtgtggtcctgacgggctgaattaatcccctaacaacggcatgcatgcatggattgatggatacgccattaaacactgaacatccgatactttgttttcgcatatttattatctgacagtgtcggcgctccgggttatacaagtttaccatgtcggagaatttaaggggagagcggttccattcttctctctcattctctcttcctcaatactaaggtgtgcttggtttgttactatgccaaaatattggtaaccaaaatctaggcaagtttttgtagtgtcaatattttggtaactttttgtgtgctattggtagcaaaccaaacactattaaaatactaatcaaagtgctaaacaatttggtagggcacattttggcttcaaaccaaaatgaccctaaaaatatggacagagtgaagtccggtgtcggttgttagggttgagttttggacaatctcactgtagtttttttgttggccaagcgacgattggtcacgtttagcaatgatcggtccagtgttagctttctcacgagtttaagtgttaacgatgttggcgcgtggggtggttattattttttttttctggttacgatctttcaggactgtagtcttgtaaatttttttattccctattaacttcgtatttcgtattgtcttgtgcgagtgggtgaaaaaaaggttgtttcattctagacaggccttaaacaccttagttggaattctacgatattacggcgccagcttcagaaaaaactgtagtatactgcagtcctacacagatgcacaacaaataattttccatgtttatggcatgtgactagtcaaagtcctaacatactagcagccacctagcaaagcaaaacatttctagtatgatctccctatagtcaaacaaagcccttggagccactgacagtgggctccacttcacaaatacaaactccctggattaaataagcaccaccttaaatacgtgtccatcaacaatcaaaaccaaccaacacgctgttcaactccagaacctcactaagtttctggcaaggtctaatcttaaaataaattttcttaatgggtcaatttatcaaaattgctgccagaaccttctctattagctctccacaaccacacaaagcttcgcgccacgacgctctctcgcctctctgctgctttagcgttcgcgcgcgcgcgctgcggctggctggctggaccaagctaatagctatggacaccgtcgtggcggccgc

SEQ ID NO: 37391 - DNA, 1501 bp, Oryza sativa
aagacagtagcaaagagcgaaagtatgtaagccatccctggcttctccctatgcaatcgccatgcctcagccagctccacgagccgtggcgactgctgcacatactcccgcagcacctcaccctcagggtcaccatccaatagctcaatgaactccctcgacgcgtcggagtagattttgatctcggcggtgtggaggtttttaaggatatggattagcctgaccttacaggttgctccgaatgactggttccaggcctccatccccaccttaaccaaattttgctcccgtttgggttccgcttcctccatctcattgtcttcattgagatcaacatcgaactgctcgtcgtcgtcatctaggattcattaaaaaaaacagtgagcatgttagtgttccatcgagaaatccgcaccaaatcgaaccgaatttacaccaaatttcaccaaaaaccgggaagtattttggtagctagaggtgctcaccgagatataaatcctcttggacgatttcatgctcgtcttcacctccaacgtcggcggtggagtccatcggagtttgtctcccggcgagcgattgcgagcacaatgcggaatcgagctggtagggtttaagcgaatcgaagggtagggtttaagggagggtatagagctgcaacgggatgagaccccccgcggcggaggaggagaggacccggcgagccgccgctgtcgtcggaggaggcgaggacggccggtgaagtgggtgctcgtggaagaaggggagtcgcgtccggtcgccggagcagcgggcagcggcgcgagtcgcgcgcgttcgccgccgtggagaagaagtcggcggccgggatgggaggggggaaagcagatgaaagacagaccagggtttcacttccgtttacatgggcttgggctctatccacgtgggcttctatttacatgggctcaatctacgtgggcttctattttaatgggctgaaaggctgagatatgtgaacaccagaccaggtttggcccaccatcatgcgtttcgtggcttagaataagttcacttatactctcttaacaagtggtatgcctaaaaaactaccggatattttgaacactcaactattaaagccgctgcaatttgactcacttgacgatttagaggtgtgacacctacatagtgttgacctagggttcatccaacgtcagatatgaatcagattagaaagctagctaaaggatttatagaggagttatttcctcttggctttgcgtcacgcgtagcggcatgcgcggtagttggatgacttggatcgatgcacggagctttcatttttgtttcgcatactactagcttggaatatgggcgggttaaacgacgtaaagaattctcgaattaatacgtagtgcgagaatgcgaatagtccataaatacccgcaccggaagcgttcgatatgatatgacccgcccgcctgttcctttcctttcgatgccacccatggctagcagttcgaca

SEQ ID NO: 37392 - DNA, 1501 bp, Oryza sativa
ggttcaccatttggaaataagttatcatccaaatgggcatatatagtacagtgccaagatgaaacatcgaacttatagcaaaggaaaaattgaaaccatgccattataattttgcaaaatttgagatatgccatcctgacccacgtatcactcatgtgggtcctatatgtcattgagataccgatgacatatctcaaactttacaaaattataatggcatggttcaaaaggtttcattcgacctctgattcaccccatcctagatatgccatcggttggtcacaggacatcaaaggcaggtgatgggaattgagttaattttcacccaaatatatagcaaaagaaaggtttcagctgacttcagattcacccctcctagctatgccatcgtccaaccggacgagaagtcatgtggctacatcactacatgcccatagcagaatctccaagggacaacgaggatatatatacatggtgagttcgagagtagatgtggagttctagcagacttctatatcaaatctaaggcagatcccaatgttgaatagctcctgatatagcagctttgcgccgtatgggcgtatggcacataacacattgatccttactatatcttttttctgaagagcggcagaacccacgtgattaatacaattatgatgtaattatagtgtactttcaaaaatctctaggtgacatgctaattatgtgaaaacgaaggtaatgatatcgaatcccttacatgtgcgtgagttatcagtttatgtgcatcgaggggaagcaacgataaagtgcaacccccgaatgagtgaagattctatcatgtaccatcacctataccctcaatatcaaaaatgtactagacaatctattactaccttcgtcccaaaatatagcaatctattacaagatgagatatatattagaccaacgatctggacaggccgagatctttggattaagatatgtcctatctattcccaaattactatattttagaacggtgggagtactatatatatatggctctcattttatttctttttctcgttgctttgtttggctgtatacctctgtacatatatctactccatttttttttcttttcgaaggatataagcaagataagcaagaagtgtcgcacgtccagtgatcgtcgccggcgaatcgccatgctattgggcctgtcgagacaactccagcacggcccaatcgctgcccaaattgggccatctattctgtcgctcgcacggataccgcttttgtttttctctggattctgaactcatatactttggcgccggtcacgtatacacaacaactatatataatcaaagagatgcacacagatacgtatgtgtttggaaacaccctgatttgttgcgaacttcagcttggagcatcttgatcgacaagacaaactctgtatttacatgttgttgttttttgttgttgttcaagcttcgttgttctccttcgatcttcgccatgggcaacagct

SEQ ID NO: 37393 - DNA, 1501 bp, Oryza sativa
gatccgttggcctttaccggccttttcgccgggcgagccggatcggtgtttgcctggcctgcacggccgcaccacacccggtgcgtgtgcgtgttccacgcgcatctgtcgttctggcgtagcggcgcgccgacacgcaggcacgcggttggtgtggtaagcgagagtactccgtgttttggcatgaatccaaacaggtctatctggatacctgacgtcagatagcgctggccttctttgtgtttcttctccaccaaagaacatgctggtttcggaaagagcgcgcactaccagatgagtactttcccttctcaccaaggatctgtatgcctgcgtgtgagttggagcgtgaaggcacggccaaattagggcatgtttagatccatttggaatggcaaatgacaaatggcaaaagttttgatggcaaaagttttagcattgcaaaagtactagttggtgtttagatgcatgttaaagtttttccattctagcactaaagtgagagagagaaagagagagggagtggtcccaaagcactttttggcacaatttgctactatggactagcaaatgccaaatgccaaattgccaacttttgctactagtgtttaaattcaaaatggcaaaaagtgctataaaatggtaaaacttttgccattttggaggatctaaacagggccttaggctgtgtttagatccaaaatttggatccaaacttcagtccttttccatcacatcaacctgtcatacacacacaacttttcagtcacatcatcttcaatttcaaccaaaatccaaacttccccctcaactaaacacagccttagtcatttgtcactttgtcagccataacacttgtttttctttttaagctctagcgctccttgtgagttgtgagtactttgttgctcaattattcctgtaaggattagcttttcttgctttaaggaaaggcgttttattcttttgcacaattagacatgtgtgccgactattttgaaggcacttgttctttagctgagattaaaaaaagagggcaccaaaggcactttttttcagttgcctctgctgaagaaagttaatgtttgttctttgcattgaattaaatgatcaaatcctaatcaaccacaactttataggagtatatttcatgctctcagttgctatctgttccacagcttgtcaaaattatgttggaccctatggccaacacaccgatgcatgcgctctcattgaatcattgttttctgttgagcaatctcatggttggttggtaggcttccttggtgggccgaaaagatgacggcacggatgccatcttttggaacttggaagcatagagtaatcaaagaaccacaaatgcatatagctcgtccagaaagagggtctatgattatcgctgttctattatgatagggttgccaaactgccattttgcaatgtggacacctgattgggtttggcccatgagctggaaagttggcattgcgatcatatcatt

SEQ ID NO: 37394 - DNA, 1501 bp, Oryza sativa
  unsure (1)..(1501): unsure at all n locations
ctctgggctgtgcatccagccagcgccgtgctttgctgtgctgtgcgagcagtgaagtgtggcggctttgtttaattgggtatcgcgtccctgtccggccaccgggtggtggttcgcgtccgggttggccgagctgcgagagcgacctctcctcctcctcttctcctcctcttcctcttcttcctcgtctcgtctagttctacatcgccttcctatcgcctccgctgcggaaaggctctccctttccgagctcttcccgagctctcctgcttgttcttggggccggggaagattcttgctgctctgaatcagaggtgggtgctgatacctgcttgctcttcttgttcttgttcgtcttaatccgagctcgtttggattgggagagagggctagcgttgtaggcggattgatttttgtttgggttgttgggtagtggcaagaacgtttgcttttggtgattttggcggctcgagctctgttgaaagttacttttttttttgggtacatggggtgtcgtgaaagtgaatgttaatatattgtttgtttgtctgtttgttcgtttgttcgtttgttagtttgttttcccgagttgaatttgaaattttggatgttattaatagtggtgttcttgccgttctgacggttgctgctgggcttgtagtctctgatttgtggctgcgaaattggatccaatcttttttttgggggaaaattggtgagttttgggatcaaattaggatcttgtgagaatataagcaggtgaactcttgcattcttgcccgcttcaatccccaaaactcgtgtttgctgctgtcctggtatttttgacaaagttctattctgacgtttgaattgtccattgcttggatttaaagcttggaatttttcttctttttttttctcgaataatattcagcttttaggtgctttgccggagaattcggacgcgattcttcccttggccaatcccattgagagatgccattcatgtttctgtcgatccatttctttttttgtttgttttctccagtaacctttctgcaatcacaacagctctactttttttctctatgtggatgtccttgtgaatttgctctgtaggtgagtagtgtctgccttgctggacattgatgtgattgatggagcatctgttgcctaatcattttagctcaatttgatctgagctggcgttcagtacattttgaaagtttatccgtacagagatttcggcgctgtacgttgcctgtttaatcacttctgtatacagctcatttggatccaattcctttagctgatgccatctggatccattgttatatcctaaacagtttgtgatccaactgtttcgttgctgtttgttatttctggttgatgaatttgaagtgtagatttatttggatggatcaagatttatttagagcagataatctcatttgtagtatgtttggttctntgctgcatatcagggtcaagtagtatatcatctgtgagttaagnagaa

SEQ ID NO: 37395 - DNA, 1501 bp, Oryza sativa
agtctggtaaaatcattcattgctccaccttcaccagatctctgaatctagagtgatggtatgaaaaaagtgctctctgaatctgccaacatgtctctacagactacagtatttgtgtaccatggcttctctgctagattaattgaccattgacagacccagccctttttctggagtaacacaaccccaccaacatttacaaagattcagcacagtagtagtactgtactgtagtagtacttgtagtatcatacagtatcaaatgaaagaaagaaaaagatacagcagacaactgaattgattctataccagttttaatgtagacaatttttcgtgtgatggctggtaataggatgccatgtcctcgtcctaggtgaaacaaccacgtcatctcgcgggtaaatccattcatcggtagtgtgattttgtaaaatacacaaccaaaatatatgtacttaagtgttaaatgtcaaaatgtgtgtgattttctgcaacttagaccacaaaatgtgtagttttatgaaatttactctttattaatactatgtctttttgacttttcgcctatattttcttgtcagttaaaagactgaaaatgttttacagtatgagccatcactcccacgagagttcaatgaaattattgaaatggacattatgtaagtggcacttcagtcttaaggagcgaagaatgataattgaagagttgatctaaaagaatactatgatttactactaaagaggtgtttacaaacagaattaggtttaagagcaagtataataatgagctataagcctactataaacttatgtggaggagagaaataacaaaaaatcaagaattttggctctcatgcaagagctagcttaacacaaactcctaggcaaatacattaaatgcataggtgagagatagagagagaagatagttgtagccaaccttatagctaatccattatatatattggctttaagataggctaatagtaggctataagtgagctatatacttatgtggaagagagagataaggaaaagtgggtagtgttggctctcatgcaagagctagctccacacaacctccaagaaatatgcattaaattcatggagtgagaaagagagagaatggaaaaaataaagttaaccttatagctaacttattatacaagttaactctaacattgacttatagtaagcagtgagctttactattaaacttgctctaatatatagatcaccgtagaggccgttgcttcattattatgatgttgaggtctcgtggtccactgtcgatttgcagcacagctcacaagtcacagttctgacctgatcgtctaattttgatcccaaatagctgcaccccaattcttcaatttctgaacaaagacaaactttttttatgaaaagaaaacaaacttaagtgttcttgctgtaatcttgtattgatgcaaaagtggtaacaattaatgattttcttgggtttggaccggctcgcgccatg

SEQ ID NO: 37396 - DNA, 1501 bp, Oryza sativa
  unsure (1)..(1501): unsure at all n locations
catgttatctttcgttgctctttagctgtttttttttttttttgtcgtggatggtagggaaaggatgaacgtgacaactaacacgtctccagtagttttgttgcacggtaacagagtagctgcagggggcagtcacattttggtgcaaatgttgtgttgggttcatgatggggaaggaaactggagaggtaaattaaagaaatggagagtcgacaaatgtggaaatatgaaacaaatatgaaagtgtgaaagtaagagcatttacgaaccacagctcaagcaagcctaacaaaaaaaaattaagagacagatgtggaaatgtgagagtgagagcaattatgaaccacggttcaacccactggtcttagccaagtctatgaggcgaagatttgggataaactcgggtcaacgaagcagtgatggcggcatccctcgcggttcatctctccaagctacaagatgtggcgatggagttgattgtcgcaccaccatggcccttggacacaccaccttcattcttttctcctcgaatgattaagctgctaatgaaagaaaacgggtaggggaagcttttaattttttagccattagatgtgcttcgaggggagaaagacattttcttcgcatgtggngctagggaatcatactctcactgtgagtttgaaaccgagcgccgcttgttgttacataagagtaacattgtaattatatttacaatataattacacttcaattatattagagttatattggaatggttttatatagntattctcttatattatctatggttgtggcctatgttgcgaaactagagagagtttttttcccattttttatcattatttatatttatttaatatgttaatgtacacaaggaaatatctcttcaagagattgaaaaaacaatctcccgtgtataaattgggaaatggattgattgtaatcccttaaggcgaatgtttcatcgcacgcatttttcttttaaatttggtgcaactggctgtaaaattacttttaaaaattgataatgtacaacataataatactaatcactccaccaaaatcaatttcaaaattgacctacatattttttaaaaagaattggaggaaatttaggtttgagtaataccaaacaattgatttgtccttttttaattattatttttcaatatgggtttgaattaagacttgagattttatgaagtggtatatgtattgtataatttttactaaattcaataagattttttatatacaaacgaatgggtttaaatgaatgaaatgatatattacgagagatgtaggaatgttccccataaattaggataagtatcctctgtctttaaaatcatgtgactttatcattgacacgtgtggattcaatataggcaaaggatttcaatcccataaattaagtgcaaagcgcgacactcaaccacagcacgtagtacgcgctgttggttggtatttcctcgcgaagcccaaccacagctcgcca

SEQ ID NO: 37397 - DNA, 1501 bp, Oryza sativa
gagctatatatattcatttcctggtgagtctttgcatctgctctttccgaactattcttagtgataacaaaagggcatgatgttaatttcaccttgcatcttgttgatttcttaatgattcatcatttcataatttggatcattttgccccaatgttggtgggcgcttggagatgggggatgttcttggtttactacatctcatgtacagaacttgtacctatctgttgtattgaagtgcaaatttctttgatccagtactccggtgccagccttattccccgttcctacgatatcttcattaaagaatgccaagtctccaagaacgcatgttccgttctttgacagtttgatagcagtggcatgttgagccgttaggtagcatatgaactgtcagatgctgttgtgcatatgaggttttgtaacatgatcaagtcaacacataattcctggcaatttccatgcactcatgtgcactaaataacagtagttgacttaacatgaaatccgatcagaattcagaaaataacctccaaactgaagaacatgaactgaattttttttggtatcgtatttcagtagctaatttttcatgatactgtatcgattcttaaattcgttgaacccggcacgaacaagctgccttggctgctaaaaatgtcatttgataattatgaatttggtacctgttaaattattgcacgactcgtatcatggtacacgaagaactctggcgttgaatcgatccttgcacgtcttagtccccaacccacacgctcagttgccatcattatccccacccgctgactgacccagggctgcatgtttgttacacctccccaacatttgcacaactcgcacatcaccgaagaaatgttcagacataaaaaaagaagaagaagaaaagaagttgcatcagcaagccagacatactactctctctcggtcccttttcaagtgcagttatagttttttttaatccaactttaaccgttcgttttatttaaaattattaaaaaaaaattaaaaaataaatacacataaatcactattcatgttttatcatttaataacaagaaaaatactaatcataaaaaaaatttaattaagacggactgttaaacgttggacatagaaaaccacaactgcacttaatataggatagaggaagtagtgctttttttttgcaggggcataattatcatatcatggtgtgcaaaggaagcgatgggacaatctcgttatgtttaaattattagggcatttgcaaatttgccaccggttttttcaatattgcaaggatgccactcgaatgatagttctagtggcatttttgtaattttctaatggcagttttgcaataatgattcaaagtagtggtaaatttacaattgcctctaaattaattaggatggacattttccaaaaagacttggagatcggtcagggcttaggacaaaccagtgcacaatgtaacagcgacatatcgcgtagaagaacaa

SEQ ID NO: 37398 - DNA, 773 bp, Oryza sativa
atctcatcctgtatcttatcccatattatttccttccaatcggattcgagaacggatatctatttgtatatctaattcatagatattaaatataataaagtaattgaagtattaaaagagatacatcaagaaaaatttatccaatattacatgtgagtatgtaaaatagttattaaccaatcttttatcatattttttatcatatttttaggtgaatcaataataatttttcatacatattttataatacggaacatatgggcggatacatgttttcccgtatcctaacccatatttatggcatgccacatcttaggtactaaaggtttggcaacctgaaaaagcatcaaaacaacccctactagttaaaatttgaagcacccaaccaaaatatattcgtgaatcattttaagcatagtactataaagtcttgttcaacatagttcattcatttcagcccatctcattcacaaaaagagtgaagaaaaattcgagcaaagcaaaaacatctcaaaaccacaaataacaagaaggaatcctgacacaaatcatctatcattctcaacatctcccacaatcataaacaaattaactaaattaaccaaacttgcctgatgttgaggcaatcaagaaagcggggattagataagccaacacacatggagtgacttctatcaaacattctcccgcgaacagtgctggtaaactcgagtagacgggcagcaccaacatccacagttcttaacctcggttgtttttttcttgtgatgctt

SEQ ID NO: 37399 - DNA, 1501 bp, Oryza sativa
aaaaaatgtttatattttgggatggagagagtatcttaatttggttgttatgatcaagttttggaaatgtttgacaaaaggtggtgatgataacaggactgctttttattggaaggaatttctccattgctatggatgagcagctggctgctcctattggattcaatataacttttcctggtatgcttagctctgtaattgagatgggtttggaggttcctattggacaaaccgacgtcgaaagagtacttcatctccaggaaacggaattgaaaaggtccacaaaattatattttattttgtcattttggattttggtgcacatattgtagcacttttcttgttgtaggctgtttccttttccagtaatcataatatttagggaagtgggccatattaccattattgtctatttgtgactatgatgagtttggaatttcttatatctgacaaaacgatatccacgggatacttcatctccgagaaataaatgccacaacaatttgtgttttattttggcatttctttctttttcctgaatgagattggcaatttttatcctcatgatctaaactaaatacagtagtcttcttcttgtaaatagtcccctttcataaccataattgttagtaaaatgggccaccttatttcaccaaactagtctagaaattccaaactttgaaatttttaatagcatctctaagtaactgactgaaattcctattttgatttaaagagaatatgaggagaactatcgtgggagaaacacatatatggcatatgtgtcagaaggattagggaatgcccaagactggaatgaagttatgaatttccagaggaagaacggatcattgttcaactccctttccataacagctgcggtgttagtccataattatgatgctaaagctcaccgatacttaaatttgcttctgaacaaatttggcactgcaggttggttttaacacttctccattccaagttgccaagaatttcttcctaaagtgcatactattagtaactaatgccattttttttattttttcatttatgtttgaaaccgagtgcagtgtatacgaaaaatatacatcgccaactttccatgcttgatgcgcttgaaaatatgggaatatctcggcattttgatggtgagatcaagagtatactggacatgacatacaggtatcagcccaagtaaccttgagtaaggatcagttgtctgcttttttttttcttagctcatgcaattgacaacagccagtttgcagttgttggttacagagagatgaggaagttatgctggacatcacaacatgtgcaatggcatttcgtattcttcggatgaatggatatgatgtttcttctggtatttttctaattctggatttttttcctcgttaaccgtgtttaatcttaggttatcttcgatcgttttgacacaattattttactctattttaattattattattattttactctagttgacacaatgatccat

SEQ ID NO: 37400 - DNA, 1501 bp, Oryza sativa
tgaccgaggtagaatggaggatcagcaactacgtgcctacaccagaggagtacatggaaaatgcggccatgacatttgcattgggcccaattgtgctcccagctttgtatcttgtcggaccaaagatccctgaatctgtcgtcagagattcagagtacaacgagttgttcagactgatgagcacatgtggtcgtctcctgaatgatgttcagacatacgaggtatatgcaacgatctgccattactcccaacacaaaaagatcaacaacatacataagcaaccatttaactatatgattatgacccagtatttacgactgtttgggaagcttttagctgttatggcttcttttagaatctctccagctccctaaacattccaaataaaatcgataaaataaactactctattcgtttcaaattataagatgtcttagactttggtcaatgtcaaactgcttcaagtttaactaagtttatagacaaatatagtaatatttatattaccaaattagttttattaaattaataattatatatatatatatatatatatatatatatatatatatatatatatatatatatatatatatatataaaataaatttatcttggtaaaaaatatacctattttttataaacttagtcaaacttaaaatagtttaactttagccaaagtcaaaacatcttataaatgtttatcagaatcttaagctcctacaaacataaagcttactaattggtactcacaattgatcttgttctaattggcactcacaattgatcttgttctttcgctgctgatgcagagggaggatggcgagggcaaggtgaacagtgtgtcgctgcttgtcattcagagcggcggttcagtgtccatcgaagaggctagaagagagatcatgaagccgatcgagagatgcaggagagagctgctggggctggtgctcaggagaggcagcgccgtccccgggccgtgcaaggagctgttctggaagatgtgcaaggtctgctatttcttctactcccgtggcgacggcttcagctcgccgacggcgaagtccgccgccgtggacgcggtgatccgcgacccactcgatctcgccgccgtcgtcgcaagccaagaacccatatatatcattcctgcttcgtgactcgtgaggaaattgaactagagatgtgatcgtggatgaagaaactgtgaacgtgttggagattgaacacgggaccttagggttgaaaccacgtacccctttctactgcactatcaagtgcatctcctgctctttcttttatgagataacggaaatattttaagtctccgtacgcatgtagtcattagttagttaattctgtttggacgcctagtgcccgcagcgtgaggataagctcgcagcgtgcggatcgtggggatggaagcggatcaaaccgcggcgtgggtgatcaaaccggggaaacgctttctatcttgcgtgttccagcatgttccacttcgcac

SEQ ID NO: 37401 - DNA, 1501 bp, Oryza sativa
aatctgcatctcgacagtttcataaaatatagttgcatttgaatagcataggtaaaaatgatcataaatttttagctagccatcaaagtaggaaactaaactcggttctacaactcttagctgtatcactaaataaaaggtgatgagaaatagatagtttttaagggtgtgtttagttcacgtcaaaattgaaagtttgattgaaattggaatgatatgacggaaaagttagaagtttgtctgtgtagaaaagttttgatgtgatggaaaagttgaaagtttgaagaaaaagtttgaaactaaactcagcgcaagtcatactccctccgtcccaaaaaaaaaaagctcaacctaaacaatgatgtgacatcccctagtacaatgaatctagataattctttgtccagattcgttgtactagaaaatatcacatccccttttaggtatcattttttttttggacggagggagtactgtacacagcaaaattatgaacaggggtcagaggatcagatcaataggattataggtgtgtcacttgtcaaccactttttgcaagatgttttcgagtcgacgaaaacgtttgtaagaatttggagataaattttgatgtaaacatctgaagttttgtatatttagatatggatgacgaaaaatatgtaggttcagtttagtggaacctcaaccaaaccctctgctgtttggaatcagactcctttgtttattgatgaaatcaaatggtgggtgaagctttgatcgatggtgtgcatccggatcgcagatgatttcacataggaaagaaatctgtagcgaatcatcttgtgtctgaattttgtactacgttacatggttgagtaaatgaagcgataaaaattgtgagattttcagagttcagacaaccatgtggtggagtcttgaattcttgacgttgtgcaacattcgcgacatgtataataatgagagcaagtttaatacttatagtatagctcactactagctccaattcatttatagacaattcatataataactgcttactatactattaatatatggtcccacctatcatacacacactgtgtcttggagtccacgctgtagctggctacagatctatagcccacctgctcttctctcttatcttttgtcttattaaaatatatttacagccggctaatagatgctattgtacctgctctgatgagaaatttcttaggccatccacaatgggtacccctaagcgtgtccctgctcacggccgtcgccgctccgtccgtttgccgtcccccagcagaggggcgcgtctccctccactcctcggtcgcttttcgttgagccatggagctaggggacgcgttgggcgacgtcgtggcttgaggacacggctcccgcacctgatttttcccctttcacccttggcctcttcgctgggactgggaggcccatggcggtggggaggagacggagttggcgacgacaacgaccggcgacgaccccgcga

SEQ ID NO: 37402 - DNA, 1501 bp, Oryza sativa
cgtgggtggccatggtgccactgcggggttcccgtcagcatccgtgtttcccacaatgcgtggagtggatattacaaaaccagcaggatgatggatcttggggtacaagaggattcggcgtggcggtcacaagagatgttctgtcgtctacgttggcgtgtgttcttgcactcaagagatggaatgttgggcaggagcacatcaggagaggtacaaacgactgtgcatttacctgtcgatgtttgttttaattgactctgtatgtatctacacatttaaggcttggaatgtcttaacgctatgaaaatggtactgtcaggactagattttattggaaggaatttctccattgccatggatgagcagattgctgctcctgttggtttcaacatcacttttcctggtatgcttagccttgccatggggatggatttagaattccctgtcagacagacggatgttgatagacttcttcacctccgggagatagaactggaaaggtctgttaattctaacacgaacatggatattgtatgtcattagtatttgtattactgttgttacgagtatgtaaagttagtatgcaagggttgattgtgtggatgaagttttaccatcaggcgttctaaaaataactgtcagcttagttttattccctagttccccctgcattctttttgaaggaaggaatataatgaccttctcctctctttttttccaagatcctatatttggaggaaatgatcaatctcggttttaatagtgcctatgagtaacgcactgaaaatctgatatgattaaatgcagagaggctggagaccattcttatggaagaaaggcatatatggcttatgtcacagaaggattaggaaacctgttggagtgggatgagattatgatgttccagaggaagaatggatcatttttcaactgtccttccacaactgctgccacattagtcaaccactataacgataaagccctccagtacttaaattgtctggttagtaaatttggcagtgcaggtgagtctgcacgcattttcttgtcaagaactttctacagtgtagactgctcctaaatacatagtaatacatttggtccattgcagtaccaacagtgtatccactaaacatatattgtcagctttcatgggtggatgcacttgaaaagatgggaatttctcagtattttgtcagtgagataaagagcatcctagacacaacatacgtgtaatgactttgagtaagtattttatctatctttaatagttcaaacttaattttagctagtttgcagttcatggttagaaagagatgaggaaattatgctggacataacaacatgtgcaatggcttttcgcctgttaaggatgaatgggtatcatgtttcctcaggtgtgttctaaggcttgaaaggaatattttttttgttggtttcgaactatattctacctttggttttcatttaacatgctgaattattttttatttaacatgct

SEQ ID NO: 37403 - DNA, 1069 bp, Oryza sativa
ttaaagatattgcagtagtgctcaagatttgtatataaagtactagataaaagaaacttactttagatataatgctgcttaaattagacgcgtgcatgaatcatgtcttgtaggagtacatgtatactccatccgtcccaaaagactcaacctcgtcctacgacgtgacacatcctagtacaatgaatctggacatactctatgtctagattcgttgtattagaatatgtcacattctaatactaggttgtctttttttttaaacgaagggagtacataccttggggtaaatgttaaaaactatatataatactcccttaaagacggtaaaatatctctagttttacattgatctgtaattgaacactaatacctattattccttccgtcccaaattatagggcaccctttttttataataaaaattaaactcggtaacttttaactgctaatcatactaatcatatagtatatgctaagtattatgcatgttatatcactagttttataatttaaattattttcgtgtgatgctaatttcatatttattggaatatagtatggaataaattaatgatcaaagtatatcattggagactatgtaaaaaaatatgtcttataatttgggatgaatggagtatttttaaatctaaatgttccaaagctgcctttaactacgtaaataccttacccctccacaaagggcacccctcatggtcatgcactcatggtgtcttttctctctcccttaattaattagttacttgtgtaattaaatgtaaagttgaggagagatggatcgtgtaagagggaaaaggacggcatagatacaatggaaaagaattgacccggccccctcttgtttccactccacgctataccacactgcacatggtttcataatacctctaatttggatcttaatttagaagaaaacaaattgtcgaaacatgaattcggcaataataaaagggggtagcgcacgagacctaaaagtggatggatgcagagacaaaggatttagacaggttcaggccctctcaatgagaggtaataccctactcctgtt

SEQ ID NO: 37404 - DNA, 1071 bp, Oryza sativa
  unsure (1)..(1071): unsure at all n locations
cattgtgcattcgctacacaacgcagcagcagcctaacttcggttcagaggagtttgtccacaagaacaccattttatttttatttttctgtatttgaactcagcagagcaccaaacttatgcagtgacactgaactgcacccccctttttttgtcgtttggaatctttggatgttagtttccatatgtttaagcgtttctgcaaattaaggaaaatttcctggaactattatcaccctagctcccagaattatcttgtcatatctgcttgtgttgcacgagatgttgagagtggatgctgacttgttcttttacctttttttcagttcattcactctgttagtgccacacttcagttatgtcagttaggatttttaccacaattcttatgcctgtttttttacctgagtttgacacgtttgtacaatgtacagtacaggtgactgaagtaaaatttgagctgtacacgttcaacacgttggtacaagggagtaataaaaaactgccgaggaaaactttcatctactatactgtgactgcaatataatttcaccataacttaacaaaattacaaaattatacctaagttatataaatattacaatactctgcattgtacctatagggtaattatattacaattatcctataataattatattataggtacactataactatactatagttaaatttggaagtttggttagcaagttttttaacaattcccttgtacaatgtaaacaaatatgagttgtgacttgtgagtngcacgcacaacagcaagagaagtagccagaaaacaagtacaagcacaaagggccgcagtatgcagacgcagctgcagcagcagcgaagaatattgatagagtaatagtagaattcccatggtcgtacagcttcaaataggcggatttatggnggggcaaagatacatttttcattgagttcgcacaatcaacacagcatgattacacaataaatagtaatctctacacaaaaaccaccctgacctattgcaatggtgttgcaatagttcagcagcactcaccagcacaccacacaaagaca

SEQ ID NO: 37405 - DNA, 1501 bp, Oryza sativa
ggaaatggtaattgccagaattgagcgtcagtgtgggaatttccgcgactgttttcacccatagtcatatatatagtgtttatgtaataaataatagcagtaaatatccttgaagcaatgaaaactaaatttatcatatgcatacgaggcaaaaggaacataaacaccttactagctataaatgttttatagcaactattaccagcaccaacaagtaataaattaaactgagttacattcttggattactaatgcagaaaaacaacttattagcacgctgagctcttgtaggtctgtaacacatgccctgagcagtactcatgctttgtaaaatatgtgtcaaataaatgaactaaagaattcattcatagtgccagagggaccaaataatttcaccaatcttcttggttagaacttgtaacaatccttaatgtcgcaccaaaattgcaaccccggggatactcagatactgtaactgtgataaaacaatcttgtaaaaacgtgttttgaccttttggaagtgaagttcatcacccctagcaatcttatccatcccccaacccaacctaccaaactaacacctcaaaaagaattgaagcaacatccaaacgaaatgatttccccccttctgtaccatcgattaccaccatatcacatcgattcacttaacccctaaattcgggacaaaactggatgaaacaaaaaaaaatcaatcggaggcaaataaatccatccaaagcccgaacaagctcaccaacctaatccacgacgcctcatcaagcgatccgcggaggatatgagattgaatacctgcaatccgattcgaaccgagatgatcgattgatcgccgtccttgcgccgcaccaagggggataagagcagggcagggttcaggtaagaggacgaggcagtccgcaccgtgcctcccgggccggttcgccggcggcgagagcgcgcgcggaggcgaggcgaggcggcgcggaggagaagggctcgccgtgtgccaccggcgaggtagagagagatgggggaggagtagacgagacgagtagtgcgatggatatcgtttgccgtttcgattgtgaaggctcaagccggtgacgtgcgcagatcacggacgttgatttactttcgacggtcaggatctctcggccgtatgccagatcaaggctttgtacatggggccggccctcgagatagatggggcccataaggcccatctccatgttggcttggcctgcagctaaacgccgaattttttttatttataattttttttattaaaagttttacaaaaataattttccattttgaaaattgacggaaatagtcgcctaccgccctctgggagggcgatttttaaaaatcgccctcccagagggcggcgaaaatgacgtggcagacggccgttcgctctcgggcgacggccgtcaacgaaatttgcaggcggcccccttgccgccctccgcgagggcgattttgtactgtgcggggggccgcc

SEQ ID NO: 37406 - DNA, 1501 bp, Oryza sativa
  unsure (1)..(1501): unsure at all n locations
gtttaagagctgactcttcataagctaatctctatttagttagtacatactgatatgaactaaggtttccagatgctaaacagttcattttatattttatgatttttgctaaactcttcctctgataaggcgcatgaaaaaacataaatcactagagacatctgtgtgtgagaattttattcaactgcatcttcatgtggagggaacattgatcacaagttttacaatatggagtttacttgaagtacagttctacaagtttcttcagggtgtcaaacacacttgtgaatgggttgaatgcaacaggtgcactcagcttcaggtctgggaactgattcgtcaaagcctcagtcatcccaggcattgacatcatcagaccaagctggtccgtggacatcacctcgcaatcctgtggggtgtccttgatcttgctcggatcataaccgaagttggcagcgtaggacttgtacttctcgatgaattctggtccaggattaggtgttcttgagtatatctgatgcattgccgagagacgacacaatgttatgatatttcagtttacaaaatgcgtcagaataggcatatgaaggtaaggaatattggcttgatttctcagtgttcaagtccttgcttaaccctatgttgtctctatttgacactatatttggttcatggaacagcttacgtaactagattgatctttcaatatgcagaataagcatgcagagggctaagaaatagtggtcatttgcagttcagagatcagtttctgacctggataaagcttgtgtctttagcaccagacacaacggcgtaattgtcataatcggttgcaagcacatcataaggttccttttgngngtaatgaatggtagtgtggggaaacggagaaagcatttccccttgatcatctcctgcctttcaagatctgtctcagcactcgccatgtcctcttcggacaggcattgcacccttccccgaataccggtgatgtaaccatcaggtccaccatgaacacagaatgtgtccacctggattgagcgtgatttctcatccaatgcatacaccccctgcagtaccaacaaatttctgtaacaatcttcttacacattatatggtgcaaatggcatagaaaaaatagcatgcctgtgataacctattccaaatcagtttgatacaaagatgtcagatatcggtgttttcaggaatcaggattcagaggtaacattatttagtttgcccttgggggggggccaattccaatttaaccagctaagaaggaaatttttttttaaaaacctactagtattggggtgaggattctggcactacaatacctgagtacagtgacagtcctcttgtccctgacaagcaaagccacgtttcagcgatgctacttcgaaccatctaccagagtagcgaattgggtcaaagttcttggcagtcatacccttcatcatcaaacctgtgccgccatcatcagaagggctatcgaatttca

SEQ ID NO: 37407 - DNA, 1501 bp, Oryza sativa
agctttttttctgctagaaaaataatttccggtagccaatatccaaccccttccattttaataccatcaatatattaaatggtatgatgttagtctattaaacctacatactcattaagcatattgtgcaggttataaaattgtaagcgtgccaatagtcacgctcttctagtaattatatattgcattgttgaagtgtggagttttttttttccaagtgtaccttaaaaaagttctatactgcattgttgttagtatctctgcacgggacctcttcttgagatctgccagcgaggagcgcgcggagagctcatttctgtgggtcaagagctcatttatgtgggtcgaatctgtttccaacctggtaacgtttataaaatctacgtacaaggacactttgtttggactaatgcgtccacgcaggtgaacactttttcggtttgatcgctgcaacctataaatatgaatatgactcctttccggatccatgctaggtttatttttttcataaactaggacggagagagtaaattgacgtgtggtatccacgtgaagacggtctcaatctcacatgttatctgtcctttttttttaacttgacatgttatctcacatgttatctgcaggtgaacacggaggtttattttttatttgatattttaaagcaacttcttaccagaaatttagcactttataaaaatgtggtaacagaaatcgaggtgaaatctgcatcttaattagaaaaaaaaaggacctagattttttttattaagattcagatttttacctcggttttcgttagcacatttttcaaactactaaacggtggtgttccgtgcgaaagtttcaaacaagctgggcaaacccgccgacgaaggaagcgagctcaatgttgtttttcatcctgttaatgtgatgtacctttgttccgcttgtcatctaaatagctactccttccgttccacaaaatgacattttagcttctttatctcttttctaaatttactaaaaactcatatataaatctaaacacatatatagagcatatacatatgtctatgtataaatttatttaaaagcaaaacatctagcattgtgaaaaccgaggaaatatatttttttagaaaaaaagaaaaacagacaaggttagtggagtaatttagcagcctccatccagcatcttccctccggactcccgtctccaaagcaagcgccacaactcgaccctctttgcacggttctctcaagcattcacccccaatacctgagcgctccaccttcgtgcccccgactgccgacgccgcagaagcacgtacgggcttgggtaagtcgtaacgtacgtatccactctcctctaacagcagccacgaatcaacaatagctgaataccactgtcatattactgttcattcgattgcatttgagtgagaattaatggttcgtcttctcgattttgcatgcagcatcttggactgaagcgcaaccgcgcgcatcggatcga

SEQ ID NO: 37408 - DNA, 1501 bp, Oryza sativa
aagtgttttttttaaaaaaatatttttaggtgttatttgcaacccttgtatgcaccaagttgaaattgtatttcctatctgggctattgcagtgccccttgaagaattaaaccacagttactgctgcaaattactgaatgcatcatttgttcagacttctgacttccaattcacaaattattttgcagaagatagtattcaagtgggttcatcaagataatttgtttgcagtgtgctggagatagtgtggtctgaccaggcttgttggggattagtgaagctaagcatcgcagatatctgacaacagagagttgatgcccatgtttgctagcacaatatggatattattgacttgtgttcagacagtgaagagtacttcagcccgtactcagatacagaagacaatcttgattttgacgatcccaatgatggtgttaaccaggtggttttgcacaacacagcatttggcaataatagttcagaactactagtcgggctggatgacgataactggttaaacaacactcatgctttatcctctcatagacctgctgagaatagatcagacattattgaaagcagcagcggtgtcaacactgactgtcagaatagtgcttggcaatacaggactcttccacataccttcatgagcagcagttacaagtctcgtccactttctctaacaggaggtaacaatgttgaaagtacacaccccactgtgaagcctaacactgtgcactataatggaattgggttcccttcacctgctattgcaagtggctacaagccatatgttagttatggccagggtgtttcaattgatgatgatgacggtgagtagaactatccttgattaacttgaaaagtatactgctgtaacttgcgattagtacaactaaagtttttcccttttgaaacctgtcagatgatgtctatgaggttctgcatcaaccatttccgttcagtcattcgagtttaggtgacaagaagatcgaggaagaatccacttggaagtacaatggttttcaaacaagttctgcctatggaatcgagatgcctacatctgcaatgtcaacaggttggaagctacctattaatagcaactgaaaagttaaaactgataatgatgatgttcatgtaccataattccctcaaatattctgatgggtgatcacataaaaatagttttactagtataaaatgcgatattagtaatttttttctctctgtttgaaacttgcaggtggtgtctctgcatatggaggtctaaactcacataggatctttcctccatcagtgccatacaacaattctgttaacaattttggagtcaatggccttggcactcagagccacttaaatatagaaaagaggctttttggccgtgatgagagggtggtgtatgatgaagccctgaaggtatagaatataattgtgtggtgattcaattttattgtacttactgtggattatacctttttaaaacaaaaaaatatattgt

SEQ ID NO: 37409 - DNA, 1501 bp, Oryza sativa
gatttcttctgtattaccaaaagtggacgattttaaaaaccgaatcaaatacggatacatatttttaaaagcaaacaaacttaaaaactgacgtatacacatatgacgtaccaaaataccgataaaaacatcttaaatttttataatagtagagatatgttcaatgaaaaaaattaaaataaactctaaaatttaaattttgacagcggttaattctatatagaggaaccaatgggagcctaagctcttttcagttactgtctgttggcttatgatgacacgctttttatactgtttgtaaaaaacttctctatatatatttttaaaatagtcttttaaagaaactataataattaagtatttaattaattataaactaatgatcttctcgtattgcgtaagacaaataagatttgaatacgctctaccgaacgcaacctaaaccggtaaggcacaaggcaattaagacctaatctcgcaacttgacgagacgagacaccaatttactaatactaacaaacagcaaatttctaattagcatcgcgtcgattgtccgatcattctcaggttccagtgcgcgaggtgactgacaagctagcttaactattcgttgagatttcaggaagaaaaagctgtcaaaagcttaataacaagacgtggcacctctaagctgttgattcccgaaaaggacaaagaaaacgaggagagcaacgtcgcaacatgccccggcccggcccggcccattatcagcaaggcccaaggcgacgcgaatctcgaagcccacaacatcgaagttgaccgttcaacagaaataccgaaaatacccctgactaaccaatcatattacgcgaatgaccctgcccgagccggccagccacttagacctggtcaccgccggcttgggctttaaactaacaccagtggcattgggtgtaaataaatcgaaatcggaggggtggggtgggtacccctgatgcgtcagcgttcaaaatatttcgaaatagctcggccgcctcgtcctcttcttctccttcctctctctctctcttctcccacacatctctcgctcagatccgagcgaggcgagaaatccatgaaaaatcgagggtaatctccgctcggtggcttcaaaaacttcgaatccttccccaatttcatcggctccgcagtttttttctcgaggtttttcggatctaaagcgcggctttgtcggcgcttgtaagccacgagagagagagattcttgtgccttcgagctcactccatccggccccaagaaagctcccctcctcccacccaccgccaccactgaggaggagagaaccctaactataacccctaatcctgccactaatcccagttcatggcctcctccctcacgccccgtagcccttacccggtaattttctctcttttgtggaaagaaatcgcctattttgggggagggttgattcatgggagcttagttcttgcgatttgtggggtgtggttgttgttgttgt

SEQ ID NO: 37410 - DNA, 1501 bp, Oryza sativa
ttctcctccgcgaccctgctcgcttccttctctgaaagaaccttcgaaagcgagtacgcctgcattgcatccatgtcttaatattttcgatatgcacaaatctatcagggacccaaaaaagtttgaaatttaaacaaatcttgaccgaatttaaatatttttttctaaattaaaaaaaatatgaaatatttggatgaagtaaatgcttgccggaaatttcgaaccgaaattgtaaacgctgattgcatcagcacacggagctgttctcatgtggccgatttaatgggctctgagcctctgattgactgacctgtgttaaataaaatctgtaattttgtgtgtacctttccgggagatgtcttgttggctggtgagctgaggtagtcgacgtcggaccatgacgactcgtcgaggacatggccgtcgccttgcagcggcctgccggagacggcggccgccgacgatgtgaggaccacgcgcctcaccgtgccggctctcacgcacgacctcatcacgttcagagtgcctcgtacaccggcttccaccagttctttctgtcattaccatcaggctgaccaagtaaaaaacaaaactactcccttcgtacaaaaaaaaaatctataactgattatgatacatttagtataacgaatctggatagagatatattcagattcatagtattaggatatgtcacatctagtactgattggtttctatgagacagaaggagtgcgtgtatgtgattctgtgtatgtgtctgtgtcatcgcaacagaaagtagcattgtttcgcttatttaaatcgcttattagtaaataaaaataaactatgatgagaaaaagatcaaacttaaaattaagttctaaattttaaatgttagcttgtaaatgtaagcataagccaacaatgaagagtgaagtgcaaagagacatttttatggaggaatacttagtatcattaatggcctggcaaccataagagacttgaggagtggcaaccaccatctagctaaatccataaagataatcttaaaatatgtttccccttcctccgttttatactataagatgatttaactcttttctaattatgttttattatgataagttcataaaaaaaatacagaacatttctcacatataacaaacataccatctaaatacattcaaagttatttttaatgaaactaatttgatgttataaatattattaaattttctataaacttaatcaaattgttgtagacggctatgtaatacctgagggttctctgacttgaggttcaccggagcagcgacgaggaaggcgtaatcacagccggcgaccgcctcgtcgaagctgccttcctcctccaagtcggcgcggaagaccgccaggggaccaagtgcgtgcaagtccttgaagtgggagttcttctccatgttttctgcgactcaaaattgcaatgtgtagcagcagtttcagaggctaaaaccaaattcctttttaaaaaaaaaaa

SEQ ID NO: 37411 - DNA, 1501 bp, Oryza sativa
tgaatcaccacacaattatattctataccttcagggcttcatcatacaccaccctctcatcacggccaaaaagcctcttttctatatttaagtggctctgagtgccaaggccattgactccaaaattgttaacagaattgttgtatggcactgatggaggaaagatcctatgtgagtttagacctccatatgcagagacaccacctgcaagtttcaaacagagagaaaaaaattactaatatcgcattttatactagtaaaactatttttatgtgatcacccatcagaatatttgagggaattatggtacatgaacatcatcattatcagttttaacttttcagttgctattaataggtagcttccaacctgttgacattgcagatgtaggcatctcgattccataggcagaacttgtttgaaaaccattgtacttccaagtggattcttcctcgatcttcttgtcacctaaactcgaatgactgaacggaaatggttgatgcagaacctcatagacatcatctgacaggtttcaaaagggaaaaactttagttgtactaatcgcaagttacagcagtatacttttcaagttaatcaaggatagttctactcaccgtcatcatcatcaattgaaacaccctggccataactaacatatggcttgtagccacttgcaatagcaggtgaagggaacccaattccattatagtgcacagtgttaggcttcacagtggggtgtgtactttcaacattgttacctcctgttagagaaagtggacgagacttgtaactgctgctcatgaaggtatgtggaagagtcctgtattgccaagcactattctgacagtcagtgttgacaccgctgctgctttcaataatgtctgatctattctcagcaggtctatgagaggataaagcatgagtgttgtttaaccagttatcgtcatccagcccgactagtagttctgaactattattgccaaatgctgtgttgtgcaaaaccacctggttaacaccatcattgggatcgtcaaaatcaagattgtcttctgtatctgagtacgggctgaagtactcttcactgtctgaacacaagtcaataatatccatattgtgctagcaaacatgggcatcaactctctgttgtcagatatctgcgatgcttagcttcactaatccccaacaagcctggtcagaccacactatctccagcacactgcaaacaaattatcttgatgaacccacttgaatactatcttctgcaaaataatttgtgaattggaagtcagaagtctgaacaaatgatgcattcagtaatttgcagcagtaactgtggtttaattcttcaaggggcactgcaatagcccagataggaaatacaatttcaacttggtgcatacaagggttgcaaataacacctaaaaatatttttttaaaaaaaacacttttttacatcaagaacaatatttgcctaaaccaggcacagtgatgtgcaataaac

SEQ ID NO: 37412 - DNA, 1501 bp, Oryza sativa
aaagtagctgagtgtttttaatttgtaccctattatttcagatcactgtcacttatgtggaaattgtaattttcaaagtaaaaaaatcaaaaaataattaggtgactgagtttttccttatctatgcgtcattgcctttccgattaatgtttacctatcctttttttcatctctaaccgtcatcactcatgtggaattaccgttttcgaagtgaaaacataaagaaatttaggtgggtaacttcttacttttttcttatctacatgatatgccattgccttgtcaaccaacatattaactaggtgataccccgcgctttgctgcgagatttatggataagtatatattaaatattgtcgaaatgatgaaagttgaaatgttgaaaaaataatgtgagtaagatgatttgacacatgcttgttgatgatgtgttatacttacatgagatttaaaataggctagaatagtactttctagtgagtgaagatgttgcatgcttgtataggattttaaatgggctagaatagtaattgctagtgggtgatgatgtggcatacttgcatgttgagttttaacttttaataattgttagtgggtaccgactatatagaagactatatagaaagtatcgatgtgtagcagcactcactcatgctttgccaggtgaaagagaaaaaaagttattccaacttaaaacaaagtattgtaatttggcaaatatctacaagctagtatagatataaaaaagctaatgtgcaaaggcattcataaaaattaaaatacatttaggtgaatccgtacatgtaaaaatccacactaaacttaaatcaggttgcaataaaaaactatcaaattaatttgaaatacaagcttatgcatgcatgttacttatatgcactacaaattaaacaggagtgtttttctgaagataacttccatatgatgcatgcgactgttagtatagggtatatagcccattctttgactgccaagtgcaaacggaaatgttggaatagtgtcaaccattcagggcatgcgtggactattccaaatctaatacaggccattcaacagtctttgcacggttattctaaaattaaagcacctagagggtgaccatagttatgcatcgaacaaaatctaatcttataactagggcaagaattctccagtgaaattcaaagcattggtcttaattccatggtctaaagaatgtatggatttaaaaatgtgaaacatttgtgtggagattatgggtaccccatacccacacgacatggttatccgactagtcttaggggatagcttatatctatggaatatgtaacagatcatgacttgggtattacgtttccctgtatattatggaacggcctaaagtcctggtttgataagattgtaaagtagatttaggaaaccgataccatgttggttaaggtttctatcttgtaatcctgccctccaccctatataaggtgggcaggaggccctctagggggca

SEQ ID NO: 37413 - DNA, 1501 bp, Oryza sativa
ggacttgttccggatacattccacatggattcatagtcatgagtctattttctatgctcaaagactggaccaattattattccccgtaagggctatcaaccgaatacttgcgccagtcgggattcaattattatatttattttggagtatcccataagggataatcattcagatcagaagctattcatatgagctacacttggtctatattacccggaagatttattactcgggagcatgttacatgcgtcatcctttaaagggtgtcgaaggcatattttttggcctaggcctaatatgtctgcagcccatattttcaggtgtggcctgtcacgttcttttagggacttaggcacttttcgcttaggccaaagtgcgcgtgatcaagtgcccaataccttaaaatccttttataccgcagttactcgactttttaggagttggtacaatgcatcttaaaaggtgtcaaacagtaaagctttatatagctgccccgctgacttttttatatagtcaaggtgctgtttgggtttatcaagcaattgattggatacaatatcattgctttttgccacgtaagtgtgcatttttattgaccaatattatggcttaggctgattatatattatggtcatttttcaggcggttggtaaatcctttatgagtttacttactcggatgttataccacatgtgccatatatttccaggtgtggtgaaacaatgtgtcttttatggacttaagcacatctgttaaagcagtgtgcgcatggcgtatgcccaatactttgaaaatttctttattcacagcattcaagcttctttatagttgttttgctatgtgaactttcaaagatgttgtcaactttaggttgtacgcatcatattttgccaagcagtcggtatatcacttggatcatattattcggggattcacaccgcatatgctatacattgatatcaagtcacttggttgattacaattatcaaaaccactcggttggttagattatttattccttgactatatgtttggttggttcaattaaccacatagtcgggggctacacctattaggtgcatctattcgatgcacctgactatatttttcagccctccacagtcttcagatttggtaaaagtactcgggagaccatggcgaagataattgaagcactcggctttggagtaatctagttcgagagaaggttatcttttcggctgtgaaggtctcaggggctactgtggagattatgggtaccccatacccacacgacatggttatccgactagtcttaggggatagcttatatctatggaatatgtaacagatcatgacttgggtattacgtttccctgtatattatggaacggcctaaagtcctggtttgataagattgtaaagtagatttaggaaaccgataccgtgttggttaaggtttctatcttgtaatcctgccctccaccctatataaggtgggcaggaggccctctagggggca

SEQ ID NO: 37414 - DNA, 173 bp, Oryza sativa
acatggggatgtatagttctttcatgcattgttttgtttttttatatagactatctttaagttagtaaaaagctttgctctctctcttcatttaatatcttccaaatagaaaaatatgctgacatggatcttttatagagaatctcttatagagaggttatagataacaatta

SEQ ID NO: 37415 - DNA, 1501 bp, Oryza sativa
atttttaccggtagatgtcgtagttgggttcccggacgaacaccgccggcaggtcgtcccgcagcgtgcgcaccgccgtcccaaggttgaggtaataatccgacctccgcgggtcctccccgccgccgccgccgctccggccgccaccgttcttgctccggctcttgggcgtcgggacggcggcggcctcctgctgcgaggcgccgagcaggagcaggaggttgaggtggctcggtgccacggcctgcgccggctggagcttcccgccgccgggaaggccgagctgcgacttgagcgggctcggcggcgacttgcaggacggcgtggtgagcttggggaggaggaaagccatggcgcgcctttcttgatctttctggctagcctacaagtagcggattccttcgcctacgagctccatgtagtagaagcttccaaattggccattgggatgttcttggggagggagaattgagtggctccgatgggtgcagcgaaggcgaaggcgaaggcgtgtgtgtgggagagagatggggtccgacgtggagccagccagccagccgtcgaggtggagatgatccggggtttcatccttcgttttccttgtccttttgtaacaaagaagaaaaaagaagaagtaatttttgctacattttctagtagatagttttctttttctcctgattacgcgagacacaccactacatatgcagaccgcatacacgcactataccgtaacacatgagcttatcaccgttacatatgcaggccatatagacgagaacacgccacgcatatagaccgcatacacactctggtgaatgtattgtaatatgcgactatacctgtaacacattctaaaataatagatttgagaccgaagttaaattttcacgacctcttttctgtagtaaataattagttgatgtctcaggtcttgctaggaaatacatggagaaatacatggatgaatgtatgctgcatattgcagaaatgaaataaagtggaaatgatatggggtgataattcgatatgcttatatattaagctctagaatgtattaaataataaatgctatgttatatttgtatgtgatttaaaatattttgatagatttgcatgttaaactttaaaaagctagcgggattcaaatatataaagatattccatggtgagcgcacttctatctatcatgctctaggcgttgactagatgtagcatggtcatttgataaagtaccatactctacatcttattaaattttagcagaatatgcacacttgtttttgtttttgagaggatacttaggagggtgtaggtacacatgagttatatacaaagacagcctacgacatggctggcctgtacaaacattacttgtaaacggttgcacatcacaccacaattaaacatcatcacccaaaggcagcatacaacatagtcttctttcgtgtatgctcctcatggaatcaattatcaaacctaaactcttcctctttttttc

SEQ ID NO: 37416 - DNA, 695 bp, Oryza sativa
tatctcctctcttatcttcaccacataagcttgtagctgacttatagtctattattgtacctgccattagagttttatatttgaacttggaatgtagtatccaaaataactttgggggtgtttagatccaagagtgtaaaattattgcgtgttatatcgggtattatatagggtgtcgcatggggtgttcgggcactaataataaaactaattgcagtatccgtcagtaaaccgcgagactaatttattaaacttaattaatccatcattagcaaatgtttactgtagcaccacattgtcaaatcatggagcaattaggtttaaaagattcgtctcacaaattattcgtaatctgtacaattagttatttttagcttatatttaatacttcaaacgtttgatgtgaaagggtgtaacatttttgtgtgggaaaccggacctttgtttttaagaccggatggagcactttgataggaggtttgggagtttggaacttgtgcaaaacggtgtgttttaaaaattaaaaccattgctctcgtacataccagatatttataactaaaggtcgagaagttcaaaatgtgtccaaaggtcgagaagtttaaaatgtatccaaatcaacatattttcaatatttgagggagtaacatgatataagaccatatatttataactaatggccgataaatttaaaa

SEQ ID NO: 37417 - DNA, 424 bp, Oryza sativa
tcaccacccagcaaatcatcaaccgaagaagtaaacatgctattccccattatcctctcgctaccttcctgagctgaattttgagctcctgggtcatcttgatcccctgtatcaatcaaatcaggcatctgtgcagcaggtactgttgtctttgtttctgaaaaattattgcttccagtaggttgttccccaaccagcagatttaagacctaagaaaatggcacggtttattatatagtaataattggaggtggaaatagctatagcctagagagagatagaatcaaagagatgcaaagcatgtattctacatagcaatttgcagaaaataaatggtgcattatacaaatttatttattaatggcttgcaactttactgaccttcgaagccttttctctgagagaaacgtgcggaagctcacag

SEQ ID NO: 37418 - DNA, 1501 bp, Oryza sativa
ccatgctgcggtcgccgtcgcgctcggcctcaccaaccctaccaaccgccgtcagagagctgacttgccacctatgtacaacacttgacatgacattttttgtatgaatttcacatgttttttgaaactaatgctgtgtttagttcgtgtgctaaattttttttaagtatacagacacatatttcaagtattaaacgtagactaataacaaaacaaattaacaaaacaaattacagattccgcatgtaaactgcgagacgaatctattaaatttaattaatccatcattagtaaatatttactatagcatcacattgtcaaatcatggcgtaattaggctcaaaagattcatctcgtaatttacagtcggattgtgcaattgggtttttttcgtccacatttgatgctccataaatgtgtccaaacatttgatgtgacgaaaaagttggaagtttgaaaaaaaagttgaaatctaaacacggcctaagctactttttatttgtatggatttcgttgggattttacagatgcaaacagcacacctgactccaaactatacactggttcactgaacaatgtttgccacttgtctctgttgtgtcggtgaactaatctccatcgccgtcgatcttaggccagccattttcagcctgcgacttgacaaacgcggccagtagcttgatatcatcttcgaccagccgaggtccgaaagtgcactgccctctcggggtgcatttttctccgaagcccttaacgcagcaaacatacaatcaagaaattaatgagtatctatctatactactcaaacatcatcatgatagcagctaagaattactcaccggcattcttcccttcccgtagtacgttatattgtatagctcgtcctccgtggcaactccatttctgcagcaaatttgcccttaattttgccttgatccaatccaacaatgggcagtaaatttcgagcagttaaaagttttcaagagcacacatacctctcaagatccttcatgtacagagtggcgccctgtacatgacaaatcagcaagctaataaaaaggttgaaaatttgtgtccggccatcgagtaatggtttcagaagcttaccggctgtaggatatttcctcccatatcatggcagccgatgcacgccttccggaacagcgctgcgccttcggattgagcaaaagctacaacaacaaaagggggggaaagaatgtgatgtgcgacgcgtacatttcagcaaatatggtaaattggcaattaatcatgctcggtgtacttgtgtagaatcattcagagttacttctgttatgttcctctactgcttccccactaaaaaacttcaagaggaactagattctagtactacgcatcctgacgtttgagatagaggattaacctgatggtgtggaagctaggaagccaggagatgcggcagaaaggaggagcgccgccgcggccaacagcggcgtggccgcgcgctctgctgccgcagacg

SEQ ID NO: 37419 - DNA, 1501 bp, Oryza sativa
gaggccggcacggcacatggtacgagattcaccgccgccgccaactccaccctacaaaccctaatccgatcgagagggggcgcagccagtgacgggaagcgccaccgccgcgccagacctcatcgccgggacatctacgaccgtcactcccgcagccgtcatcgccgtcgacctcaccggcgccgcatccacgacaaccgagcgccaacgacgacgatggccggcacttcttcatcctccaacacctcaaccggtcggtctatctaaaccctctcccgttttcaatctctatagttcaaacatcaaacccaaatagaaccacccgactagatctaacctaggtgatcctagtgcaaagtttaacaatggtatcagagcaaccctagtgtttagatcgtttcggggaaagaaatccaaagaaagaaaagcacaagatccgcacggatcaaaagaaccaaaaaccctaaccctaattcttacctcgtcgccggccgtcgtcgacgccggcaacggagggggggaggggcaaagaggcgccgcctaggagccactcgacggccgcgcgcgcacctgcacgcgcgtgccggcgagggggcccgcggcggcgccgccatctccgtcgtcgccatctctctctcacacggtgggggttagagacggtggggggagcggagaagagaaaagaaaggagcgccggccatggcgcggcggcgcgagggccgccggcgtcggcgacgccgctcggcgcgaccgcgcccgcccgagagagagaaagagaggagaagctagggttttcggcggccggccgggagaggggggtttttgatcctccgatctcggcgcccggccgtccgatcgcaaaccctagctgatcggacggccggcggcggccggaccgaaatcggcccaagtggggagcgcgcggcggcggctttcccggcccaggcccaggttgcggcctgggggaggggagggggcgcttgcccgcgcgcaaagtggccataggccgaccggcaaaggccggaacaaagtccatataaggtccctccggggccgaaaatgaataaaagagaacagtagcaatttttccattttattttgtcgatttttcatgcaaatttcaatagaattttgaatagatttttgcatgttttacctctgtttaaatttgaaccaacgggagaattttcacagagagagaattacagagattttgctactgttcatatgattttatatagtcttccgctgcaaatagatgaaattgatgaaaattagtgtttctaaaattaaatttcgaaccaacgggagaatttaattttaggaacattaattatgtgctatgatgttgtaattttctgaccaacgttgttaattgcaatattatagttatggttatatgtgttatgtctaattctgcccaacggtgatgtaggcttaatgcataatattttaatgttaattttgttctcaccgcacatgattatttcaggtggctact

SEQ ID NO: 37420 - DNA, 1501 bp, Oryza sativa
atttctttccacaaaagagagaaaattaccgggtaagggctacggggcgtgagggaggaggccatgaactgggattagtggcaggattaggggttatagttagggttctctcctcctcagtggtggcggtgggtgggaggaggggagctttcttggggccggatggagtgagctcgaaggcacaagaatctctctctctcgtggcttacaagcgccgacaaagccgcgctttagatccgaaaaacctcgagaaaaaaactgcggagccgatgaaattggggaaggattcgaagtttttgaagccaccgagcggagattaccctcgatttttcatggatttctcgcctcgctcggatctgagcgagagatgtgtgggagaagagagagagagaggaaggagaagaagaggacgaggcggccgagctatttcgaaatattttgaacgctgacgcatcaggggtacccaccccacccctccgatttcgatttatttacacccaatgccactggtgttagtttaaagcccaagccggcggtgaccaggtctaagtggctggccggctcgggcagggtcattcgcgtaatatgattggttagtcaggggtattttcggtatttctgttgaacggtcaacttcgatgttgtgggcttcgagattcgcgtcgccttgggccttgctgataatgggccgggccgggccggggcatgttgcgacgttgctctcctcgttttctttgtccttttcgggaatcaacagcttagaggtgccacgtcttgttattaagcttttgacagctttttcttcctgaaatctcaacgaatagttaagctagcttgtcagtcacctcgcgcactggaacctgagaatgatcggacaatcgacgcgatgctaattagaaatttgctgtttgttagtattagtaaattggtgtctcgtctcgtcaagttgcgagattaggtcttaattgccttgtgccttaccggtttaggttgcgttcggtagagcgtattcaaatcttatttgtcttacgcaatacgagaagatcattagtttataattaattaaatacttaattattatagtttctttaaaagactattttaaaaatatatatagagaagttttttacaaacagtataaaaagcgtgtcatcataagccaacagacagtaactgaaaagagcttaggctcccattggttcctctatatagaattaaccgctgtcaaaatttaaattttagagtttattttaatttttttcattgaacatatctctactattataaaaatttaagatgtttttatcggtattttggtacgtcatatgtgtatacgtcagtttttaagtttgtttgcttttaaaaatatgtatccgtatttgattcggtttttaaaatcgtccacttttggtaatacagaagaaatcatataagaaatttgttttaaaaaacttgcatgctaacttgagatgattagactcctaaatatagctcatgattt

SEQ ID NO: 37421 - DNA, 1501 bp, Oryza sativa
gaagttgtgtatatctgacattgttatgagtttcaggcaaaaaaagaagcaaaactggctctggcacaacatggactcggcaagggccatgacacaaaatcagtaacctttaaaatgccttcttctgatcagcttagtctgaaacgggttgacccatccaagcttgaggtgcattttctctcttcccctcccgcattgcactcgtgccagcgcgctcatgcacacacatccacactttgcttatatgaacatcttcctttatgtaggctcacataaagagaaagcttacgaaagaggagagattagaaatggtgaaggctggaagagaggatagaggaaaataccaagcaagaacagctgtgaaacagaaaaaggtattcgtttatatgatcctcctttttggtgcttattttgacctatgttggctatatggcacaaccttgtgaaatctgatcatgaattgttctttcgtagttgcttttattccttctctacttatatgcttctcattgcgttttagaccggtggcttgagcaataggcagaaacaacacaagaagaaaatgcccctcgctgcaagcagagcgaaggcagcgcgttctcgacaggagaagaaaaaactgcaaaagcgctcgggaaagcaattcagaggacggaaggcgtggaaatgagggattttttgtacttgcgtttgccaattcttgtggtctactggccaaaattttgactccttcagttaatgattttcgtatacaaatatggtttcacaaaccgtgtatcatcgatttttcaagtgctggtgtattcttttgtgagtggagagaatgaagccggtatatcatcgctcacagtggttgctctatgaatttggacagtactcgtatccagaaggttcagcatcacgtgtcctcctggcccagtgtctatacgttgcagtgactccagcgagagccacaattacgatatgataaatgctgtctctgtttctgctttgatgagactgtttcgattaggccagcaacctcacctctcctatataggctgtgtttatttcagcgtaaattttggattttggttaaaattagagatgatgtggctgaaaagttatgtgtatgacaggttgacgtgatgaaaaagaattgaagtttagatccaaactttggatctatacacacagacggattcagatcatgcgcagttatagctattactgcaacttatattctgtgctacagtatttatgctacagtacgatgaatagtgcacctcgctgatctggaccgttccatctacatccgttgatgaaaactggtaccgcctaaattgcagtcccagtagcgactgcagctgatccggattcaacacggacatagtacaccctcttgttgcttcgatgagactggtccttagcacaatcatcaaaccactaccattatatcagtgcttggtgttctattgggttaaggaattctcgatcgttctctgctagtaggaaatcgagc

SEQ ID NO: 37422 - DNA, 1501 bp, Oryza sativa
gatcagtggtctgtttcactgctgtgagaaattgcgtgtggttttgcaattcatcggtgcttttttcccccttcttctaggttttgtgtatctaccgtctacagtcaccatggttggcagctaatgggggattggaatataaatctctttttggtagttctttttttgtatgattgattttggcatgtctgtttgccatcaccttttttttttaattaggaccaccaatggatagggttgttggtattaaactcgcaccatatcaaatcatcatgttatctttctttttcaagtattctggactcgtggcctgcttgaaggaacaagggaacttctagagggtttcctctctcaaaaagctgttttttttttcataagtgagagcagttaaaccccaaatcttgttgaaacgattaaacttgccaaagctctcctagagactggattaatttctcatggttctgttcagtatcaaagtcttcaactaaaccgtaacactgaacttgagattttttattttttatttatttttctgagtaagagatattttatatgaagttactatgatgtccatcaaatttgaacacatccagacttgtaaatttcttggtctcgtctctacttttagttaacgcagaaaatgacaattcacagttattacttgctttgcaggaattctaggaatggcagcaaactaatcttctaacctcaggcagtccatgtttttgaggtgattctgtgacatgtgtgctaccttaagtaaaacaagctacgttttcccttccgtatggatctcctaatttgttcacttggtagctttaaactggatgttattgcaaggttgccacatgcaaaacttattactctagagcgggagaatacaaacttattgttctttgttattcgattattgcaataagaaatatatggaaattgcagtaggtgcgctctgcaaaatgatgatactttatgatatatccgatttcaaggagctaggaacacaaaaacatcgctttgtaatttaccatctccaatatgttctaacatccacaatttgttgtattgctaataaattgaccagctcatgtagaatacgttaccatttcagagctagtacccacctgataagcattccttttccactaggagataagctctctattaatttgctaccctttctgcatcacggcccttattcccgttgggcatatcttttatgtggttgatataagctcatagcttttgaagtactgcataggatactgactccagaagaaactaccagccaaaataaggcaggacccaccagctttagaatataaatccccatgcttatctaatcttcaggaggattgccacttctctttcctgtagacagtctgtgataattttgttctcttcttgttggggtcttggggaaaggagcaaggaggaggaggagaccaagaacacggagtgaaagggagagggttctgttcttgcttcttaggccatatggaga

SEQ ID NO: 37423 - DNA, 1501 bp, Oryza sativa
gttttggtggatctgtgtatgaagcagctacaaagtgtgagccaacctctcccttgttctaggttccgaatctggaaaaaatcaatccaagaaaaagctcccccttctctcagtggtcaaggtcctccttttatatcttaaggggataccacatgcaccatttccctcttttttctgtggggatttcccccaccttctcagaaatagacggagatttgcatggttgccgttcgagtcaccttctgatggaacggcccgcacctacctccactttcgccgggagcaggcgcgacgtagaatcatggctgtctgctggcgacatgaccggtgtcagaatggtcacaaatcggtcattcttgtccaccacgcgtcagcttagctatctgcacgttggctctccttcacactacattttgcttgtaatggttaggatgaagcctggcatatatctgatcagggctaacgtgccatctctgggaggtaacacgctagctccagctggggacgagcgcctagaagccctcgtcctgacgggatggggcgaggcgtgcgtcagaccgcctgccgccacctaacccgcgatctgaccggtctgtgactggtcacagaccggataaacgagtgcactgcactgcgctacatgcggtgtgacacgctcagccaaaccgcaattaatgtggttaggtgagccccactgtgctcacctaacccatacacgcggagcgaaaacccacgaggggtcagggcgcctcggccctcggggccgaggggggtgcagcccgaccccctcggggggactaagaggagggcgaacacatcaccctcgggcccgacgtcccccgagggtgccaggccacgtgggcgattgtgtctgcctcaaacctctagtcatgatactcccgatcccatgtcaccgacagtagcccccggcgttatgccagggcgatcgccctccttaagggaagcggtcgggcgtgacgccactcctaaggcctggtgacaggtgggaccggtctccacaattgggcagaaaaccaaacggtcacaaatcacgcacatcggcagtggtaattcggctgtcaacaatgagcggtctcttcaagactgccacattactcgagtagcacacgaatctggacatggcgattcgtttcatctgaagatatggtaacgtcgcttcggttggcgagcgtaattaacgcgcgcacgatatgatctacctcgaccgccacaaccgcatatccacctcatgcgccgcaagcgggcgaatgggattagtggaagcgtgggcgcgagaaacgagggggcgaaatagtgggcgcgagaaacgaggagccgggcatagcgttggcaagggtataaaggcactgaggaagggacttgtttccttcctttcgccattattccccttgtctttgctgcttgcgccctaactcctcctttcctgcgccctaccctcgccacacgcgctcgctcttaatcttctcttcctccggcgcca

SEQ ID NO: 37424 - DNA, 1501 bp, Oryza sativa
aaacgaaaaaataattaatcacatagattgtgtgtaaattacgaaacgaatcttttaagcctaatcgcgccatgatttaataatgtggtgctacaataaacatttgctaatgattgatttattagacttaataaattcatctcggggcgaattctgtaatttattttgttattatactacatttaatactttaaatatgcgtccgtatattcgatgtggtatgtcaaatctaaacatagccttagtagtaccactatgtatgctcacttaatttcactagttaggatttgtcttttttagacggagggagtacgttgttgagatcttgtacctcagatttgttgtgtatatgcatgatgtgactaaaacaccttaattatcagtccaatgctccgtagcatgaacttggatttccatttattacgaggtagtccaaatgatcaatgtgagcagcagaagtatcaattgatgaatgatcaatgtgagcagcagaagtatcaattgatgaaggataataacacactatgattacaaaaatctacaaattactgtttggattgtcatgcggatgacttgggcttgtcaaagattttactgttagtaattcaggcttctcctaaatattgaaaaaacggcctaattaatggagtggtgaagataactgaaaaaaaaaatgatgcctgtcagacaacctatgggccaaccctgaccaagcgaaagcccggcaaggaacgatcctctacagccgcgggatcaattcacacggaaatgatccgggccgtcaatcacgctctggcccacaggtcatgcgtcatcaaccaagcttgagtgcttgcctccttattagtcaaggatgcaacggtacgagcctatagaacagatcctgttcaagtaaggtcgtgcttagcggtcaaaggttttgcattttaagctagattcatttcttgaagacttccgaggtggtactatgtttggcaaatgacgccctcccatgttttgttttgtattgtctcaaactctaggtctgtgcacatggttgtcatgtactgggctgctgggccttccttcctaaaatgaacccaggccttcggctacaccatggagccgtagaaagtggaaacatggttagtggtaaaaacagttacagaaattcttaaccaaccaaaataaactagtaatttgcccatgctaacgctacggcgatatctagcaaattttctacttaaaaattattttactatttcgaggtccaaatttatttaaatattattatcacaaaccggagtagctctcagtatgaaagttcaagtcgcaatcaagagaagtaatctgttcactattatttttctacttctacatgcataaacaaatatcaattaaaggttttctatttttttcatcaataatcaccatttgtatcacaattctctatccagcatttaagaaaggtttaaaaatatgtatggctatttttggaaatatcatatttgatagagaacct

SEQ ID NO: 37425 - DNA, 1501 bp, Oryza sativa
tccaatgcaaatgatgtctcctcgtcgcttccaaatgggcaaatcggcaagagatttgggggcaaaaggatcaagggggtggtaaccaacctgccctgccacgatgtggtgaatccgtgatacgtctgctccccggacacgcggaaccactagctctctcgcctggcaacaccggcgctgacgccgccgccgcgccacctcgcgcgctcgcggtggcggacgaaccgccttcccggttggcgccgcccgctgccggctcggtggtcggtgccctcttctccgtcgtctgaactccacgcggaagggttttgtacctgcggcccaactgggtctgattcggccctgcgtacacggccacggatggattggcccacatatagcacccgcggcccatgtttaatccatgaagcccataaggccaggccggctgtttacagcccagcgctgccatggagcacgtcagcaagccgttgacgacacaaattctgtttattattaattttatttattgaaatattttttcaaatttctataatctacacccctaccacttttagcagaacgtttttttttgacgtggcacatattcattggtgcatgttaacggtcacatagaaagaggctgaagtagcattcttaccgccttattagaaggttatatgggattatatgtgaaatgatggctagagcattttgcaagcggccatttcacaacatctcaaaagatgtgacaaggggttgcctgtaaaataacattctcggttatttttgcaggtggcctccttatagtcttttgggaagatgtcaaggcaattgcttgcaaaatagccggcctctttttacgcggtatgccaacacccgtgtgccacgtcataaaaaaaataaaactctctcctagacgtcgttttttaggtgtagatttctaaaagttttctagaaaattattatgtaaatatttaaataaataaaattcaaaaaatcgacgacttgacgccatcaactcctgtgttgattagtgtacaaagtccccgtgtgtcccagcgtcatcacgctcacgcgcaacgttttgagactgaaattttcgttttctttgttgtttttgttcaggagagtcagcgaagatgtttcggacttcccgtgtgccaggcacaaccgcacaagttgcattacaacactgactacctgcctacctgctgcctctcggcattgcgtaacgcgccatggcggcgaccggccgacacacgcgcatgccgcgaggtttcgctctcttgccaacttttcacggtcgcgtctctctcgaaagtttaatcagctgaccctgatgtcgtagctacagtaattagtttgcggtttgacactgcgtcttcaccagaggggcagacaagtcccggtcaggcgttacttcgttggcccaccgtactaaattcactgttcagaaaagagtcgtgtatggattagtagcaaaaatcaaaggtgccaattgttcacgcttcatagccac

SEQ ID NO: 37426 - DNA, 497 bp, Oryza sativa
ttcaaatttgaacttgaaagtttttaaatcttaacttgaaagttttcaaatctcgatttgaaagttttaaaaattttcaaatctggacttgaaagtttttgaatctcgagttgaaagttttcaaatctcaatttgaaagttttcaaaatttcaaatctggactgaaagttttcgaatatcgagttgaaagttttcaaatctcgatttgaaaattttcaaatctggacttgaaagttttcgaatctcgagttaaaagttttcaaatctcaaattgaaagttttcaaaattttcaaatctgtacttgaaagttttcgaatctcgacttgaaagttttcgaatttgagttgaaagttttcaaatctgagttgaaagtttttaaaatttgactttaaaatttaaatcgaaaattttcaaatctaacttaaaatttttttaatctgttagtaaaaaaaatctccataatctttcctaattactattattagtgttaagtata

SEQ ID NO: 37427 - DNA, 1501 bp, Oryza sativa
caggcagatgatgatgcagattgcgactttgcggatatcttgctcacgaaagttcaagttctttttggaggtagaagagttctattttgtaattgaaatggtgttgttcatggcaacctggagagggaacgaatgatgaagcctatacgattatattacaagcttaatcatcggccaaaatactactcacaggaggaagaacgatcgaatgaagtagctagcagaaagaggataatgaatatgaccaagaaaagctgcgacaggtgaatcgacctggctgctactgcgatcatgtgatcaagaatcggggctctcatggtgggtatcgccggcgacggcgacgtcggcgtcggcgtcgccgtctgtcggctcccacgacgaggcggtgagcagggacaggtccttccacccgagcttgaggcagccgtcctcttcgacgagagtgtagcccttccatgggtacatgccaagaagcagcctcgcctgcgcggcggggctgccggccagggtcaccggccggaaccccgctcgccgcagctcgtcgccccaccgctcgacgcgcacctcgccggtgcgcttggggcccccgacggcgacgatgttccgtatctccgcgccgaggagctgacgctccaccgcgtgccgctccgccgcctcctcctcggcggcccccgcgccgtcgcccagcgcgtcgaacagcgccgagtagtagtgcagcgcctccacgaagcggcccaggaagtcgccgctgtggccgaggtcctgctccacgatggtgatcagcttcggccggaggctcttgagcaggcgcaccgtgccggcgtcggagcccgtcacgtcgtagaggcagtggtgcatccagtgcacaacggtggcctccccgtggtggcgcgggccgaggagcgcggcggcgtcggcgacgtgcccgatcttcccctcgatgggccggaactcgaagggcaagccgagcgacgcggcgaagtcggcgaggcggcggccggtggcctcgaggacgtcgagcgacgcgccgaggccggtgatccggagcgagcgcggcttggtggggcgggaggcgaggatgtggaagaggcccggccactgcagcccctgcatgatgtcgaggtcgatcacgtggacgcggtcctcgccgtcgagcgcctggaagatggcctggttggccgtgaagtgcgagaacttgacgagcggcgacagcgcgttgtacgcctggaacgcgccggagatgcggcggctctgcgcggcggcgagcgggcggagcgccagcggcgagtaggcccccaggtaggagctcagcacgcgcgcgcacagcgcgtccccgaagtaggccgcgacgcgctcgggcgacgacccgaacggcgacgccagctcggcgatctccggcagcaggtcccgcgcctccggcagctggtccatcgccaccgcctccgcacacctcagcaacaaactaagcagccgcagcccacgcgtctccgccgccgcctcc

SEQ ID NO: 37428 - DNA, 414 bp, Oryza sativa
cccaccccagggcccttatggtatttttttttggccattggtggatttttaccagaccaaaccaaaattccggaaaaattttcctggtccggattttcttttgtttccattctatttagttaaaaaaacttgggttttaaaggttaaagggttggcccccttgttaccaacctccttaaaccccttggccttgggccggcacttaaaaaccaccccggcaattcttaattccttttattaccttcttttccatttttttttgaatcttttttttaatctattggtcaaaccaaaagcttgtatttcattggtggccccaagcctgtgacttaatgaaattcatatgtcttttttatttgatggcttttaaattcgtacttagcattaccgaccgggccttctcttattcaaagc

SEQ ID NO: 37429 - DNA, 1501 bp, Oryza sativa
  unsure (1)..(1501): unsure at all n locations
tttaaagttttacctaactcctgaagacagtaaggaagtcactgctcttatatatgttttgaaacttgagctgtgaaatcgtccattaaaattcaaaaagagaattttctattcttaaaaaaattgatgccaggttcaaaaattaaaagagatgattgcggcgaatcattttggtccaacatctggtgtgatttttttccttttttaaaaaccccttgtgttctgaagtctagagcgaataataaaacgagtctcattctcccaagtcatgtttttgccaagtacatgttacggtctctcaatgatctctcatttagatgggtcctttgatattgtgcacaactaatttatatgcttacacagcacaaaccgattgcaaacataggtgaccatcatctgttaccttgtttatatgacacttgcattcaggattatctgaagttcatagcagtgatgctcaaatgaggcagaggttagaggttgccttcgaaactttaaaggatgacatgttgctgttttcagctactcatatatcaatgaacttcnnnnnnnnnnnnnnnnnnnnnnaagaaaccaatgagttcaggattaattccagttcctacatctctaccttgcattgtggttgggatgtctgctatataagttatattagatgcatcattttagtaatatattgaggctcagaagtcaaaatcactgtgaactccagattagcagatgtagaagttcgaagcaagtaccctcaagaaacatgcaaattagcaaaataatggatattagcatggctttatgccttacacataactgacataagttgagattttttagccagatttaatttctatgtggaatacttgaccaatttcttctgttgtaaaaggctattatgttttctgctattaataaatcaaaaatcctcatatggatgtatttcaaggtttggaatttttttttttttttgggggggggggggggggagtaagatttgagtctttgagatcttcgattctttccgtcaaaaagatcttcgattctgaattatgacaaatatataatatcccatctgatttttgcatatttttcatttaatttggtagtgttttttcttttttggtgtttatcgtccagccttcatccaaatgtcaatacatggtggcagtaagaatttgtatgcaggattccaatttgctcacgaatcatggggaaaaggaattaattctccgtgccgtcgatattcggaccatagaaagtccaaaattcagcgtgcctgctaagttatacaacccctgcatcaggggaaaattgcgtctgctgctgtgacaaccgacaactgccgttcaaaccttacatcttgatccaaatagagtttaataatttgtttcctatacttcctaccaaatgttctgattttactgaacccggcgttggtgagctgttccattgtgtctataggcatcaagcttcagtggtgcacaggccagcatcactgcatctgcca

SEQ ID NO: 37430 - DNA, 1501 bp, Oryza sativa
cgggggaggaagaagcagcagctccatgcaccggcttcctctggcctcacggccaccgggtccgcatcgcgcggcggccgccgctcatcgcgctccccagaggacgacgacggcgtgctgcggccgcctgaagcaggaggcgacgccgtcatttgcctctctcgccgtcgctgcgtctgcggcagcagagcgcgcggccacgccgctgttggccgcggcggcgctcctcctttctgccgcatctcctggcttcctagcttccacaccatcaggttaatcctctatctcaaacgtcaggatgcgtagtactagaatctagttcctcttgaagttttttagtggggaagcagtagaggaacataacagaagtaactctgaatgattctacacaagtacaccgagcatgattaattgccaatttaccatatttgctgaaatgtacgcgtcgcacatcacattctttcccccccttttgttgttgtagcttttgctcaatccgaaggcgcagcgctgttccggaaggcgtgcatcggctgccatgatatgggaggaaatatcctacagccggtaagcttctgaaaccattactcgatggccggacacaaattttcaacctttttattagcttgctgatttgtcatgtacagggcgccactctgtacatgaaggatcttgagaggtatgtgtgctcttgaaaacttttaactgctcgaaatttactgcccattgttggattggatcaaggcaaaattaagggcaaatttgctgcagaaatggagttgccacggaggacgagctatacaatataacgtactacgggaagggaagaatgccggtgagtaattcttagctgctatcatgatgatgtttgagtagtatagatagatactcattaatttcttgattgtatgtttgctgcgttaagggcttcggagaaaaatgcaccccgagagggcagtgcactttcggacctcggctggtcgaagatgatatcaagctactggccgcgtttgtcaagtcgcaggctgaaaatggctggcctaagatcgacggcgatggagattagttcaccgacacaacagagacaagtggcaaacattgttcagtgaaccagtgtatagtttggagtcaggtgtgctgtttgcatctgtaaaatcccaacgaaatccatacaaataaaaagtagcttaggccgtgtttagatttcaacttttttttcaaacttccaactttttcgtcacatcaaatgtttggacacatttatggagcatcaaatgtggacgaaaaaaacccaattgcacaatccgactgtaaattacgagatgaatcttttgagcctaattacgccatgatttgacaatgtgatgctatagtaaatatttactaatgatggattaattaaatttaatagattcgtctcgcagtttacatgcggaatctgtaatttgttttgttaatttgttttgttattagtctacgtttaatacttgaaatatgtgtc

SEQ ID NO: 37431 - DNA, 211 bp, Oryza sativa
catctactattaattaaaacttgactatttataagctagtctagtgattatttttgtaattaactcctaactcaacaagccaaaatttgaaatgcaacaagcatttcatcatatccgaatcaatcaaatcgagaaactattaattaattaattaataacgtgtgttccaactttccaagcattagaagagcacccaagctccagctggcaa

SEQ ID NO: 37432 - DNA, 264 bp, Oryza sativa
aattctgatccgtgaaactttgttccattaatgacgaactcatgtcactcatatgcatgtttgggaagtgcctaggccgactcccgatgcttggtggttatgactagtcgggcagagtgtttaaacgtacagagtcatctgctcggggaaatcaaaattgacaagaggagaaatacatatttataaatattttaaaatacttgattttttctcgagtattatatttatatcagatactactcatcctatatgtttgttctgcag

SEQ ID NO: 37433 - DNA, 1501 bp, Oryza sativa
gaggagctccttgaagatgaaggctttggtgtctagctcgtgcctgccgtcaagcgcctgtggtcgtcgccctagtcttccgctgtttctcgtttgtctttgtgtgtgttgggccttcgctgcccatgtaataagttaactatttacgcttccgcttgttaaactctgaattgtatcaacttttggtgtaccttgcctcctgggacaaggattaatgcacgcacgtcaggaaagcccgttgggttatttccggtcgtgacaagttggtatcagagctacccttgaccctaggacgagccgtagatcccaagccttagcagtatttttcgaaataaaaatctcttgtatttgtgaaaatcctctagtctctctctgtcttgctgcttcatttatcgccaaaatctgatctttaaaatgttgtttttctttctgtttttgtttgtagatggccggcagcgtcacccgtcgtggtttggacatgactggcttcgtcttggagctgcgaggcatgtgcgtggtcttggggtatccacatggagtggactaccaggccaggccgcttccggatcaggagggtgacgacgcggagccccacgctggttgggaggtcactgcagtgatcctctctggctcccccgagcggacttcgctggcagtcaccgcgggtggagattccttccccgccgcttgccagaacgccgctctcctcgccatcggcactcttcaccagcgctacccggacgagttgcagcactcgccctaccgctaccaccctcgtcgcggaggagcccgcgactacgccaccttccgggatgctagctcggaggatgatgctaccgtcgtgcacctggcgcgcatggtggaggcgtacgacgcggctcgtatcgacttccatcagatggtacgccgcgggatggttgagaacaacatgaagatcctggagctgcgtcaggagaacctgcagctcaagaaggacctcgacgcggtggaggcgcagctgcatcagctcaagatcgcccagggagaggactgccgccccaagcgtcgccgcgtttgccgcagccagaagatcaccgcccgcaagagcacctccaggcccgagctggttcgtcagtccctggcgtggacctgctttgtcgagacccctcgtgccgagcccgcgcccgtggttccccaggagggggaagcctccggcgttggtagcacggagggtgcgctgttgctcaccttccgtcctggcccgtcgcagcggtagacgagcagttagtaggcttgcgcgtgtgtttttcctcgtttgtcttcttgagttgtgtggggcatagttatgccggtgtgtggcataactgtgtcggagcctgtcttattttatttgcctaagcaacttgaacattaatgaaccaatttaatagcagtaataaattcaagaattatagtagtcgtgggtggttagttttaatcgtcagctctctctctctgtttgctggttctgtgtggggttttc

SEQ ID NO: 37434 - DNA, 1501 bp, Oryza sativa
ccggctgccgtggcgtccgccgctacttctccaaatgcttcagccgagagcgattccccctaggctggcaaacttcctgtcgatgccgtctgctccctcgcgtggcagcacccgcgttgacgccacccgacgcgggctcgccggccatggccatggccgcagccactcgctctcctcccgccgcgcggcgccgctcccgtgccgccggcggccgccgccgcacgggattgggtcaaatcaggccgcatgtacgggagactcctggtccaatgggctagtgggccgtactgagttattgaggcccataaatacgaggccccagacggctcaaggcctaccaggtcggcacataaaacgagaaagtcattagtttaagattagtcaagttttaattactagtatgaattagaaaattaaatttatttgtggttttagaaaaacctttgtatagaaagttttctcataaaacatatccttaagcagtttcgaaacgtaatagtgaaaatcgagatagaatctacatcttaatcggaaaataacagggttcacgcgggctttttgaatgaggcgagatgttaatcagatgatcactacgctccttgcttttctgcgcgatatgattctgaaccacttaagtacagtagtactagcatttagcacgacttcacggatctttagctaggtcaaacgaagtttaataaagctatcgtcactttaccagcagttttcaacagcacgactatgatagggatgtgttgtggacttatcactttgatgaattatggtttccttttcttggggtcgagggcaacagtatccctcacttatgtttccattcatctctcttttgaccattgccatgaagatgctttaccctggctatcacgacggagagtacaccatgcatgttatatgcagtcacgaatcatccatgattccatggacagccaatcttctttgcagtttgcattaccatgcaactcacccatatggattcatctagctagtcaatcatgggatattactgtactacctccgtctcagaaagatcatagtttcacgttatttatgttcaacgtttcaccgttcgtattatttaaaaaattaaaatttttaaataagatagtcaaacgttagagacgagaatccacggctgcatttaaactggtacggagggacggaggtggcaggaagtaggaacgcacttgcagtcttcctatgcggcggggcactactagttcctagattccgtatatggctatgtttagttcagcgtaaagtttatattttggttaaaattagagatgatatgactgaaaagttatgtgtgtatgacaggttgatgtgatggaaaagtactgaagtttggatccaaaatttagattaagcacagcctatgtatggtgctcgtgagtcgtgagacactgaggccggccggcgtacgtgctccctgcacagcggccgtgaacaattttccaaggagatgcaaggaaaaaaagaa

SEQ ID NO: 37435 - DNA, 1501 bp, Oryza sativa
aaaaaaacgtacacgatcgtacgtgctcgatcgatgacgggagaattggaagggagcgcatggtggacacgaggaaaagagaagatttagaaggaacgtatggtgaagtattagtatataatttattactccttctgttctagattacaagacgttttaactgttttaagtttgaacaattttgtaaaaaaaatactaagacaaatttattaaaaaacatatttaattattgatttgatgaaactaatttagtattataaatattactatattacctataaactttgactttgaccaaagttaaaacgtcttataacctaaaacggagagtaattataaactatcttgaatttaaaaataagttaatatgatttttagaataatttttctatataattttcttaaaaaaatccatcaatagttcgggaaacgtgtgtgcagagaatgagagaaatcttttctcagtgtacaactgcataacacggtcttaaagagaaatcttctctcaatatatagctgccgaactaaataatcatagttctccataaaaatgaaaaaaaaaaaccttatcattagggatgtgtcgggcatggccagctatgggcacttgggcagcagtgcagcactgccccactccgatacatcgatggcaatccttttcttctcagccggataaagccttgtagatataaaaaattgacttctcaaatcatctggttggactatgagtagaccaaatacattacgcacatttctcttgagcatatatacgccactaataaacagctcaagacaaccaaacgcaggcgcccatatcagccacggcatgcattgccatacttaatccatgttagattcaaagtcgccttatcggataggtatttttgtgcagcacggcaacctgtccaaaaagcacacaagtactagtacatgactgtaaaatgcaaagccaatcgcaattacagtcttccaattccaacttgtccaaagatacttcaccttggagtgcgtttagtttacgttaaaattaaaaatttggttgaaattgaaacgatgtgacaaaaaaagttaaaattttatatgtgtaaaaaagttttgacgtgatgaaaaagttgaaagtttgaaaaaaaaaaggtttagaactaaactcagccctaatgcatccaacgatggtaatcaccacgccagatgtgacaaatacgctgtagatccaaatcctggatcggaagagcatgtactagcagtagtccagaaaaatgattttgtcgcaactgttgacagtaagcagagttaagaaactgcgtaaataacttccaaataaaacaaacaaaacacacacaactcacacaaagtacacaactcacaaacacaggcaactcgctctccctacaaatacaacagggcgcaccgtgcaaaaacgcatcgccccccacgccaccgagcgacacgcacgcacgcacacgcgcgcgccgaccgagcggatagccatgtcgacggaggc

SEQ ID NO: 37436 - DNA, 1501 bp, Oryza sativa
acgccgtgctctggaaccccagccaggtcgtcttcctcgtcgacgacacccccatccgcgtctacgagaacaagaacgccaccgccgccgtcaagggccaccaccgccacgccgccgccgccaatggcaccagcaacgccacatcggcggcggcgtccgtgccgccgttcccgtcgccgcagccgatgtcggtgtacagctccatctggaacgcggacgactgggcgacgcagggcgggcgggtgaagacggactggtcgcacgcgccgttcgtggccacgttccgcgacgtccgcgtcgagggttgcgcgtgggcggcgaacgccacggactcggacgccggcgaggtggcgcggtgcacggggagctcgtggggcaaggaggggaggtactggtggaaggagaaggacatggaggagctcaccgtgcaccagaaccaccagctcgtgtgggcgcgcgcgcaccacctcgtctacgactactgcgtcgacaccgaccgcttccccgtccagccgccggagtgcgccggacggtgaccgtcgatctcgtcgccggttaggatggatcgatggatggaactgctggtttctttcttggttagcaaatcaaatggcaggtagtttatctcagatgaacttaggtgatggtagttcatcgtaattctgtgtctctgtgggggtgtatctgtaaaaaattgttactcggcttccactgctgttctgctgctgctgcatttcttcagtcttccgatctggacgatgctcacttttaacttcaaatcgaaatgcaaatgcccaatgccatcattcattcatttggtcctcctcacggtgaaaaatcaatgaatgccatctgaaagatcactgatgtattgatggctttaattcagagatcaaccgagtaataagaagaggtgtaccgagaggtacaataaacctgtggtccatttgatcgactcgtacattattactattacagatctcactgtttggggtgcaggacgagagagtccgaagagataaggcatcgatcagtactagtactaggactgaccaggcttttgccttgcccctcctcatcacgggtcagtagaatcagaatactgaaacagctgagatggtcacgagatgatgctcttgccttcgccttgatccctcttttgcatgctcactttgttctgaagggaccagcctagttttcgctttagccaaactctctcggcttgtctttcttttgccagctacacagctggacaggtcgcagtagtactatacgtatgccggtagagtggtagaccgtagagggaatgcagagcgagtgattgattggcacgttctgtaccaatgtaggactagtgtataccaccgaaaatacagatgcagatgtgccgcaacggcgcaacttggagacgtaataataccttgcttttgcttttgaatgcagcaagtgcgagagagctccaagctaggtgtacacctgtgaacgaggcaacactgtatct

SEQ ID NO: 37437 - DNA, 1501 bp, Oryza sativa
aggccgattcggaggacaccgtcgacacgggcaccgtcaacacatcccgtgctagttttgaaagcacaggatatgttatcttgtggtcattccaccacccgaggacgttgaaatcttgtgcttcgtggtggatggcgtcgctgtccaaataaccggacaactcttcggccacaacatgcgaagaggcgtctccacttgtagccgacgaactgccaccaccttggattgaacttgaagacgatccaccccaaatcctaccccactgtatcttcttcttacctgtagtggggataggagggggtctctgctggcgaacttcctgaaactttacttcatatcttccaaaaacctcatataatttacatctaacctcagtataaaaagaactataatctacacctatagtatctccaacaagtgataaaatagcagacaatccccttaatttacacctaggatctaaaacaaaagcaagagcatacaacataggtatatttttccaatatttcaaatatttttgtttcatgtgaaagacaggttcagttagaacgtcatcattttcgtattatttaaataaagtagcaatttcaagaaggttgtgcaaaattatattagcagttggataataaacttgtgacaaagttagagtacaatcataaaaagtttctagaaattggtaaaatttttggacaattgcccaaacatgctcgttcagtactgaagacccgtcactgtttcttgggccaccacgtgactgaacaaaatcagaaagtaaactactataaggtaaaacaacttttaacattaaatacgttgcattccaccgatgctctgcatcggtggcaaacttacgagctttcacaccggccgcattgcaaaacctcttccatgcagcaatccgcgggttagaagcagttaaccacgcgattgcttgacgaacagcatcgatgtggtcacctaccctcttcatgccagtcttaacaatcaaattaattatatgacatgcacaacgctgatggagtagaaaagattgagcatacacacaaaataaaggttgcaatatttcaatagccctagaattagcagatgcattatctagggtgacagcaaatattttatcagcaagattaaattcattaattacttccctaattctttcagctatgttttctcctgtatgtgagacatctattaacctaagccctaaaactctcttttgtaattgccaatcatcatcaacaaaatgaacaactacgctaagataatcctctctagctctactactccatatatctgaagtaacactaacagagaaagtacatgtactaaacagttccttaagtgcagttgcttccttgtgataaacattctctaaatctctagttgatgtttgcctactcacagttttaaacctagggttatgagattgctgaatgtaatgttcaaaagcaggggactccccaaagttcaggggtaaatcttgcctggcgattaaccggac

SEQ ID NO: 37438 - DNA, 589 bp, Oryza sativa
actttcgtgagcttcctgaagtatcagctgtttaagttctctgttatcgggaacacatacccgctttccgttccatagggttccgtgttcatcctctgtgaaaccagcggctttaccctgtttcatattcttgaggagtccatgcatgtccggatcattcttctgagcctcgcggatttgatcgagcaaggtaggcttggcttccaacgcagccaagaatccacgaccaactatgcttaggttcagggcttccatctgttggttaagctcgggcggaatgccacggacgttaagagtgttgcaatggctctttcgacttagagcgtcggcaaccacgttggccttaccaggatgatagtgaattcccacatcatagtccttgatgagttctaaccatctcctttgccgaagattcagatccgactgggtgaagatgtacttcaaactcttatggtcggtatatatttcacagcgattcccaatgagatagtgccgccagatttttagagcatgaaccaccgcggctaactccaagtcatgggtagggtagttgccttcatgaggtcgtagctgacgtgaggcataggct

SEQ ID NO: 37439 - DNA, 632 bp, Oryza sativa
tgaatgaaacttcgagctaatccatctgaatttgttagtagtaaatactgtagtacaatttactggtgcaagaagtaagagctccatgacacccagctactctgaagaaaatgttcaggtgttcggcaaagttgcattcagatgttaggctactcggctactgtaagtacacatgttagtacattgtatgagtccttgttatatcgagcaactgaggtggtgtttggatccagggacttaactttagtccctgtctttagacactaatttagagtattaaatatagactacttacaaaactaattacataaataaaagctaattcacgagacaatttttttaagcctaattaatccataattagagaatgtttactgtagcgtcacataggctaatcatggattagttaggctcaatagattcgtctcgcgaattagttcaagattatggatgggttttattaatagtctacgtttaatatttataattaatattcaaacatccgatgtgatagggacttaaaagttctagtcccatctaaacagggcctgagcataggggacaaacaaagggcctgttcactttgatgccatttccaaccttaccaaattttggtaaagttgccaaaaaaa

SEQ ID NO: 37440 - DNA, 1501 bp, Oryza sativa
cgatggcaggattggcaacttgtcgttgtcagcaaatactacatgggccaaaaaacttaatgtacccgtgtttacgtgtcagaccgacccatcttctactaattccctgtagtcgaaggaaggaaaggatatgaggatgagtaggcagagcaggtacaatagtaggctataagtcagctgtaaatatattttaagaagataaataagagagcagtgggctacagatttatacctagctgtagcacggactccaagacacagtgtgtatgacaggtggaaccaggtattaatagtgcagtatgtaactattgtatggacgagctattagactgactatagttgaattgtaactagtagttggttatactattaaacttgctctaattgcgctgcctgcgtgtggtcctaattaactgactgatctacaacgacaagacaatcagtgcgagcgtgacaaacggagcaatgcagccaaacggagtaatgcagccgagttaaggaagcaccgattttggaggcagtcatggctcaaggcgattccaacttttttttctttagacttttaatttttttatcacatcgaactttcctacacacaaacttctaattttttcgttacatcgttccaatttctttaaacttctatttttagtagcgtgtaactaaacacagcccaagttatactgccagcagcatgggcaacaacatccagcatagctcccctctttaatttcttgggaaatatgctaggtatagtaaaagaatcaagatgataattaaagactatttgagcatgtatattgcagtagcaactagcaaagcaataaatatcgatctgttcatgacttgtatcacttgccctacatggctacattaatcactttattgattgacatacattgggtagcatttgcactccatgtagtggagcaaggattggcttggcatacatgaggttggaaactttgaagataagattgaatggtacgtatgagtagtccttaataatgtaaacaatgaagaatttctatactgtatgtatatgtagtggtggtttttctaccacaccatccctactagtattatataatattccctccagtttcattttaattgacgctttggacattgacacgctctacaagatatatctttgaccttatttttctattataatatatacaataaataaatgcatgtttacttttattatagtgttttgaaagacaaatctatatatgtttttctagtttctttaaactaaatatttttaatgttattgatggtcaaagttataaaagtttaaccttaatcttatccaaaacgtcaattaatatagaaccagagggagtattatattacaccactgactacttcctccatcccaaaatataaaaacattcttatattttgggacggagggagtaggcaaatagattccattaatcaacccacacccttcaacggtcatctcctggctgattcactgttgattcttctt

SEQ ID NO: 37441 - DNA, 1501 bp, Oryza sativa
tccttgacgtgagcgtacctctcccgcacgtcgcgggtgatgaagtcgctgagctcgccgctgaactccaccccggtcggacccccgccgacgacgacgcagtgcaggaggcgcttcttctcttcctccgacaagcctacacaccatcattcaccaaaacgatcaagaactgatcgagcaaccatcgccatggacgccatggacgaggtgcaaatgcaaggtgtggttgaaagcgtacctggattctcggagagcatgaggttggtgagcagcttgcggcggatctcctgcgcgtggctgacctcgcggaggaagatggcgttctcggcgacgcccttgatgccgaaggtgagcggctcggagccgctggcgatcaccagcttgtcgtacgacaccttgaagttgtacgggttggcggggagcccgtcgccgtccgccgccgtgcagtgcacctcgtgccgccccgtgtcgatgccggtgcaggaggcgaggaagaagtaggagcccgggcgggtggcgagcgccgactggatgcggctgacgggctccacgacggaccggaactccagcgtgccgacgcacgtcgacgccagcagcggcgtgaacaccatgtggttccgcggcgagatgcacaccacgtcgtaggcgcgcgtgtccacgtccttgaggaacctgcacgccgcccaccccgtcccgagcaccaccacgcgcggcttctcccccggccgcgtgggcccgaggtccggcaccgccgccgccgccgccgcctcgtcggcggcgtccgagcactccaccaccctcgccgccgcctccgccgcggggcgcagcgcaggtgacgtcgtgctgatccccctgctcggctggagccgcccggcagcgccggccgcgtacttgtcagcaagccccgccaacgcgaggctgtggaacgacgacgacgccgacgccgacgaggcgcgctggcccagcgccgccgcattgcgcagcgcgtacgccgccggggtggcggccgcgttgccctcggcgagaatcctcgagagcggctgcgtgagctgcgagcccctcgcaatcctcgaccacgccatctgcttcgcttcgccccacacaagaactcgaaaaaaaaacaactacagaattaccacgagaacctgcagatcaattcaaagagttgtcaatttgaatctcacaaaactgatctgatggcaacaacagcacgaggaatatatatacacacacaaagaaagcgacccaaaaaaaaacatgatacacgaacgaaacgagacttggcttcgcatttttcttccttggaaaatggagcccagtgagaaaagagaagtactagaagcacatcggtgttgaccaatctccctcccccaagaattttggagcaaacgaactctccaaatttatcacgccatacataataaagtgtacaacaacgtttcttctccaagaaaactggctgagagatgggaatcggaaccttctctcgggccggcgtgtg

SEQ ID NO: 37442 - DNA, 372 bp, Oryza sativa
gtttgactttgaaacggagggagtaccgttgctccagtgtatcaaaacaacgcattgaaaacataccattacgatttaattccatcactagcgcaacttattattgacgccgcgcttattagctcttttttctccctgatgaggatcaataattcgttacctcatgctgaaatctgcactgtagaatacctaagaccgacgtcgaggtctcgaggatgaagaatttggcacgccaaaaccatcctaagatcgagaggctgtgactgtgcctggtggcatattcaagatgtgatcaggttgatgaagacagcattgcacagaaatgtcttcgattgaatcaatgagcacgatcattggcgtgttttgcacgaa

SEQ ID NO: 37443 - DNA, 1501 bp, Oryza sativa
cctctgcatattcagttcttcagaaattctataccatgccttgcaagtgtatatatggatgttgcttttaattcgatgagcaggctatctaattaagagctttattttcaccgcagggcaagagaaattgggcataccagtagagtcggccaaccggaggtacagattctcaccaatgttggccctcccagtgtcagcaagttcccctgaccaaagcaagcaccttgcctggtcggctccggtcaagttggcgtaagcgtaggccgtgcacgagcagttgcggctgcactcggccgcgcactcatcgaagcttctattccggacatgcaagaacttgtcagggaccttcattccggccatggtcacgaagcgatcatctctgcctcggcatctcaattgctgcttcctccggcatcctctcgaagaagagttggagccatcaggctcaaacccatcgaggcattggcacctcgggatggctgccgttgcgtcgcagtagccgaatggaccacacgaggcgtagggatcgcacacgatggtgggtgatgggcgctggacgacgactgtccatgacgacgcgctgtcgttccaagccaggaacttcaaggtacccgtgtagtccagttgaagacgcttgtaaggtgagccatcagaggttgtgtatatgatgtagaactcatcatccgtgctcaccgatgtttcgtagatgagagaggtactgaatgagaagaccgaagaccacatgctgctaggcccaaatccaataaagcggatatatggtctggtaccgttccaaaggaagatctgaaggtttgagctgggatcaccgctgatggagaagtctccggtggaggggtcatctgggcccttccaagcgatgcaccgcatggcgacttgtgccttgtagctcaccaaaaacctcatgcccatcagaagggtgtcagttgggtgatcaaagctctgccatatggttgtaccattcggcaaccggagaaccaagttccccgagtcgagcagcgccgcgtaagctccgtcgcctccggtggccgtgacgttcgtcgtccaaagggtgtgattgccggaatccgacaggacaaggttagagctgttgctgatggcgagcgttgcgaatgaaggggtggtgattgggttgtcgcggttggcgacccaaacgtacgtgcgctcggactcggagatgttgtggtaccatatgccgaggaagaagctctggttggaggctgttggggagaagaagccgagcgcgaagaccctgcctttggagatgagtacgtcgccgggggagatcagtcgatttgcctgtgtgagctggtcatcgcctttgcaggaagagatgaggaacagcaaggagatgaaaactgggaggcaggccataatctggtaaatctcatatggccttgttcttggctcgcctgtggctatgaagcgtgaacaattggcacctttgatttttgctactaatccatacacgactcttttctga

SEQ ID NO: 37444 - DNA, 1501 bp, Oryza sativa
tttggtcaagttgccataagcataatcgtaggccatgcatgagcagttgtggctgcacttggccatgcactcctcgaagcttctgttctggacttgcaagaacttgtcagggagcttcattccagacatggtcacgaaatggttcctacctccgcatcccaactgttgctttcttcgacatcctctcgaagagttgaaatcacttggctcgaatccatcaaggcactggcatctggggatggccaatgtgaagtcgcagtagccgaatgggccacatgaggcgtagagattgcagtcaccagcggccgctggctgttgagagatgactgtccaggacgatgagctcccgttccaactcaggaacctcatgttgcccatgtagtcaagcttgattcgtgtgtatggggagccatcagaggttgtgtacataatgtacaactcatccctagtgttcacaagtgatttgtacatcaaagtggcaatgttgctcccgtatgcttcaccggacactaacactctattaagtgaaagtgcaatgaaacggtaatatggcttggtcccgtgccagatgaaggcctgaaggtttgatctggggtcgctgtggtaggagaagtccccggtggatgggtcattcggtcccttccaagcgacaagtcgcatggcgacttgtgccttgtatctcaggaaaaacttcttgttggggagaagggtatcagttgggtgatcaaagctttgccatgcggttgtattgtccggcagccgaagaaccaagtttcctgagtctagcagcactgcataagctcggtcacctctggtgttgatgttggccatcgtcgttcaaaaggtgtggccttctaaatctgacaatacaaagttagaactattgctgatggcgagcatcgcagatgaaggggcagtgatcggcttgtcacggttggcaatccaaacgtatgtgcgctctgggatgttgttgtaccatatgccgaggaataagctctggttggaagttgctggggagaagaagccgagtgcgaaaaccccgttctgggagacgagcacgtcgccagggtagagtttctttgcttgtgtcagctgatcatcgcacttgcagaatgagaagatgaaaagagggaagcaagccataccattcatttggtcttgttcttagctttgcctagttgcctgcaaagcgtagagaaatagcacacacacatatgggtgtttaattatctgatgcatacatgattctcctgagtcttgactcttgactcttgaggagcacgcggttggaccaaaggaagcagcgtaataacgaatggccgagactattctgtccgtcgagataaagttttgctacgaattcaaactgaactgtggggagactacggtgaagtggcctgacgagagcataggcgtagctggtattagtactcagtgttgtgatgctaacttgtgcagtttgtggctggctggctggctcggtggcaccgggacaacctcg

SEQ ID NO: 37445 - DNA, 1501 bp, Oryza sativa
ggctgtcggtgcagagaatggttggtgctaaagatattattgctatgatttattgcagagttaggtggagcaggaggagcattggtgttgtggatgatatcgtcgatgttgctgttggagctgactagctgacgagacaatcgtagggtcgttcgttggatttctgcggtcttggtcaacaacacactgagttggcaatccttgggcacatgatttgtaccttcgcacagaaagcatgtgaccttgcgggtgggacactcccctggtggatggtcttcttcacaataagcgcagagtgtgagacacatgctagcaatgtgtccaatttctccacaacggatacatgcttttgattccatctcttcctcaccgagatgtcggggagactcatcttcatcatccgaggagacttgatctgacccttcactatcagatactctgccaccatggcttagaaggtgctgggtcaactgtcgtgcacctcggaaggtatttcctctttgacgtctaggaatagttatccctgcgggaggccattcggtgctgctaatagccatcttacgtacttcttcttcagttcgcatcggcgcttttctcttctgattcttactcttcttgcctttggcttgcttagtacgtgaccccacgtggtacgaagggctaggaggaaagcaattcccgggattcaatggattctctccattgggctctctactttgcacactaggctgcaagcttgacttggtgcgaggaggctggtttagcgatgtctgccctgttaaaccaaaggaaggggcttctttggcatatacccatggacaattcagggcatagtgtccttgttctctacaatcgtgacaaaaggggacatcctcttctggcattggaagctcattgacctgggtggcaaatgctcgatcaaacacatactgattttggtcttgacttccaaccaatggtagctgtgaactaagcggcatgcttggaatggaccaagggtgtgccctggttaactctcttgaggccagtggtggattgagttgaaaacttgagttactggaggcataccctctgacattctttcctttttctctgttaaacatctgttacagggattgaggtgagagaggaaacaagctaggaaagaatagaccagaactagggacaggaccttaaaggaactaactctctttgttgatgtgttgtttgtttcacttattctgcaagttgattaagcaaacaacctagcatggttacatcacaaccccccgatgcaaaccacgcgctacacacacaagcaaggaacacacgactaacaacactaccctacagggtggcttaggttctgcgacgggttctccaagatcttcactgcttcacagctggcttcactgcttcctccacttcgctagcggatcctgcagtcttccggagcttcggcgaacaattggcgacatcttcttcttcgcaaactaaccatctagtactagtggaaatccga

SEQ ID NO: 37446 - DNA, 1501 bp, Oryza sativa
ccgaccctgggtcccagctcgtcccaagccaacccaggccaaccattccacattttagttgttgagcaaattttaagaattaaaacactgacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagttcccaacccatcctagccataaacaagagtaccgacccaatcctgcctacggccggaacccccgggacaggcaggcaggactgagccccaagcagcagggcaccaaccctctgccacgacatctcgactaccgggccgcagctcgtgtagccttcatttgccctggagaatgtccatcgacccccgacttcatccatctccaatccgtgtacttttgtttataaccagactgagccacaaactaagccttacccactagacatgtggaagtacggtagtgctttgcaacagaggcccgagcttaatccttatagtggccggggtgctacttcccacaactggcatgcacccaaaccccaccgaaaacaggttttaggggttttgaaaggggaagagaggtgtatgtccaattccaccataaaccaacaattccaaagtgtccaaatgatatgagaattcccaaagtctaaagttataaaatcacctaatgttgcctaattaaccagcgaagcatctacctaagttcatactagtggaaccataaatagagtacccactagttggggttttattttcctagggtgaacaaggtaataataacaatagcaataataatgtcttaacaacgataaataggcatggctaaataaaacagtgataacgcgggaatttaaataaagcggtaatgcaataatttaaatcaaaataattttataaactgggattcaatatgctcaaggatgatgtgacttgccttgctcgctttcccaaacaccggcttcaacttccacgaagagcggatcttccgaagctgcagcgtctacacgaccaacggaaaagaaacggcttttactctaataaactccacataacagcagaaacaaagcacaaaaatgggttcttgacttcttaaggaaaaattagagacttgaacggtccaattccgagttcaaatggccaagatatagccatttgaagtttatatgctctttaaatggatatttacgaatttcttcatttaaattttaattaaaaactcatttattgcgtcagccgggagagagggcgcgcggaccgggtccacgggagtggggcccacgcgtcagcctctcggtccacggtggaccgggtgcacgcggctgacggcggccggcgccgtgggtcccacgcgtcagccgcacccgcgggcgcgggcggctgacggccgggccccacctggcagccgcggggcgcgcccgaaggcggcct

SEQ ID NO: 37447 - DNA, 1501 bp, Oryza sativa
cacgccgctcatcctccgcggcaagccccttgtgcgccggcgtggagggccctaggggcggcgaggtcgacgatggccgccgcccacggcgaggtccccgtggaggcggtggtggctagcgcgtggaggaagcgcggcggcggcggcgctggtcgccgatctcctcctctccgccgccgaggccgtgggcgttgcagccgtcgaccgcgccctcgccggtcacccggaccccttccgcgtcgtgcaccggtccgagctcgcagagtcctcaaccatctgctcgcctgcaagcctcgcgctcgcgctcaacagagaggaggaaccgaggaccggctgacatggcatcctgatatatgggacccacgttggtcccatgctgactcagccgccacatagaccgaaatcggggtcaaaaccaccgaaggatctcgggtgatcggttttgtttagttaagggactatatatatatatggttttatggtttaagtatgtttttttatctcgctgacaagttgagggaccttgggtgtactttttcccccaattaacacggtgcacgacacgacacacggcgcgattgtactttacctaccgtcccctctctcgatcggcttacggacaatgcgtatgacgcacgcccggattaacgtcagttgtaagtcgatggtcggccatgaatctacatgtcagtccagacgcacgaatgcatgactcaggtccagttcttttcttccacaagacttagataaatattaagattttcgtgacacgcttttcaaactgttaaatgataaatgatgtgtttcgtacaaaaactttttatataaaagttgcactaaaatatcatattaatctatttttcaagtttgtaagaattaaaactcaatcaatcatacgttaatagcatattgttttgcataaaaacttaggggctgtttagttgatggccataagttactacactttgccatacttaaggttagacaagtttgaccatgttagatgattgtttggttggcttccacaagtgtggcaagattcctcttttgtaatctaggtcccacatgtaagtgtctctaaaaagtgtggcatggtttcattttgttggctagagtgtggcttggattttgatggcctcatctttggcaagtttggttaagaaagcatggtaaacctagtcaatgttagtatctgaaccaaacagccccttaatctccatcttcatcttcaatattcaaacaccaccgtagtattgtgtagtactctaccagctatgcttaccattgctgagagcagcgtgatatgacgatctatttgtccactccatattgacacttcaatcaaccacccaactcgcaccgcaccggttttattttataataaaggtgatattctggatatagtgctcgtcagaatgtttcttttaggaatacttactgataagcacgccagaccacctcactggctcactacacaaattgaactctttccaaagaacag

SEQ ID NO: 37448 - DNA, 1501 bp, Oryza sativa; identical to SEQ ID NO: 28339

SEQ ID NO: 37449 - DNA, 1501 bp, Oryza sativa
ttaatacttcaaatgtgtgttcatatacttcaaagtttttacacccaaaaaactaaacacacccttagtctaagataaattttctccgtgtaatgccgccttttcaaaagccttatcttatccgctaaaatttaaattttcaactttaaatttgaagttgattttaagatttttcatcgaagtttttttagtcttcccttttagatcgttatgaacacgtatatataagttttattcataaattatttttcgtttgcccgtttttcttattccacgtaccacgatggagccacgagtgtccagacttgaatgaaataattaccccctccagatccaagcaagttcaagagccattcaatcaaaaaaaaaaaactcaacctaaaaaaacttaacctagcagaggtcatccccttcctggatatatggtagtcagggttgatttttttttcttgagacggagggagcgaagcaaacgaatctccaccgtccgatcaaacagcgtctcatacttaaggtggtgtttgaaagtcctacaggtagacgaaatgaatcctacccaggaagaaagaaattaaagcggggcccatccagcccgtgccgtgggacgtgcgttttcttcttcttgcagcacaagccgcggccgtgagatcttccggcaagcacggggaaggctcgcgcttataaaaagaaagaaacagatcttttcggttaaataaattttaatcaagaaaaagagagagaaaggcttctcttcttcttcctcgtattgctgctgctgcttttggtctcctccggtgaaagcgacgggccgtgatggtgcagctgccgtcgcgctcgtggtgaaatcttggacactgccggtaatttcttgtcattttttccccttcttttcctcgagtctgggtggattacgcacgcacacaaaaaaagaaagctggggtttctcttcaatgcgattcgagggcgaatggggatgacgcacgaagcccctgcggcgggcgggcgagacgacgagcgatcgaatatcctcaggttttattttctttccacgccgttcgcttcccgcaatcttgtttcctacgtacgacgatgacgagtccactcggaatatccccggaggaatccatggtggattcaacgaatcatcaaaactaccaaaccgtggagtagtgtgtgtgtgccgtactgttgaagtctggccgtttcgctgggtcgcgatcttgtgcagcacacgccggcccgagagaaggttccgattcccatctctcagccagttttcttggagaagaaacgttgttgtacactttattatgtatggcgtgataaatttggagagttcgtttgctccaaaattcttgggggagggagattggtcaacaccgatgtgcttctagtacttctcttttctcactgggctccattttccaaggaagaaaaatgcgaagccaagtctcgtttcgttcgtgtatcatgtttttttttgggtcgctttctttgtgtg

SEQ ID NO: 37450 - DNA, 1501 bp, Oryza sativa
aattttgcacgatttttcacggttaccgcgcggtaaccgtgcttaccgctggggcgcggtaaccccggcccttgcggtttgggaaaacctgaccgacgctgctcctatctcttcctctcctcttctcgtctcttccgcccaccatttcctgcgctgatttttctccctctctccgccgctgctccgtttcctcctcttctcgtcgccttctacctcgtcggtgccggatccactctccccacgccctctctctctctctcgtcactgcctctctctctctcttgcaatgctcgatggcaagcggcgtcggcggggtcatctctctcgccaccgcccgtcgtcaccgcctctctttcccgtcgccgctgatggagagcggcgcgcgggtcgaggttgttagaataattgggctaggcccaatttattctattaaatctcaaaggcccataataaatgttaaggataataataccacctcaggatttaagcgagaaatatctcaacctaaatagggagttattagaggctccctgttgaccagttgaggtgggggtcggaatgccacacgcgcgcgcgcgcgcgccgggccggggcgtgggcgtgggcgtgggcgaggcgtggcgtggctggctggctggctggcggcgggcgtgcgtcacgtcgctcttttgcagccactaacccacgttcccacgattccctccgcaacagcgcgtccacgttctttctcctgatagaaaaggaggccgcgagtctgatccgatttcttagctgcttccccggtgttagtttctcccctgtgcctgagttgctctctcccttccccgcttctgatctcttgcgcgcacgagagattggaagaagcagtgcctccgaaaccacaccttcgcctgagatctgcaccgggtaggcgggtgatcaggtttttggggagtgcctcctgcacgactgctcatcgccatgtctggagttgctggcggaggtggtgcgccgccgccgacaggagctggatccggagctggtgcgccgccgccgacaggagctggatccggagctggtgcgccaggaggaggtgccgtgaacgactacaacaacggaggcaattctgcctcaccatccagcggagggccattctcggggtataatcttctcctcctactactgttgttagcgctatactgtgtgagctatgttcttgttcctgttctacatgatgcctctagcatgttatcgcattactggtatgttcctgtttctgacattcatgatgcgcatagtatgctactggttatgttaagatcaccctacactgcttatgccatgatcattgtttcaatttcttggattaaaatatgccgaataatgactatatttccaacaatccaaaaacctgataggtcattttcggtagttggctttgctgctgcactgaaaccacatgcttttgatggttcaaactataagagatggaaagcacgtgcactattatggttgacagcga

SEQ ID NO: 37451 - DNA, 1501 bp, Oryza sativa
aaatatatcaacttttggttatgtttctggatcaaaagtaaagttactatataatcactatagagtagtacttatcatgtcaatcaccttaggccgagtttagttccaaactatttcttcaaacttctaacttttctatcacatcaaaacttttctacacacataaacttccaacttttccatcacatcgtttcaattttaaccaaacttctaattttagcgtgaactaaacacacccttaagttcaaatttctctacattctacctctccaccttcccactccccataaaacatcatttaataagaagcactatgttttcaaaaaaaaaaaaggagcgctaagtctattctcttctcaaacattaatctatgcaaaataacctaaaatgactttcttttagctaggaacagatcgatggagttgaatttacttaaagatatggcagtagtactcaagatttgtatataaagtactagataaaagaaacttactttagatataatgctgcttaaattagacgcgtgcatgaatcatgtcttgtaggagtacatgtatactccatccgtcccaaaagactcaacctcgtcctacgacgtgacacatcctagtacaatgaatctggacatactctatgtctagattcgttgtattagaatatgtcacattctaatactaggttgtctttttttttaaacgaagggagtacataccttggggtaaatgttaaaaactatatataatactcccttaaagacggtaaaatatctctagttttacattgatctgtaattgaacactaatacctattattccttccgtcccaaattatagggcaccctttttttataataaaaattaaactcggtaacttttaactgctaatcatactaatcatatagtatatgctaagtattatgcatgttatatcactagttttataatttaaattattttcgtgtgatgctaatttcatatttattggaatatagtatggaataaattaatgatcaaagtatatcattggagactatgtaaaaaaatatgtcttataatttgggatgaatggagtatttttaaatctaaatgttccaaagctgcctttaactacgtaaataccttacccctccacaaagggcacccctcatggtcatgcactcatggtgtcttttctctctcccttaattaattagttacttgtgtaattaaatgtaaagttgaggagagatggatcgtgtaagagggaaaaggacggcatagatacaatggaaaagaattgacccggccccctcttgtttccactccacgctataccacactgcacatggtttcataatacctctaatttggatcttaatttagaagaaaacaaattgtcgaaacatgaattcggcaataataaaagggggtagcgcacgagacctaaaagtggatggatgcagagacaaaggatttagacaggttcaggccctctcaatgagaggtaataccctactcctgtt

SEQ ID NO: 37452 - DNA, 1501 bp, Oryza sativa
tatattgggactatctatacatctgttgacagaaaatcccacctcccatctttcaatttttgaaccattggatgtgctttatgattcatgaagatacattaaccctacaactcctcctcccgttccctcccatcacgctcgcgagctcctccgcagctccacccgatcccccgccgccaccaccccaccgcgtcgccgcccgcctcgccggctggctggagggcgtcaacggcgccggcgagactccctcccccctaccatcctcctccccctccttctcctccctcctcccctccttcctcctcgagctgtcggcggcgagatgcccccaccaccgacgctggcccaccgccctcctccagccctgcggctccggcagcgccgccggcgcctcgccgcccacccgacccgccgcccacctccgggccgccgccgcccacgaccatccctctaagcccggcgaactcccccttcttcctcccttcccacccctcgaaccccaccctaccccgggaacctaattcgtcggcccttcgccggagtttgggttatcgccggcgtcggggaagaagaggagtttgttggggttgaagaagaagcagttggagcacgaatcgcgaagcatatctagtgaaccaaaatttataagatttagaggtagcttttctattgactgtagtttagcaattccgtattttattacagcgaccgtaccggtggcgcagccagcccagcagcccgtggaacttttgaacgcatcaataagtcaaaccgtggggcagacacgtgagatgagagggggacagtccaacgtgtgacgtcatcactctcgcacgtcacccggcgatcgtacggctcccccctcctccgatcctcctcccgaccccaaacatcgttgcagtagtattcctgtcccattgattgctgcagttcagcgtagccccgtcgttcaagtatttgaatggttctcacctccacaaaatttctattcaatcttctgcacggagtgttttttgcctttggctgcacgctgcgcagagtctcgccaaaatactgcaaagatctgcaggtctaacgcaacgcgtgtgtgcacgctcgagcgaggaaaattcaaacttttgaaacgctcgagcgaagaaaatccagtaatgtatatgcttttgcttggagaggagagcttgaaaagtagcgaatcgctctttggattgtataatatttggtctgaattcatgcagaatatctgtttgttgtactatatataggggaccagaaaacataataattatatagtccgtcttagcataagccacggggtggattgacggtggactgacgacggtctgatctttggattgataatactactcaaagcgaaatctgactattaaaataacaaatttccccgcccggggactgtgcgcggataacttactcagtactttcatgtcataattaaaatgttcccatgcgcgcgcgatgcgaccatgaccaccccgaaccc

SEQ ID NO: 37453 - DNA, 325 bp, Oryza sativa
ccaacagacagataaagtccattactatcttttagtgttttatttaattttaggaaaaaaaagggaaaaaaacatgttgctgctattattttggtttgtttcttttgttacagttgtactatgaattagtatatggatcatgaacagtattctagaagtatcacaaaatataatgggtataaataactaggtctcaagtacacaaggtttatatctcatcttggtttctttttgttgattataactttgcaggcgtatatatatgcttatgcataactaatcatagcaatcatgtatttttcacctaacttatgttaattgcagc

SEQ ID NO: 37454 - DNA, 444 bp, Oryza sativa
cgtttcacaatgtaaatcattctagcatttcccatatttatattgatgttaataaatctagatagatctatctatcatcaatatgaatgtgggaaatgctagaataacttacattgtgaaacggaggaagttctgaacattcgtagactagatcatggaagacagaaaaactgtgacatgcaaaaagtccttttagaagcacagttaaattttaccctttcctactgcaactgctatttccatatgcaaacaggaaacggtacttcgccggcctcttgagcctcaagtacggagcagtacaagatcaaagcagccaccgtcactaactctgacaagcttgagttgtggcgcatgcagaagctgctttacaacttcccaaaataacagtgcaaacttagacccgttctgtccgggggcttcggacaacgctgtcaacgcacaaga

SEQ ID NO: 37455 - DNA, 1501 bp, Oryza sativa; identical to SEQ ID NO: 37412

SEQ ID NO: 37456 - DNA, 1501 bp, Oryza sativa
aaggattgggttcggggtggtcatggtcgcatcgcgcgcgcatgggaacattttaattatgacatgaaagtactgagtaagttatccgcgcacagtccccgggcggggaaatttgttattttaatagtcagatttcgctttgagtagtattatcaatccaaagatcagaccgtcgtcagtccaccgtcaatccaccccgtggcttatgctaagacggactatataattattatgttttctggtcccctatatatagtacaacaaacagatattctgcatgaattcagaccaaatattatacaatccaaagagcgattcgctacttttcaagctctcctctccaagcaaaagcatatacattactggattttcttcgctcgagcgtttcaaaagtttgaattttcctcgctcgagcgtgcacacacgcgttgcgttagacctgcagatctttgcagtattttggcgagactctgcgcagcgtgcagccaaaggcaaaaaacactccgtgcagaagattgaatagaaattttgtggaggtgagaaccattcaaatacttgaacgacggggctacgctgaactgcagcaatcaatgggacaggaatactactgcaacgatgtttggggtcgggaggaggatcggaggaggggggagccgtacgatcgccgggtgacgtgcgagagtgatgacgtcacacgttggactgtccccctctcatctcacgtgtctgccccacggtttgacttattgatgcgttcaaaagttccacgggctgctgggctggctgcgccaccggtacggtcgctgtaataaaatacggaattgctaaactacagtcaatagaaaagctacctctaaatcttataaattttggttcactagatatgcttcgcgattcgtgctccaactgcttcttcttcaaccccaacaaactcctcttcttccccgacgccggcgataacccaaactccggcgaagggccgacgaattaggttcccggggtagggtggggttcgaggggtgggaagggaggaagaagggggagttcgccgggcttagagggatggtcgtgggcggcggcggcccggaggtgggcggcgggtcgggtgggcggcgaggcgccggcggcgctgccggagccgcagggctggaggagggcggtgggccagcgtcggtggtgggggcatctcgccgccgacagctcgaggaggaaggaggggaggagggaggagaaggagggggaggaggatggtaggggggagggagtctcgccggcgccgttgacgccctccagccagccggcgaggcgggcggcgacgcggtggggtggtggcggcgggggatcgggtggagctgcggaggagctcgcgagcgtgatgggagggaacgggaggaggagttgtagggttaatgtatcttcatgaatcataaagcacatccaatggttcaaaaattgaaagatgggaggtgggattttctgtcaacagatgtatagatagtcc

SEQ ID NO: 37457 - DNA, 1501 bp, Oryza sativa
gcttttccctctctctctccctcggattcgctcggaatctttcccctaaacctcgccggcatcaatggcgcccgagatcgccgcggccgtttccttcccctccggcctctctctctccctcccggcgctatataattgttccccgtgcctctctcctccgtttccgccgctcgccgctcgctctccccgtcggattcgtgctcgcgccgtcctcctctctctccgccgtcgccgccgagctccggttcgccgccgtcgtcgccccggacttcctcccgtctcggcgtcacctccatcggcttcgccgcgtcgtcgtcgacctcgtccgctcctccgtttcgcccgccgaccgccggagcaccgtcgtcctcgccgtcccgaaccgcgccgccgctttcctccactccggtcgtcgtttccgccgtcctcgtcgtcccggggtgagccgtggaccgcccctttcgcttccctctcttctccgctctctcgggcgccgctccgccgcgccggtggtcgccggcggtgaccatcggggcgcgggcgcgccgtctcccgtcggccgtgccggcgaggccgccttcgggcgcgccccgcggctgccaggtggggcccggccgtcagccgcccgcgcccgcgggtgcggctgacgcgtgggacccacggcgccggccgccgtcagccgcgtgcacccggtccaccgtggaccgagaggctgacgcgtgggccccactcccgtggacccggtccgcgcgccctctctcccggctgacgcaataaatgagtttttaattaaaatttaaatgaagaaattcgtaaatatccatttaaagagcatataaacttcaaatggctatatcttggccatttgaactcggaattggaccgttcaagtctctaatttttccttaagaagtcaagaacccatttttgtgctttgtttctgctgttatgtggagtttattagagtaaaagccgtttcttttccgttggtcgtgtagacgctgcagcttcggaagatccgctcttcgtggaagttgaagccggtgtttgggaaagcgagcaaggcaagtcacatcatccttgagcatattgaatcccagtttataaaattattttgatttaaattattgcattaccgctttatttaaattcccgcgttatcactgttttatttagccatgcctatttatcgttgttaagacattattattgctattgttattattaccttgttcaccctaggaaaataaaaccccaactagtgggtactctatttatggttccactagtatgaacttaggtagatgcttcgctggttaattaggcaacattaggtgattttataactttagactttgggaattctcatatcatttggacactttggaattgttggtttatggtggaattggacatacacctctcttcccctttcaaaacccctaaaacctgttttcggtggggtttgggtgcatgccagttgtgggaagtagcaccccgg

SEQ ID NO: 37458 - DNA, 1501 bp, Oryza sativa
accacttgccggctgggcgctccctgctgggagcgccggcctttttctttttgtcgctcgctggcctccccttttgggtggcccgcgaagcgccctcgacggcgaggacatgaccctcgtcgtcggaatggactgacctcttcttcctcctcctgtcacgccgccctgtctgagcggcggatccgggggcggccgaagctgccactccggaaccggaggggttccaggtccatgcctcctccttacgagccactcggtccgcgagctgaaaaagctccgcggtagtctggggctctttggaggcgatcttttcgagcatgcggttgtgccgcacgccccccctgaacgcgtagattaccgcgtgtgcagggatgcatggtatggtattgcggacttgacagaaccgctgaatgtacgatcgaagtgactcatcgtcccttcgctgtactgcgtgcaagtccgcttcctcaccggggcgcggatatgtgccttggaagttcatggtgaactgttggcacaaatcctcccaagagtggacagatgcaggtggcaagttcattagccaaccccgcgcctgccccttcagggccatgggaaagaaattcgccatgaccctgtcgtcacccccggcggcctcaatcccggtcgtgtagacctggagaaactcggcggggttgatgctgccgtcatatttttcggcgatggtgggccggaaccttgggggccaacggacattccgaagactcgccacaaaggctctacagccgacaccaccaaccgggggcacggagggctgattcccacgtccgtgtcgaggtgacactctggacgaggaagcgccctccgttgcgtgggcagcacttcggtcattacgccggcgctcgatgctggtgcgggcgtcctgctccccacgcagatcttcccgggtcgaaggagtcgacgaaggagtgacggccgaacggcgaacagcggctgccgctcgtcgtgccctccgtcttgacgacgcggagccggtggtagcagcaccagaggccttggtggcggaggaccgcccaccagcatctaggcgctgccgcgccgtcatgaccaatttggccacgtcgtccagccatcgttgggctggagactccgggtcagggacgacaggcgggtggcgtaagagcgcgcccgtagcttggagcgcgccctggggcgtgctgccgtcgccgtagacgaggaggcgacgctccccatctcgccgttcttttccatcgcccgcgatcggtgaagtcgcggatctttcgaccctctcgagcgcctccccccgcttaggactttggcgtggagggggcggtggagtacgagctcgacggcgtgggttcggctccccgtcgtcgccactcacactcggagagaggtcgtgcgcctttgcttgctcagccatgaggctgaacaggaaaagcttggtgcacacgaaagagcgcaagagctcagaagatcactcgcagagtcccctacctgg

SEQ ID NO: 37459 - DNA, 1501 bp, Oryza sativa
catcgtcagtacagtataaagaagcaatcttttgaatccttttcaagtaggagtatagtatgagattattatagcctgtcaacttgctgtttgtaactagccaatgctaatcttttcagctcgattatgatatatatcacgtcgtcagatttgtgcaaaattggtatagagacattctgaccgggttatggtcgatgacactgtccatcatctgagagtttgcaagtctctgaactctgaacattgcccagaatctcttacaggaatctttttgttggtcttctcatacagtatatatcattggccccttgcaagcagaggacaaattctctttgcattcgtatgcattttaattctgcgaaacctgtagcttgtcctgtgtataaacaacgagaatatcatctgtttatcattccaatttccaagtatcaacttctacctcgaccaggagtaatacagattctgaagtttataaacacatctctgcctgaacaagatggacacctactgttttcagttcaccatttgatctttaccagataaacctgaagttcaaaccgtgcagcactgcagccatgtttcccaagatagaatgacgcgtacacaagcttccagcgtgtcgagggcgaggtcgacggcggcgccgcaccgcgtgtgccagcaaccccaggcgccgcaccccgggagcggcccgctattgggagccgccaccgacgcctgcctgctgtacagaaactgcagcacgagcacgagcaccagcaccttgtaccgcaccagccgcggcaaccccctagcctccgccgccgcgcccaccttcttcctcgacgccgaggacgacgacgacgacagtgccacgacctcctcctcctcggcaccggcgccgcccacctctgccgcgtgccccacgcagcaccaccctccccggtggcgccgccgcgccactatgttcgttgccggccggcttccaacaggagaaaagagtgagagagagagagagagaggaggaagggaggatgctgacggcggcgttgcctccgccggcgcgacgccggctgccggaccttctcctctcccctccccccggcggcctcctcccccacagcgccgcccgtcgccggctgagaaaagtgagagagagaaagggagaagaggggaaataagagggaagagatgaggtggcgtgggttccacgtgggtcccatgctgactcatccgctataaaccgccgaggaatctcgtatgatcggttttgtatagttaaggaatcccgcatatctggttttgcggttcgaggatgattttgtatctcgctgacaagttgagggaccttcggtgcactttttccgaattttttttatttttaattttttttattaaaagttttacaaaaataatttttcattttgaaaattgacagaagtggtcgcctaccgccctctgggagggcgatttttaaaaatcgccatcccagagggcggcgaaaatgacgtggcagacggcc

SEQ ID NO: 37460 - DNA, 1501 bp, Oryza sativa; identical to SEQ ID NO: 28342

SEQ ID NO: 37461 - DNA, 1501 bp, Oryza sativa; identical to SEQ ID NO: 28343

SEQ ID NO: 37462 - DNA, 1501 bp, Oryza sativa
atatcctgagtggtttgatagggttccatttccacaccgatacaaggttctagacttgtccaagttttcaaggcaagacgatatatctacaatggaacatgtcagccgattcttagcacaatgtgaggaggcatcggctgaagaaactctgaaagttagatttttccgattatccttgactagatcggccttcacatggttttcttctttaccatcaaattctatcaaaggttgggccgatctagaaaagcaatttcatacatacttcttcgctcgcatcgatgagatgaaactttcagatttgatatcagttcagcagcaggaaggagaatcggttatggaatatattcacagatttcgtaatgtccgcaaccgatgttatagtttaagtctaagcgatgagcagctagcagatcttgcgttccaagggctatcaacacctatcagagaaagattcttttgccatgagtttgacagcttagcttatctaatgcagacagtatcggctcatgaaagccgattggaagaagcaaaggaagatcaattttggaggtaccaagatcggacagaagataattttgaagcatgagacctcatactcaaaaattggggggcatgtgttaacgccaaaatttggtaagcccgaagtcaccatcggcctagagtcagtgtcggcttcagagtcctgggatcggccgatgagagttatcaaatcgcccgttgtcggattcttactatattcggttaaggaaattaatctactaaaggaagcttatccagaagtgatcgaattcaaggaggatgcggcatggcgagttatctattaattaggaatagtttgttagtttccttttatccttaggaaagtgtgtttagtgtcctataaggactttatgtttttatttttttaggaaagtttctttcttgtcctacaaggactagtatcttaccatgggtataaatatgtacacccggggtcattgtacaaatatctctcgatcaatacaactactctcggcccatcgccaccctcttttttgaggttttttcttattcaaccggcggaatttggcacctgacgcggggctatatcggttcagttcgatctccggcgaaggggtaagtcctacgttccgccggccctggcgaatctatcggctgcgttggtgttgttcaaggctgcatcgctttgatctcctggatcgctctggtttggttgatatatttgcctacctgatatctcaattctatctctaattgcattgtgtttagagacgcatcagtttagttgggactgtctcagttaggtccgatcttctgtcttagccgatatatctctacaatcacaatgttgttctaaatagatttgttttatccatcacattagacagatctatcggctcatcgagtattagattatcgtatataatctcgtgctgtatcggttaggttcgacctactatattgttgttgataatataaatcttgttgaactgatagg

SEQ ID NO: 37463 - DNA, 1501 bp, Oryza sativa
gcaccggctgagctccctccgccctgtgcccacacctggcagagctccgtccgccttcgcgaccgtgcacctagcatagctccatgccggcgaccgcacactgcatcttgctccgcgccgcgacctccctcccggccacacgctgagccaccaacacttcgctcaccttctgctcgcctactgcccaaagcctagcttcgtcaagtctaatatgggatgacggaagcagtggcgaatctatgatgaaaatgtaggtggggttttatttatcatcgtaatataaaataatcatatatctttgatctatatcaacaatatttgaaaatcctacacggatagaaaaaaatacagtggattaaagaatgaagggaactgaagagtgaaaaagattaaaagatatatatagggatgggctacacactgacagctactaaaacacgaaagtaaaagtaatccacatcgtttctttcaccctgaacatctccagccaaatatagtcatcatcggttggctgtttgctgtaattaattttgttggcactatgaactcactagtcactacacatagacatagatatctgggatcaatccctgtcagccagagctggggctggagcctcaaccagccccaacagtggattcgccacaaccagccccaacattggattcgccactggacggaagggggaggaattagaatccacccactcctatgttatttcctaggagcatttcagtctttcatcctgaaaatgacatacacccctaaagcttggtttggaaagggtcagtcggcaggtttggtattttaaaccggggttaaataaccaaagtttaaaagcagggctaaactcatagttaggttttaaaataggtacaatggtgccattgcccctactaattatgaaattaaggattacgtgaccaaggaaatctaaaattaccatgacttaactttgtctttaaataatattgttcatatgtccttaaatgttttccatctatctatctataagtttactaatttgactctgaataagctcctaagttaatcataaatatcttacgatcaattagtttgatcgaatgatcatggccttagatagtcaaattcgtataaaataaaaatatataccttcaaagataacaccaattgaaaacctatgcatacggtttaatttgaattgaaaacctgtccagaccgaaaaatcatgtataactttgtcaaggttggccaaactaggtatacgtagtcataagccaattaattgctatagaactagatctttgtctgaatcaatatcaactatatcaactattcctaattaatcttagtgataggtatgaaagattaatctatctgctttttatttagaatgacttgaccgaattcatttgtgttaactaaatataccactgaaaatttcaaactattcagattttttatatatgccgatacaattaagaaaaacaactaatatttttactaaatggttaaattt

SEQ ID NO: 37464 - DNA, 615 bp, Oryza sativa
ccccccccccccccccccccctcgtaataatgcgtttaaaacttctcaccgagcccggaagccttggccgctaaggattttgctgctctgctcggtggagaacaacggagacgacgggagaaaggggagggaggaaagagacagatctacactagccttgcaatctcgcagagccgtcgcgcggcaggggattggattggggagataagcgagcggcgagtgaggaggagagtgtgagagagcgtctgttacgcttgtgtgcgcgtaggcggagatggggtggaaggggaaaaagacaagtgcagcaaagcagccgcttttaaacctgcttagccagcgctaagaatgagcaatgattgtgacagcaccattttttttttcaaaaaagattgtgatagtagtagctctctgattttttttttaatacggtataagagcaggtacagtagcagactattagccagctgtaaacatattttaatgagataaaagatgagagaaaaaagtagtgggctacagatctgtagccagctgcagcacggactccaagacgtaatatgtgtatgacaagtgggaccatatattaatagaatagtaagcaactattatatgaaa

SEQ ID NO: 37465 - DNA, 818 bp, Oryza sativa
ccccctaagtcactgagcatgcatgggcaggtgactgaattttagtactagtagatgaatggagtacgtcctaaaataagcgaaatactagtactcgcatgttttctgatgggtactccttggaaatgctgggacctttgacctgcttcctacttgtgtcgtcctcgagcccgcccaagattgcacttgtccacgccgtgcatcgagccagcaacccgagtgatcgaccagtcaaggacgcatcacacatggcgtgtctctctgccttgcggaagcaacaagtgtcagtaggagaaccttgctctgatcatcatcctggaaaaaaataaagcttagctaaacataattaggagatgattcaaaactaagattttcgaacacaaaaaattgataatactcttacttccatacagttgcaagagatggaaaaatttcggcgttggcacttggctttaaagcgttctttgaagcgttgaataaaagctttggaaccacacgtccgacgcacgcccgagccgggggcagtatgggaaggcggaaaccgcaccgagccgcttctcgcgagaggagaacgccacgcgcgccccgtcacggtggaaatgcccgttctacccctgctcctcgtgtgtgtactagcgcccccccgggccccgtctctcgtcacgctgcagacaaggacctactagtcgcgcgtaggccgtgtgacggcgtgacaccaccactgaccaccccctcctctcctcccagttcgtctcctccactcctcctgcatcacctccactcgtcggcggcggcggcggcggcgcggcgcagtgcgg

SEQ ID NO: 37466 - DNA, 685 bp, Oryza sativa
cacaagccatgcacttgccctagataaataattggcctcaccaccaatattgtatctagtggtaaacataataataatatcatgcatcatgcaaagttaaaatattgcaatagtaaaataaaaaaattatgcgtcaccaagcttgtgtgatcaatctctcgagtggatggcggcattggcctggttgcttgtccatgtcccatgttttttttaataggcttaagaaatttaaacctagaaacatgatcccagatataatattatcttggggccaataaagtaaacacaaagaacacaaaaagattagaaccaacttacctcgagttgtctcccacggcattagtttaattaagcaagtagctcagtataaaatataaagaattaaaactggacaagaaagaggctttcaagtattgggcatctcttttgttagacctcattatcgtaatttcagcctttcagtccctttagagtcccttaactcacttgccctataggagtaggatgtagcagcaatagatctcaaaattaatactactacctccattttttaaatagatgacgctgttaactttttctcacatgtttgactattcgtcttattcaaaaattttgtgcaaatgtgtaagatataaatcacacttaaagtactatgagtgataaaacaactcataacaaaataaat

SEQ ID NO: 37467 - DNA, 1501 bp, Oryza sativa
aagacacattgcaagcatgaaaagttattagccattttcttcaagaacgaagtaacagaccacaaaaaaaagaagccgagaacaaagtaacaggctgcaaaagaaaaataaagaaatataactgtttcatatagagaacataggttcactagttaggtaagaataataatagatttatcgagaaatcaaataattggacacaaagaagaaagagacaactatgcatataacatatcatgtcttacagcaacaaaaagctaatatgtttgattcattcttcttactgcaggctaattttaaggtaagggcaaccgtcattatggcaatatttttctccctgactgcacctgtgggcatcgtgctaggaattgcaatttcatcgagctacaatgtgcatagctcaactgccttcgtcgttgaaggagtcttcaactcagcctcagcaggaattttgatctacatgtccctagttgaccttctagcaacagatttcaataacccgaagctacagattaatacaaagcttcagctcatggcataccttgcacttttcctaggtgctggactgatgtcaatgcttgccatatgggcatagatcttcagaataacagaggatcttatttcccagataggcttgatttgtattaatctatgagttttctatcttcgcaaaataacatactcttggtggagtatttattgtatccatcctagattttctaaaaccaaagcttatctcaggtgatctctttgtactttatgatatgataatacatgatgacttaacttgttcttagctgctaagccatgtgaatgactaagggtaaagtagattctgagcttcccatttggtcagatcagtaccattctagcgtcgagcatccataagagtgagtggcatgggcactaataaattattatctccctaaagcataataggcttactccatgaaatcatctacttccaatgggcaaacatttgcataagtttggaacacaactttctccaggtttgttctcctaaccagaaattttttttaaaaaaacagtgccacattgcgaatggataactaaatagatataatatttatcttattaaatgtatgctaaaggagatctctgaccacattgaagaaaaacgaaattgacttaaatacagccagccaaagtagttctctgcagccaaacaaaaataattctaacacagtatctcgataataacagtacaaaaggtaaaactcatattggttccataattctcaagatttacagaagataatattgaattagaaggcagggtatcgagaagaactgtttctggataacatgtgaaacatgcacatgttgtgatatgacctactccacctttccctttccatgggaatcatcattcacttgagacggagttggttgatcaatgcttgctttagcatttgccaagaaggttggatcaggttgtggctcttggtggggagtctccttcatcgccatgcatatataa

SEQ ID NO: 37468 - DNA, 1501 bp, Oryza sativa
tccactccgctgcggttggctggccggccggccggctcagtggtgcttctcctgttcgtgtacaagaacatagctggtctgcctacccactatgctgtccttgtggtgtgttgtgtcgccttcttttctccctggtgcatccgttcgaccattagccgagcccgaggtcagcgaggaacaaggatacccctgcttgaaaatttgaaaacttggatataactgaattcttttttttatgaaaatgaatataaacgaatggtctgtatcaacaagcacttaaaaatgtcacttctaactatcagaaacaggtgcaaggaaaaaggaaaacatgatagtcttaggttgatacgggtagtagtgattggtgaaggaaatatgcagaatcctgctaatattcttgtaaacagtgcattagttcttgtcaacagtagaacccacgagtgtagatcttgagacccatccgtataggcaacaaatactttccaagtcacttcttacttgcatgtacatatcaatcgataagccaccaatgatgcagcacaattgtgcctaaagctaattaaagggagcaaatgtgatgaacataccgatccaacatgtccgacgataagttcatcatgagccatctaatcaattcagattgcacattcaggactcactggcaggctggtagctgatttgcttgattcagattgacagctcaatgcaaaactattgtgttcgaaccatcagatttgcacctgtacatcttccaaccggataagaacaataatgttaattagaagtcttaagagatgaagaagggtggcaatagaaggcaaaaaaaaatctatctgaatgctatatccccagctttactcaaggtgaatataatcaggtgaaatctgcttcagccatattcattggtaatcaggagatgggtcaacatggcatgcggacgttaacactgaacatgaagatttttcacattcaccccacaactgattaccatggatgcaaacaagttccacatgagcccaggcttgatctacctttatggctttaccatgccccatgatacacctgtcaattaacatcatgatagagtgatagcgttaaattacggtttacatatttatggagagagtttggtccttccacatttttgggtcaactttgtccaaagtgctttagtctacagtttttgacacatgggcatagctcatcccacctagacaaaggatgacatatctccctatgatctcatcccctcctatataaatgacccagtattgcatccatcttctggccaaagaatgacatctcttctcatcatcttattcccttctacttaaataaaaaaagaagaagaaaaaacccatcattgcctccatcttctggtcaaaggatgacatcaatccctatcatctcatcccctcctatataaagaacccagtactaccttcatctctgactcatagcaatatacatacatcgtatcacagggaaataatcaacataa

SEQ ID NO: 37469 - DNA, 1219 bp, Oryza sativa
ttgtccatttcataggaatttcaaaggattggatatgattcaatctttttttcaaagggcttcataggaaattttcctataggattgaaatcctctaaaattcctatatttttcctccaaatcaaagggggcctaaccttttgctaactttcctttgagtctctctctcatccaattcctgtgtttttcctgtggttcaatcaaacagttattcctgtatttttcctgcgttttgcaattctttgttttacacttacattcctatcaaaattctacgtttttcctattcctacgttttctcaatcctgcgattcaaaagggacctaaacaaggctcacttcctagatcaagtggaaaagttaaggagagagaaaattacaggagaaaattacaagaagcttcctgcatcaaattgcaacataggacatgaggacgtaatgctaaagaaaaagagaacatggacaaagatccattcaagcattcgcaagaattccagagaagaaaaacagtactacctcatgccgtgcagttgacagtaaaaaaataaaaaataaatctaggtagttgatcagccccagggccaagaccaagagaggtcggtgagaccttgagaccaaacgagagagaaaaaatggttttggaaacggggtagaaacttggacagtttacagtaaaaagaaaaacaacttctgaaaataaatctcgtcaagagaaaacaacttctgagaataaatcccgggagaaggagcagctgtcccgggagcatcagtgatttgtccgcaacaaaagcggcggatagaccggctcactcgtatatctatcctctgttgtctcaggtgataacagtagtagcctgctactagtactatctatacaagtaaaagcacaattaaactcttaattatgtagtattcagaactaatcaaagtaagtacagctgctgctacttgtaactaccgaaaggcacgcaatcactgattaattaggcgagcaaccatgcagaaaagaagtttcctggtttcaggggtacagtagttcttttggcagttggctttgactgattaatctcatgtattccaacactaataaatgggacatcagtataattcctgtagtatgtcagcttgttaactgccccataccttctgaaaactttgacagcgactcgtcgcacgcatgcttaactcttgaggaaccggcaatcacatccaatcatcca

SEQ ID NO: 37470 - DNA, 1501 bp, Oryza sativa
tgtgtagatgtgtgtgcacacccctggtcacacgccacagctagctcagctctgatcgatctcctttttctgttttgttgtgttgtgtctggaggaggaagaagaagaagaagattggattgatctcagcctctagattttggtagtgaaaataaaatgtgattatattgaataattgaaaggagttgaagctcactggccacctatcctagctctagctaggcctctaaatatctggggacagtgccaatggagtaagggcccataggcatgcatatatgccatgcaatgtatgctgagtaatgatggtttcatactttcatttgccttcatgcatggcaagatcagagatgatttaacagctaacccgctgtcagtactcggtgacacgttcattagctagcaaaggtaagactgttctggattccaacaataagggcatgtacaatggttgtcaatagtggtctcttagcgttactaattaggaatacttattgacatggaagaaagagaaagagaagagacaaaacgtcgttgttatacatgacaacggcttaacaacgactcttaatcactataatatgaaaatatggttgcacgagggtaaaaaaagggaaagaatattaacaaatggaatattttttgagttaatgattagagtctttgtcgtctcaactattgtaaagacagggtctctaaataatcttgtattgtttaagagatcatactcgtctctaccattgaacgtgccctaatagtgaattattttgcatgcggaccatgctgtgtcgatcgattaactcacctaccatgcagtaatttggaggttgcatgggcaccatggaatatccgaataaatagaatagacataaattaaaggtcctctttcaaaagaaatttagtgatatcaagaatttatcattaatttctactatatctttcgacgtaaaagttacgattctttcttgggtgtgatatgcacggaaaatattttctacatctagtacttgaatagggaacctttttaagataacagaagaattttatcaatctgagtcaattatattaaaatgatacaactgcattaagaatagtctcgacctgttgactgttttaaggttaaaaaaaaaaaagctttgctcttttgactgttgactccccaatcagtcggttttgttttaaccgcgacatgcaatatgcaggggccccgcatttgctcacaggctcacatgcctgcgcgagtaatccaaagcacgagtcatccaaattaagtccaaaccgagatgacttggttgaatttcagcagcagcaaccaccgactcgatgcatgccagccacaatcctcgccaccgcgcgcgacgtgacacgccaagctctacctagctagcgtgctccatgtccatcactagctagcttcagtgacggcctctcgcctccaccaatggcctataaatccaggctcccagctcgtcttcttccctcgcacaccagctagctatag

SEQ ID NO: 37471 - DNA, 1501 bp, Oryza sativa
ctggcctacgagcatgttgatgttaagccttttcgagcaagcattttgctatcttttgtcaaaagtcgaaacaacaagttagatatttgtcatcaggtgtctactatctaggttacagtacttggacatacctgaacaatgcaaccacccaaacctacaccttcaaagaactggtggaagctgagggcaccaactagtggcctgatagtagatggcctcacagatgcacctaaggatactccaatgataactgaatgcaccaagattcccagctcaagaacctgcatggccaaaaattcatgtggttattgcaagagggcctatctggttttgtgaagcattcatttagttggcaatcaatgtgcaaatggagttaattctgagtttagtgggaaaagtttcccctgaagtgcagattatcagacatatccattgaataggtatcttctcttccccatatatgttttctatgtgttttatggaaataagtaaaaagagatattagataatcaacatcatcctgcactattgtagtttcaagattacaatagactaaacttattctcattactgttgccaggaaggcctatgagcttcaagtgactgctgttacctgagatactaccttatgtcgaattgattcagctactgaaccctcctctggtgagccacagaccactatatcaccatgtgaatgtgtatgtcctccatgtgtgtgcgcatttatgtgttgtgcatgttcagccctctcgtctccagcatgcttgtgtacgttgatgttgtcaactgggcgtgccttcctgaattgagaccggtgatagtatccagcagccaatgagtccaccaccattgtggacactgcagcagacattgaaacaaggcccgcaaaggggaagggattcctatccccaccaccccttttgaggcatggagatgtgagcgcatcaaacgccgctggaagaatgtgcaccatgccagtggcaaggatgacgccggctgcaaatgccttgacagcaaagaagatgtcaccatcagggcgcagcgcagccatggagcggccaatcactggcaccaagacaccagccgccccagctgcaaggatggatgcaatggcaatgagctttagcttcattgcaccctgtctgtctgccccgtctgtggtgttagcacagtcgcaggcactggctgcagtgtgctgcgcaaagagcagtagccatggaagcacttgcaaggtatgcttcttggctcccattgttgctgattatgttgattatttccctgtgatacgatgtatgtatattgctatgagtcagagatgaaggtagtactgggttctttatataggaggggatgagatgatagggattgatgtcatcctttgaccagaagatggaggcaatgatgggttttttcttcttctttttttatttaagtagaagggaataagatgatgagaagagatgtcattctttggccagaagatggatgcaatactgggtca

SEQ ID NO: 37472 - DNA, 517 bp, Oryza sativa
aatcccttatattatgggacggagggagtgttgttcttttgtggctgatgtcgatgtggtaagacactcttatatcccacacgaaataaaatatactacctctatattatatttcaatgtatgacgccgttgatttttttattcagcgtttgaccattcgtcttactcaaaaaatttatgtaattgttatttattttattgtgacttgatttatcatcaaatactctttaagtatgatataaatatttttatatctgcttaaaaattttaaataaaatgaatggtcaaacgttagttaaaaagtcaacggcgtcatccattaaaatacggagagagtatatctagattctaaatccacgttgcattcagagtttgtaagtttgattaaactggtttcaaacaatacacatgttaatatgttatgaatcgacagcttcagatggaccgcaaccgtcttcatccaaagagaacgaaattgggtgctttccagagtgaggcatcgcacccgcatcgtgca

SEQ ID NO: 37473 - DNA, 1439 bp, Oryza sativa
ccatcttcgctgtcggagattcagatcaggttgggtgaagatgtactttagacttttgtgatctgtatatacctcacaacggttactgatgagatagtgccgccaaatctttaaagcatgaacgactgcggccaattccagatcgtgcgtcgggtagttgccttcatgaggacgcaactgccgtgaagcataagaaaccactttgccatcctgcatcaacacacatcctagcccctggcgagatgcatcacaatagacctggaaatctttcgtctgatcaggcaggattaagactggtgcagacaccaaccgtcgtttgagttcttcaaaacttctattgcattcagcagaccagataaacttttcttccttcttcaatagctgtgtcattggcttagcaattttagagaagttctcaatgaaccggcggtaatagcccgcaagtcctaagaaactccgaacctgagtgactgtccttggtggggtccacttggtaattgactccacatttgctggatccacagctactccttgagcattcacgatgtgaccgagaaactgaacttccttaagccagaagtcgcacttgctgaacttggcatatagctggtgctcttttaacttttcaagtaccagccgaagatgctgctcatgttcttcctcggacttggagtagataagtatgtcatcgataaaaaccacgacaaacttgtctagaaattccataaacaccttgttcatcaaattcatgaagaaggcaggtgcattagtgagtccgaaagacataactgtgcattcgaacaacccgtaccgagtgatgaatgctgtctttggaatatcctcttcgcggatcctcaactggtgatagcctgatcgcaggtctatcttagagaacacagtagctcctttcaactgatcaaacagatcatcaatccttggcaaaggatacttgttcttgatggtgacctcattgagtgcgcggtagtcaacgcacattctcttggttttgtctttcttctccacaaagataaccggagcaccccaaggcgacgtgctcgggcggatgtatcccttctgtaactgttcatcaacttgcttcttgacttccgccaactcgttggctcccattctgtaaggcctcttgtggatcggtgcagttccaggtaccaagtcaatccggaactcgatatccctttttggtggcattgttgtcagatcatccggaaaaacctctggatactctctgactatgggaatatcctccaacttcttagtggttttctccactgctacctcttgttcttcaccagcagcctggtttaaactaatccctggcttccgcggcactggagactggaaagttaccacctctccttttgcattggtcaacttgatggtgcggctggcgcaatcaatcactcctctgtgccttgtcaacc

SEQ ID NO: 37474 - DNA, 1501 bp, Oryza sativa
ttcctgtgtttttcctgcgctccaatcaaacgacaattcctgtatttttcatgtattttgcaattctctgttttacgcttcaattcctgtcagaattctgtatttttcctgttcctccgttttttctacctgcgattcaaagggcccttactgatgttattttagtgttagagatgtacgggagcgtatcctatgcacacaggccctcgcgtatacacaccgtgtacactaactaaaaattatcacaaaaaattctagaaaaattcatacatgtactttcaatagtattacatctacgtgcaaagtcgcatcttcaaattcattctacatagagaataacaaaaaagataaaattctgacaaaattgcaaccttaaaactgtcagattttttgtttttttgttacggctaaaatataatgaatttgacgttaagattttaaccctaggtgtaatacaattgaaagtatgtgtatgattttttctaaattttttggtgatattttttagttggtgtgcacgtgtgtacacgtgagggcctgtctgcataggatatatgttgccgagatgtactccataaatcactgtatcaccaactagctgcatgcaggtagcgctgatgcgtttttttaattactgtcatgcatccgtgtagtgcagatcagagccattacagagctagagaggatggacggacgtactatgcgtgggtacgttgtattgcgtcttaatttatgccgtcctgatcgcgagaacagtggtgtgattagacgctaaatagtctccgcgcacacacaccacgcctcaggataaacaccggatcgagtagacgataaggcgaggagaccgcgcgcgcttgcgtcccttccttttcccttcgtgtgtcccgcacgttggttttttccctcttcgtgtggatttttctcgttggaaggatatatgcaatgcatgcttatgctgagagcagacacaataacaagctataagctagctataaatatattttaaagagagaaaagcagcgggctacagatctatagccagctgcagcacggactccaagacgtactatatgtatgacaggtagtaccatgtattaatagtatagtaagcaactattgtatgaattggctattacattggttatagatgatttggagctagtatttagctatactattgaacttgctcttatgggctctgcgaaggcacaaattaaggtaattaaacttgtagcactaataaatgtgatatgaatcgtctcacaatgtgaatatttaagacatcgttgtcgacgtttgatgtcgcgattccggtatttgcatagtatggggatcgttggtactaggatatacgcaagactgagataaaagagacagatacagagatttttatataggttcgggcctctgaattgttaggtaataaccctacatcctgttggccgaagccggtattgctcttattcaccataatcacaccattacaatatttggggtagcc

SEQ ID NO: 37475 - DNA, 200 bp, Oryza sativa
gtcgactctagaggatccccctgcaggtcgactctagaggatccccggcagagtgtttaaacgtaatgagtcatttgctcggggaaatcaaaattgacaagagaagaaatacatatttataaatattttaaaatacttgaatttttctcgagtattatatttatatcagatactactcatcctatatgtttgttctgcag

SEQ ID NO: 37476 - DNA, 666 bp, Oryza sativa
gaagaactaccccagtgattgaggctttggtagtcctctccgtgggccggctcccgcctagcccaccccttgacgaagggggcgtgcggtggcttcgtgattgagcggtggagttgggctcgcctcaatggggattaggaaaccggcgtgtcggtgacatgggaccgggagtatcatgacttagagacttgaggcagacacgatcacccacgtggcctaaccccctcggggggggggggggtcgggcccgagggtgatacggccgcccttctctttgtctccccgaggggtcggaccgctcccgtttcggccccgagggctggggtgccccgaccccttgtggattttgcgccgcgtgtatgggttaggtgagcgcagcggtgctcacctaaccgcatttattgcggtttggacgagcgcgtcacgccgcatgtaacgcagtgcagcgcgctcgttcatccggtctgtgattagtcacagaccggtcaaatcgtgggttaggtggcgacaggcggtctgacgcacgcctcgccccatcccgtcaggacgagagcctccaagcactcgtccctagccggagccggcgtgttagctcctggagatggcacgttggttccggttagatatacgctaggcttcatcctaaccattacaggcaagatattg

SEQ ID NO: 37477 - DNA, 200 bp, Oryza sativa
caacatgtttctctgccagcacattttgttaggtttaatttgagaggattctatggtggataaaatatcatcctgttacccatgctattacattatctacttgaacgactcaccaggtctaaccatgttccggatttgtagttccttacagccttagtgtgctagatactaatgatacatgattgtttcttgagtgcaga

SEQ ID NO: 37478 - DNA, 1501 bp, Oryza sativa
tcagatccagtagcgcgcacagtccacaacagcacacatgaaaagcggcagctcgagttatcactatcaactttcggcgctgcctgtttacataaagtgaatcacgcccacgcgtgatcgtcttgtcacatctaatgaataatgtatctcattgagttcacatatattgcagtgaaaacgacgctatataattgacaatctgaaggcaacctcttcatatcttctttcccactagcacacaacacacgaaaatggaagcctattcattggtaatacgtaatctagatttgagattatgtagaacattcttcactacaattttacattttggcagcaaaccaaatatgatcaaatgcaattttaccttaccaaatatttggtcgtgaagaaaaatttggcactaacaatccaaatatgccctaaaaattaataaaatatttgtacggtaacaaaatatttgtacggtaacaatccaaatatgccctaaataataataaaattgtattttaccagtcttggagattttaatcttgtatagttttcaatataaaaagatttgataactattgatatttatacaaaaatatagagcacagtacaaaatcgcccttgcggagggcggcaagggggccgcctgcaaaattccatgccccctcgccgcccatttgcaggcggccctccgcacagtacaaaatcgccctcgcggagggcggcaagggggccgcctgcaaaattccatgccccccctcgccgcccatttgcaggcggccccccgcacagtacaaaatcgccatcgcggagggcggcaagggggccgcctgcaaatttcgttgacggccgtcgcccgagagcgaacggccgtctgccacgtcattttcgccgccctctgggagggcgatttttaaaaatcgccttcccagagggcggtaggcgactacttccgtcaattttcaaaatggaaaattatttttgtaaaacttttaataaaaaaaattaaaaataaaaaaaattcgaggggagaaagggggaatattcagtgcaaggtcggcagcttggcataattcactggcatgtcatgtcacattatcacggcaccggccggcccaatgcatagcccagatatccatctgaaccaataggcccaaaagactaaccagctctcagtctcagcctccggcctgcaacaaagtggagcgccttgccgccatttcgccgagcgccttcccggcgagcccgcgctccacggggagagtccgccgcagcgccagcgcattcggcgacaccacgccgcttggcaacacacaacgattccggactaggtacccaccgccgcgagccccccgagcggccgaacgcgcagctgctccgtgtcgaagcggaggccgctggccgcgcgagtccgagcggcgagcgaagcggcggaatccatcgatggccgggttcgggcctcttcggttcgcgttccatttcgtgcaagcgaaggcaccacccgccctgacgc

SEQ ID NO: 37479 - DNA, 1501 bp, Oryza sativa
tagttaagtccttctcgcggtggatggacgaaatcaacattgatgtgtacctcggctttcacacagtgaagttcagggcaatggagcattggagcggctcctcgttgagtcgttcttcctcagtgccctcatggaatggaggggatcgccgttcaaatgctttttttttgccactctcaactcaaccaaagtttagcattatcagaatctaacaaggtactccctccgtattttaatgtatgacgccgttgactttttgaccaacgtttgaccattcgttttattcaaaatttttatgtaaatataaaaaaatttatgtcatacttaaagaacatttgatgatgcatcaagtcaccataaaataaataataattatataatttttttaaataaaacgaatggtcaaacgttggataaaaagtcaacagcgtcatacattaaaatataaaatataaggtagtatcaaccaagcacaccattaacaacacatcctctaccaaaatttgttaatttcatatctcaaaactcagccaagatttagtaaggcctttggccaaacaccactctgcttggccctgtgttggaatttggatccccccccaccccacacacacacacaaaaaaaaaacaaagagagagagagaggagagaagaattttttttatttataattttttttattaaaagttttacaaaaataattttccattttgaaaattgacggaaggagtcgcctaccgcccttaaaaatcgccctctcagagggcagcgaaaatgacatggcagacggccgttcgctctcgggcgacggccgtcaacgaaatttgcaggcggcccccttgccgccctccgctagggcgattttatactgtgcggggggccgcctgcaaattggcggcgagggggggcatggaattttgcaggcggcccccttgccgccctccgctagggcgattttgtactgtgggggggccgcctgcaaatgggcggcgagggggcatggaattttgcaggcggcccccttgccgcctgggggagggcgatttttgcctctccccctataaagcccagtccctcctctgtaaaatttcattatattcactaaaaatccaaaaaaaacaaaagagagagaggggagggcagcagaaggggagcggcgaagccctgctggttcgctcaattcatcacaggtatgctcccatacatcttttgcatttgtactaatatgttatgtttgagtatatatgttgcgttttagttttagttccatatattttagcacatctgtagcacacagcacatatgtgtagatccatatcatagaatataatagtatgaattgagacatagacagtagtgttaattgtaagatgtagtttagtttgatctggagaatgtaacgtaattttagaaatttagagaacaatattgtagagaatgtaacttagggcgtagtacagaaatgcgaggttaacgcagttattgttttcatcaggcacaa

SEQ ID NO: 37480 - DNA, 1501 bp, Oryza sativa
aacatgaaatggagagagtacgtatatatgaagaattgaagagcatgtatagtgggtctagccaatagtaggaggggctcaagcccacctccccccccccccccctgttgggatcgccattggacctcgagtggtaaatcaaacaagatcactgatctagatgaacaatttacaaaataatgtaactaagtggcacctagatccaagtttataggccatcaacaaagtttactcttttctttatagaattggtatgtcctaatactgcttcagtggagttactggattgtttcgatcgcatagtacataaaattagactgtatactactactagatagatttatggagaataattttgtgacgtgataaagctgtttgatagaactttagtttcactagagtcggatccttgtccgttttgtagtcatctgctaactggcaaactgtgtgattttttaatgtctcaccaccgtctggagcacttgttactgtgaacctgtggtatactccccctgttaaaaaaatcaaacttattcctataatttattttttattaattattataaataaaaattcggtaacagaatgccatctgacctcatctatagcaagtcaataactatcctccgacctttgatcctaggaatccggcaaaggctacagacgggactgttctagttatacctagcagctgaacatgcccaatattgatatggacatgtggcatcattggtatccttctctttcccacctctgttgtgaaacacacacaaagcgcatgaaggtgtcaaaggagaagagagctggtagcaaaacttggtacaccaatgtttagaaagcacatgaaggcattggcgcaggtcgggaatagtgaagcacaacaatggctgggaggggaggaggatgtggtcggggtgatagggtcggaagctcgaagcaacgatggtggcaacagtgttctgcaggggaaaggaaaaatagaaaatgattggttttttcgagacgagagaatatttggccccggttggtagcttgacacaattgacgggtacaaccacattttcatgggccgccccaacaggatctagatttgttcttatccctctagcgattagtaatccaaaaagcccaacgggctaaagcaaatcccatcctccagcctacaaaaccgccttctcccttgacgtcatttcaaataatgtcttcatgctgatttgtattgctatgaaaatttataatcttatttggcattctaaataattttaaataaaaaaagtcatagactacaagttatcgatcttattgaactctacaactttaaaatagagtttatctccatcggaggactttgaaatgtagatataatattttgtaaaaatagatttaagattttgtaacgaatgtttgaaacccctaaatgatcttaaataaaaaaaattgtatgtctcgtcgagctctatagttttgatataagtttgatttcatccgatttcatattatg

SEQ ID NO: 37481 - DNA, 1501 bp, Oryza sativa
tcctccacgcccgatccacggccttcacggtgtcggagacacggttcttgccgatgaccgacatgacggtctcctgcccctgacacgttagtgtaatgattataacatgagatgaacaaatggtgaatttctcaatcattttcacacaagaggcaatggatgaaaatttgtttgattaacaaaaaaaaagtatttaaagacaatttgttataggacattgaaagattgtggttttttattgtggttttttttgttgtgagacacccgaagaacgcgtctctattcatggatacataaaaacatggtaattagttgtttgatacccgacgcattattttattattttacaaaagacaagtttgtccttgagaacaaccacagccaccacctcctcatcattgccacggccaccgccacagccatgctactccttctgctcctgctgactatcgtgctccacctttggagccaccgctgccgtcccactctcccgttattgccgccaccggaccgctagctccgcagacactcccatcatgcggtccgccgcggcacgggcaggttccgcccatctagtcttggccgcggcgccacctcgcaagtcaacctcgccatctttctctgacatgtcgctcaccgctgtgagattccttaaccgggctaggcggctcgccgtcatatgcgacgtggcatgcacgacgccgcgccgtacggctgaggcgatcgctttgatcgacactaagaacctcactgcacatctcgtgcacatctcagtaataattatcctatcctatgcatgaaatgagtcagaggcccacgatagctccaccgctagtgtctctaatatgttgtctcatggaaaattttaattttttttacaatcgatattttttatctcaaacaaatattaatgggcaagtattttaattgtttgcattttatactatttaacggtttcttttacccgtaacgaagcacgtgtattttgctagtaataataaaataaaatattacttgtctgtaaagttggtatgtgtatgtcaaaaatagtttgttttcagcgaaattcaatcttgtggttaccacaatatagagcacaatggcacttgactgtaattatctaaagtctcaagcacgtacactatgtacgaccagtaaaaatatctagacagtcgctccctcttttttcctctctcttcccgtctttctccgcctctctccgtcctcactttctctgtttattcctctccctcaacgttgccggccgatccaccacatcgtcgacggcctatccacaacatcgtcgccggccttctttttccctcgagttgccggccagatccacgatgccatcaccacggaggtcctcctagagggcgaagacgtggaggcggcggtggtattcggaggcgagcagcttgaggcggagagagtggtcggagacggggaggccgagcgagccacggatggattcgcatcgctcgccatctccttctctcca

SEQ ID NO: 37482 - DNA, 398 bp, Oryza sativa
cttggacacagaaaaccgcgtaattagccaataatctactcctactactaacttaataataatcaaacattttcactcgcctagtccaacgcattacaacgactaatcattcccctccttaaccataaataaataaataaataaataaacaaacgtacgctccctcctgtctttcttccaaccaaatcatttcgtgtcgcgtaatataaccctcccaaaaaaaaattaaattcaaacccccccaacctgccttcactcgaagcaaacctcacctcacctcgcgtggtatataaccaccactccaccaacgagtcagaaagagagagaacagaagagggcaagaattccacgaaaagatcaatcaaaaagccaaagcgaagcgagagaaggagagagag

SEQ ID NO: 37483 - DNA, 210 bp, Oryza sativa
ttacgcccaccccttggaaaacatcgtttgaaggtactggatgatgcaatgctcatttacaaattacaactgaccatttatccatttctgcattcaatgattatttcttgttctgtacaaagtcatttgcttaatggatggatctatgcatttaataaacatatttaaattgcctagatttgtttaggtttagtcattttgttttgtaga

SEQ ID NO: 37484 - DNA, 485 bp, Oryza sativa
tgttggtcaagggcataagtatatattaatgtgataggtcagttggaatgggaagtttacttggattgggtaaaagagtctcagtttagatctctagaggtgtttgcatcaaagttagttcgtactgtagaaaatttggatctaaacaaatctccttcttatcattacgttgagaagaattttgtgacatattattctcgtcgtggagggggtgcaagtaagactgagttggtacaagaagacttggagggggaaggagagaagaagagacctttgcttggaaatgatttatgggagacaggaccatcaaagagacattgcggtactgatgatgtggatgcagtgagggagatgaaaagggagttagtacaagagaggcttgatctaagtgaacatttgtcggcgagtgttcattggtcgtcgtatggaggcaaccctgaatacccgacagaagtagcaggccaatatgtgaatccagatgatta

SEQ ID NO: 37485 - DNA, 821 bp, Oryza sativa
cccaaataattaatttaaagaacttgtttggacgatttgaaacttaaaggaataaactgagtccaaagataaacttcagggaccatattagctattcaccctttttttttattttatgtacggtgctttgacaactatattaatatattaaattatttagttaagtaaagtgaaaagagcatcattggatctgccatcaatattgcattagtatatttgtagaaaagacaaataatcgattcaaataaatttaaaagttaaatgagtcatatattaaaatggagttcctaattaccaaagcctgacaattaagtggttaaccatgatgattgtgtgctcgcctgctcggcctttgagcaatttttgtcgtgagcgaggtcattgattggcccagaaaaaaataggcccaagttcagatggaacccaacagtagttgatgtgggcctcgtaggatggtccagtacttcagctggtttgggcctgtgtttgtgtagacttaattgggcctcttttcttttccctactttatcaattgggcctcttgactagcttctctcaaaatatcgtagatttgatttttgagcaagttaatttattgcagaaatcatcgctccaccaaagctgtagttagcttgcaaatgttgtttaaccgcgtatcagattatctcagaatcaagcagagaaggatactcgagcacatgaacatactcaggggcgaagctacatgcagctatgggggttcctaggcatccgagtaagagaaaagttttagctataattaccccatctccaccatatatgcacccccctcatcccaacaa

SEQ ID NO: 37486 - DNA, 378 bp, Oryza sativa
ccaaaatagaacgcataggcccattggaaatccgatccaaatggccccatcccaataaggccacaacgcatgagcttaattatccagcgaaaaggtacacgaaggtccctcacctttgtaatcagggtaaaaaacatcctcgaaccgcaaaaaccagatacgcgagttctctttaattatataaaacgggtcacccgacatccttcggtagttttgaacccggttttatccgacgtaacggctgagtcagcgtgggtcccacatgtcagctggccacgtcaacaccctcatctctcttgtcctctcttctctctcttcctcatctctctctcccttctctgtggccggcagcgcctaggcggcgggcgtcggcggtga

SEQ ID NO: 37487 - DNA, 280 bp, Oryza sativa
tataacccgtcaaaggtaatggtcactactgaccaattcgtttgcccgtcacaggtatcccgtcagaggtgtgaggatctggcgtagtgatacctaatagtagttgactaaatctcggcaggacccaccacataccatgtctatacggaaacaaccttcggatatggagggagttccggataaggaaagacaaccagagttctacatggaaacaacaaggactactcggattgtatctatattggtttccctagttctacttggacaaagggacacctat

SEQ ID NO: 37488 - DNA, 239 bp, Oryza sativa
ttattatcctcaacacttattatgggcctttgagatttaatattataagttgggcctagcccaattattctaacactcaagtcatcgggttcgcccaagtactatataacatgcatgaagctagcttagcatagatgtcaagtttctcaagaatttaacacgcctatacattctcctctcaaaaattagcatctgctacgacagccacctccaggcacggatgacgaagcatcatccaa

SEQ ID NO: 37489 - DNA, 200 bp, Oryza sativa
gagcaaaaacgagagctcaaagagacagtgccgtaagctaagaggaaccattccgatcatccaagacagaaagtactaatatccaaggtacaggtacaaacatgccccttttcaactcatacccgattactttctgtttggtaaaatgcacgcactgcttgactcatcgatctgatcaaccttgtaacctgctgtgcagg

SEQ ID NO: 37490 - DNA, 292 bp, Oryza sativa
cctagatgattgcctatttgttttcgtagttgagttaaaaattcggtgcttcatacatagtagctttatgttgctattcattaccataggtgttttgtgctgcatttcaccccatcagttggtgtactaacaccttacacttgagttatcttttgttgcttgctggtagttcagggttatgcatcttgtggttactggtacatcaggggcatccgttagatcttttgtttttcttcaacaaacttaactgttgtttatttgttcattttaatcttatttttttcattctagg

SEQ ID NO: 37491 - DNA, 181 bp, Oryza sativa
tagaatattaatttttggttgagtaggagaaaaaaccgtgtgaaagttctgaattacccatgggcccacatgctaggcttgccatctctctatccttctctctctcgtacatggaatccgcatataagcctctactatctttttccccatctacttcctctattcctctcactctcgcagg

SEQ ID NO: 37492 - DNA, 286 bp, Oryza sativa
tatccgggtattcacgaccctccatcggctaggccgtcggtcagtcgtatccatacctatgctattgtcgtcttgcggttacaaccaagataaaatctgactcttactctagtccaaacacctattacaactccaagtcctaaattgcaaccgactacgtacacatattcgacacaaaactctaacaaactacaccttggcgaatatgccacgtcaacctgaaattatcccttgcgcgaacatccgtgtaccttgacttgggagggatggggcggtggttagggga

SEQ ID NO: 37493 - DNA, 371 bp, Oryza sativa
taaatattggctagcctcaggatttgctagccatgccctctgaaaaatagaaacatcacagatatattccagtgacagatccatcacagatacattacccccccaatataacatcacagatccccaacaacacatatatgcagttcaaatgccataattttgcacagcaaattcacaccccttgaaagccacaatttcggtcgttgctcatagaaccgcatatatacttaccaaatggattaaagccataatgtcatcgacctgcacaacctgtcaataaggaaaaaaaaaggagaaaacagatgaatagtacaacataaatcgtagttgatcaaatgtgatgacaatttagtaaagtaccataaatattg

SEQ ID NO: 37494 - DNA, 167 bp, Oryza sativa
ccccctcggggggactaagaggagggcgaacacatcaccctcgggcccgacgtccctcgggggtaccaggccacgtgtgcgattgtgtctgcctcaaacctctagtcatgatactcctgatcccatgtaaccgacaaagggtaattcagcgggtcttaaacacagga

SEQ ID NO: 37495 - DNA, 158 bp, Oryza sativa
tcctaggaacaataatggtcggggtgtagctcgtggaggagcacgtggtggctttggtggctacaatgggagccgtggtggctatggaggctatgtacgagaccgaggtggccaaagaggtgaacgtggaggccgtggtggaagccgaggtataggcc

SEQ ID NO: 37496 - DNA, 328 bp, Oryza sativa
ctgggactggtatcgattaacaggttaatttggagcgtcacgggctagttccggtcgggactagttcggggcgtgacaccaccccgccgcgcgcgccctcctccttgtgggccggcccaagccgccctccctctctccccgggacgccgacaggtgggccccacctgttgggcccgtctccttcctccagtcggcgccggcgcgcccgcaaccgccgccgcgtccacgcctccgcctcctccgggccacgtcagccacgcccgcgcgtgcgcctcatcaaccgcacccacttctcctctctctctcccgcccgcgcccgcgcccgaga

SEQ ID NO: 37497 - DNA, 334 bp, Oryza sativa
cacctaaccacatttattgcggttgggctgagcgtgtcacgccgtatgtaacgcagtgcagtgcactcgtttatccggtctgtgaccagtctcagaccggtcagatcgcgggttaggtggcgacaggcgatttgacgcacgcctcgccccatcccgtcaggacgagggcttctaggcgctcgtccccagctggagctagcgtgttacctcccagagatggcacgttagtcctggtcagatatatgccaggcttcatcctaaccattacaggcaagatgttgtgtgaagaagggcgagcatgtagattgctaagctgacacgtggtggacaagaa

SEQ ID NO: 37498 - DNA, 294 bp, Oryza sativa
ctaaccatctactattagtagtaataatttactactgctcggggtggactaacccctgaatgatggggacggtttttctaggattatgttctagggaccagtactgacttgtcggatgcgggttctatagctggaaactacaaagggatctgttgtaatcgtgccttctgttgtttattatatttgtagttacctaaaatgcacttaaccagttcttcattgagctatagtacagcacatcgtggtcctgaattgtagaagtggtacgtggcatgctatttgtcgcaccctagc

SEQ ID NO: 37499 - DNA, 405 bp, Oryza sativa
atctttaccactggttggcaccatctgttgtcccagttatacaaccggaacggtgaattcggaataaatatcgctatctttagtcccggttcaatcgatctttagtcccggttggtgtgatgtggtcccggctagagggttttttccttcttttttttcttctctctctttttcactgttcttttgctatttgcccaaatcatctcagatcaaacattcatcattcacggtaatatagttcatcccaaatcattcacaacaacacatattgaatcacacggtaaggacaaaagaaaaaaaaatccaaaagcagcgccggcctccaccgcctaccgctgcactagccttcgcaccggccgcctcccccttcggatccggcggtggccggctgcctcccctcccaga

SEQ ID NO: 37500 - DNA, 504 bp, Oryza sativa
tccagggtttatttactagtagtagtagtcagcagcgcaagttcgattagttggcggagtggtgattgacgatttattaggttatttttgcttgtttctggctttctgcagttcggacgacttaccttgtgattactgattagcaagtgtgttagtatcagtatgttgggtggtgtctcttgtgaggaagtgagtttaaccagagtattcttaagatgaccaagctcaccaaacatacccagtgttttgtattatattgtctatgcttgcatttttgtttacttgattcaaatgccactctgtgcgtgtgacctaagcaaaacaatgtttactgcctatgttcaatttcatgcatcctcacatcactaaagtgaacttaggggcttccagatctagcagagtgcatcattttatttagtgaatgtgtttgtggacagcacgtgttttttcattatcattattttgtgtccttgtatgctgatggtgtttctctgatgcggcaga

SEQ ID NO: 37501 - DNA, 280 bp, Oryza sativa
aagtgaacttattccttaagctttttaatggacctctgttaagacccacaagtttatgtgggcctggtaattatctggcggcccatccagaattccagacaaggctagtcaactcggcaagggtttcctcgccgttgccgtcgccgtcgccgtcgccgctgccgcttccgcttgcgtgccctcgtcgccgtcgaatcgctcgcccgtcggtcgggtccggtgacctcgctgcctccgagatcctcctctcctcgcctgcgcgctcttcccgtcggctaga

SEQ ID NO: 37502 - DNA, 1501 bp, Oryza sativa
tttcgatcttgtgatcctatcccaagcctttcaagttggtttccttaattctttattaaccggccaaccaaaaatggcgtgttacccacgttaaatcatcacatacagagtccgggagtttgaatacccccatcacgtatactgggatggcctgtatgactgcttttatcaacacctccttgcccccactggaggggaaactgtcgccccattgtaacaaccttttccagattctatcttgcagggactgaaacttgcctttacacactctgccctccggggtcgggaagcctaaatatttgtcctcaaaactattgtttgcaacctgaagagaggcctttatcgcctcctggacatccgttggagtggcctctccaaacataatggaacatttagaaagggttgataagctgtcctgtacttgattcatagctgctcaacacctctttaataacatccgcttcttccgtttttgccttaataaacagcaaggtatcatcagcaaatagtaagtgtgatatgcctggggcacggcgacacacatgcacgggggaaattgcacccttcatcactttctccttcagtaacagagataagccgtctgcaacaaacaagaacaggaacggagacagtggatcgccctgacggagtccacgagagggagcaaatgtttcgagcaaggttcaattgaatttgattgcatatctcaccgtggttatacactccataatccaatgagtccaccgataagcgaaacccagtctatacattgactgctccaagaacttccagtcaactcgatcataagccttcgacaaatccaatttataagcacatgcagctttctcctgccttctatttttctggatgaagtgaaaacattcaaaggcagacatgtgcgtatataggaccatattgggccatcaaaaattaagtagcgatttctaatcattatattttttaaataaataaattccatttaaggtataacaatttggtaggtgaatatactctaataggaacacctaaaggggcgtccctgtcatttccttatcttaccgactctggcagtattcatgggcctacttgggccgtggcccttaattaagccagtgcgtctattagaaccaaacttcaaatgacctacccggattttgcgaccttcaccgacatgactttgttgccgctatggctttgccatttacacgagccaatacgttcgtggttttgacatgtgtatagcttcggcgttttgtgactccttgctgcgtttgaggcgcttctcttttagtggtcctttgccacctcacagctcttcaccacttctatagttctgtggcttcaccatccttcaactgtcctaatggaaggcctaatactctgtctccaaatatcacataccaaattagcttatgacaattttatacgtattaccgcaagaatccgcgggtagcccggtttgcagggctggacccaagcctcgagtcacctgggccatgcc

SEQ ID NO: 37503 - DNA, 1501 bp, Oryza sativa
ccgccagcgtcgctggccgccttccaaatgctcaccaccatcgtgctgatcccgctgtacgaccgcgtgttcgtgcccgccgccaggaagcacaccgggagggagaagggcatctccgaccttctcaggatcggcggcggcctcgccacggtcggcctcgccatggccgccgcggcgacggtcgagacgaagcgcgccagcgcggcgcggacgacggcgagcatactgtggcaggcgccgcagttcgtgctggtgggcgccggcgagctgctcgccaccatcgggcagctggacttcttctacagccaggcgccgcccgccatgaagacggtgtgcacggcgctcgggctcctcgccgtcgcggcgggcgactacctgagctccgtcatcgtgacggccgtgtcgtgggcgacggcgagcggcggccggccggggtggatccccgatgatctcaacgaggggcaccttgatcgcttcttctggatgatggccggcctcggttgcctcgatcttctggcgtttacgtgttgtgccaagaggtacaacaaatcaaggaaggcttgttgatatttcagggcttgttttcgggaggcacaaatcctggccgatgcacattgatgggccgaagaacttgatgctaactggcccaagacccggatcagccaacagagagttaggctttgcatggtaatcacatggtggaaaaaaaatccgctccctccgttttacaatgtaaattattctagcatttttcacatttatattgatattaataaatctagacatttatatctatctagattcattaatatcaatatgtatgtgagaaatacttatattgggaaacggaggaaatacattttaatggacccgcaatattaagcctcggggcatggcccaggtgactcgaggcttgggtccagccctgcaaaccgggctacccgcggattcttgcggtaatacgtataaaattgtcataagctaatttggtatgtgatatttggagacagagtattaggccttccattaggacagttgaaggatggtgaagccacagaactatagaagtggtgaagagctgtgaggtggcaaaggaccactaaaagagaagcgcctcaaacgcagcaaggagtcacaaaacgccgaagctatacacatgtcaaaaccacgaacgtattggctcgtgtaaatggcaaagccatagcggcaacaaagtcatgtcggtgaaggtcgcaaaatccgggtaggtcatttgaagtttggttctaatagacgcactggcttaattaagggccacggcccaagtaggcccatgaatactgccagagtcggtaagataaggaaatgacagggacgcccctttaggtgttcctattagagtatattcacctaccaaattgttataccttaaatggaatttatttatttaaaaaatataatgattagaaatcgctacttaatttttgatggcccaatatggtcctatatacgcacatgtctg

SEQ ID NO: 37504 - DNA, 169 bp, Oryza sativa
atgcctcatgccacggagtaattttttagtttgatcccaaaaaacaactaaatgtattaataaagaggtgaacattttctgttgtgaaactgaatagcagctaaatgtttttggcagcagggcgactgattgaggagtggcgctggagtggatcatgtgtacctttaga

SEQ ID NO: 37505 - DNA, 232 bp, Oryza sativa
catcacattaaaccttttctacacacataaacttccaacttttccatcacatcattccaatttcaaccaaacttccaattttggcgtgaactaaacacagccttaagcattctggcacctaatatctttgcaacctgtaatcaacttcttaatattaatgagtattaaagacttgtgagacgagaagcagcagatatgcaacaataatttgacatattgcagaactgcagga

SEQ ID NO: 37506 - DNA, 453 bp, Oryza sativa
ctgttgctcatggaaaggtttattgacttaacatttcaaatgtgtttagtatgctatttgactattatttattgtagacaattttaatttgtatacccttgattgtgttaaagccaaagtccaacatgtgattttctaccaatgaaactctcttatcattgttaggatatccttgcatggctgattagtgttcaaactaatttaccagaaaactctatatgggccttgtcgatgaccttgttcttcgatagttcgttttgattttgattgtcaatgactatttattttctgtaaagcttacaaccttcaatttcagtcaagtctatatcttaagttgctagttattatatatggaataatgttaggttaacaatcaagatttatgttctatttgcatagtcgaatggtgcttttgtcataatcaaatttcttgccaattctttttcccgcaga

SEQ ID NO: 37507 - DNA, 280 bp, Oryza sativa
ggccgacggcggcagacggtgcggtcgacccgccgtctgccacgtcagcttgccgccccatagtgggcggcagggtctatttttataatttttttggccgatagattatttctgtaaatattttttaaaaaaatctaaaaatgaaaaaaaatctagaattttaggtccgatacaaactgacgaatttgcagtcccggcccggcccagcccagcccgctcttcgtttcctctctagtgactttaacagttgacacagggagcggaggggcagcttggtcat

SEQ ID NO: 37508 - DNA, 696 bp, Oryza sativa
attcctgcagccctacctttctctataaagaaaagaaaaacggcgccgatggtacgtgcgcgcctgcgcgagttacccatcaagcgctagcgcgcgctaaataggaatccccagttgggcatacaccggaaattaaaagtggagagctggcggttccgtggtttgactttggagaaaccacgaaggaggcctctccatggcgactccatctgacgccgcgacgatcatatggagcacggagctcgagctagctccactgatagcaatggtgaggaaccgggattatttcgccggcgctcgattccacgtcctccgtggcgcgtgcgagcacctggcgcacgtcagggactgcgtgcgcacgagggcccgcgtggcggcgcggcggggcaggaggctggcgacggcggcagcctggacagaggaggcggagatctacctcctccggttcggcgagctgcggagcgcgcacggccggatccccaggctcatcttctgggatctgctcggctgctaccgcgtcagcaaggtcgcgtcgctgatgatgccgcaggtgaagaggctgtgcgaagaagggggaaggatcgtgcgcaggagcaagctgccccaaccgatggagatctccacggggttcgcgagcagggatcgtaccctccgggccgcgatcgagagggtgaggacgatccaacccaacggcat

SEQ ID NO: 37509 - DNA, 607 bp, Oryza sativa
tagatttctggagagggaactggctaccgactaggaggagaaacatgcacatcgcaatcaaccaaagagaaggaaacatcatataaccatgcacgagaaggaagcatatataagcatgcactagctccacactccactacaatccacaatccctataatctattctcttccattctcaatacgttcacccatatgtcgatgttttgcatgttccttggcaacaattttatggtcaccacatttgcaaagtaattatgaaaaatattggaaaaagaaatatcatcattgccaaaaactattttagaattgtttgttggttacttagtaaaaaagccaactaattagataataagttgactcaaatttgcgcatgtatttttatgcacactatggaccaattggtccataaaatagtctgtcagcactaataaaagtgcaatatatgttgcaatgagcatttctatataaggtacatacatcgcaccgaaagagagcatgcagatttatattcgagtggtagaagtcaacaatggtcactgactggttgcttgaagaataatttgtatgccaagcgagaacagttgtttgggtattaaggatttagcca

SEQ ID NO: 37510 - DNA, 386 bp, Oryza sativa
tgctagtttcattcattgataaacaaaagagaaagcttgtagatatacttggtaacttctccatatatttgtttattttaatggattttttttgacctggctttcagaggggctaaaaaagtaatttcttactctatactcatattttatttacctggaagttgtagctattttggctcttttgaactgttaatgttcatgctgtctaccgatttttatctgaatgatgtgttttgctcaagtgcatacgctctgctattgaaccagctgtttctggatctataatttgtggatttttggatgactttataatttgcaatgcaagagttgggttgtatttttcccgctactttaaattcataatagatattgattcaactttcagg

SEQ ID NO: 37511 - DNA, 189 bp, Oryza sativa
ttcctgcagcccacgactgctcgcgcaccgcgagagggaaccatgcaatcaagcctacaacgatggtggatttggcatccttgcatgacgctcgtaccgagggtgacggcacggggaagacctgacatgcggggcctcctatggctgatccaccctagagacactgggtaaaccatgaggaggccacta

SEQ ID NO: 37512 - DNA, 363 bp, Oryza sativa
gatgataacatgtaaggatgtgcatctcatcaatcattttaaggaacaataaatgtgcagtaatagaaaaatacaatttattagtttcttaattagaaatataattgcatttgtagatattaaaataaatgtatatctcaatatttgaaaatatgattgatctaaggaaaatactcgggaattaaatttttaaatatatatatatatatatatatattatcttgtgggaatatatgaaattcaaataaaaatatatttgtgttgtcaatttacatgatgacaccatttcatcacgcgacactgtgtgatgtagcttatttaaatgtggacattgccttgggctatgagccactgcaccaagca

SEQ ID NO: 37513 - DNA, 374 bp, Oryza sativa
ccagcccccagccctcattccaccccccacaaatccagtaaaaaaaaaagaagaaaggggaggagaagagaagaaggggcgaagccctgccggatttagacgccgattacaggtaatattcatagatcctatatgtgtttattgagttaaatactgtgtattttttaaaaactttgtttgaataaatgcattatatttttagggttttagttgtactaatctagaagtgcgtattgtagatatcggtaactacgtagatctgctagtttggaatcaatactttaccgttgcattggcatacacaagaagatattacgttgtagatgtttattgcatgaaagagtaatatgatctagttatttcattgacagata

SEQ ID NO: 37514 - DNA, 1501 bp, Oryza sativa
ctttttgttttcactgaattaatcacatcaaggttttcctttgctgtgtacagagcaaactcttatgtatggccagcatatttctacaatccgcatggtgttcttattagttttggaataactcgatttcatatttttgctgttaaatgtttacgttcatctctgaagtacatatttcatagtattgccatttgagtgatcttttgcagtatagttaatcttcctgtctatttcaaattttttggataaaaatttatcaatttctgatatcatcttgatctaattattattaatttatccattggcaaaaaaaaaaaaccattgttactgctgaacatctttagttacttaattggaattggaacaacatattttcctgcatcgtgttctaaacctctagttcattttagaatgtaacattagtaatcaaactagtttaagttaaatttcctgctcttttttttgcggggaaatttcctgctcttatgatgttcttatgaattagttaatagttcactttcgaggcaagaaattggtatcctctgtatttgcattagtataattggtatttcaccttttctttttgttattttcagacactatcatcatccaaagcagctgatgtggctgattatgcagttggagttcttagaggcaacttggtaagcaacatgagaatagattgtaaggttaacagttaatgttcactaattgcactgagtagcctatgcctctatggaggtctagcatgctacataaggtaaagcaatgaacaccattccaaaccataaacctgaacttggtggctttgatggttgactactctttttaatgtagtagtgtaattattggagtggtggttagtgctttggcttgtgtataagttgctacctcccaatccaaaagaaacaaaccattcataagcaagcccttgtattgtgattaccggttgcttgtcgcacattgatcaggcactctactcatgccagtaagaatatctatactccttacaaaagggaatagtggtggtggtgctgcctccctaccaccaactcccagccttttattttgtagagaaaaggacatgtgggctagagggcccacatgtcaatcactgacaccactttttacttttttgtggaaaggaaaaaaaggatagtgtggggccaaagggtccacatgtcagtaacaaatatatacatcaatcaagagatgataataacatgttaatgataataattctttaattaattaaaatcccgttgcaacgcatgggcaatatgctagtgttcaagtaaatattcagtgaaaacaagaaactgatgtatatgccagtgaaatatggtggtagttgtttgtcacactctataaccaaaacaactccaatccaaactagagataatgagtttggttttccttgaatgtgttcttgtccttggtatgtgataaatgtaattcagggcttgctccaataaatcttttttatctggtgaaaggcctt

SEQ ID NO: 37515 - DNA, 980 bp, Oryza sativa
taactattagcttaaataaacttaaaaagtagaatgaatactgttttttaaagtaattttcctatatatctttttataaaaaaatcacttatcagctcggaaagacctaatacagagtttatgtaggccggccaggaactctttgttgcctggcatcgaattcgttcggttcgtgggactaataaatattttatctgttttatatcatataagtcatttgattttttttccgagtttgatcaaatctctacttattataaaaattaaagatatttttaccaatattttgatacgtcatccgtgtttgagtcggtttttaaggatattcgtttttgaaaatacatatttgtgtttgagttggattttaagctcatttgcttttgtaaacacaaaagaattcatataagaaatctcttttaacaaactccgcatgctaacttgaatgaatgtcggactcgctaattttccaaaagaaaaatccaagcaaattcccacaataaatttaccataactaaaccatataacaataataatattaaaatagcattcacctgttgcaacgcaacatttttctagtttatataaaaatttagcaacatctaaaatattaaattaattttattaaacctagcattgaatatattttaataatatatttatgttgtgttgaaaatactactcccttcatcccaaaatataagaacgtatgattgaatacgacatttctagtacaaattagataggcaggttatccaaattcatagtgctaagttaatgttacatctagtactaagtccttatattttaagacaagagtataatatttttccgtaagcccattattttctaaaaaaaagaaaagtaacacctagtttactagtattaacgaaaagatggaattacaggtttatagaatcatgcagttttaatgtgtcaccctacggcagatttgggagatgaatgcaacaagatatcaaaag

SEQ ID NO: 37516 - DNA, 791 bp, Oryza sativa
ctacaaatttatcctttctggcattccatggattctgtttttactcttcacacgtatgatgcatcgtgtatcaggttgtaaagcaaggtgattgattgttttcttctcttgttttattctgtcacaagcggcatcttaaatatctgactaactatataaatttgccaaacaaacccaagcttttttttttagtttggtaaggatttgaatattgttacatctttgggttgatatgatcttaatcttccattgtgcttataaatctgaatggatttaggccagttcatggtttcaaatagattttcatgttattatctgaataaaatgttttgtgtattagtcctaaatcgtaattccaaaccctaaggataatcagctcatcagtgaatcggctaattagtttagcacttggaagttagaacttaatcaaataacatggaattccagcatgatataccttgatacctccatctatgctcaagaagacaggcactaaatttccattaatttctttcaatggctggcaacatattaattgatggacatgtcatgcttgtttcctgatgttactatgtttgaaaatcatggttttcttaacagtgagcaaattaaacaagccttacttttcttaacttgcctgaatcagtcaataagccaaggaaaatcaccattggtttttgaactttgttttagcaacattgaataaaaacccatgccttttcaagatgttgtggtccacatgagtacaatctgatctttaagatgattttcgatggtttatcatgagataa

SEQ ID NO: 37517 - DNA, 308 bp, Oryza sativa
ccatgcatggtgtctttgcaatcagtcaatcgtgggatcacattattcatcaaattgctggttcttatttgttacgtttagttcttgtttgttatgcatgaatttggtcggagaaaggatgcgatttataggacaccattccataatgaacaatgaggcaatctgcaaaatggtcatctagaatctatgtgaaactcagtttcagttttagaccttctcaagtattataagttacagatttgcagcattttcctttgatcagcagtagaagtttcatttacatgttctttactctcttgcttcttttc

SEQ ID NO: 37518 - DNA, 271 bp, Oryza sativa
tgtgccctttgagttcttcctgctgtacatgtcccttttgttgaggaatttctatgtaatctgttgtatggtgaattggcttagcagatcaattattgctaacaatagacaattttatgtaacctgggagtttcttgtggccaatagtctcaccatatgatgatgatatcatgtgcctgttcatactcctcctgctgattaaatctgggcattattttgtgcaaatgtttgatgatatccctggcatttacaaactacaaagaatgtacaa

SEQ ID NO: 37519 - DNA, 1501 bp, Oryza sativa
tgcaggttatatctaaagtaacataccgggtatgactttagtctttggtacttaagaagataaggcaatcgaggtgaagaagtataagggagaagagagttccagagttcctttttctaagtatggttggaattatagaaggaggctagaagtttaatcctttgttctcttttgttagtcggataaactcttattttaagttgtggtttctcttataagggataagtactcgtgtatgaacttttgaccatatatatccatttagtagttgtgttaattcttttttaatttttatggtgtttggatgcctttctttcctgtattagcctccttcaggtcagtgtcacgcgttaagtttggctatggtattaccctactatgacttataagcatggtatggttattaagttcacaatgaaatatgagtccgaattgtaatagttgataacatggttgtttaattttccttgagcatacttttaaattatgatgccatttaatttccttgaactagtaccactgtttttagtgagttttgtttaattgatcatgatttactttgtgccagtttgtgcctaccgttaccaacagggagcttcaggagcataacaatttggaatcccaacaaccaatccatgctgctgtagaacataatgtttgtttttccaatatggaagacatgcatgatccatcagcgcaatgcaatagatagtatgtaggtaatttagttcttaggggcgatatcaatggtaaaggctcgtagcatagattatttaattttctttttctttatgatgtgccttttttgattgatacggtcttgtttgaatatggagtgagtaacaatttttaagtttttgtgagaagcttcttaaaacatatatcgtcacatttggttgtttgttttacattactaaatagcgtagtagcattagtacgagcatatcactagtgataatggtttttttaatatggcatccctgtaaaaaaaatacaataagaccatatatgtaatagctactgtcggtgacatgggaccgggagtatcatgacttagagacttgaggcagacacgatcacccacgtggcctaaccccctcgggggggtcgggcccgagggtgatatggccgcccttctctttgtctccccgaggggtcggaccgctaccgcctcggccccgagggccgaggcgccccgaccccttgtgggttttgcgccgcgtatatggggtaggtgagcatagcggggctcacctaaccacatttattgcggtttggacgagcgcgtcacgccgcatgtaacgcagtgcagcgcgctcgtttatccggtctgtgaccggtcacagaccggtcagatcgtgggttaggtggcgacaggcggtctgacgcacgcctcgccccatcccgtcaggacgagagcctccaagcactcgtccctagccggaaccggcgtgttagctcctggagatggcacgttggttccggtcagatatatgccagg

SEQ ID NO: 37520 - DNA, 523 bp, Oryza sativa
agacttgtatggttgcagtccgaatgaccttctgacggggccgcccatacctacctccacttcccccgaaagcaggcgcaacgtgggaacatggctgtctgctgacgacatgaccagtgtcagtccggtcacaaatcggtcattcttgtccgccccgcgtcagtttatcaatctgcatgttcgcccttcttcatacaatatcttgcctgtaatggttaggatgaagcctggcatatatctgaccggaaccaacgtgccatctccaggagctaacacgccggttccggctagggacgagtgcttggaggctctcgtcctgacgggatggggcgaggcgtgcgtcagaccgcctgtcgccacctaacccacgatctgaccggtctgtgaccggtcacagaccggataaacgagcgcgctgcactgcgttacatgcggcgtgacgcgctcgtccaaaccgcaataaatgtggttaggtgagccccgctatgctcacctaccccatatacgcggcgcaaaacccaca

SEQ ID NO: 37521 - DNA, 1501 bp, Oryza sativa
tttgaagaaataaaatggtttgccatgtttactcaccaataatgttagaagaacacccattaattgcactactcaaatgtttcgtcaagcatgcatgcgtcttattgattttcattgcctttggagatttcacctttaagcatcatgatggttactctgtgcgtaatcatatttttatcttttcttccttttaccatttggttaattagagcatatgttttcgatctttgtgcttgaattattatatttatttacgatcggccaagccagtccatccgggcataaccgttgccaccgttgcctgatgaatgtttcgtcgagcatgcatgcgtcttattgatatttcattgcctttggagatttcacctttaagcatcatgatggttactatgtgcgtacgtaatcatatttttatcttttcttccttttaccatttggttaattagagcatatgttttcaatctttgtgcttgaattattatatttatttatgatcggccaagctagtccatccggccataaccgttgcctgatatgcgcgctctctctctccactgtaagaaagaaggctataaagctctagaataatgtttcactatttttttactaatccaatccaacggctacttccaccctccttttctttatctgatggtctagaattttttgcttatgtggatcaataaggtgacgttttgagattctcttttcacttagaaagatttgtatgtaatatgctgttagtagctagaaaactgatatgatgtgaaagccccttgaaatatggtctataccaaacatgctacatttttataactaaatatacttaaaatattactgttaccagtcaaaatctacaaagtttgaatttttgaaaagcatgcattctgtataaaaggagggagtacaattgatcgagctggctaaatctgcaccctactgtttcataacaaattaaatcctctatcatgtgtctgccgcatcttcatatctagaaaggtatgctaggtatgctattaactatatatggaggtaattgtggtttcagtagaagaagataaatgaaacatattcgttcatgtgtaacgatttccagatcaagggaataaattggagtggtcacctatcatggtgccctcctctttccaatgtaaggacacaagtttagcagttgccaacttttagactgattagcactttttgatgctactttaatgcttgacttggaaatgatacattctggataatagcggaaatatatactcccttcgtcccaaattataggacgccctctttctaagaaaaaataaacttgataacttttgactaataatcatactaaccatatatatgctaaatattatgcatgttatatcactatattcatattttaaagtactttcatacaatgctaatttcatatatgttggaaacataacatgagataaattagtggttaaagtatatcattgaataccgtgtaaaaaaatataggccttat

SEQ ID NO: 37522 - DNA, 1501 bp, Oryza sativa
gttgtgacctgcaaccctatgctgccgttgcagattgacaggagtgctagagtcttgtggaagtagtggattagagttccttttgcttttggagttaaccatttgcagtgcaatcctcaacacatagtctgcctgagaaattggaagaaaaaccaagatttgtcaaagttgcttggtatgttatgctaagcttaaccttgaagtgaagctaacgtgacacaaaaaacaccaaaaacaagagtctctgtatgtgtttataataatggaagtatgttttgggttttgcatgcaccaactatgagcacataattatttaaccgtgggtagcaagatctaaattttgttcgtagagtcatacacctaagattccaccggactcctgatttctactctattcctattctaccagctagatactactaaactaaacttgagaggggagccactccacacaaatacaaaaaagaaaagcagcccaccctcaacaacacatctccgtgcaggggagggtctattgtgtaagcacgtgaaaagaagtatggtaacattgtaacggtagttttcatatatgtacaacataaaatagtttaactgacacattttgctctatagaaagagaaataggaacttgccattgatctggcaagaagaattaatcacccaaatttgagccgcgcaaagacgacccataattgggtgctggggatttaaacctacacctccaatcctattaatatcctagcaaccaaaccatagcctagttggtacatattttactacggaatcaaacgtgttttgaagtctgaacattatttgcatagttccaatccatagatgttctaggcatatattaccaacatttttcatagacctcatgaatcatactccctccatcctaaattataagtgtcagggttatggataccacatacctaatagtagttgactaaatctcggcaggatccaccacataccatgtcctatacggaagcaaccttcggatataggaggagttccggaaaaggaaagacaaccagagttctacatggaaacgacaaggactacccggattgtatccatattagtttccttagttctacttagacaatgggacacctatgggtataaatacaagccccctaggaggacagggggacacccaccacgggacaatcaacacccaacacaatcaacatagaagcctacatacgccaagacacgccgccggatatcgactttagggataagcacgactagtaccctacggtgtctccggatactgtcaggagagacgaaagcgctatctctgatctcgctgggcacggattcgaggtggaaggctaccctgttgtcgactacgagtcagatcgtcagaccgccatgtcgacaacagttagataggctaccccaaatattgtactggtgtgattatcatgaataagagcaataccggcttcggccaacaggatgtagggttattacctgacagttcaggagcccg

SEQ ID NO: 37523 - DNA, 1501 bp, Oryza sativa
tttatttttattataataaaattgagaaaatatgtcctcaaattcttcctaataatgtgtgtgtgtatatatatatatgtatatatatatatatatatatatgtatatatattcatatatatatacatatatatacatatacatatatatatatatatacacacacacataacattaattcatattatttagttataagtaccaagcatggtaaggaaaaaatgtaaaaagatgaaacaagaaaatggtactgtgggttcgaacctttatcctttgaccttagattaaatcacctccaccactgagctaccgtaccatgaagctgtgaatgggagattcgtctttttagccagtacagaggtcagcgccaattggcgctgacatatgatgatgtggctagtttgtgccacctcagatgagaggttagcgccaaaattaatggcgctgagatgttggacctcagcgccattgggtgacggctcacttttaaaataagtttttggcacggactatttttagaataagtttttgtaaacggtcaaattgtcaaaattacggtatctaccaactgatggatgacaaacaacccgcaaaaattatagattgtacattatattgtagtacatatgcaaaccagcttggtcacaccgatatcttggattcatctccacatgtatagagctcacatcaatatgttttactctttgtagatctatccttgtgcacagcatcaatactaacggcaattagtttctctccctaattaactttcttttacagttttacctttgatgtacagtatctagcaacgcaaatctgatgatactagaagggtgctttacgtacacatcgcacatcaccttaggtccttaaactcccccatcatgtctttacctaaacttaattgctcttgatccgctgcaattcattattatctctcaaaaattcctcaagtcaaaacaaataaacaaaccataatctccactaaggctacatctcaaatttaggttgaaataataagaggtagacacttgatcatttgcacagatgtcagttgacttcaaatttaccatacactacatattatgagggcctgtttggggaaagcttttggcagatgcagtttctagcagaatcaaaaaaacttcccccaaatattctagcttttagattctgagaagctacttttcccagtttctccatattctcacgagctgaatttctaccaggtgttcctcaaacagacccttagtaagtgacgtagaagaaaagagaatgctaatttagctaagtttattaataaaatattaatatatggtcttttatatacaaatgtacaccctttacttctagagcaacaacatatagtttggaggagagagactactatagcacaccgatttcaaagtagtacataaaggctgtgtttagttggatccaaagtttggattttggttgaaattagagatgatgtgactgaaaaattgtgtatgtatgacag

SEQ ID NO: 37524 - DNA, 486 bp, Oryza sativa
tcatgcctacctagtaacattcagtatttcagtaataccaatataagcagtctattgttattagttattgtggtatttgtatagaaactacagttaacagtgggttgtagatattcaccttcagggtgtaggactggcagtatgaatagaataataccaatgtttcacctgcattaaatattatttttgtgttagtttgttctacaaactttacctggcttagtattagatgattcatggttgcatggaggcactttttgcaagacaacagaccaatataaaagctttcatttgtatcttgttgatgatagcttttagccttttacgttctatttgcatgtttcgaacaagtacagaattttccaatacttgtgttgcataaagtgctgtttatagtgccaagtactgcagtaactcgttgtatttggttttcttatttccgtattctttttattgctgattgcattggatatatgttgatgtagt

SEQ ID NO: 37525 - DNA, 1501 bp, Oryza sativa
ttacggcctcctcgaccgcttccgcgaggcacggtgggggccgttcgacggggaccagctgcagctggcggcgtccatggcagggaacgccgcgggcgacgggacggctgtccgcgccgcgcccgacggcggctgctgcgtcgcgcacggcagcgctgtgcgcgtgtacaaatgagcgatggaggagcggcggcgacctgcgcgtgtataactgccttcccggcgacctgcgccacctcttccgcatcgcgcgtgtacaactggagatggcaggcgcgaatcggccgcgtctcgggcaacaaggggcattcattgagtgttcttcttcctccccaatctctgcaactgcaccatgatccactagtagttattcttgtccggattcttctctacatgaatggccatatcatgcatcatgtgatcgatcagcaatgagcagcaaagtgtgtatgaggttggctttgcagaggctgtcacggtttaaggatgcagggtgcatcctgtcacaatgatcataagacctcagtcagctataggtggcatcggtgtctgggactgcaccaccggcgagcaggccgacttcttctacgagccgccgggctgtgcactcggcgacgccgacaagctccagtggctcgacggcacgagcacgctcatggcagcgaccatgttcccacggacagacacctccttcatcatcctgctggacttccgggacaagaagaacgtggcctggtcgtggtccgacgtcggcacgccggcgtcgctggaggacaagaacgtgctgcacgccatcgcgatggaggacgggcggtgcgcgcgccccctctcccccgctgccgtgccgcgcgccgctactctccgccgtcgagctcgccatcgcgtcggccgtctctctccctctctccagcgccgccgccccctgctccgccgccggccgcctcacgcaagtctgccaccacgcctgctcgagagaggagagaaagaagagaaaaagaaaggatgtggggcctacaccgccccgccgccgcctcgccatggctgagccgtccaggctcgggccagccgccgtcgcacactcgcacctctgctctgctgcaaggaagaagaaggggaaaaaagatagagagagaggaagaacagtgtccaggggtattttggtacttacataactctttctctctccatcttgaccggaaataataaaataatgggaagagtgtccagcagctaattaccacttttttacagtgtccacgagcaaatacacgatcttcgggtgtcttacagcaaagaccacaatctttgagtgtcctgtagcaaattttgccatgggtatgacacaatcacccagtgcattgctacccatttctctttcccatcgacagcagcaacagctgtcaaaggcacactgtactaacttctgtgaccacgactagtcagttgcacacagtccagccagcaacttgtacgtgacatactctctccgtcccataaaaac

SEQ ID NO: 37526 - DNA, 207 bp, Oryza sativa
agccatgttcccacgtctcgcctgcttccggcggaagtggaggtgggtgtgggcggtcccgtcagaaggtcattcggacggcaaccatacaagtctccgtctgtttatgaataaaataggataagtccccacaaaaaagagagagatggtgcatgtggtatccccttgaggtataaaaggaggaccttgcccacttagaaaggggat

SEQ ID NO: 37527 - DNA, 627 bp, Oryza sativa
tttggaaagaatggcattgattcgcgtggatttgagggaggaagaaactagggttcacgggagagagagagagaagctgggcgggaggaggacgacgaccgggcggtgggacccacgcggggcgcgtggtcagcgcgcgtgggcgcgcgcgtgacgggcgcgtgcggcgcggcctggggaggctcggctgggccgggacacggcccaggtgggaggggagaggagggagtgggccgggaaggagaggagggaggggcggcctgagaaaggaagggagggggagggagctgggccgaggggagaggaggcccgagagagaaggggaaaaaggagggatgagggaaagactttgggccaaactcggcccaaaggaggaagggggattatttttagtttttctttttaataaactccgataattgtttttgttgcttaataattatttccagtgctctgaaaattcaagtaaaatttgagggctccgtttagaccaaggagaatttaacaaaaattctccgggccacattcgaatttttcttgtacgtattttagtgtttgccaatttcttttcgaattttaattaattctattattccttttagaaaatgaattttatttcgggatgaa

SEQ ID NO: 37528 - DNA, 1501 bp, Oryza sativa
aaagtagagtttagagtccgtataaaaatataatttacaaatggaagaagagcctagagtctatatagaaatacaatttacatataacggaaatttgaaattaaaaaaaggaaatattgaaagacgagtctagagtaaatataggaatataatttacaaataactaaaatttgatattaaaaataattaataactagcacgtatatataatacaatataaatattacatattagtttcgtaaagttagtacaaaatttaaaattatattgccattttaatatatttgaataatacattgagaaaacatatatgctattacatgagagaaaatataatgatactagccgcgcaatttacgcgggccaccatactagtttagatgttacgtgtgtaattgtttttcctatgtttaaataatgtatgcacgtgtatcatgaaattttttattttgggaacttaatagggcctaagttccttcttcctcggtccgtccaccgtattccccctccggctagtccgaaaaaccaatccgaatacttcctctcggacgccgatgcggcggacccgtaggaggcggcggaggtggaggccctctccggcgataggaatgcaggcgatgccctggagcccggcttgagcgagcaggcggcaaagagccgacgggtttcgtggttcttggcgacgggcaaaccaccggaggaagatcagatggcatcgagggttagtcttcttcgcttcgctttccgcaactttactgtagactatttggtcactgctgcaatgaaaaaactcccgcttttcttgataccatgggcgtagaccaaaagcaaaggggggagaaaaaaaattggctcaaaattttcctgaaaaagaacctttttattttaaaaaaatgtttttgcaacttttgcaacccagataaagtttgggctgctaagaacttgaggataaagggggagtcatattgagtaatgaatactgggtataatgaggtgttcttgattagttgattgattggatatgaaataatttggggacagtcgtgtgaaattggtgaagagcgcagctagttgctgtcgaaattttccttgttgatcggcatatgatatatgcaacttgcagatctgtgcttgtgcagttggaaagcgaaaggatgaatcctatcattcaaaagagtactgctgaagtgatgcagcgccgaattattggctgcttttcagtgtctgtatcgccttcccacttgacaatttatcttggaaggtttcccatgaatgttaagagtgtagttcttggatgcatcttcatgaaaagaacattgaccaaagactggtgcgagacaaccagtgacttgttgtctagaaaaataaaaccaatgactgacaaagcgacagcttcctaatttgtcagagtttcagacataaatatacacatatgcaacgatatgaaaaatgtaagtcatttagagaacataggcctgtgcttatagtcacttcctcatgg

SEQ ID NO: 37529 - DNA, 335 bp, Oryza sativa
gggttatttccggtcgtgacaaaatcaggggtaagggtaaaacaccgtgccaaaaattatttgatttgagaaagagtacacatacgttgcacctgtacatttgagatatacatcatagtagcaactcctgatcaacaatcaggactttgtttcctttcgtcctttactcgggacgagcaaaggttcaagcttgggggattttgttgacggtcgttaacgatcagtttcgattgtcaatagtaccaaaataaaggagaactagtcatgcttgcaatgcatatttatgtttgataataaatatttcactagcactaggattactaacctctcgcaga

SEQ ID NO: 37530 - DNA, 1501 bp, Oryza sativa
ctagagtactagacaacattaaggaagcaaatgagagaacagtaaacaatatttttaaaaaaaaaaaaatgttacagtaaacacatcaggctaacctgggggagcataaccgattgtccctctaagtcccatcgagcttgtagactgttggagcaatgagttgccttcaaaaagaatcttagcaagtccaaagtctccaacatgtgctaccatctcagcatctaaaagcacattgctcggtttgagatcacaatgtacaacaggtgttggtccatggcaatgtagataatccagcgcattagccacatcaagtagtatgccaactctctgaagaagatttaagtactttgggttgtttgtggcaggatgcaaccagccttctaaattaccactaggcatgaagtcaaacacaattgctttgaagtcattgccgctgttatcaatgcttgagcaagctgtaattatcttgacaagattccggtgtcgtagatttcgcagtgcttcacattcagctgtgaaactcttgagcgctccaggagtttggagttttagcactttgacagcaataatatctttactttgaccagattgtttatctaattctcctttatacacagaaccaaatgatcctgatcccaacaaattggtcgctgagaaactgtctgttgcccttgccagctgagagtaagagatcaaaggatggccttccatgcatgtggttgatggtatctttgattttattttcttgtaccgagccagaagcttgtagaataataaaagcaggagtaatgttgccacaagagacacaacaataggaattaccagaaatttctgccttctgtgcggtgcttgtgatgtacatctaggcaaatgtagatcaggcacgccaccacaaagtttgccattcccttgaattgaaattgcagaagcattcaaaaagacaccaagtgtaggtacttctccaacaaaatcattgaatgaaaggttgagataaccgagcatggtaaggtttgataggaatgtgggtatttgaccagacaaattgttactcgaaagatcaagagtttgtaggcctttcaattgactcaggagtgatggaagactaccagttaacatgttattttggagatagatattctggagaagttggcattcaccaagggtagtagggatttcacctgataatttatttgatctggcatctaagtttacaagatttttcagattcccgatttgttgtggtattgatccctccaagttgttattcgacaggttcaaaccttcagagagactgacaatgctgactacctctgttgggatttgaccagtaaagttattgctgtctaggcttagtcctaataagtttgtaaggtttctaaaaatgcttggtatgctaccgctaaaagcatttgatctgagttgtaaaatatatagttctgttaggtttcctaatgtcaatggaattggcccaccaattttgttgttccctatggagagaaga

SEQ ID NO: 37531 - DNA, 1501 bp, Oryza sativa
gcacctccttccctatggcactacatacactggtgcacagcgcagctccttcccaccatgcgttggtgtgctttagacatagcgaaaattttaagggggtgtaagttagatagttagacttatctttttctttgagtaaagtgcacgaacggtacttaaacttgtaatgatgtgccatctacgtccctaaaatctcagaatgcatatctaaatcttagaacttatagagatgtgtcatctaggtctctaaaatcttagaatgcatatccaaatcttagagcttgtcatagtgtgtcatctaggtcccaaatcaccacagcctcttcagaatcctacgtggtgctgatttggcgtgccacactgacatttaaaagtttcccttttcttttttcttttttttgttctccttcttctcttttttttccctttcttctcctttttccgtgacccgagcaaaagaaaggaaaaaagaagaaaataaagaaaaagaaaagaaggaaaaaaaagaagaaaatggcacatcacgtccacgtggcatgccacatcagcaccacgtatgatactaaagaggttgtgtcgacttgagacctaaatgatactaatgatactgttagacaagttctatgacttataatccattttaagagtttgacgacttagacaacacaaccctataaatttaatgagtgtctatgtactttacttttttattttttttcttctatcacaaatttaccgagccaagccgagtcaaacttgtccgttccaatgtcactaaaatgtggaccaacgtgtaagttccttcttcctccccacatccccggctacggccggaaaaaaaaaaccaaccaaaatactcacggacgccggcggccggcgtgccgactagtagggggcggcggatgtggagcccctccggcgaccggaaacgaaggcgacgtcttggcgccgtccggctagagctctcaggccgcagcgggcgggctggcctctctgccgccgccgcctcccagccagcgctgatgagtggcctggtttcgtgcaattaattattggcgacgtacggacaggaccaagaaatctcgcatcgagagtgacaagtgagaacatcacttgacccctagtctacttcatttcaaatcccgcaacttgatgctctagactactggtcactaccgcatcgaagacctagatgggcatcgatttcaagtcaatgtcgtcccatgtgcacaaatcagcttctggtggtggtagcattctagctggaaagaagatggattctttttccctagtggatgcatgcattcataccataggtcagctgagcatatccaattgacagtggccttcttcacacgttttctttttagatatttattcgggcttttgcttggatagaaactatagccaaaccaattatgtagatatgcctagtatacatatgcattctaaccttacttcctggagagacattgcgagaaggatagtcttcctcatggca

SEQ ID NO: 37532 - DNA, 733 bp, Oryza sativa
atagctataggtagtgtcactgagtatttttcatcacgcatatgcatataaaattagggggtgtttacatccataggtgtaaagttttggcatgtcatctcgataacgtagagtgtcgtattaggtgttcgggcactaataaaaaaataattacagaatccgttagtaaaccgcgagacaaatttattaagcctaattaatctatcattaacaaatgtttaccgtaacaccacattgtcaaatcatggagcaattaggtttaaaagattcgtctcgcaaattagtcataatctgtgcaattagttatttttagattatatttaagacttcgtacaggtgttcaaacgttcgatgtgacatggtgcaaaattttagggtgtgatctagacactcccttaattagaaagttaggaagaggcggtaaagaacgcagcatgactgaaactttgaaaatttgataaggtacaccaactggagtatcttttattttcattgaagactttgaccagaagagcttgatccgtttttcttggagtagccagtaatgtttcattcttttccttttgctgggacttctttttattttttttgacaggagccatttgttgggacttgggatccctttactgttataggaccagtgcttgaatccaaacactgcattgatcagctcagctcattgtagcgcactcctcctccgcatgcatggcgagatcaccaacgtcggtcatga

SEQ ID NO: 37533 - DNA, 1280 bp, Oryza sativa
gcatgccacattaacgctatgtaggatgctaaaggggttgtggcgatttgggacctaaatgatacactatgacaagttctaagacttggatatgtattttgagagtttagggacctaaatgacataccactacaagtttaataaccgtctgtacactttactcatttagattcatatcctagattcttttttatgggacgcagagagtaatttttgggaggacgttttgaacaaacttttataactttaattgtcaataactttaaaaacactagatttatcttacaaattactataataaaagtaaaaaatatttattacatacattataaaataataataataataataataataataataataataataataatatatttttgtcaataatgtctaaaacatgaaaaattatagaatatgactacaatgcaacgaagctttggcacgtggcgcgtcgtcttctcccgaatggaagaaagggccaacgaatttttttagagtgaattacactttgggctacattttattatttaattttcactttggaccacccttaaacacatctgttcactttggatcaaataaatttactattgttgcgatttggatcaccacgaacgattttttttcagcacaatcaacgacattaatcacatcagctctagtatacggccgaactcctctgtgtatggctcatatgtttaccgaaagggaagttagacatgacgagaaaaagttgttcatggtagttcaaatcgcaaccatgataaatttatccagtccaaattgaaaaagatagaaaacatggataataaaaggtggaccaaagtactatgagaaaatctacacaacagtatcccgtcacaatgggataaggtctcatcaaccttatctccttcgatcccttcccctccacaatctctctctctctcactcaggagttaggagaagtcctcaggagtcaggagaagtccaagagcatggagatgaagccagctaggaggaaggggtcgtcgtcgtcgtctccggcggccgaggtggacgacgacggcacggcgtcggcgaggtcggggcggcatcgagggtgatctcgtcgcgcctcctcgacgccgtcctccgcccgctgcggcgccgcttcttctactggcgccccccatcgctgccggcgtcgaggcctctcccctcctccctcacactcctcaccaaggtctccatcaccctcgcgatccaccagtgccatcgtccttgcccgctgctcccgccgcctccttgctagt

SEQ ID NO: 37534 - DNA, 1501 bp, Oryza sativa
tttttttagcaaaagtgttacaaaatttacactaaaatggtgtacccctcgttactcgtcaagcacagtaaaaattctccatcttagtagctacagtgctacactatagaagttataagaaaaaaaaaacgctggatatgagaagaagggctcttataacagaaattattaagaggagcgaggctcaagatagcacaccaccttgtggtgttagcgggaagactcccaggcctttctctacagaagttataagaggaaagagcctccacacacactccacataatagcttcttgttgatcagtccatctcaagatgaagaaaagctctcttgctgtcttcctcctcctactcacccttgcttcccagggcacatggtgtgctgctgagagaagccacaggattaatggagctcatctgagacctcatgtccaggtggaagaatcgcatagtcagtactctctctctctctctctctctctctctctctctgttgcttccttgccatggcactaatcttgtcaagaaatgaatttgtgatactaatcaatcttatggagaatcaaataactttttgctgaaaacctttggtttgttcagtcactgaaggcaagaagctcctggagattcaggtccccaggaagcttggccatgaggtgaagtttcccaagagaatggccatagctcacaagggtggcagcacgggcggcggctcgacaggcggcaccacaggcggcgccagcaatgtcaacagtggaccggccgacacgcggccgaggaaaaacgcggcggcgatgccagctccggcgacgacgacgtccatcctggcactggccttctccttcgccattgctgtctcagctttcagcttctgaagctgtgtgagtggtggtgttcttgcaagaaaggtattagtatgtgtgttagtggtgtggtaatctctgaatgactgaatttgtgtatccagtttatcagtagtgcacactgaaattgtttcatcttcctgtatcttatattcaatattcttgatttatcgtctgcacaatgatgtcccagacattgttcttgcagttccaggttcttgtggttctcattctaactgttcttatcttggattctgtccaattggaaaaccacatgctgaaacagtctgttaaaaaattgaagctttttcttcagtcactgacagaagatgaaaaccaatttctcaattcatatatctcaatccagacattacaggctgccacaatattatgggtgagatctggcaagggccctggtccatggtgcaccaaaaaatctgcaccaaccacatgcaaaatagctatcagttctgctcctttcagtgccttgtgtccctctttcttcctgaagaacatcattagattcagaagcttggaagtaacaaaaagaacatagcataattttgtctgtttaagagtgccaaatcagcaatcttattgggtgacagatcccattagacctgaactaagccaggaatcc

SEQ ID NO: 37535 - DNA, 1501 bp, Oryza sativa
tttgtttttgaaaaatagggtcaaatgagtagagttgaaaaaggagagtcaaattgatagtagcctttacaatagtgtcaaaagcacaattatctttttttttcagactgggactcttagaaaggaaagtgggtattgcatgtgtactttattaatacttgcataatttgactcagaccctctttaatttttgttgcgcgaaatgatgtacactaacagcacatcttgataaccgtagattgtattggtttcaaagattggacggccaagattgttttttctttttctcaattagtcagacaatttatagctgattttgattaatgtgaaaaaattttagcttgcatttctcatataattaaggagagcctccaattagcataaagataataaaaaaagattttaacggctcgtagtgtcattattggtgttgctccctccgtatttaattatatcgcactattgactgcactcggtttaaatttaaactttgaccatcgatagctctcaaaattaaaaaaatataaaaatcatattagaagtgttaaatatattagaaaaacagtgaccaaagttacccatcaaaatcaaataaatttaatagtaatttcttgtctctcccaatatcttagcacttggaaggtactccctgtgtttcatattataagatattttgactttgatcaaagtcaaactacttcaagttgaccaagtttataggaaaaaatagtaatattttctacccaagataaatttatatgaaaaatatttaattattaatttgataaaactaatttgataatgcaaatattactatatttgtctataaatttagttaaacttgaatcagtttaattttaaccaaaatcaaaacatcttataacctgaaatgaagggagtatcgaaattctcaataaaaaacattgtacctcttgctaacgtgtcaagtagcttattttagtagctactccctccgtttcataatgtaagtgattctagcatttcctatattcataatgattttaataaattttgatatatatatatatatatgtctagatttattaatatcaatatgaatgtgaaaaatgctagaatgacttacattgtgaaacggatggagtagtagctacggtactggtgctataagaagaagagcctccacacacgctccaacataattctgtcttgctggtgattagtccatctcaagatgatgaaaagctttcttgctctcttcctcctcctactcacctttgcctcccatggcacatggtgtgctgctgctgctgacagaagccacaggattactacagctcatctgaggcctcatctccatgtagaagaattgcatggtcagtgatctctctgctcctttcatgattcttcttcctttgcaatgatactaatatttagtgttccgaattttttgctactaatctcctggagagtttaatttaacaagttttctgaatttgttttggattgttcggccactgaa

SEQ ID NO: 37536 - DNA, 276 bp, Oryza sativa
tcacaaaaaaattgtaaaaaacctaaaatttcgggcgagatttgagcacaccggtgggggacgaaattaccgaaatttcggaaattatgaaccgaaatttcaaaccctaccgggagatcagtaactaaaaatccgagatcaaaacgatgttgccactaaacgctcttgatttctcaacgaaacccaacaaaacgaggagtttctaaaacagcgattaaaatctctccagcaaccaaagcggaccccattttgaccagcgaagcatgtcaatcaaca

SEQ ID NO: 37537 - DNA, 332 bp, Oryza sativa
ttcatctgcaaatggcccataatattatgagcctcactccggtgctttctacttatagtagaaaataatccgagccgttgatcgtatataatcgtagggttgagatctaattctactaccaccactcatagtggtagtagaaacgtggaggggtatatttgtccatagataataattcatgtaagggtattatcgtaaattattattcagtaactctaaaccttcgccattctcaagcggctgaccccatccatcgttgacttcgtcgcttgtccatctccctctccgcctccatcatctccagcgcgatcgacatctcctccccctccagc

SEQ ID NO: 37538 - DNA, 447 bp, Oryza sativa
gaattcgagctcggtacccacaaacgtatagagaatttggagacaatttagtaagtgctttaacatcttagaaattatcctttgaatgaatctttatctctcgtctgattcctgcggtccaatcaaataatggtcattcctgtgtttagcaatcgtctgttttgcacttacattcctatcagaatcttgtgtttttttattcctttgtttttccattcctgcgattcaaaggagctcttagattcattcttgatttaatagttgggattaaatctgtcttagatctgacggcttataattgcgtattggcgtggtgcattctagtggtaagaagtattatcttttcactacttttagatatcttgtggctaggcaaatgatcacactacaccatatcctcacccctttgactgcatacctgtgatgggcataagtgttggtcagtga

SEQ ID NO: 37539 - DNA, 443 bp, Oryza sativa
cacatatatgtaaaatttgtgaataatattactaacatttcgtcagatgaagaaataacaaaaataaaagttttagatcttgatgagttattcaactttgttgttgatgactttttcaattgaaatcatttagtatttgaaaatgttatttgaagttttcatatttttaaattcaaattcaaactgttcaaaaaaaatgttatattgaaaaatgaccaaactaaaagttgtaaatattgataagttatacaactttgttgttgacattttttccatttgaaatcatttctacccgtaaaattattttgctatagtcaacttacaaatataaacatttcatatgaaaaatggaaaaatagtcatcggtgacaggctttagttaatgcccgatagagattaagtatatagcccgtcactgatgagtcatctgtgacgggtctagt

SEQ ID NO: 37540 - DNA, 1501 bp, Oryza sativa
ttttaatatatgtcatctaccaaataagatccaatcttttccggaggttgctttaatcctttatctccgttataaatcatttgtaaatgatttaattaatttggaatagtctccgtttaataggtttaattggaattaaatcttgtaaaattcataataaattcatatgaaatcagaatgaggccgttcaagtctcataattcatctaaaattatgatctacatgtttgtttactttttatgtattgtttatttggtttttattagtctttttcctcattttgcgtgatagcttgtcgtttccgtcgttgcgaaggttcgcgagtgcgccggaagtattcaagaagattaattgaagaccgattattgcaaggcaagtcacacagatcctaaacacaatcctttgagcatgttgatcctatatttaaattctctatttatttcaactgtgcatttattttcgaatgtcaccgggtggtgtgaacctattcctttgttatggcctattcgcattgattactctattccttgataccttgggttattataatttgactagttgagctttatatattggttcagctagatattagatatgattgcttagccatgcttagaaacattagcatactattgggataacttatgactcactattatttaatgatggcttaatgatagttcacgatggtcaatcgtgattggttaattaatttcttgccaactaaaacttgataatggtgggttgtgagcacatggttttgagagtcgtgctcatggcaattaaggaccggttcgcgagctactgttgtgaaacattaaccgtgccaaccacaagccagcgtgggcaacggctttaccttttgtataacatgattcattgcggagcaccagactgagaagtggcggaaataagcccacgggggtcgctggggagtccatgccttgttttataagggggtgattatgatccaggaatggtgcactgtggtgagttgtgttatgcagagggtattgtcacagcctctattcgggtacttaccagtaccgcgacgcatggtagacatgatgttgaggctgtgtcttgtgggtacagtggtacacctctggccagagtaaaactattcgaatagccgtgcccgcggttatgggcgagttgagcaatgtttttcgtgattagtcccacacctctcaccataactatagatgttataactggtaataatttgcttagctcctggtttggagttagatctgtacagccgggtatggttgttcaggatggttgggcctgtgcagcatgggtgtgctgttcagtgttgattaaaattcctgattaattactccactgttttacttctcttaaatgttttgctaaatgctgcttttgcaaatgagccaatattatgccatcctttggtatccttgtgcacttgcatatttgctgtgtggcttgctgagtatgtcatatgctcaccttgcaataatcaatcaacctcagt

SEQ ID NO: 37541 - DNA, 595 bp, Oryza sativa
gattttatgcacaaataagttcggaaattactagtgaatttccgggcgtgacaagttggtatcagagccatctcgactgtaggataagccaaatggtcaaaccttaaggacaaattttccgaaaacatgatttgtgaaaatttctcctttcttccttatctagaattctttgcaaattgtttcattgtctactcccctctctctttcaacttgagtagttctgaaactagttgttgaaactagaaaatgctgatgtggtcaacttatggaggtcagtcaagtggatcgaggaagaactgaagtgcccagatgtcaacatggaatgaagtttggatcctaccttagaacctatgccgccaaactatccttgaagaatagttagtagggtagaacgtttgttgcttgcttgtgtgtaggtatggttgcattcccgtcattggagtggttcaatgatgagtgtgtaattatactaggttgcttgcttaatcaacttgaacaatataatggtctacacacaccagatcagtgttaacctggttaaggtcttgtctttagtgtaacctctctccttctatcttctctaatatgcaataga

SEQ ID NO: 37542 - DNA, 330 bp, Oryza sativa
tttcgtgattagtcccacacctctcaccataactatagatgtataactggtaataatttgcttagctcctggtttggagttagatctgtacagccgggtatggttgttcaggatggttgggcctgtgcagcatgggtgtgctgttcagtgttgattaaaattcctgattaattactccactgttttacttctcttaaatgttttgctaaatgctgcttttgcaaatgagccaatattatgccatcctttggtatccttgtgcacttgcatatttgctgtgtggcttgctgagtatgtcatatgctcaccttgcaataatcaatcaacctc

SEQ ID NO: 37543 - DNA, 734 bp, Oryza sativa
cttcagttcttcctcgatccacttgactgacctccataagttgaccacatcagcattttctagtttcaacaactagtttcagaactactcaagttgaaagagagaggggagtagacaatgaaacaatttgcaaagaattctagataaggaagaaaggagaaattttcacaaatcatgttttcggaaaatttgtccttaaggtttgaccatttggcttatcctacagtcgagatggctctgataccaacttgtcacgcccggaaattcactagtaatttccgaacttatttgtgcataaaatcctcgtccaggaatcagccgaggtacacaaactgacaatttaatatacagattcatcaaattaactaaaacgataaatacttacttatgaggcacttagtcctcatcatgaagaaaactgcagcggaaaataaaatctagcgaagctccggctccactcccacaggcagctcaactggggtataagccaaacgtcttctccttctggattctttttcttcaactgaggttgattgattattgcaaggtgagcatatgacatactcagcaagccacacagcaaatatgcaagtgcacaaggataccaaaggatggcataatattggctcatttgcaaaagcagcatttagcaaaacatttaagagaagtaaaacagtggagtaattaatcaggaattttaatcaacactgaacagcacacccatgctgcacagg

SEQ ID NO: 37544 - DNA, 371 bp, Oryza sativa
gcaaaacttaacccctatattattactccttgtaccccccttgcattaatcatgcatctgccggtgtggcttgctgagtactgtggttgtactcattcttgctctatctttctccccccttcagtaagagaagctttggagaagaagtcttaggtggagtcttggcttataccccagttgagcgcctgtgaagatggagccgtaggcccgctagtccgctgctgtttatttttgattgtcaggccttaagtgcctttgtaataatgtaaatattatcgatgtaataaagatgtgtcttttatatcatgtttgtatggtgtaccccggcttttcctgggacggggattaatacactagcgttcgggaaaagg

SEQ ID NO: 37545 - DNA, 797 bp, Oryza sativa
agggggagggaaagggaacttttagggtttttctttttataaaacctttttaactttgtttatttcttcttaattattatttgtgctctaaaaattccactaaaatttatttacgcattttaggcttttaggaaatatacaaaaatcctccaagccctatttgatttttaactttgcacattttaatttttgaaggctttcacatggattttaattattctaggcataatttagaggatgtattttagagtcgttttgggacgcgacagattcccatgagacagtgcctctccttgtcttgagcggttgagagacagaacaacaattagaacactaatcacccaatctttattcaacttttattccggaggttttcaaatgattttgcaaaagaaatccaagttcctcaaatgattcacttgatctctccaagtgtattaataagaattcctcaccagtttgcctttttattcctattctaaggttgatatgtggagtttggtagggatcaaatatggcatacttgcattcacatttattactaagtcaaaaacttaaactaaaatagatgactaaacatactcaagatcaagatcgtgcaaagtgtgtgtgtgatatatggtggaaatgaaatgtggaaaataaagaaaatgcttctcttttgtgctttcttccttctccaaaatccttcttttataattaaggagaaggcatggctatacattattctcttcttttctttttttcaacatcatgctcatgcttaagagagcatgactttattattttcataacca

SEQ ID NO: 37546 - DNA, 315 bp, Oryza sativa
ggtcttaaggaaatctttgggttaatcagacatgaacacgttcattgaactattgaagtagcaataagattaaatcatttacatttaccttgaagaaatataattcttttcagcaatgcgttcatgcagtcagtattaaagaacgttctactatcacttgcctaatgatggtgaaatagtagagcaaactactcaaaagaaaagaaaaaaagaaacagtggagcaaagatacatcttacaaggctatgaagactaggcagcaattgttccaatgtaaactcgtgattttctgataaatacatccatttctgcaga

SEQ ID NO: 37547 - DNA, 274 bp, Oryza sativa
gtgctttcgctgactcttaggagttacaatctgaaatttccatgcaagaactgttattgtttagtacaaatcatcataagcattaatcaaagttctgcacatttcgcttgtaataaacaagtactgaagcaaaaaggatgaaaagaatcagtcttctgtgtcatagttagcaggaagctcatagttgtttattctcttatcttaagataattcaagaaaagctaaaaatgtatttcaattatctaacctcaatctacttgtaaatattaactta

SEQ ID NO: 37548 - DNA, 421 bp, Oryza sativa
atgtggtgataaatgcttacttgtattaactctagcctgtagttgtctatccttcaaaaagcaattgtaaggtggaagtcgataacagggtggtatcaagatttttccatcatcttttggaacctgtaaaactatgttgtcagtgacccaacaattttagaattgcagttctgaaaaaaagcactcatgggaaaaacattatgcggttttatttctagtattattggattgaaacaaacaggtaataggattttatctaaattcttttgtttcaaatttcaccagatgaatcatggattcatgagatagtttgctccgtgtcatgttgtttggtaatttcggttcctatgatgttgttatatactaacaaccgtatatcatatcctttatatttgatcctggaactcttgtcattaccagg

SEQ ID NO: 37549 - DNA, 484 bp, Oryza sativa
taataattctatttacgcttccgcttgttaaactctgaattgtatcaacttttggtgtccttgcctcctgggataaggattaatgcacgcacgtcaggaacgcccgttgggttatttccggtcgtgacaattatactctaatcagaggtgtacatctgtacccacaagacacatctttactccgcattccaaggccttggaacccgtcgtaaacatgtgacataacccttcacccatcctagcagtgaacaaaagtaccgatccaaccctgcctacggccggtttcccgggacaagcaggccaggattgagcccctagcaataggatctagaccgggtgcgccacacacataggggtgagaccacccgcgtactagtcgagtgccatggcatctcgactaacggacaccggcccttgtagccttcatttgcctagacatctcgattaccgagccgcagctcgcgtagccttcatttgccttaga

SEQ ID NO: 37550 - DNA, 330 bp, Oryza sativa
caccacatgagcatcactagttcgagcccagctcagcggatgcttcaaagacaaaaaaaaaaaaagcaacggcgttatctattaaaaaacggaggtagtacttgaaagatatgttagttttagtctcagaaaaacttaaccaatttggataagattttctagtttccacatgaccattgatatccatcttatctacacagtactacatgactacatgtgagacttcttttgtgtggtttatatgagatttttgttagattgagtttccacggttccaccgtatatttggcctagttaagtaggaagaaagtttaacgtagacaaactaga

SEQ ID NO: 37551 - DNA, 252 bp, Oryza sativa
cacaccctaattaagtattagcttaagcaaaaccttgaaaaatggcattgatatgattttttaaagcaacttttctatagaatttttttgcgaaatacgccccgtttagcaattcaggaagcgtgagcgcggaaaaagagggagtagaagttgggaaagtgcagtatagaacacaccctagatactctgttttcttcctgagtgtcatgctcccaattctactctgactaattgtgattatctttacatttc

SEQ ID NO: 37552 - DNA, 312 bp, Oryza sativa
ctctttcaacagagacatcttccttgccactctactgttctttgatacttctttcaccaaggaaatcactcccttcatttgctatcttttctatcattcttccagcggatccaaccgaggagtccattttttaactgaaactacaacagcatgaataattcacacattttttcagtcattttttggccccacacataacaagcagaacacaaaccattatagcttgaaaaaaatagacatgctgatacctacactagagacaagctgatacctaaactagagaaaaacactgatacccaaaactagagaaga

SEQ ID NO: 37553 - DNA, 220 bp, Oryza sativa
tcatcgatgaagtaattaaccaaagggaataaaatatgcatgggacaactaaactgggatatatatgtagacaatgccagtttatatctaatcgacacaaccatatgcatatatgcattgcatgtacctacgtacgtactacactctcttctcagaaataaatctgcacatggatattttagcggatcaattaattataattaatatatgatgatgcagg

SEQ ID NO: 37554 - DNA, 182 bp, Oryza sativa
ttagagggtggctcgcacgcacatataggtgctcggtaggggaggtttcatggcatgcacgaccatcggggctaggccgcacttgtgcaaaaagcgctcctaagccaggcctgcgagttgcgagcttcatttgttccatctccacatgcatgttgttgtcgtctctccattggtcgttcaga

SEQ ID NO: 37555 - DNA, 482 bp, Oryza sativa
attgatcccccaccaatctaagtacaccaataaactccatgtaactatcaatccatcaatccctccatggaccacccaagatcgcattccatgcctacctgcccctgcccagaaggagaaacggcaagcagatcgagtcctcacctttcaaacgaacaccggcgccgcaagaacagcggtggggggattctgcggccacggagcgaagaagaaacacgaggatagccgccgattttgttgcgaggttggggagaagaggggaaaaaaagaaaaagaagagaaaaacaagtcaatggaaaccacgaggtgaccgtagaccggccgacctcgtcgggagcgcaggcgcggatctagatgctggagagtcaacgcggggagagcccgcggcgcacgcgatctgggggattgaggaggagggagggaggggatcgcgcaccggcgcacgcgagagagattacgctgcggatcgaaatatttggaaa

SEQ ID NO: 37556 - DNA, 1501 bp, Oryza sativa
agatctgtagcacgatctttaagatgtaacgtgtgtatgataggtgagaccgggtattattaatagtatagtactccctccatttcaaaatataaggcacaaccacccttaacccaaataccaagaaataattaatatttcatggttatcatgaatcacctcaatcaatacaatacatgcaaccaatagaattaaaaatcttgtgagtataggatttaaaataataataatttagaggagagaatgtgctaattaattatatgcatgcatgcatgccttatattatgaaaccactttaaaaagtagatgtatcctatattttggaatggagagagtaaacaactattgtatgaattggctattatattggctataaatgatttggagctagtagttggctatactattaaggccgagtttagttccaaactttttcttcaaactttctaatttttcatcacatcaaaactttcctacatacacaaactttcaacttttccgttacatcgttccaatttcaactaaatttttaattttagcgtgaactaaacacaccctaaacttaactcttatgggtgtgtttagttcacgctaaaattgaaagtttggttgaaattggaacgatgtgatggaaaagttggaagtttatgtgtgtaggaaaagtttagatgtaatgaaaaagttaaaagtttgaagaaaaagtttagaactaaacaagtccaatatcgaacgatacaaggcctttggccaaaggtgggctccatcttgtctccgtacccaactctcaggccctcacttgcgtcatcgcaagttcagacttctgttagaaacgtcgtcttgactaattattgttcgaaagattatccctttctctttcaatttctttcgaatggcttacaaacataaagtgattgtaattcggctctcgttgaataatcgagaatcgcttgaaattatggttttcacttgagatatgaaaatttgataggattttcacaaaaaaaacagttcagttccttcaaactgactagaccctggaaaaagtacaccgaaggtccctcaacttgtcatcgggttacaaatcatccttcaaccacaaaaccagatacaacgcatcccccaacttacaaaaccagtgcacattgaggcagggcccgcttatattgctccaggccaagcacgcttaaccctggagttctttgaaaatcggcttccggaaaagaagttgcaacgtgtccagtgcaccactcccggtccacaccagccatgcgctatgtaacgtcttgcctctcccaagtcaggcccgcttacatctggtagcttttataggtaatagactgccctcacaggccaacacatgccttttctgcacactttgtcctcactcgtgtacacccggaaagaattcctcggtcggtcactcatcccaaattgctccaggccaagcacgcttaaccctagagttcttttgaaatcggcttccagaaaagaagttgcaact

SEQ ID NO: 37557 - DNA, 360 bp, Oryza sativa
cgctggaaggaggggatagagagaagagagataagagagctgacatgtgagccaagggcattacatttcacgtgatttttctctcatcttcaaccggaaattattattttaatcggcgcggtgtccactggcaaattaccacgtttgtggagtgttttcccccaaaagtgagtttggacagtgttttagggctaaagccacatattagcagtctccagtagcaaaatttgtcttttttttctattagttttggtcaaatctaatgaactttgattaagaaaaagtcaatatgaacggggagagtagtattttttaaagaggaattattagcgttcgtagatcaaagcaaaattacagtac

SEQ ID NO: 37558 - DNA, 510 bp, Oryza sativa
tgttgtctcatgtcatctaatgtgccttcattgaattgtaaacattttaaagtagtcaaggactcaaatgacggaagtatagaaacataaataaaaaaaatagaatgatccagttatcctattcaatgaatatgaagtagaggtgactatggagagaacgtatcctatacacggaagtcttcatgtgcacgtaccgtttacaccaactaataaatgtcatatttttttaaaaaaagatgtacatatattgtcaataatattatatttacgtgtaaaatcccatcttcaaattcatcatacatagggagaaaaaaaatcttacagattttcatttatagtcttaaattaaaacagtctaaatgtttgtttgttatcgctaaatataatgaatttgaggttaaaactttacatatagctgtaacttatatgcataattttttcttgatttttttatatttattagttggtgtgcacacaatggttgtgtcttgtgtgtatatgttcctcagg

SEQ ID NO: 37559 - DNA, 218 bp, Oryza sativa
acatattcttctcccacctctctctctctctctccccacattaccaacaacacgtacaccaaatcagtcggactatcatatcgggtttattccttttctcccatacgccttctacggcatcgcctctagcaccgaaaaggtcataccaataatgccttctttccctccttctcctctacactaagatgagcagcagtgacatgctcctttcccacagt

SEQ ID NO: 37560 - DNA, 665 bp, Oryza sativa
gatgatatgtaccgtggactacctgtattgtttgaggactattttcgggcactgattgtgttgttaattcacagagacgaaatcgaatttgaggtgatgttagtttactggatatattatgccattagatttagaattgagtagcttttaattagtctgtccacgatatcatacagattatgctgttataggttgtgtgttggtcaaaatgccaacttttgctggtgctggagtgctggtgaggtgtttgtgttatatgcttcatctccggacctaacagagcattagcttgactctacagtatagggtgaacagaaatgttttttctggataagtaaagacaagtcgatgtcgaatggaaaatcagttcgttttgtgttaaattcatgtggttgttgagtgctcttccttttcatgcatgattcaagaagagacgattgtgattgtgatatatattttttttgtaggagttggtagctgttgaaagttctagtgaaacttaaactttttacttaaaccttgtcaaaagtctcaaagtttaccgttaattaagatcactttatccaccaaaattttcaatttaaaatgcataccatcgaaattaattaagctagtatatcttctttaagatatgtaaagctagaggaatttctagcatggagaaa

SEQ ID NO: 37561 - DNA, 555 bp, Oryza sativa
ggaccttaaactctgctaaagaacatagaatgatccattataattatggacatagggagtaatcggtgttagattgatgggtagaaggcattgtggttgatgacgtatcgtatttagtaataggaaatagggtgaaggattgcaacattactacctgattggatgtccgctcaatcataactagtgtaagagtcaaagatgattgttgggataggagtaacaccaatggataatctttatcggtatacaagggacacattctaacaacatatgtctttcgagattctttctttgactgcattatccacttgtcataataggatcaatggccatatatatagtggtggaggtaaaaacaaatatacgattgtttcatcggatacaaatgatctttacattttagaaagaaaatgttcttttttacataaaaccaagataatgggtctttcacatatcctccaatatactagcccgctcgcccaccctactacccccgcacacacaccctacccctcaccgcatgcgcagatagaactgtacccctatacatggaaa

SEQ ID NO: 37562 - DNA, 1501 bp, Oryza sativa
cacttcgatcttcgggcgatcaaaccgagcgaattcgcggcgggaggggagattttgcgcgtgtttcttgtgggttcgctcgcgtgggcgtaaggggcgttgtgaggtgtggatttcgggggcgagaggttggagaagaatctgggtgactcctcgctaacaataggccgcagctgggaaagaggaggtgaaatgtcggaactgccccgttccgggaaagaatcttcgcgggaatttagcgggtgtttttttttttagctcatatccgtttcaggcattgcgatagtgtctgcttcttattaccggcgggaataacctctcttgtttattcgtatccagcgtggaccgaccaagctgtgctttcgtcagctgtaaattatggtaaatttggaaagtattttgtattttaactttgatttaaaaattttacatggtcctttttttacttgtcttgcatcatgctccctccgttttcactattgtatcaaattttaccactcataactctcaaatgattagactacaataaatttatatttaagggtaattcgatccatggtattgcaaatatatcatttcaaataaatatcattacaattcgtctactcgtagccatgacactgaaattttacaaaattgtaaccgtgccactatcgttacgttttccatccatttactcatctgcacatgggaccaatcatgttagaatcatcttcttcctttcaccctctcttatcttattccatctctgcaattttcaacactgcctcctgtgccagccacgagcgtcctggctaactccatcggcgtccgccccctacctgttgggggcctccagcttgacgtccagttgcagcgcgtgtatggccatcatgtatctatatctgaccttatcgctgctacttagtgccaccggcgaacctgcgttgcgcctagttgccgtcccggagctcgccgcaatggatctgttcgtgccattaccatcctcgacctggtctctgctagtaccatcggcgaacccacgcctcattgccttccccgagcttgctcgtgttgttcgcatcgccaaactcaccgctactgctagcaccattggtagacccgcaactcattgccttcctcaagctcgtcatcatggatctactcgcattgttcccatccccaatcttatcgctactgctagtgctaccggtggatcagcacctcgttgccgtccttgagatgagctcactgccacggatctgcgccgtagagtcgagctcgtcgacatcaatgggcctcgctgatgccctcgcacctatcaacctaccaaagatggatgaacctcatctcagatatatgcatccggtttacacttgcctgcatatattttattttaccctaacgaacaaccataatttaacagggcacaaaattgtatcgcacatatcgcacctaaaattgcgatttcaattatgtaatcactattttataattaattttttattaaaatagtgctatt

SEQ ID NO: 37563 - DNA, 1008 bp, Oryza sativa
atatgactctttcatgagactctttatgttgtttgttactatttttaaagtgtccgcgatcaaatatcatatgtggaataaatatatttaagtgatgaacacatgtattaattgatgatcatgtctcatggatcatagtatagagataccaaattaataatgtggacacatgttgttggatagacccaacatgagacactgcaagagccatatgtgttgtgtcatcagtgatctcatttagtgttggtgttgaatccttacatctgagattattatggttcccaatatgtgtagtagcttacttagggacagataaacgctacttcgtaattgggtagttataaaagtagttttcgggtatgctataaaacatgtagtgggatatgaataatcaagatatgatttgctcctcctatggagagatatctctgggcccttcgatattgtaggttatggaagtgcatggccataccaaaggtgattgaggagtcaatcacaagttatataactatcacaggttcgagtgaatgattgagctattagaggatggcacatatatagctttgagcttaatcgatatcgtgagacaaaggggttcatacaagtatactctagaggttcaaccgatttgatatttatgtatgcccggtgggtcaatacgttctgctaggggccgctgttgactcgtggaacaaaaggtagttttcgggttacagcagagtgtacatgaatctacagggtcgcacgtttaatgggccggaataaggggattggatggagatccaatatgagcttaattcggatagggatccaaataggagtcctatggaccttggaggcccgagtcatggatcctatatattcgtgaggggtgtgattggctaaggaatcgcattacgtgagaaaccctagccgtcactcccctccccgagcaaaaccctagccgcgcgcgggtgctagcacatctgcgcgtggcgtttcgtctctgtacgtgtggatactggtaga

SEQ ID NO: 37564 - DNA, 179 bp, Oryza sativa
gcgcgcgacgcgcacggcggcgcggaagcagagctacggcggggcggcacaacactgagtggggcgtcgccgggaaaacagagagggggcgcgagaagttacgggaggacgacgacgagctggttagacgagagagaagggccgacgacggcgcgcgactgctcggtggcggacgcagc

SEQ ID NO: 37565 - DNA, 160 bp, Oryza sativa
gcgtttcgggttacaaatatatctagttattcttgatgattgttctcacttgtgtgaacctttcccctgcgcttcaagtctgacatgtttaccacgctatcacacttctttgcctatgtcaaaacccaattctccaccaacatttgcagcatccagtgcg

SEQ ID NO: 37566 - DNA, 1501 bp, Oryza sativa
tgcatcccagtttataaaattattttgatttaaattattgcattatcgctttacttaaatgcccgcgttatcactgttttatttagccatgcctatttacctttgttatgaccttattattattgttattgatattattaccttgttcaccctagattaaacaaaaccccaactagtggacactctactcatggtaccactagtatgattttaggtagatgcttcgctggttagttaggcaacattaggtggttttacaactctagactgtgggaatattctcatcacctggacactatggaatggttggattattgtggaatcggattcacacctccccctctattcaaaaccctaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctctaaggcaaatgaacgctacacgagctgcggcccggtagtcgagatgtcatggcacagggccggtgtcctgctgctaggggctcagtcctgcctacctgtcccgggggttccggccgtaggtgcggttgggtcgttactcttgtttatggctaggatgggttggaaactatgtcatgtcttctgtccgtataccgtggtggtatgtggcacgtggttacacgtgaggaagatgtgtcttgtgggtaaagatgtacacctctgatcagagtataatctattcgaatagtcgcgccctcggttatgggcaagccgagcaatgtacccaagttagtgtttttaattcttaaaacctgcttaacaactaaaatgtggaatggttggcctgggttggcttgggacgagttaggacccagggttgggttgccagttcggtctgaatcatcgtgggccttgggttaaggcaggttcgtgtgggttcacggccttgattaataatcttgtatagctctaggaccgtgtttacaaagtagctttgagcaactaagtgacttttaatgctgtttactgcaaaccctaaccccccctatattatggctcccttgtactcccttgcatttattctgcacttgtgggtgtgtcttgttgagtacggtggttgtactcagtcttgctcaatttttcccaaacccagaagaggagcccctggatgatgaaggctttggtgtctagctcgtgcctgccgtcaagcgcatgtggtcgtcgccctagtcttccgctgtttcccatttgtctttgtgtgtgctgggccttcgccgcccatgtaataaagtaactatttacgcttccgcttgataaactctgaaatgtatcaacttttggtgtaccttgcctcctgggacaaggaataatacacgcacgtaaggaacgcccgttgggttattt

SEQ ID NO: 37567 - DNA, 158 bp, Oryza sativa
ccagatgcgccaagctccgtctgcccccgccgccctcgtcctccccgcgcacacgccaccgagagggaggggggaagccgcggcgagctccgtccgcccgcacgccgctgagagggaggggggagggggaagccgcgtcctcgtcctccccgcgcgca

SEQ ID NO: 37568 - DNA, 1501 bp, Oryza sativa
agcggtggcacgggaggagaagcgaagcggcgcgggaggagaagaaggcgatggcgatggagtagaggaagagaaagtcgttaggggtaggtggggaataaatttcgtcccgtaccccgtgtccacacgcttgggtaatgctgcactgtgggtccggttttcttcacctgtggctccatccaattaagccacacatagtatgggtgcttgcactgtggggtgggtgtctttaggccaactttttttgctagagctacgggccccataacttgcactgtgagaggcttaatagccttgagcacgaatgtcaaaggaagacgaggccaaccgttgacgaagctggcaacaacgtagagggctatgaaacagtggtctggcagtcgcaaaaatgggtggcccagagttgcacaggtaggggcgagctggaggcagcgacgatggttgcgcttgaccttgacgaggagaccattctcctgagcggtggtagcctgaggaagggatcatagatgggatgaccgaagaagaaagactacgagcgatggagaggagaggaagagggcaatactgaccggtgggccctaccattttttatatttttcgttgatatgattgccatgtcaaccaaaattctgctaaacgtgtgacatgtaggaccaacaccgctccggattgggccaaagggataattcattcgggttgaagagcttagggttcaagatgtttagttttgtagtttgaaaggattatttgaattgctgtaatagttcagggatagttaggatttctttgtagattgaaacgaacagtgtataagatggtattgcacacatctgtcttagcttaagtaggtcagaggatccatatcacatcaaataccatggatagtcttcgatcgttgtcaattgtgcttgttcaacaattggaacgccactcaacaattggaacgccactaagtgagcccacccacttagggccctttgaatcataggaatgaaaaaacggaggaataggaaaacataggattctaatatgaatgcaagtgcaaaacagagtactgcaaaacgtagaaaaaacacagggatgaccgtttgattgaaccgcacgaaaaacacaggaatcggatgagagagagattcaaatgaaagtttccaagatgttagagttcttgctaaatttcctccaaaatctctatagaattgtccattccataggaattttaaaggatagcatatgattcaatcatttgtttcaaagggcttcatagaaaattttcactatagaattggaatccttcaaaaattcatatgtttgtcgtaagtccagggatcatcgagggctatttggagtttgggcagaggaaaatcaagtcgtcgtggtcttcttttaattctacctttactaggaagcatcgatgcacggctacaacttctgtaaggaaaaagtacgaattacccccccccccgaactatcgcggtcgaccgaattaccccctaaccataga

SEQ ID NO: 37569 - DNA, 656 bp, Oryza sativa
ctctcaaactacatatataagatataagcccaagatcatattgaaggaatttttatgagatcataattatatcacctattttatctctttgaggttgtgttaaaaaaccgtttgtgtgagcggttcataacccgttacacgagcgcttttcaatccgcatgtagctaagggcctatgaaaatcgaccatttatataggctcaaaatcagccgccaagaaacattttcacaggtggtcttttggagccgcctatgaaaatgatttttttttattttttaggctaaaagaacttgaaaaagtctatcttttattttatgtaatcgatcctctttcatgtaattaggcaaaagatgcaagctcgagatgtaactaaagttcgcatgggccttcagctcctgaacacaaatgggctattggaccgtctcctattacccatccaacattggaatttttttattaaaatatttatgaaactaattttgtgtttcaaaaatttacaaaagtagtcgcccaccgccctcccagagggcgattttaataacgtggcagacggctatcgcctcacaagtaacggccggcaaagggggcctgctattttgcaggcagcccccatatcgcccttagggagggcggtttaacactgtgccggggggggc

SEQ ID NO: 37570 - DNA, 1501 bp, Oryza sativa
agtatgaaaagaaagagtgaaagaccattcagtagtagttactactctttcctctttctgtactaaaatataaggatttttagttataaatttgaacaactgtgtttctaaattcatagccaaaagttactatattttgggatgaaggtagtacctccacctctcgacgatatcaaatgatgacagttcccacaaacacatgtgaaaaccaaataaattttgtcaaaaattatattttctttgaactggatcgatccaccgagtgaatttatttccgtacctggtgatgggcacaattaccatggtaaccgcgcggtaagagaaaccatacttattcattgtctttcgttttcatttcaattggttacaatgaattttttaatatctaagtttttattcattttcttgttttattgtaaacttctaatttacggctccctttgattcaaagaaaaatcatacaaattttggaggattttatttctataaaaaaatatttttcctatataatcatttgaatcaaaggaataaatcctatgaaatgtctcactccatgcaagttttataagaaatttaatatgggttagaacctcatgggacgtttcttttgagtctttatctctcttaaaatttttgtgttttttctgcggtctaatcaaatgactattcttgtgtttttttctatgtttaatcctatgttttataattgcatttatgtcagaatcctatattttttttattcctccttttttatttctaatatttaaaggggtcctacataagattgtgtgacaaaaagaaaaatgagttttccttttttttaaaatcttttcttgaaggtttttatgtctcccaaagggtatttctgttgtagtgtctcgaagcaaatgtttccaatctgtattgttgatactttttgtgataagatgctttagagtctcctcaagtgaaagttgattgacctaagatttcacgagtttgactgcaactgtttgaagttattagaactgttttcgtttgataatgagctactagaactagcaaagggattataatagatcacccgagtaaacatcccctcatttactaggcaactaaattattatgattcttttctaaaagattgatacgacatatcaatatataacatatcattatatattactgtataaatatataagtataaattcgacttctccaagttataaaaaaaataacaaaatggatgccaactcaagtgactaaaaagagtttctcgatcaacataatctatcaattttcaattagaaaattgactctgacttggcagcataattgagactaacacatgcacatccaccataccaaagtacaattactgaaccgtccccgtccactacactgttgtacgatcgattaccagtagtagctcactcctaatctcctacaaatacgtagcgtcactcgcttgcattgcatcgcatctccaacccaaacccaataaatcctctcccattgccca

SEQ ID NO: 37571 - DNA, 1501 bp, Oryza sativa
acgtgcggcggatgaagaaggtgggcaagatgttcgacgcgttcatggagcacgtcctcgacgagcacagcgagcggcggcggcgcgagggcgaggcgttcgtggcgagggacatggtggacgtgctcatggacctcgccgacgacccctccctcgagatcaagctcggccgcgtcggcgtcaaggcgttcacgcaggacctcatcgccgggggcacggagagctcgtcggtgactgtggagtgggcgctctcggagctcttcaaaaaccccgccatcttcgccacggccaccgacgagctcgaccgcgtcgtcggccgctgccgctgggtcacggagaaggacatcccgaacctcccctacctagacgccatcatgaaagagaccatgcggatgcaccccatcgtgccgctcctcatcccgcgcgtcgcccgcgacgacgccgccgtcgcgggctacgacatccccaagggcgcgcgcgtgctcatcaacgtgtggaccatcggccgggacccggagctgtgggacgcggcggaggagtttatgccggagaggttcatcgggagcaggatcgacgtgaaggggcaggacttcgagctgctgccgttcgggtccgggcggcgcatgtgccccggctacaacctcgggctcaaggtgatgcagctgagcttggccaacctgctgcacgggttcgcgtggaggttgccggaggggatgaaggaggaggagctgagcatggacgaggtgtttgggctgtcgaccacgcgcaagtacccgctccaggtggtcgtcgagcctaggcttcccgttcaactctactccttatgaatctgtgggtcagtgtgtgttgatgagtgggacgtacgtgattgtgcactgctgtactagcttacttgctttcaagtttcaaggtttcaagttgcgagttgcaaatagccgttggtgcagtccgtttataggtggccaaattggccccctgacccgacctacatgtcgggtcgtgctgtgccaaccaacgggctgcacacacggcccaataagattcgggtcgtgctgggccagcccgaaggaatgacagtatattgtgcttctccatagaataagtctactttttcatccctcaactctttggggtgtcttgtatggctagaaatatgtctattttgtattcctcttctctttgggccttgccttatatggttgattaagtctattttggatcccactactattttctttgatcatgccatgccggccggccgactgtgtcaaggcatcggccccggcacagcccactgttgggccatgtcatgcttgggccgggccaaatggccgttccttgggtcgggccgttgggcctcgggccatatggccaagtccgtcctctcctccatcccggtgcacctctcccttgccatcgggttgccgaatgggtcttgaaaaccgttgacaaatggcaggaatccttcctttggaatggattggactcagtctatggtagg

SEQ ID NO: 37572 - DNA, 422 bp, Oryza sativa
acattgcaagaaccgtacgacacacatactaattaaaattagtactcatactgtcctaaaatataagcatttttaaatcctgacatggtcttcgagatgctaatttgaccaacgttatctataaaaagtaagatattttaaataaaaagacttatatattataatagtttgtttaatgataaatctagtaactttaattttactgattatttttattttctttttctattaataattaaaattaaaaatgtttgacttgtcgctatacttaaaaaatgcttatattttgggatggacggtggagagaaaatctgcctgattgatgatccaatggcatccgggccgtaataaacgcgtaagatcaggggcctggactcgatcgtcagtgtgtgtgtgctcgtagtcgtattaaaccccgacca

SEQ ID NO: 37573 - DNA, 1501 bp, Oryza sativa
ctcgcatagcttgcatgtattctagtcttttcatgagatttacatgttgcttttaagggagatgatgcatgacacttaaattctatacttgaattaagcaaatatgcaatgttgatgctagcatatggtttgatctataaatgctttatatatatgctttattgaattgttattgctcaaagatctttaattgctcattgtgaaaaagagaataaaaatatgaaaaaaaatgaataccgaatccttggaaacagtcttgacgacaaggacgtattcgatgtgagcaaaataatgggtgccgaatccctggaaacagtgttgacgacagggacgtacccagaataaaagagaaaaatatgagcaaaaaggctaaagaaaacaaaaagttaaaaacttctcttggttgttttgtgcaaaagctaatttgagaaagagtaataaatgcaataggtatatgtgtagaaagagtaataaatgcaataggtatatgtgtttagtgtttattcttcaacctatgtgcttgttaagatgttgcattataaatcgtatgaaatcatgaattttgactgttgattcaagcttaattataaaatctttgggtcatgcttatacttttatgcatgcttgttatactggagatgggttcattttctttttattgcaatacatgacatgatatgctatatgtatgctaagctcttaaacattaatgaacataggtcctatgcttgatgagctcggtaccctgtcaaaagggggagaagagatgagttttggaagaagatttttggagttgttgagaagagcatattttttagttcatgatggaatttctttcttttaaaaagggggagaagttttcttttggattttttagcacgatgtgtacatttgtacgaagtgtgctttttaccacttttgtttttatttttccaaatacaaaaacatttttgatgggtttgccaatgtgttcatcaagggggagattgtaaaatcaaaggtgtttttgattattattctgtgaacaattgtcattggagattattggttttgttatttggaatttattcacgaagtggttttggagatgattggatttacaggtgaatatgcaggttctgttattttatgtggaccggttagaccgggcactgtgtgccggtcagactggcggtatacgcgcggtcagaccggccagcccgcggtctgaccgaccgacgctgtgtctgtttcggtttcgggttgtttgtttggatatccgtgattatttcatgattatggcttctaggtcgatactatacgtatgtaatactgttgtttgctactaatgagtcaaggtggagatagcttggtctcggaatatcgtttctttgtttatttcatgtgtaggtgactcgatgcctcgggagagtatttgcggtgatggaccgggagtcggcttggggataagacgacgttcgtggtggtcagagatcatgcgggatacttaggctagagttga

SEQ ID NO: 37574 - DNA, 167 bp, Oryza sativa
cgccgaatcgccgccgtcgtcttcgccccgtggagcgccgccgcctccctccgcgggcgctccctccgtcgccgcgcctctcggtgagccgcctccctcctccttttcctcttcgccggccgcccgccgccgttccacgtcgccggctgctgccgccggtggccgca

SEQ ID NO: 37575 - DNA, 1501 bp, Oryza sativa
tcagtgacactgccacctgatagtccgcaagcggcccgatgatatcagtcagaggaagagcctacgctttatgaagtcaaatggcgatctcggaagaaaaacgcagaaggcccacggagaacacttacattgatggcatcgtcgcgttcggccgcccccttctcacaaaggggaacggggacattgctcgtcgtcgtcggaccactgatcatcacttggccgacacgatgtcccacggcttcactgctcagacctatgaatcgagaaccaaaattcgataagtcaggaggaacgcgcacacaagcatgtcagggtaaatgcaagaaagataccccgaggagaaacccgggttgtgtcctccggtccagaatagtcaaaggctggatggtctcgagcctggagcggctggatccatctaccaatgaagtcagcagcgacttcatatcccgacaaacctcgtactcggagatcgtcgacaacatcgatgaaggactgaagagaaggggtcaagaggggttttgcggtccaagacgaaatcttgtccggttgttcctaaggaacaacgaagacaggatccgaatcttctatctgaagatagaaccacctcgtccgccatttgctgcgagaggaagggcactggaaggggatataacgcgacttcaggccatcccgaagtcggaatccgacacatccaaacacgctatctgactccatccaacgcagctcgtagtagaagcgcaagagatcaagaaagggctctaccccaatgtgggcctcacaaagatgcgaaaaaatactaagaaaggcaatagaattggggttcagatggagcaaagaaagaccatagaagttcaaaatcaagagaagaatttcggaaggtggagggagaaaaccgcaaagaatgtagtcctcaatcgcaaccatgcgacctaggacaggctggggttcagtacatcctgcttccctctccatggtcccacgaccgggaagggcaccgtcctcctgaagcttcttcagcgacgcgctggtggaggaagattttccaagatccatcgccgactgcagatcgctggagaaagggttgagattgacgagctagggttttttgtgggaacggagaagacgaaaaacgcttacaggctggaggttttcttcacaacaggcagacttcaaaatggatccccaaaattcccttaaatagacacacttccgatggtgcgaattccaaggaaaggagggacatagccgccgaaaatttctgggtccgttatgcgcggcagttttttagacttcagtttaaattcactcatgaccgttgggcttcacagggtattctcgactatgtcctgtctctacggttcttacaccgggaacgacaacagcctcgacacctgaagtcactaatggttacacgagttcatttaagcagaagtcgggggccactgtcagggttacgggttaggtataccctttacccttcgatatacgctaaatatcggta

SEQ ID NO: 37576 - DNA, 719 bp, Oryza sativa
  unsure (1)..(719): unsure at all n locations
ggatagcccaggtcgccgagagtgtccgccatggccttcatcttgcagcaatagtctgtgatgnagaggtcgccttgatgtagcatgcganactcggtctcgagggtgagagcacggcgttcgctgttgcccaggaattggagctcgagagcgcgcgacaccgaccgggcagtggcgacgtgggtcatcacctcttgaaggagatcagcggagatggagctgtagagccacccaagtacgacacaatccatctggagccagtcggcgcgatcgggaaagtagttgtcggagataacgtgatccgtcaaggcgtatttgccaagggccacgaggaagaggccgcgccatcttgtgaagttggtggcgccgacgtcaagggtgatggggacgagcgccttgacgttcagtacaccaacagcctgcgcgtgcagggcgttgcgggcctcgttgttgagaggtggtgcggcgggacgagttggcgcgatagggatgaagtcaccggggaagccgggaagatgggcgccgtgtcgtcgtagttgccgcaggcgcctagtccagtagcgagacgtgccgcggtgaagagttgttccagcgccggtggtatagatggagcgccggggggaacagagaaaggagcggtggacgccggggcggtagtggccggcgcggtggaggcagggatgcgcggggcaccatccgaggttgacatggccgacgaa

SEQ ID NO: 37577 - DNA, 601 bp, Oryza sativa
tcctctcatccagatcccaattccgaaatctaagtcaaattccaagttcaaattctcttcgaattaatctcctccgaaaaagtctattttgcctccctcgaatttttgtgggccgttttctcctcggcccatctcctctcagccgctcctcctcctccccctcgcacgtgcgttgcgcgtgtgcgctcgctctctccttcttcctcgctctctctcaccctctatctctctctctctctctcattgactcccgccgacgccgcccaaaatcccaaccgcgctgccgtttctcgcgcgcatggccgactggcaaggacgccgctcccacgcgcctcgcctgcccgcggcccaaaacggaagggagaggcttccctttccaccgtcctccctcactttttcccttctaaacccggcctctctcctctcgcccttgtcttcttgcgcgcggaagcagaggacgccgacaacgtcctgccacgcctgtgcccccaccttgaccgcgccacgccgatgctcccgcgcccgtgattcaattcccgccgcacgatccaccgcctccaccgcccctttgcatcctcgccgtcgccacgtttcgcgcagc

SEQ ID NO: 37578 - DNA, 1501 bp, Oryza sativa
aattgagtattaattatttcaaaagtgaaaaatggataataccatatttaaatccactttcctatatatttttttaaaaaaataccttttaaccgttcaatatctgcgcacgcgaaaaacgatgcactattttttctcacggtgcttcaaatgaaagcagccttaggctacaatactatgaaactgtcatgtaaggtatttggtagagttttatttttatctaagttcaaacattttttttcatgtaatttagtaagtttttattagttataagtttatctcatgcagttttgtaattctttttataggttagaatagtttattgtttaatcttttaggagaaattgcataaatcattataattgtcaccctgttttgagattccatcgcataacccattgtgttggaaaaaccactctaccctcgccctctccctgacacatgagtaactgattcggtccattttttacttgaatcccggcggaccatatcaactaagccaagctaggtagtgtggtttgtggtgagtccgacttaagcatttgggtaattttggcctcacaatatttgatgggtgggcttttgcgacaaaataggttatggggtggtttatgtaattttgtcaatcttttagtagaaacagattttgtttgcataagtaggtattgataacaaccagtggattatatctaagaggtgagaattgtgattaaagtttttgaaaattttccatgtgcttaaaatctagacactcccataatttataacggagttagcatagaactacatatttagccataatataacaaagcggcaaatttagcactaattttatttgccaaacaacgtatattttagaagttttactaggataactatggcatgatttaacctttaaaatatgtggatttacatattgtttttaaattcatagttttacattgctgtgcaaatattgctttttgtttgccattcccttctaacctacatgtcatattctacctgtcatatcatggagcatatacttcaatcatcgaatagaaaaaccgataatttgccctgagaaaaagtggaaagctaacagcgaaacttatattgtccgaaaggcgaaagtgttcgctgacaggaacgcgccacaagcgttcgctcccacattagcattcccgagacatggacgccgtgcgcacggtttcctggttccgaagagggattctaatcatcaaaatggatgtattacatgttaacatagttattaaattcgattatagaaatcgatttcttcaagttatataaaaataataaattaaattttaattaatatacgcaaatgaacattgaatgccattctcgcattgaagttcatcaatctttttacaacgtgaataaaaaagcctcaagaaaaacaaaggagaaatggccttcggttcctcgcctcattgtttcagcctcacgagcttgataaagatgcagaagtcatgcgcgaacgcggtcaccgcgatgg

SEQ ID NO: 37579 - DNA, 329 bp, Oryza sativa
catatctcccgatccgtaattctgattaaccccgttccacttccagtattcccgtaaaatcgagatctatttaatggcactattatttagtctaaataggatccttttcttggtcttttgtttaggttttgattgtttgcgtatagttgcggttaccggatttttgtcgatcgtgggatttctcgaagattcgtgaagcttcgtgaagaccttgagcaaggcaagtcaccgtttgatcatttgctcctataattggaaactcattattgttttgttttcaacttgcattagtagaatcacacacttaacttgcttggcctcggtttgcg

SEQ ID NO: 37580 - DNA, 1501 bp, Oryza sativa
tgaggtaaccctgggtcggcttgggaaaggctttgttgcgaacctccgataccgatgggtgtttggaataagttcgtatcttatgggtaaagtgtacccctctgcagaggttaacttactgttcgaacagccgtgcccacggtaatgggcggatgtaaggtggttcccgttgcgtagatttgtttgcttgtgcttggtgaaaagttgttgtggtgtgggaatcgtaaccagaatcagcctatgtggcagatggatgacctgagtggtcagaaacgaatctatgtgattcgggatgtctgcgggcatcatagactaggcttcccgagtggaagcggattgttgtgctgctgggcagctggactctgggagtccaagaaaatgaaaaaggctctgggagccgatttaatcaagtgaaatggctctgggagccgagaagtaatgatctgacccgggaggttggtacattatcaattgagttgttgaaatttgatacgcaagtctcttttcgacccgaacttaaaaagaaataaatcacttagtgatttcaaaatgatttcaaacaaaagatttaccaaaacaaccttgcctctcttccaagcttgcatcaaacacctaaattcccgtgacttgctgagtacgaaagtactcacccttgctctatataaatatatatagttcctccgccctgaagagaagataaagtgaagtgaagattagggtttcgtcctggttcccagccgtcgcctgtggtgttgggtgttagtccgttggttccgctgctgctgctgttgttggtgttttcctcgtccgcgtcgtcggttgcattctcgggctgttctgagctgcaacctaagttaaggtaaataagtcctttatttattttaaggattgcaatgattcatatttttcatcgtgggtaccagcactatgtcctgggactggtactgtaatcgcggattcgtaagaagcggttcacgccgttttttctacgacacgctcctgtcaggtgccgttgtatggcagtgccgaattggggtgtgacaataatctactgaacagtctatcaaatggacatgatctttgcaccaccaaacctactatgtggcatccacaattcgacatgccacctcccctccaagcggccgtactcgattcatttttgcttaatatcatatcacacattaaatattctctctatcaaaaaaaagtcgaactctagggatgaatttaaacatggtaatgcatccctagagttggactcatttcgagatatagggagtagtttggaagtaagttggaataatatacttaatttaaagtgcgatgtgcaggcttagtccatggcgtgcactaattgaggcccaatcatttatcctcttcagattgcatcatgtactgtgacgagttctttaacttcatccgcgttacgttgagagtcaactgtcgaggtcaacgctcgattcaccatttagcaaatcgcattcaagtcaatttgctgttt

SEQ ID NO: 37581 - DNA, 1501 bp, Oryza sativa
gatgccgccgctcgccgccgtgtcgccgcttgtccaggtgatggtcgaacacctgaccaggttcacggagaccatcgcggtgaccgcgttcgcgcatgacttctgcatctttatcaagctcgtgaggctgaaacaatgaggcgaggaaccgaaggccatttctcctttgtttttcttgaggcttttttattcacgttgtaaaaagattgatgaacttcaatgcgagaatggcattcaatgttcatttgcgtatattaattaaaatttaatttattatttttatataacttgaagaaatcgatttctataatcgaatttaataactatgttaacatgtaatacatccattttgatgattagaatccctcttcggaaccaggaaaccgtgcgcacggcgtccatgtctcgggaatgctaatgtgggagcgaacgcttgtggcgcgttcctgtcagcgaacactttcgcctttcggacaatataagtttcgctgttagctttccactttttctcagggcaaattatcggtttttctattcgatgattgaagtatatgctccatgatatgacaggtagaatatgacatgtaggttagaagggaatggcaaacaaaaagcaatatttgcacagcaatgtaaaactatgaatttaaaaacaatatgtaaatccacatattttaaaggttaaatcatgccatagttatcctagtaaaacttctaaaatatacgttgtttggcaaataaaattagtgctaaatttgccgctttgttatattatggctaaatatgtagttctatgctaactccgttataaattatgggagtgtctagattttaagcacatggaaaattttcaaaaactttaatcacaattctcacctcttagatataatccactggttgttatcaatacctacttatgcaaacaaaatctgtttctactaaaagattgacaaaattacataaaccaccccataacctattttgtcgcaaaagcccacccatcaaatattgtgaggccaaaattacccaaatgcttaagtcggactcaccacaaaccacactacctagcttggcttagttgatatggtccgccgggattcaagtaaaaaatggaccgaatcagttactcatgtgtcagggagagggcgagggtagagtggtttttccaacacaatgggttatgcgatggaatctcaaaacagggtgacaattataatgatttatgcaatttctcctaaaagattaaacaataaactattctaacctataaaaagaattacaaaactgcatgagataaacttataactaataaaaacttactaaattacatgaaaaaaaatgtttgaacttagataaaaataaaactctaccaaataccttacatgacagtttcatagtattgtagcctaaggctgctttcatttgaagcaccgtgagaaaaaatagtgcatcgtttttcgcgtgcgcagatattgaacggttaaaaggtatttttttaaaa

SEQ ID NO: 37582 - DNA, 892 bp, Oryza sativa
agttcacctccaatagtcgccgaaaagatccagaagccgttgaaggcatcgatccagggttcgatccctcccaatccatctattgcacgcgaagtaacgtttttatccttctaactctgttttccaaaaggtcccgcatcaagaataattttggtaactcgctgtaccaaacaatactagccgttagattgggctagatccaacaaccagcattcggtaccgtacggtaccgtttgaccataaaaaatctcaaagtttatacacagcaattagacacaaatatattgatgtgaaaagaatcagtgcacaacataaagcttgttatttctttgcttccctacccatggcatcagcaacatacatatatgaatatttatttagaaatacataaagtaaactaacattgtgacaaagtaatagtaatgacattccctactacagagagaaacaaagaagatggtattataggtgtcaggatagctaaaaccagcacctatagtgctttttctgcccacacatgcaccctcgataaaaatcggcacctatagtattactatcagtcagaagagccgacacctataatatattataggtcccagtttttacgaacctacacatacactcatattataggtattagtttatttaaaaatgaacacctactaaaaaaaccagaaggtgccgaccgaaccaaccaaccttatctgctcccagtcagcattatccccacagttctcctccacactgatgccgcactcacccccttctcctccgtcctccacatcctagacacactcccacccgccccctaccgcggcctctccccacctgcctccaccgtgcctcctccccaccgtggcggcaacagagatgactactctgctctcctagc

SEQ ID NO: 37583 - DNA, 1501 bp, Oryza sativa
tgttttggtaaggaagaaaaaaaatcacagcacacatatatgtgaaaggatttgttcccacgacctctattttaccgaaataacatgttaacgagagattcttgaaagttatatacaagttacactatagttacagtgtaattacatgcaagttacagtgtaattacactatgattgtactgtaattacatctgacaaatttttggaggaaaatttgtcgacaaatatatagcaaattcgtctcctttttatattagtatatatatttttgtcagacccatgaacgaaataatttgatcagtgccaacaaccaatcctcataccatttcaattattacgatattacatactcgatcgtgagtattcaaattcagttggaagaactttaatttaaattaacacactaattaaaattaacacacatagtagttgtttttttgggagaacactctacataaaaaaaggtcaaaattactatttcgaaggaatcaagaacaaattcagatgaagcagtaatattggcaccgcagctccacagagacaggcgcctgctaaatggaaagtttgaagttttttctgaactaatagtggattccttcaaccgagttaaatggacaagcacaaagagatacgaagaagaaaaggaaggaccatgccgtgtgggtatggggtacccataatctccacagtagcccctgagaccttcacagtcgaaaagataatcttgtctcgaaccaaatttctccaaagccgagtgcttcaatcatcttcgatatggtctcccgagtacttttaacaaagataatcttgtctcgaaccaaatttctccaaagccgagtgcttcaatcatcttcgatatggtctcccgagtacttttaacaaatctgaagattgtggaaggctgaaaaataaagtcagctgcatcaactagatgcacctaataggtgtagcccccgactatatgtggttagttgaacaaactaagcatatagtcaaggaataaataatccaactaaccgaatggttttgataattatagtcaaccaagtgacttgatatcaatatatagcatatgtggtgtgaatcccccaaataacatgatctaagtgatataccgactactttgtaaaaattgatgcgaacaacctaaagttgactacatcattaaaaattcacataacaaaacagctataaaaaagcttgtatgctttaaataaagaaatttccaaagtattgggcatacaccatgcgcacactgctttaacaaatgtgcttaagtctctaaaacacacatggtttcaccacacctggaaatatatagcatatatggtgtaaaatccgagtaaataaactcataaaggatttaccaaccgcttggaaaatgaccacaatatataatcagcctaagccataatattagtcaataaaaatgcacacttacgtggcaaaaagcaataatatagtatccgatcaattgcttgataaacccaaatagcgcctt

SEQ ID NO: 37584 - DNA, 1501 bp, Oryza sativa
gaaataattaaggaggtaactctggctcggacgtccgatgtttggggaaaaatcgggcgctgacgtcagcgtccgatttacgtgtaaaaactactttaaactgatttttctcttaaattacttatccaaatcatgattcgattgcaccattaaattcgttgcaattaaatctttaaaacaagaccacacatggatatattccgacgaaattttttttagcttattattgaattatttttaaatgttgcacgatgttccaccaggtatatcagaattgtttcactaaatagatcgaaaatgtttcactcatttaaatcgggtgttgtttcaccttatataaaaataatgttttagcaaatagagaaagaatatttcagttcactgcaacatttgatccatacatagtgaaacattataagtacactaggtgaaacatttttcggtggaacaaaaaatgaaacgaattcccttgatagggggtttctaaaatatatgggttttttttgttgcaatggaatatttcagttcactgcaacattagatctatacatagtgaaacattgtgagtacactaggtgaaacattttctgtggaataaaaaataaaccaaattcccttaatagggggtttccaaaatatgtgggtgatttgttgcaacgacgcgttccataatatcaaaatccactgcaacatttgattcgtacatattgaaaaatcgcaagtacactagctgaaacatcataaacctactggttgaaacatcaaacgagatcatatgcaacattcaaaaaaatatcaatatagaagctaaaatatttttttatcaaaatataatcatgtgtagtcttgtcgtaaagatttaattgcaatgaatacaacaatatgattggatcgtagattggataattagtttaagagaaaaattgttttaaaactagagcaacaggaggcgcgggcgccaaggcgtccgatttttttttctgacgtcggacgcgcggcacggggtattctccaataattaaccatgattacgtcaaacttgtaaaatgtatcacaaagcttatatatatatacttatgtcaaagcaaatttatttagagaatttactacgtgcatgtcattatatcaaatttactatgcatgtattgtattaagtacaagtttactgtatatttattcattcagtaaatagtcccactgcttcacggatatcgattccacgagctggcaactggtaactcttcctattgacttgcatcagtagttacttttgaaatctgaaaatacaaaattttaatggttttctaagtaaatactactatgtatcttatgtatctttatcgtaaaatgaccagaacttaggtagaaatattatttatttagaggaccctaaaataaaaaatttttgtaggggtgcttgtgtaaaactagcaggagaatttaaaaaacacaattggattttcaatgtgaagaagtcacgtgaacactctccataatccct

SEQ ID NO: 37585 - DNA, 196 bp, Oryza sativa
gcgtgtagtccaactgcctgggcttaaacactaggtagacgacgggggcgaaggccgtgagcgcgacgatgagcaagacgagcatgaggaggagccaggagcagacgcggacgcaggagcagcgggcgtggcgcctggcgcgcgcggcgggtgtagtgctggaagaggtgcgcgttctccggcggcgggacgcgga

SEQ ID NO: 37586 - DNA, 277 bp, Oryza sativa
cagcatggcatggcgcatgccggtgcgggaaaggcactgtagggcggtgcgacagacggtgggcgcgggcgatcggcgcggaacggcacgtacaggcagaagacggcggagaggcggggacaaatggggatggccggtagactcgtcgccggagtagacgagtggctgacgagtccgtcggcggcggactcgtcagcaccttcagcaggatgttgcggtcgagcaggatgttggccggcttgaggtctcggcgcacgagcgactccggcttggtctg

SEQ ID NO: 37587 - DNA, 365 bp, Oryza sativa
ttacgatattcatgttttaccgcacatctcatcaggaacctaactttagaaaatatatatatatatatatatatatatatatgcacaccatacattacatgcggccaaaacgaagccatccatccatctatccatgatccatcctattgttagtttttgccatgaaatcatgaacgcgtgcagtaatacacacccctagaacgcacactctacccagccatattaatcctctcatatctttgacacacgctacactataaaatcagttatccatagccaacaattcatcacagattcaccaaccagaagactactcccgtcgtcatctgtgtgaggctagctagctctagctcgatcgatcgaca

SEQ ID NO: 37588 - DNA, 478 bp, Oryza sativa
cccaaaatcaatctagaaagattgaacgaagaattaggtgaattgtactcttttctcttagataagttttcccagcagtttcttatcaaggtttttaacgaggcgattcgtgtgacattgcaagcgtatgctatgtactctttctctaaatttttcccactggatttttctgaagttttgatgaggcatagacatcacgcggtgagtgccaagggggagtgttaggaaacctatggggttgggtccatgaaggcccaacccatatacactaattgggcccacacctaaacattccatatatgcaatatggctatataaagaggaggctgctcactttgtacacttgtgcttaatcaatgaaaagagtgcctcaccctatatcttgtgtctccacttttgtagaactatgcaatcccttttggactacctcagtagcaggaggggttgcataatactttcttttttaaaaggaaaaagt

SEQ ID NO: 37589 - DNA, 1501 bp, Oryza sativa
atctcgatcgactgcaattgcataattgcatttcactcgtgcgtggaaggatcatggagattaaattaaaacgagaatggtgagccagaacattgtgggaggaactgcggctggaatcagattccttttgctgcagatctacctgcttcaggtagcaaccagatgcagctcatggcttcacctcctttgcatccgctgctttgcctcccaaaacaactctggttttagcatccccagtctgaccactcccagttagcctaaaaggaaaaaaagaaaagcagaaacacccaactagaagcaacatataaagaatgaaatactttgcacgaaatttttcacatgatccaagcacttggaattgcttaatctgttataatcagtttagtatcagcatggagcacgctggattaattccgctataagcaaccctcccaagaactcacttgttttacaagtatgtcagcgtcacgtttaagcagagagtaagaaacagtgacgcacgcagagaattccattccaaccccaaaaatagaacagaaaaattgctaccttccgtggcaaggaagaaatgaccaaacccacagtgccagtacatgcggtgaaaagcagccgagactgtacgagatcggtctaataaaagaatgatttttcaccgttctacaggtctgaaagaatgaattttcaaaattcaaaaagaaaaaaaagagagaatgatttttcatcgtttctacatggaaccagcgaggattttttttaatcttttgaacttttatttttttcaattttaaaaatagaccttttcaaaacttctttctataatccgaaccaatcgacgtgatatggcaaaacaatactgacacgctacacgcagtggacatgatagttttattctgtcatgccagcaaggatggcgtggccacgcccgtcaaatcggcgtgaccaaataacgcggagtgacaatgttgtttttttacaccagttcggctagcgtagcccaaaaggttaatatcttgaaaatacgttttgaaaaatgtttatttttaaaactaaaaattaaaaagttcaaagaaaaaaaaattcaaccatcaatgcagcagcggaaacagtaatagtactctctgccaacttaccaagatgctgcgggggactcacccactccgctttttttgagtcgtttcgtggccggatttgacgcagttttccgcagccctcggcgtcgccgtccgtgcgtggtttcgtgccgcgcgacacggtcaaggcacaagccacagccacagcgcctacatatctcgccattgccggtgcagacgcttcctcaactctgtcctctcttcttcttcttctttacaagctctggtactcgctgtctccgtctctgcatttcggtctctggctctctgctgcttcgtgttcgtgggcgattggtttttcttggcttcttgttcatcttggatttgatcgattcgatggctgagttgcggacgtcgtggaagtcgatgct

SEQ ID NO: 37590 - DNA, 186 bp, Oryza sativa
aatcatatatcaagatatctagtaattaggtgtacgggattcctaactaggcgttgacgtttgccattctgcatgcatcacatactacgactaccatatccgttgatggataagatatggacacatctgccgaacaccagatttctgaaggaacccagctcgtaaggtacctgcgcctccacactt

SEQ ID NO: 37591 - DNA, 1501 bp, Oryza sativa
atgcgccgcgcccgccgccgctcgccatagctcgccacgcgctcttgctctgtcccggaggccgcctctcgtcgccagccaatctcggtgccgcttcgtccaatccgacgccggaaacggattccttgaaccccggagatgctcccacccctttgaatcgaaccctcgtcgtctcgtcgtgttttccccttttgctctctggtgattgccgcaccgcaatccaccgtcgtcggctcctctcgcgtcgattcctctcgccgccacgctcccggggatccccttgacctccccctggctgccccaaggccgtcggccttctcctttgtctccgcgccatgtcgccgcttccgccgccgcctaacgccgccgtgcgtgcgccgccggtgaccatcgggtcacgcgtcaccgcgtgcgcgtcgcaacaccataccggttcggctaagcccgagcccgcgcacccttcgctcttctcgcgcgcggccacgtcggcgtgccggcgagattggccgccgccgccggccgtcgtcgcgcgtcctcttcctgatccgagctgtggaatgagttccccttctcctcctcctgccgccagtgctagccgccccttccggctcgccgctgttcgccggatcccgccgcgcgccgcgggccgtccgatgagccgcccggcctcctctcccttccccatccgacgtgacgtccacgtggcagccacctcagccccgggcccgcttgactgggtcaagtcgcgcccagtcagcctcctccatccgtcttccctcccgtgcgcgcagtccacggcaagccgtgcggctgcacatgggcccgccgccatccgtctacccggcgcgccgcgcctgaaccgcgcgcacccgaaaccctagcgcccgcccccgcgtgcgccctccccaccgtgaacccaaccaccgccatgtgggtcccgcgcggtggaccgcgcccaccccgtcgggcctccctctctccccgcgcgccctaatgggccgcctccccgtggccgcgctcggcccaatggccggccaagccttgtgaatccctcgggccgcgcctaagtcgcccgaggaagtctaaatccgatccctccttccttttcttttccaagggaattaataattccttttccttgtccagaaaatccatttagacctccaaaattcatatccctcgatccgtagctccgattgactccgttcagcttccagtaattccgtaaaattgagatctatttaatggcactactaataggtctaaataggatctttcttttggtcttttgtttaggttttcgattatttgcatatagttgcggttatcggattttcgtcgatcgcgggttttctcgaagattcatgaagcttcgtgaagaccttgaacaaggcaagtcaccctttgatcaattgcccctataattaaaaagtcattattattttgtttgcaacttgcattactagaatcacacacttaacttgtttggcctcggtttgcg

SEQ ID NO: 37592 - DNA, 217 bp, Oryza sativa
tgttatacctaattttgatagtccatgactactataaaagaataaggtggtcttgaaagtgtggggcaacacgagtcgtagctgagtcggtcgacccaccccgcctaatgggtagatccgcccctgcctggaacggtcgcgacaaacccgcggctcggcgaggccgcgctccgacgggtcggcacgtaagcggcggtggtggaccggctggtggaga

SEQ ID NO: 37593 - DNA, 1501 bp, Oryza sativa
tgctcaaaacatttgcagaaaatcatgtgtggagcatggccatactctcacctctggtgtcggagctttcttcctttgtccattcaaccagcaaatccactcaactacaagtgtgacacaactatcagcaaaatccaagcacgtcgattcatacttcagaaatcagaatcaaaagttcacaaaccatacatgcctgcagaaacaaagtgccaagtcagtaatcatatcaggttctctacacaggccagaaattgaagttgatcaaccgaaagagaagaagaggtaacctggaacagtggtcggatcctggtcgctccccttgaactccacccaccgtttctccttcactggtcaaagccatccaagaaatgagccgccgccattgatgtagcctacgagactgaatttgaattgaaggagatgtgggagacgtactgacgccgtcgacctcctcgacgcgggtgaagtagcggttgccgaacttgtcggcgcccacctgcgcccgcgagcggaacatccccagcagccgcgacaccagctgcttcgacatcgcccgagacagcgatggagggttatctcgcggaggacgacggatgagatgaacggggtcgaactcgaggagggcggcggcggcggcggccaccgctcgtcgtggtcgacgacggcgaggtcgcgggggacggcggtggtcggcggtggcgcttggccgccggcggcgagggtagagatgcgaatttgggggacggggagaaagggagtcggagagggaggcttccgtcctgacaagtgggcccaccatactaactggccgtctggccccacatgcagcctctcgagattcggatccatctcaaagaaggccctccttacatgggccttctaggcccaagccgtatcgtgcacgcctcggaatggataagtccactttgacaccctcatagtatagctttaatctaatccgtatcttaaacctcaataccggatattttaaccccacaactattgaaaccggtgcaaaataactttctcagtggtttcagaggacgtttttgctgacgtggcgttttgacccgatccaaccggctaactcaacagtgggactcaaagaattctcctctttattcttcctctccttccccacaaacgcacacggcgactcaatggcggactgcggtggtgcaatccttccccgggcaagagacaccccttcgtggctccgccaccgccgctactggtgaccaaatgagagatacgccgtgtgatattaaacgaggccaaatgggtttacttttcccatggaatcgatttagcattaaagggtgggagcagcgaccatcgctgtgtttgtcgctcgccagtcaccaccgctgagaatggcctttgggtttcgtcttctccttttttcaatttaaatttcaaaaaaaaacctcgtgttatttttttttgaacgaatcggcaagctgccaatttcattgaataaaggaggaataaattttacaag

SEQ ID NO: 37594 - DNA, 663 bp, Oryza sativa
atcactatctgtttcctatatgcaagtaattttcagggcaacatattggcttcgactgtgggctcaactacaaaagtgtgaggaagatggagaatttctgtctgatggagattcaccaataaactggaataatgttttccttgtcatattaggatttcttttatttttggttggtgtgcttgttttattttggactgcgtctttttagtgtgctacttcttgtaataattggctatagctctcctaaacaaaggccggaatgttttattccattatctaaaaaaaaatctaacaatgacagtatgtgttgcaccctgcattgtcatgaccgatgcttcaaagaacctctttgctattcaactgttgtgatcttgtgattggtatcctattcatttcgatggaatatgattatttccctttcttataccatgtttagcattgccaccttttcacacttcttttcttagcatttagctaataatcgcgtaatagagtatatgcatccttaccaaggatttaaatctccggttatagctaccactatagccggagatagttgttaggaaaggaatcatctaagatatgctgattttgccgctacacattctcagccgctaatagctggtattagcgggagatggctggtaaatagacctcgaatta

SEQ ID NO: 37595 - DNA, 1501 bp, Oryza sativa
acaagttttttaacggaaaactttcaaaatctaagtgtagtataattgtaatataattccactttaattatattgtaactataatataatttgtatataacactggtagagaaaccatttttggtcggtcgacccaaatccataatagtcccgattccattaaaaaccgggactaaaaattagtcccggttaataagaggaagatctttagtcccggttgttgttaccaaccgggactaaaaatcatctttagtcccggttggtaacagggactaaagttcatttttagttccggttgattccttgccagggccctaggatctttagtcccggttagtaacaccaaccgggactaaaaacctatttttagttccggttgatgttactaactgggaataaaaatcaaaacacactatataatccctagtaccgatcctcttttcccgtccacacaacaaactcctccctctatctcattttttttcctctctaacttcttatctctttccttatctctaactcctctcctctccttccttttttttccttcaccccacaagtttgcgaagcgtgcaggcggccggcgcgggcgaggtaggcggcggcggcgggtggccggcgcaaaggggaggcggggtggcggcagtggccgccgaccggattttttttcttttttttttgagatgtgaatctgtgatgtatttttgtatgagatgtgaatctgtgatgaattttttagaaccctgtgatgtaattttttttaagagtttgtgatgtatttggagatgatctatttttttaagagtttgtgatgtatttggagataatttgtttgaggatttgaggatttggagatgttctgtgatatgtgatgatttggatataggaggggatggtgtgaagtcaatattcaatattaaaaacagaaaaaaaaagaaaaaaatatctttagtcccagttggtttggtaacaccaaccaggactagagatcgatttttagtcccggttatttgaaccgggacttcccgggttcgtagtcccggttgaaaaccgggactacaaggggggttacgaaccgggactaaaaagcacttctccaccagtgtaagtattaaagtaatatatgcaactttgtatctaacttaatatagagattacaatgtcattatagtgcagttacaatgtaattatagtgtaattacagtctagttacattacaactgtactatatatagttgcatttgaaagttttttttcccaaaaaacttgcgatatttttttagcaattccgatcttgcaatcagtatagacagaaatcttgaaaccatatagacaataacacaaccgtaaaaagggttatcatagactttataagcacaatcacaggtggttctgaacactgccactatcagagacgattcaagactaaactaaaagagaaacagttacgatattcatgttttaccgcacatctcatcaggaacctaactttagaaaagct

SEQ ID NO: 37596 - DNA, 415 bp, Oryza sativa
tgcgaagttcttctatttcctgcttttgcctcttcagcagagctgcatctgttaaaatctggcatgccagtgactattattaggtactcaacgcttgacatgctaataaatttgaacttaaaaaaaatagtcatttaatgtagtaagatagacagagggcaatatttggatgaatactgaaagagcaatgactgttattaaatatattatacaagttatacctcatccttaagagacgtaaagaaacaaacacaagacatcttataaatagtgagacttaataagcggtaggttaatagtgctacaggaattagttcagaacaatatacttagggcccctttgaatcgcagggtagaaaaaacggaggaataggaaaaacacaggattctgacaggaattgaagtgtaaaacaga

SEQ ID NO: 37597 - DNA, 1501 bp, Oryza sativa
cccccctcgatcacctccgcaacctaaaccgattcatgtatctaggttgagaattgagattgatctaagtcggctaggtccttaagatcttcaatttagtgagattgatctgcaagcatcctggctccttttttttccctgattgatttgagcagggtagtgtagtgctcaagtattccttcctgttccaatgtggatttgtttgcaaaaaaaaaagtagtactagtttcatcgttcagggaaaaaacaatagtttgatctgtaaaaaaaaaaagagtaggtatatttgtggcgccatattttccaatagtcgacttgtatttacattgtaagtcctagattacatatgcaattttagtgcatttataatgtaggtcccaaaattacatatgtaaatcaaaaaattacatagtaattatatatgtaagtggtgtgtaactactatgtaaatttataaatttaaatcttacattggaaaagttaaaaagcaaaagcatatgcagtccttactttctaggagatgatcaggagaagaaatcgaacggtccgaacaggcacaaccgaagacgtgtagcgatcagacggatagcaaagccgactgagatcagccccaaaaaatgtcgacatctttttagcaagtctgaagaaaaagtggttcgggagaagattttaagagatacttgaacaacggatggttccagaggaggcatccagtatcaataaaaccacgagtgtaacagtgcttatgtgcagttccaggaaaaaatagaacattttttttctgtttgtgcttatgtgctttgactttgttgtttccttctgttagtatctttattaattaggagtaaccattaccatacataatattgttgcagatggagtgattacttccatggctaaacggaagggcacactcctccaagggggtggtagttctcagggtggtaaaagattgagatattcagggccagacctcccagaggtatgccataagagtttaggctttgtttaatcctctatgtgaaataatactccgtacacaataatgataatgccttcatcacgaaagaaagaaagaaaacgttaataaggagcctaccaaaatctactgagatccttcttcagttaaaggcagcaatatgtaaagattgcagccatctttgaggcattgtgaccgtaaatacaaagtgatacgagaacactccctaatatacaggcaaccttgtatagaatacttcctattccagtgcactaactttttctttgatgcatgtcctagtaggcaacatgccactacactgcgaaagagtcccaagtgcaccagctttttctttgatgcagaacatttcatgctgacattcacagatcatctgtggtagaatgttattctgcgtggttctgttttccttagttgaatatttgcctttatagtctcaatgttcaattgttctttccatgcttgtgcaggacatttggcgccatatacatttcctaatgccac

SEQ ID NO: 37598 - DNA, 393 bp, Oryza sativa
ggttgttcaggcatgatataaaccactggtggcctcacactgtgtgaccactaactgacaacagaatcactatggagtaagcataacaaacctgacagattactgtggagtaagtgcatatggtccaccctaaatttcaactatgggttatataagacttaaaagtgatcatgtggtccactctgaaatttcagagtggctgaatttgtactcttaagtcttaacacacaatcctcaatcatgacatctgtgtctaggcagcaaatttaaagagtctgacaaaatttaggctcacatagtgttgatttcacaaagatcaatgtacctgttttactgttcacaatcctggcacatatcttcctcaccatagctagacataaaaatcctaaaact

SEQ ID NO: 37599 - DNA, 1501 bp, Oryza sativa
gagcagggtattgtagtgctccttcctcttccaatgtggatttgttttgtttactatatatgaaaaaaaaagtagcttaagagaagataaatgatgcagtgatcaaacaatggatggcagattaagatgcaaattctaccttgactttctaattaagaattaccctgttcttttttattaagatataaattatatctcgattttcattagaacgttttttttaaactgccaaatgatatgtttcattctaaaaccttttatatagaagttgttttaaaatatcaaataaatccaaattttaagattgtaataataactaaaacttaactaatcatatgctgctaatgacttatcctgcggtgaaaaatcttcatcttcgtataagtcaaacggcaactaagacgcatttacgtacccatttatgtttagagaaacaaaactccccttaggaaacgttgcatgcaaaaaaaaaaaaatcttcactttgttgttttcttctgttagtgtctgtattattcattattatacattatttgttgcagatggagtaattacttccatggctaaacgaaagggcgccttcctccaaggggatgatacttctcagggtggtaaaagattgagatattcagagccatacctcacggaggtaggacataatattgattgtgaaatatttattatacgtagcaagtaaaaatatatcattgctctaacttgagtctgcatacattgagtggacctatgctaagccaactaaaaataagcgacgtattttttttatagtattttagtactttgttataatgtgggcttagcaaccgtaaagtcataaaccgaaagagtttatttttctttttaaaaaaactagcatatgaatatttgatttttatatttttcttgttcgaggtcttacctgtggggggagctcccacttttcgtgggtctcatatgatagttggggacggtaaccaccatcaccaccactatcttcttaactagtcatatccccgttttttaatacatgacgtcgttaactttttgatattcgtttgaccattcgttttattaaaaaaaatgtaattattatttattttgttatgaattgatttgtcattataggtttttaagcatgacttgtattttttttatgtttgcacaaaatttttaaataagataaatgatcaaacatatgtttaaaagtcaacgttgtcatatattaaaaaaatagaggtactatatgaaaaaaactgcatgtttcaaaaaaaggggaattcctctttttttttctcagttaataacaaagaagcacaaaaagccaaatcaacttgatttattgctaatatttgcagatcacatgtggtacaatcttatctgtatggccggtcctatttttcttagttggagcaaactatttgcctttataatcccaatcttcaactgttctttccccccacgcttgtgcaggacatttggcgccatatacattccctaatgccgc

SEQ ID NO: 37600 - DNA, 564 bp, Oryza sativa
tggttgtgagacatgtgaattttggtgggatagtgatggtgaattgagaaataaactccctccttttcaatacctgggcaggggtggtaattgggagggaattcctcctttacttcgcataaacaaatctcagccatccattttcattaataatctaatctccaactaatctctctatcaatttccaccacctctaccaaacaagagactgggatgaaaaatcaaattcccatcttaatctcaccatcaattccttcgtgtaaactcccaatccccttccctcgagttgccaaacaagccgtccaaagctatcgagagatgagcaggagcgaaccacaatgacgcaacacatatatctattcgtgtcacaaactttacatttcataccacttaaaaaagtattaatatgattttttaagcaactttttatagaaagtttttttaaatatatacaatatttagcaattcgggaaacgtgtgtttagaaaataatattcttttttcttctctttgttcaactctcaaaccgcctaaaacttctctctccgtatcacgatcgccaga

SEQ ID NO: 37601 - DNA, 497 bp, Oryza sativa
tttttaaaatactaaaactttctaccagaaataaaatgcttccttttcctaaaaaggaaccagagatattcccctacaatgacctaaaatttgtcgcagtgggcccatggtcaaacaacagaaaaaacacaaaaaatggaatcatgctaaacatgggataaggggggaaaaagaaagctgcatttaacaggaaaaaatgggatcgcatgccttggaggaatgtgaaaagcttatatcgttgtaatgattagagccaaagaaagaaaacacatagaggccagagaactgtttgttggccatgaatgcgcagccatgacatattttgtttacagttacctgaatacatgtttcagcagtcaattacacattgttctattcgctcatcttcatatttttgctattgtacttgcctgcattggtttctctatgattgttatttcaatagcttatatgtcaactcgcatgatccactcatgatatttctttacttgtataga

SEQ ID NO: 37602 - DNA, 1501 bp, Oryza sativa
tggctgaatttcttccatcccaatatattaccacttccgatgagatttaacccatcctatataagaatattttgggacaggggtagaagtatcttacatacagtggcaccgactagggggtgtcggagggtgccaacaccccctgtttttactctatattaaggttaactaagataagtatttatctagtttatttgtatagcttgaaaatattatcagtttagttagttagcaagtctaagaacattagcaagaaccataatctacaaaattagtttgtgatttctcatcttttttcaaagtaaaatagatgatacttacttgtgagattattcaatagttttatgatacttatttgtgagattattcaatagtttacattgaaagaatttagcaataattactagttttaaactttcaatgatattattaaagagctaaattttaagttttttaaaggactagtttacgcattgattgttattgatggtgattatttgacctcctttgctatcaatattagttattcggtctcatggcatatcctctcaccacaccccctaatcttaaatcctagcttcgcccctaccccatgcgtacatatgctttttaagggacactcttggtcaaatatttagttggagtagctgatataatgtgcacaacaagtaatgaattgatatcgggaatataagtccatcaaaccatacaagagtcgaagcttgctatgtacagacgtacaaccagaagggttttccacgtttctatgaacggtgagtgtgttcttttctcttctttatcaacttctactctttcattcttagcaaacatgttttccaaactgttaaaaaatatatttttaataaaaaaatcacaaaaaatacttttaaaaatcgtattaatttatttttttaagtttatttagctaatagttaattattatgtgttaatcgataattccattatacgtacgaccggtagaagtgtttgtaaaccctcaaaacaacacatccttaagagttagtaagactgagacttgggtcagttgggtgtagtactgtagtgaacgaataaacgctcactctcttctcaagatgcactacaaaattggaaaaaaaatttcttttttgaaaggatggcaaaagctttgccacttcaaaatttgaaacgaatgactccaaaacaaatgcctcacacctgtcagaataccttctcaaccatccgcagcatgcaaaattgtcctgtctgaagaagagacgaagaagacgcattaaaccccgtttctcttgctttcgacccagcctacagttcttcccccccccccccttaattttctttagcggttttcaggctgtgtttagttcacatcaaaattagaagtttgatttaaattgaaacgatgtgatgaaaaagttaaaagtttatatgtgtaggaaaattttgatgtgataaaaaagttgaaagtttgaagaattattctgtaactaaacacggcgtcagt

SEQ ID NO: 37603 - DNA, 1501 bp, Oryza sativa
ggtaatgcgaaataatcctaacaaactactatatatgtaacttgaaatcctaaacaccatgggaactatacaggacaccaacagtttggataatcagcatccaaaaagaacactcattttaagttgttagcgaagagcacaataacagtccaacagataagcttgtatcagcttgcaaagagtcgttaaagtctgatacatgtgaataaaatagtagccttcctgctcttcccaaattctattatattccatgtaatagatagatgggaggaaactacaacatgccgaactagattctaaagttgtggcctcatcaaatagtgaagcagcaaatggctaacagtcttagattaaagaacaagaatgggatcatcaaaatagcttatttagtacaacaaaactatcacagcattaaaatgaaaacataaaagtatgttagaaaactaaccgcatagacatgcttagcccctgcttttgcacagaaaagtgagaggatcccagtcccagcaccaacatcaaggactattttgtccttgaaaagaaagctgttctgggtgataacattttgatatgattttgtccgaaccacatcttttagcatttcctgcaatcagcacgataaagtaattggcatctcgacaacacttggtttgcacatttagatgcataaatcatctgcctaaagttaatgtgcacaaaaaaatcggatgaaaactggtttcttgtgaactgtggtgcaacaaaggaggctgatttcttccagattcacttacttcatgaatacctgcaagacaagtacacctcataaagttactgcgcaaaacagagcaggagcattataaactgcgcaaggtaataaattacacaataactttaggcaaaaccggagcacacagtatcaatgaaaatctcaagacctgtacagatcaaaagctaaaattattcagcagtgcaaagtgaaaatcccaaaagaccaactgaatctcaaaaaacctatgttcaattgcagtcctgataaatcaacaacagaagtacaaaaccaactaaataccaatctgtcatacaaccaccattgccaaaaaacaaaaatgaattgttaccacccaacctgctactaaatgaatgatgcgggtgcacttaacggctaacacgcaaaaaaccttcaatctttcacagcattactgtcaagaacaaccaaaatataatatctcaatccaagtaacaacactacatatgaatatacgttatattttaggccgcacaaattcgcaccagatatcgaaccttccccctaacaactaaaacagcacaaaaatctaaaaacttcattgctctattaattagcattatcatcacccaaaaaagaaaatctgcggaacagtacagcatctccaagaaaccggatcgagcgcgagcgccgcttaccgaagtgggagtaggagtcgaagtagtagtcggcgctggtcttgtcgctgccgatcacctcctcccctcctcctcc

SEQ ID NO: 37604 - DNA, 1042 bp, Oryza sativa
agtactgtatgcgaggatctcaattgacttctattacgctagttctcctctatgagagagagagagagattgagagagcgctgcagccgccacctattctcgccttggccatgggaggatcacgattcacgagctggagctggagctcgagcagtcaacagaagaagggaggaaaggaatcctccctcaccccacccgagcaggtattgggctcggaatcggaaggggaattggaagcggaagcggaagcggagccgattctgatgatctgatctgatcgaggccaggggactaatatcttgttgtaaggaacctagtggagtagtatttgatttgcctgctgcatcgacaccaatcaatctccccactactatggcttcttcgcgcgctatcgtaagtcgcagcttagattagattggatatttcgtttgcaatctccttaattaggttttcccttaatttgtttttgttgcatctatccatcttcgctttttggttaaaaacaataaatttccttcatgtacttcctccgtttcatcacaatataagtcattatattatttcccacattcatattgattttaataaatctatatatatatatatatatatatgtatatatatatatatatatatgtatatgtatatgtatatatatatatatatatatatatgtatatatatatatatatatatatatatctacctacctagattcattaacatcaatatgggaaatgctaaaatgacttacattgtgaaacggagggagtatataatatgtgtgtgctgaataaactgctgcctattgtgctgctgaatgctgatcacaatgaatgttaaattagatttggatgtccttagatttattatctttttgttaaaaaaaagaattcctttttctttccatgtttatatatgtgtatggtgaataaactgctagctcttgtgttgtgctgcactgctgctgaatgctgatcatatatactgcataaataagtataaattgttttctttaggaggaggaactcgaaactgtagg

SEQ ID NO: 37605 - DNA, 593 bp, Oryza sativa
cgcacatatcaaatcttcatcagtatgttttttaataactggcacttatattatcagtaccagatttctaagaaacgggcagtgatggatcaagtcgagctgagctgaccgggtggggtgcgtggagccgcggaggccacgaaaacatctcctctcttgttttttattccctctccggaatgatttgtttgaaatgatttataaaaattgatttgtttgaaatgaaaaaacagttactgcgctggtaattattggccaatcattcatttgataactgctaataactactgctaaccatccgctcacccataaatagtgggaatgatttgaacagtgcaaagtttagaggtcatgtgaataatccatgcatgtatattgtgaaaatcataaaagttatattttgtttattattatgagtgtaatcaacttactatactgaatccctttgaagaaaaaattactatatatactgaaacaactcaaatttgtatttttctttctaagaaaatatgctgcatcacacaggcttttaactagtactagaccgaatttttttatataataattaataacctcaaagttaaataaatagt

SEQ ID NO: 37606 - DNA, 1501 bp, Oryza sativa
ttaacgccgttgatttttttaaatatgtatatacactagaaaaaatagtacctgtgcgttacaatgggtgaagtctattttaatcttattattgttatatggtttagttaagataaaattcactatggaagttcgcttggatatatatttttttagaaaatcatgagctgcagttagctaggagtccgatcgtcccaagttagcatgtgagtttttttaaaacagatttcttatatgattccttctgtaccaaaagtgaacgatcttaaaaaccgactcaaatacagatatatatttccaaaagcaaacaaacttaaaaaccgactcatacacggatgacgtaccaaaatatcggtaaaaacaacttaaatttttgtgatagtagagatatatagaagtcattactaactcaaataaaaatatactgctatatgaattatattgttgaaaagctcccctagagcaccaaacgaagtttaatccaatcgaacgtgattgcaagcttcagtgggatcgatcgatcatgcatgacatctcgcgacatcctgctaatccctgcaatcctgttctttctcacatccacgcgtgtacgtgtttgcgggaccgccggggtggaggagctttggtgttccagggatgtcgtcgtggttcatggtcgtgtagccgatttcattgtcggcggagacgccgacatcctcgacggcggtgaggacgaggagagccaccagggacaggccgacgacgacggtcaggttcaccctagctttcgccatggcgatccgagctaatatagctagcttcacagatgatcgacgggcacctcgatcgctcgatctccttctctttctcctggtttgtgtgaatctgtgatgagttaattgttggctaaggctaactgattttatagtgtagcatatgtctaagatatgagaggattaattaatggtccaggagtgttctagctaggggtttgtattaccgcatgcattgatgatttcatggtaaaaactaacaatagcatggatcatgcagggatggatggctcattttggccaccatctaatgtatggtgtggatatatatagcttttctaaagttaggtttctgatgtgcggtgcaactgactactgtaactgttcgcttttaatttattggccgtagttttgaactaacaatccctgacagtggctttcaacggttcataaccgcctgcgaatattgtgcttataaattctatgataaaaaaaaaggctatatgtgatgagttgtgttactgcccatatggtttcatggcaagatttgtctataccgattggaagatatatataaaagaaaaaggctatatgtaccaacttttttcgtactaacactgaaacataattgactaatgcaccagaagaaatactcattacgtttcaaattacttgtcaactttgtcctaattaagtcaagtattcctaactttaactattaaattcaagaaatttatgtgtgaactata

SEQ ID NO: 37607 - DNA, 1501 bp, Oryza sativa
taaaaaccttgataagaaactgctgggaaaacttatctaagagaaaagagtacaattcacctaattcttcgttcaatctttctagattgattttgggtacttgattttctatatcaagaatctagaatgagtcagcgaaattctcccccttaattttacatttttctaagtctcattatttcgattcctcggacacacctattcaaaagaagatgtcaataatgagttagtaaaaaaatatgcaagatttccacataacttagttggttgcttctatacaattcatgtatatagaaaagcttggagttcatgtgattaatgagctttgcttcgcaagttattcatttgcatatgcgcgacatatgctgctttaatttcatatatgatgggggttgagatagttttcaaaccactattgttgaagcaggacaaccatctctcaaaaccatgtcgaggctctgaatagttcaaccatacttagttcggtttagttcaattagcgaagtattcgtgtgctgctatgacactcttgtgtttgtgtttgggaattccgtcccattttggcgataattgacttcttcaaaaaccatgcaccttgaacattttctaagtgtggttggactgatgtactagacttccatctatcgcatgcctttagctgtaagcataagcatgatctggattcgtctgaatatttcaaatcaaactcaaattcaaaacaaacaagtttgtttcttcaattctttctacattaccctattcatcctatgttagttcaagacttagtacttcttcatgtactgttatgcaagtgttcgattcaagttcctaaaatgtattaattgattatatcttcaatgcttatcaacattcaggttgagttcttcttttcaacttctagttcattaattccattcaactcctggttgactgccaatgagttttgttgtctaaaaagacattgcccataataggtctcattgccaacttctattggttatatgagactctatgcgagtatccatggatatacaaggagatgcatttttcatatgcttcttctttctgcttaatgctttttgatgtgggcatgtactagcgttagtgtgcactccaactactggttttcttccttgatgggaagatgtggcacgcctgttctgaggtttcgtagcatttgccaggtgtcaacttgcctccacgatctacactccactactgcactaccacagcgagagcaatgaacgagtggaaggccactaggacctatagcaaaccgagcagttgcaccaacgaatgggattcaatgtcacgcccagaaattcccgaatagaattccaagcagaatgtgcatcaaaacccccgtccaggaccggccggggtacacaaacgacaaagttgacatacagatccacgtcttacaaacattataaaaggtcttacataaatgcagcggaaaattaaaagataaatggagctaagccttgacttgaactgcagc

SEQ ID NO: 37608 - DNA, 1501 bp, Oryza sativa
ctcaccgtctacatcgtaggaccaaccctaaccctagatgtacacgttttctcgctagatttgtattcacttttttccatggtgactactaaaatcttgccaacataaacagctcttgatttaaatacaaatggagaaaatgtattgaatatagattggattgttttgggtaagagcgtagcatatgtttgcaatacactgcaaacatatatacagaatatccgttcatcggatggcaatctaacggcaaggtggggagccgttgccggcagcctccagcgtcaagacagaaggcacgtgtgccacaccctgcatgtgagatggtggcagcgtctcggtgggaggtggagaggcactaggttgattatgttggattgggaggtcgaatgtggatcattacctcttgatcagatggagcaaaaaatctactaattggagcgggaatttcatgtgaaaatagtttggcagttttcatgattattacactgtagccccaccatgtacaccgtggcactaaaacctatccctagatctacgactctttctcgtcagattcgtcttcaattcctctttaccatggtgattcctaaaatatcaccaacataaacaactcttgtttaatatggaagatattgttcttttttcatagtgtagcatctgtttacaaattagacttccttattcactgtaactacgagtgcgagggattaatttctatccatcggatggcaatatagcaaacggtagggggaaaccgtctatatttgttgtatgatcataatttagcgtcgacatggcatggaaaaatcttctagctgcctcggtcatcaagggagactttattggtccaaattacattagttggagaaaaaaaattattgtcccatatgaaggggtaatttcatgtgaaaaataattaggcggcccctcctctggcttcactatctgccatcattttagaaaggaaaaagtacgttttacccccgtgaactatcgcagttgaccgaattacacccttaaactcaaaaaccagacattctataccctcaactattgaaaccggacaaataaggcccctgaacactgttttgagtggttttgacttgaccttgcacacgtggcgccaaagtggcaatctaaccagcaaaaaaaaaacatggcccacctgtcatacctatcctcaaaccaatctgacaatctctcaaccattcaatctctctcacgcacacactcgggcaaggcagcgggcgaccggcggcggaggtggagctccccgggcggccggtgtctgaggcagagcgggcgaccggcgacggagacggagctccccgagcagcaggcggcggaggtggagctccccgggcggcgggtggctgaggcggaggtagagtgggtgaccgacgatgccgtggtagagagcgcggcggtggcgccgatgcgggagcaggcgtgtgtggcgtgcgggtgatggcagcgcgcggggccgggcggttggcggcgg

SEQ ID NO: 37609 - DNA, 1501 bp, Oryza sativa
ttttctcccaagttttctttaattattttaaaaataaactctaaaatggctgtatgatctgaaaaaaaaacagacaagatcattagctcaaaataattcacatgctctgtattatggctaatatctttgtcaaaccaaacatatagattgtacaattcaccttatagtcagggaatgcaaatgaacaaccaaattaaatatttctctcggcaaattttccatctctggttgtttggatcgatcaaagatttggaaattggtcaaaattttactaggtcaacataactacattaatattgtttaatgtcttctttcactaaatcagttcaagttatatgcaacaatataacattttctgatctactatgtgatcctattatagtgtgattgactctgtagtttacattcatctctaggtgtttcacatccagctaaccacaaaggatcaatgcatagattaacccacaattattgcagccctagaaagtattgttgaacttctcgtcatggaaagagtatatgtaccacacaaaagatcaatgccttgattatatgctggcatttgattcagtataattaatgtgattctacttgagtattactttcgaacgtgttgggcaactttctaaaatatctgcctcatttcaattgagttacaatagggcattctattatatattccaatagggtgcacatggcttttttttttcttacaggcaacattgctgatgtgatgtggttttcctgctctaatgttttcctgcttttagaatttgctactgatctatccttttgaattgagattttgctttcatggacatgtttataaagtgataattattaagtattcattatagattcacttgccagtataatttcattaagatatcatcttctgaccatgaaatgttttatggaaccctttttggaagagggagatatatatatgccatgtagaacttacatattattgattgcaaagcaactgctatgttaaaagattgcaacggttgatgaagagaagtatgcgatgatgttgcaaataaagaaccacctttttatgattgtggttatagcaccgtttcagttctcccatccactccattgtatggttacagcattttgttcattgtatggttgctaattttgctgaaatgcatatgattgtacaaatagtgcatagacagatcaataggaacaattcatatttgaatctttatggaaaacctgatgtgtatgccagtttgttttcacggaatattgacaactatatatgttttgtcttgcttttgttatcgagcacgcagcgtagcgcgtgattattgctagttatttgttaatggagagagtatatctatattcttaagagtttgtttacaaggaattcaatacttaagagtctaatagatgaatacctttggggattaagtgaacttttttgacaggctgatgcagcaaagttattttgggctaaacaaaacaattccacaattttagtgtt

SEQ ID NO: 37610 - DNA, 1501 bp, Oryza sativa
ctcatcaagaaggtcagcatccacaacattcattttgctgatatttttcttttcacttgaatttttcatgtttattatagtttacttaccaaaaatactttgcagtgcctgcgctaccctggaggtatagtttacatggcgggtaaaaagcattacttcggagtaggtggtggcacaaggcactttgttcgcttggttacagaagatggtaaatttatttctagttttttagtcattgagttatttatccatgtacctccataatattactcctgatgacatgcttgtttgcaaactttgaattagcaagattggagcaatacctactttttatgttgcatgaatgttaaacattttcctctgtgaaacactaaatgttatttcttttaagcttatataccaagatagcgtccattgtatgagttatgtttttgtttctttaaaggcagacatcagttgcagatgttttaaatgaatgaatttagcactctttttgaggatatgtgcattgaactatgcatatgcatatgcttaacatatcacatgccaaagctatagactagttattaacgcattgtgctaaaattcaaaatttttttggatactttatgtgtgtattacagttgcatgtcatttggtatttatgcagattttcactgttattttgttgtcatttaggggccatgcagtccgacctacttgctgaagttgctgatggatcatcgaatgttcgggaggtttggaaattatcgttcaaatagactagtattctgcttgtgatcgttgaagaaaccacaaacatgtactggctccatattggtcgagtggaagccttagtttaggtgtttcttgttctattaatgtactgggtcagttctgagataattgctacctcttttcagaggtcttatattgaatacaggaacatccttttactctttgaaaaactcatctaagtaagttttactgagatcttgatagttaccactggattgcatctcttccacttatccccttctctctgtcattatgaggtttacatcgtcttctcttgtactctcatatttgctctgacaaagctaacacttttttaattactctttgcaaagattctgtgtaattccaatggcagacagaactgattcactgacaactgacacagtgacaagtcagcagattaaggaacaagaaacaaaactgtacccccgaaaacatcaccttccttatttccagatgaaatcattcatgccatgctgtcatgcaatgcagccaggaaatttctccagtaattacaagatggggatgttctccgacaaatgataagggagcagctgtgaatgcatgaggaagggacatggatgtgaaaggtcaggggtagtcccatgtggcataaggaatcaaacattagagcaatccttgtccttttcttcatgtttcattgttgctaatgtttgtaccacattggggtcattccatgtgcaccatactgttcatccctcca

SEQ ID NO: 37611 - DNA, 1501 bp, Oryza sativa
atccatggaaggggcgggtgatcaccttcgacgcgacgcagcagctgcacaaggtgtgcggcgcgacgctggtggagaagctccggtcgctggcggcgcccgtgcgcgccgcccccaagggcagcagcctgaacctgcagggcgtgttcgaccgcatcctgaccgtcgcgacctacggcgggctggccaaggacatgatggtgaggagggtgttcgtgctgagcgacatggagctgaacgccagcgcgtggcgggtgcaggacgagctgaaaaccatcaggtccaagttcacggcggaggggttcacggcgccggaggtggtgttctggaacgtgggcgcgccggcgtcggcgccggtggtggctaccgaggcgaacgcggcggtggtgagcggctactccaagaacctggtgaggctcttcctggagtgggacggccaactcacgccggccgccgtcatggctgatgccatctccggcccggagtacgactcgctcgaggtggtggactgaccgaatccatcctctgcttccgtatgataagagacgatcagtagtagcttgtgtgagtgagatctagtgagtgttttctgcactttgaatggaatgagtttgctggatgcttaatttggttgatctaatgaatgaaatctagtgagatatcacgccttggctgatttctcccactcttttctttgattttcgaactgattaaattagtagaatcatccctggcgtaatgtgattgcacgtttcttgattttctgtttcgattaggagttgcatgggcagcttaattcccagctcacactaatcaacatacattggcgcaacatgttatgttatcataagctcatacgccttcgatctaagcagtaattttttaagatgctcaaaatgatcaatagaaaactaattggttcaagatgccccaaagaaaacgaattgtaaatttgtaattggcaatccactccagaaaaatacatgttaaagtgccatatgcgttgaattcgagcaggctagccgaatatgcgttgaattcgagcaggctagccgagcaataaaaatgtaaagcgaaattaaagtaaaagacaacaacataaactgataaacatggatacttagggtattctcaacccaatgattaggatagacataaatgaatatgtcttgtatgagacatggtttctacacaacatccaagatattatgtgagataagtagcattaaaacattatgtgagataaatagcattaaatttaagtatgaaatagtagtgtttgcattagaagagtagtgtctagtattagtttcttgatgatatagagtttatggaaactatatctagtgtcttgggttgggaatgcccttagaactatttcagtttgagcacatcccctgttccattggaaggatccatgatgatgcaccaacaggatttaatttgtgtgtactagttatagaatactagtgattgtgcagtaattagcactacaaatatt

SEQ ID NO: 37612 - DNA, 1501 bp, Oryza sativa
ataccaacacatactatctttattagacacgtcgtattatattactattcaagacatcaacagaatttgaaatttgaaattgatttttcttttctagtaacctgccgttggacatcagaaattccagagaaactgatattctgccttctcggccaagatgtcatagccataacgtttagattagctagcacattttgcccttttcgctcaaactagcgtaactcttccgcaccaacctaaatattcattacactcgatcaaaaagataagatatttcgtcagttctcttccttcaatatattaaataatcattaaacgcacgaaacaactgtgccagccatacagcacacacaccctttacgagacgtgtcgtattatatattactctactcccacgcaaacacacgagtcggagtaggtagcacccgatattctggcccacccggtaatatgtcatagctataacgcttggattagctagcacgctttggttttctcgctcaagctagcgtagttcttccgctcaagccagcgtagttcttccacaccaatctagatgtctattacactcagttaaaagagatttcgtcagctatcttcctcgaacatattaaacaaacatcaatacacgaaacaaccgctagccataccaacccatactctctttattagacacgtcgtattatattactattcaagacatcaataaaatttgaaattgaattttcttttccagtaaccgtccgttggagatcggaaattacggaggagctaatattctgcccccctggccaagtagttgaatatgacttgtgaagtaatttagaaatgtgccaagcgttatagcacgttttggttttttcgttcaagcgagcgtaattcttccgctcaagccaacgtagttcttccacaccaatctagacctttattacactcaattaaaagagatttcgtcagctcttttccttcaacatattaaacaaacatcaatacatgaaacaaccgtgccagccataccaacccatactctttttattagacacgtcgtattatattactacccaagacatcaatagaatttgaaattagaaagtgattttttctctagtaacccgctgttggagatcggaaattccggagaaactgatattctgccctctcggccaagatgacgtagccataacgcttggattagctagagcattttgtcttttttgctcaatctagcgtaactcttccgcaccaacctggatgtttattacgctccatcaaaagagataagatatttcgtcggttctcctcctttaatatattataaataatcattaaatgcacgaaacaaccgcgccagccacaccagcacacacgtcttttaataaaacgtgtcgtattatattactccgctcccacacaaacacgcagagtcggagtaggtagcacacagaaagagtagtctatcgtacagaggttgcagaggatcctggccattgcggccccgtcc

SEQ ID NO: 37613 - DNA, 1501 bp, Oryza sativa
gtccaatgctcaactggtatgagtcaattgacactgtcccaagcttccagtgatgaacgattcttttgaactgactaaatttaaactgggcattatatgactgaccccaatttgaaaaccaacagttgggcttggaggcaacaggcatagaatcaaacgaaattaaaattgcagatactactgaaatgactaaggtcaacaaggctggagtggatctcccaaaggagactgctgaggagattagaccctgctggtctaaaccaagatcaagtaagtaaaatatattcttgacaagttctttagatcccaactcttgagtcttgacacattggcacttgtaatttctgcagatgttcaggagtctaagggttttgttacattctcattgactatgggccctgaataccacatctcacaggtgagcttgcaactcagagctcatatgtatagttaattactatatgtaagaaaaacaagttttgtgtctgcatattctgtttgattgaattgctggaaccccgcttgaaattttcaggaccatggtttttcttactgaatatacttctgtctgcagattactgatgctgtggttatcgcaagatatttaggtgcaacacttgtgcttccagaaattagaggaaatgagttaggaaagaggcggtatgtttcattgctagaaccttacacttttcccccctcaaaactgcacaaggctatcggctattgctatcttgtattcatatttactttagatatactgaagaatttcaaaactacaagcttttcttttccaatttataaaatcttccacaatttgtttacaattcctttcatgaattcattaaaaaaaacgtttcttctataaacatgaaaaagatgtcattcatttgcactaatgatataaggaatatacacaggaaattcgaagacatgtatgatgtggataaattcatgacgagcttggatggagttgtcaaagtagtacattcacttcctaatgcagtgtcttctaagaagccagcagtagttagagtaccaaaccgggtgactgaagagttcatcacgggaaccattgagccgatcttccaaagaaataactacttacgacttgcgactattttctcttcagtaagtttgaaacagaaggagtcgggtaacaaggacttggattcgactgcctgccttgcaatgttcagtggccttcagttgaaacctgaattttcagcagtagccaagcatatgttggacaagcttaaagaaataagcgagaaatccgatgggatggttatagctattgatttacagaccgaattgctagaaaagaagatctgtaagacgaatggaggtgcaagaagaagaggctgttattaccctcaggaagttgtgcacttcctgaagaaggttggcttctctgctgatacaaccatctacttgacggagacatggtggcacaaaagcctggatactctgaaggaggcatttccaaacacttataccaagg

SEQ ID NO: 37614 - DNA, 1501 bp, Oryza sativa
tgagacatagatctctagttcctaatacggtctaaccacaacattactccaataaccagggaatcaaaacaaattaaagcttgttcccgctaattatgacgttatgtttttatacctggtattgagagaccactattgaagtgcatgtacattgcaaacgagaagaaaaaaaatgaggaaattgaagaaagaaagtgcgtggtcaattgcatttgtaggatcaaggatatatttttcttgagggtttgagggttttacaacacatgtgcatatctacaatggaaaaggatgcatcacaaaagaatgcaactgacaaacatttcgaactgaagctctcaacaccgatggagtcttctcccgaatcaaagaagtggagcagagagatttgataatagttagaagtttttcatttgttacgacaactattggagcgccctctgtaacatgggtttgacaacggtgccatgcttgttttcccttgtagttccaagctgcacattttgcacctagcattgtatgggcctatcattttttattgggaaaaagtttaaattatcatttccttaatatatgtagagagtataggaaatagagatacagaagtataggaagtaaagatagcgatgaaactttatcatgagatgcaaaggatgacgattcattgcttccgtagaattatggatgaggctatcatatcatgaacttcttctctatttgtactgtatcctttaaagtaaccatactttgttatgggtaaaatactaattttcttgtttttttcgtgcttatgtcaatatatattaaattcaaacaaatattatactattgtatagtatcgaaaaagttattaaggactaatttttaaacatactaaagtagtaaagtagtagcagaataaccaccaacaatactattctctcatttgtttgatagtatatagatttgcgtaaaatcaggcaacacaccctactgctggctggctggcagcagctgccttgtgcctacgacactgttcgtgctggctgtggcgtagccgcagtccagtcattcgaacaggcccatagtccctcctaaggggcttgacccggggtttgggggcccatccgggttggcgttctagcccaacccggccccgacccggcccgttgccaccacttgcggtaaaactgcagaggtcagcatttcttctctgttagctaagctgtagggttttagctcaaccgtccacccccatggaaatctcccccaactccgccgccgccaccgccgccgccacggcggcggctccggcctcttcctcgacctcctccccatccgcccccaagcgcctcaccaccacgctccgcatcctctgcccctccagccgcgcgtccgcgctccgcggggcgtcgcgggacctccacgtggaccagccccccgtcggcgacgaggccgtgctctccatctccgggccggacgcccccgccgtggccgtgagggcgtgggagcgggtcgtggggca

SEQ ID NO: 37615 - DNA, 382 bp, Oryza sativa
cgtcccgatccgatggaaagacctccacacatcaaacggagcgatagattaacacataattaattaaattttagcaatagaaaatttagaatttggattaatatgatttttaaagcaacttttctacataaactttttgtaaaacacgcaccgtttaacagtttgaaaattgtgcgcgtggaaaatgaagaagatgagttaggaacttagataaaagaacataacctagggaagtcaagtgaagggaactcaaccaaatcactgatctcctctcccgaccaattcccttcttctgttgtactcccctcgtggccctgtatacgcgactggtaagcctggatcgttgcggcgcgcctcctcggttgttggctctgggcatagc

SEQ ID NO: 37616 - DNA, 1501 bp, Oryza sativa
ctatggctcgaaagggtggacctcgtgataggcgcccaattcatccgatgactgggcgccccttggatcttgagggtgtcacggttgttgatgactccaatgttcccgaaggtggtgctgaggaacctgtgtcagaggagtgatgctgcagtaggtctccacttgtttgttgtgcctctgataagatcatgagtactgtacaatatggaaacttcctaatcatgtaatcttccattgttttctaataatttacaaggtcgtagtgctgcactatgagttagctgttctcaaccctttctgaaatggatttttttctgagttctcatggactagcttacagttcacacatgttttgttcagtcaagggtatcttgaaaggtaggcaatatacagagagctaccataagcgtcacaattccagcttgattattcctttttgtgcaatcaaatcagaatagattctttatctggtctggttgcaaggttatttgattttatggaactgcaaaaaggtgcatcttttgtcatcttcattgatctttgtgccggttgttcatgttgatagttttcttgtatgattccttccttgcagttttcctccaaaggcatgattgcctcctgaaagaatcttgtatgaaatggatcgtacgctttttacaaaacacatgacatttttgtagacaaaatgaatttgcagtcttgcaccttgattttataaattggaattgaagagcatgtctgacgcaaaaatggatcataaattttacaagcttaccgataggttgaagtgttcagaactacatgtagcgaactaatgttctgagatagcagctactcgagcagtaaatcaaacccaaataaagactaagaaaaaagaaggataatgagaattgcaggcttgcagcgcatggatatgatagcaaattcagaatcttcatgctgttatcctgactactgattctaatactgtaatagagttcagctcaagtcttttttctgtatccaaataagaaaagtattctgtacatttccattttcccggttgctcaaactcacaaacatgtactctgtccaaatgttcagactgtgtacagactacagagtattcaaaacatagcatgtttgactagtaattaaggtatctgcattagcacaagcatcagaagattcacctctcttgatgctaagatcatgtcaccatcataagcttgcatcatcccaaaaggtatttcttctttcctaggccaccccatccgtgcaacatgctaaaccaagcacaccaagaaaaagctttctttgcatgcaaacatgcaaaaatgcaatgcatcatggcacttgcacctttaaatcttgcaagaattctctcaatgtcttcttccccttccctgctcaatcttcttcctatcaacatcaattcccaaattttgagccataggagccatgggagagccaagagcttgcaagctatggcttcttgtggtggcaatggcggcttcttggt

SEQ ID NO: 37617 - DNA, 1501 bp, Oryza sativa
taaaattatgggtggcaatagatgcctgtggaataatgcgagatagactatcttagttaaacattgggagttggagaaaagaaagggagaagggtaaataaactacctagacataccaatacatcttcctcatttagagtttctctcaacctgacatgcatataaaattttgtttctttatcgtttttatttttaggcatcatctactaatttatttatatcatttttgaacctctgttactttcttgacgttcgcagtaattgtttgttcatgctaatgctaggaaaagtatgtgatggaaaagattttgccttctttaacatgtatgaatgcatttggatgactaaatcacagttttattcttcaaacatggagcagcctaatctgaagggtcctacttctacaggtacaaggtccttgatgcatcagttcattgaatgtaagacatcattttattctctcatgatttcagtgatgctaatccctaaaggagtaatcagtttttttgttttgacacagattccttagctgtttgtcatagcaagaaaatgactttacatgcaggttgtttcacttttaggtgctcttaggtgagaaaaagcatgccatatgccagtacggatctttttgtgtctgttagacaacaaaataccattgccaattcggttttgttagagagcgatgccaatacaaacaagtaagccttttgcttgttcagttttttgtgcctcatccttctcttccaattccattcttactgcactcattcttgggcaaagttcagcatgtgtgcttccatcttttgtgcaggaaaaagcattcgtctaccaaccatgacaatgatcaattgggtgtgactgagtgagcaacaagctatattctccaggcctccagacttcagcaaaacacagaccagggcttcctgatttccattagttaggttatcaaatgtgttaagagcagagaactacaaatgaattctggccttgtcagttcccttcttttgggccgattcttgtgcaatttcagtattcctgcacattgtccaaacagactattgatttttttcattaattttacagacagtttatgtgagcttttatcgtgttaattttgttcatcactgaatggatggagctactattgaattattgattggccaatgcataagtcagcttaaatggctaataaccattcaggagcctaaccaagtataaccataagtgggccggagtttggcccatgggctaaagcccagaaagaagtctcgtgtgaacaagctctagctggaaggcccatactctatgggacatcaggcccatcacagaggtaaagcccgctgagttttttttcttctttttttgttgggtttctccagaatccaaatccaaaacccttgctcccacaggagtgaacacgacgcgacccgagccggagaaggggaagggaaggcggcggcggcggcggcggaggaggaggaggcgcgaggggaggcgagca

SEQ ID NO: 37618 - DNA, 1501 bp, Oryza sativa; identical to SEQ ID NO: 31646

SEQ ID NO: 37619 - DNA, 1501 bp, Oryza sativa
aaatagttactgagcagaacatacccttttgctttcatccatgtcagctttgttgcctaccaaaatcttgttcacattatcggaagcatgttgctctatgttcctaatccagtttcttatatctgtcaataacaccaccaagatcagaagtggaaggtgaagtgccataacagaagattagcagaagtgaaagagtcggtactattaaatgatgactcgtcggtgacatcataaacaagcaaaatacccattgctcccctgtagtaggctgcattgcacaaagtattcagatgaacagcagtatatccatgtaattgttcaaaacaaacttgacttcaactgaaaataaacaaccataccagttgtaatagttcggaaacgttcttgaccagctgtatcccagatttgaagtttaatccgtttaccatccagttcgattgttcttattttgaaatcaatcctttttcaagaattaaaaataaaaaagtttttagatgcactgcaataacttgtacaacaataatccagtcaaaagcttcttttctaacttgtacagcacttacccgatggtggtaataaaactggtggtgaaggaaccatcagagaaccgtaggaggagacaacttttcccaacacctatacaaggatttttttttaaaaaaaaaagaaagtcaggtgcattatcagacatatgattagtcctacaggttatagtatgtttacaacaagcacgatagcgagtccatgaaaaacaacttgatgaagataaagtggaaatgtaaaacggataccaatatacgatcaagtcatacattcaacaaacatatatcatttcacattttccactagaacatctacacaacacttaagctagccagcttggcttcttctcaataattaaaatttagtaaccgtctaaatacaaagatagatctggttttaatgataatatggatatcatatcatatcataccctgtggtaagcaaactgttattttaggcaaagaagatcaaaagaagtgcaaatcaaaaaaaaaatattgcacttcttttttgttacaaacgaccatagaattgttactgactgaaaaagcagcacccaaaaagtacaaaataaattatcaaggacaatggaactagagagaagaagtaagcacttctgtgtttctttttattggcttcccagttcccagaaaactcaattaagtaacattcattgagaaaccagtatatgtatttttcccataattttaatgatggtgtagccacaacgtatggcatatgctactgaatgagatcagcattttacttcatacactaaatgcgcttgtagtttgactaattgttggtcaaaacctacaaattttgactttctggaattaaaatgtccccgataaaaatcacagaaggagtagctagatgatatatcagtgtgacattaactagctaagtcaagacagaagacatactactaagtagtttgagatccgtgttgcagaac

SEQ ID NO: 37620 - DNA, 1501 bp, Oryza sativa
gaaaaaagaacaatatcttccatattaaacaagagttgtttatgttggtgatattttaggaatcaccatggtaaagaggaattgaagacgaatctgacgagaaagagtcgtagatctagggataggttttagtgccacggtgtacatggtggggctacagtgtaataatcatgaaaactgccaaactattttcacatgaaattcccgctccaattagtagattttttgctccatctgatcaagaggtaatgatccacattcgacctcccaatccaacataatcaacctagtgcctctccacctcccaccgagacgctgccaccatctcacatgcagggtgtggcacacgtgccttctgtcttgacgctggaggctgccggcaacggctccccaccttgccgttagattgccatccgatgaacggatattctgtatatatgtttgcagtgtattgcaaacatatgctacgctcttacccaaaacaatccaatctatattcaatacattttctccatttgtatttaaatcaagagctgtttatgttggcaagattttagtagtcaccatggaaaaaagtgaatacaaatctagcgagaaaacgtgtacatctagggttagggttggtcctacgatgtagacggtgaggttatagatattaggcttgatgggatatgaagtggccgaagagggtataagggtcatgctacatgaatttcatctaaaagtgacagaatagcatctcagctatctaattttctatcttgatgagattttaggattcaaagtggaagatacattttttaaatttctaatagcattattttatgcatgaattggattacaaggagatttctaattcccaagaagtaaggatttcgagccactttcatcttgtcctttagtatgttgacttatattctgatgagattttagttaggactaaaagagggaaatacactttttttcaaataaaattcaagtaggaatttcgaggcactttcatgttgtccttttgttatgctgatgaacatctatgaataattaatgcgcttggtgttatgaaatatgaaaacggtatgaaactatccagctaatttgatatgggccacaaacagcattcatgaattgtcatgatcactactaagcgcctacgaagctgttgacaaccaaatttggtaggtcatgaaccgggttcgacattgggatcgaggcagattcgataaagagattgatttgaaaaatagagtatgtatcggctgcgaaggcatcggctggagtctgcatcgactgagatggatcggacagaggataactgatacaaccgataaaggtgatgcagccgattctgataatggtggtttcaaagatgtttctagaatcaatcaaggtgcttcacgaagattgccgcgatggagatagggctctcggataggcaattgcatctattaattaggatatttcatgtaacttccttacagatatgtttgggcaaaagtcagcc

SEQ ID NO: 37621 - DNA, 1501 bp, Oryza sativa
taaccatacaatggagtggatgggagaactgaaacggtgctataaccacaatcataaaaaggtggttctttatttgcaacatcatcgcatacttctcttcatcaaccgttgcaatcttttaacatagcagttgctttgcaatcaataatatgtaagttctacatggcatatatatatctccctcttccaaaaagggttccataaaacatttcatggtcagaagatgatatcttaatgaaattatactggcaagtgaatctataatgaatacttaataattatcactttataaacatgtccatgaaagcaaaatctcaattcaaaaggatagatcagtagcaaattctaaaagcaggaaaacattagagcaggaaaaccacatcacatcagcaatgttgcctgtaagaaaaaaaaaagccatgtgcaccctattggaatatataatagaatgccctattgtaactcaattgaaatgaggcagatattttagaaagttgcccaacacgttcgaaagtaatactcaagtagaatcacattaattatactgaatcaaatgccagcatataatcaaggcattgatcttttgtgtggtacatatactctttccatgacgagaagttcaacaatactttctagggctgcaataattgtgggttaatctatgcattgatcctttgtggttagctggatgtgaaacacctagagatgaatgtaaactacagagtcaatcacactataataggatcacatagtagatcagaaaatgttatattgttgcatataacttgaactgatttagtgaaagaagacattaaacaatattaatgtagttatgttgacctagtaaaattttgaccaatttccaaatctttgatcgatccaaacaaccagagatggaaaatttgccgagagaaatatttaatttggttgttcatttgcattccctgactataaggtgaattgtacaatctatatgtttggtttgacaaagatattagccataatacagagcatgtgaattattttgagctaatgatcttgtctgtttttttttcagatcatacagccattttagagtttatttttaaaataattaaagaaaacttgggagaaaaaaggtacagagacctctccttgctcaaagaagaaaactccccgttgtagatcacctagcttgcacggaatataagtaactttctcacttatggaaacaagttcaaattgatctatgcaaacaaaaaatgaagaaaaagggtgtattactccacattggaattcagaccactacctcatgtaggaagttattacaccatatttgcatcagaagagcagcaagagtactgcgtttgtttcttgcattgcactgagctgtacatgtcaactattagcaatgcataaagtaatcatacgatgagataaagaaatagaaaaatgaaacgttggagaaaattttaatatcagtatgtgtactattatagtcagcatcatctaaaatgcatga

SEQ ID NO: 37622 - DNA, 1501 bp, Oryza sativa
ttgaagattcatagagagtggattctaatccctcgagggaatgtcatttgtgtactttttttcctttaaatttgatacaaatagttgtagaaaaattctaaacttttttccactgtagaacatagtgatatctatggtaccccaaaaatcaagttcaaattcgagctacacatcgagaaaaaaaacaaatttagatgtggacaatacactactattcatacgttaaatttatctcttttatatcttgatttgtgagttgagtttagacctaagattctatggagatatgttgtacgagtgctgcaaaaaaaattcatatccgtttggatggtttttaagtaaacaagtagacatcccctcaagggatgaaaatagtttcccagattcatatatgtacataaattttttggaaggcttatttagaaattgagatgaaaagggtttaaaaaaatccaatgcaacatctcctagcaacaaaatttcaattgcaatgagttttttttcaaacaaattgattttaggcacactgattctttacttcaaaggacattttttgttaacgactcgcacaagacggtgcgaagttctactgatagagcagaaaaaaaaacaagattacaaccctagaaggtcttaatcaggaaaaaggaaaaaatataccaccacatacacatcgacagcgccaacacacaggtccgagagaagactagcactggaccggccgcggctaagcgtgaccgaccgccgctaggccaacaaaggaacatagacgagaatgctcaaaagcccttacaacctacacaaagccaactctatctagagtgtgcttgcaccaatcgttcgagtggttttgacaaggggatgcctaaacgacgtctccaaggagataagcgacggaaaaccgccgtcgctgtccgtcggggactcaaaagagccaagattgggcttttgcccgacaaacacccttgagggatgagacggcacgacaacgcccttaggagggggaaaccattgttgtcggtccgggcaaggccgggctaggttttcactcgccgctcacctccaagtccacggctgatgcaccgatgctccaccactgctcaacctctgccgacatgtgggaccactgcaccggcgcctcccgctggccaaccttcgtgcgccgaagaccgcgtcacaccccccgcagctcctcctcacatcgtggtcgcctcctttaccgccggccgtgcctcatcgcgccgcgccgtcctcctccaccaccggatgagcctctcgcgccagtccggtttcctgccatcggctgtgcctctcacgccatgccggcctccttgccaccggccatgcctctcgcgccttgccgacctccactgccaacagccgtgcctctctacgccaagccggcctccgacccctccaatcactgccgcaccggccaggtgcggccgtctgccacgcccccggctagccttccgagaccgccatgcctcaccaccattgc

SEQ ID NO: 37623 - DNA, 295 bp, Oryza sativa
aattgagataaaagccttcaatttgttgaagttgggtgctaagcttttatggtgtgattaggacatgtgacttttctttttcctggttaattacgataattacgacccttcagggttgtaatcttataatttttttctgctctatcaatagaacttcgcaccttctcgtacgagtcgttccaaaaaaaaaaggacgtgtgacttgacaacgacggtagcataggggttgacgaagacagctctgatggatctgccggtggtggaaggagggatcagttggccatcttagccgaca

SEQ ID NO: 37624 - DNA, 160 bp, Oryza sativa
ccgttgccgtcgccgtgggccttcgccaccgcctccgagcccctttaaaaggatccccgtgctcttctcttctcgccgccaccctcgccttcgcttctcgtcgccggagtcgtcctagcgccgtgcgccctagcttcgctgtcgccgccgccgctccagc

SEQ ID NO: 37625 - DNA, 197 bp, Oryza sativa
ctatataatccatagtaccgatcctcttttcccgtccacacaacaaactcctccctctatctctttttttcctctctaacttcttatctctttccttatctctaactcccctcctctccttccttttttccttcaccacagtgcaggcggccggcgcggaggcggcgacgcaggggacggcgcgcaggcggcctgca

SEQ ID NO: 37626 - DNA, 1501 bp, Oryza sativa
cgccgacgggcagcgtcttgtgcgcgggaggtgtaggtggcggcggcggcggcggcggctggggtttgggccgcggcgcgaagacggaaggctggaggaaggagtagacggtggggatctcatggggcgcaggggagggtgaagacggcgagaaggccctcgtgtttatgggcagaggcaaccggcggcggaggcggaggagagcgcgcatcggagtctcggagaggtttgccgttcaggtgttcgagcctttgccaacctagtctcaagaatttttcaggaaagcccctagtcttctcaagaagatcgtatctatctgaaggtgaaggatgtcatattagtcccgcttcacatattatagtactattaaaaaatatagcaaagttctagagtttaaatctattcaaaacatagcagctagaacatggagtataaagataacgtttactactccaaccatttcaggttataagacgttttgacttttgtcaaagtcaaactgtttcaagtttgactaagtttataaacaaatatattaatgtttataatactaaattagtttcatcaaatcgctaattgaatatatttttataataaatttgtcttgggttgaaaatgttactacttttttctacatacttagtcaaactcaaagtagtttgactttgaccaaagtcaaaacatcttataagttgaaacggagagagtataaatcacccatattacatctattatctcttgactctattataatccgagtcagcgggttatctatcctgcgaagataagtagctatttctaccataattccttcttaacattcgctatcacctaaagaattataaattattacattttgagacaggggaccaagggagtaaactagtcacttcttttttacacgttctatttggcatcatagtcaagcatccgaaaatgcatcccagcacaagtcatttttagacttccacacgaaccaaaccagacgaaaaaaaatctcaatttgttggttagtaatttgtgcagtgttgacaggcagagtttctcagcacaaacaagatttgcaatggcttcttctaatagaccggtaataagaactaaaaccagaatgacggagcataataggcaagacaaaagaacaaacgaccatcaccagcttgacgatatcaacatttcttgcattctgaaggaacggggtgacaattctaggaagcaacttatcaggtttctggcactgaattcatttcagtggcacagctggatgtaaacattttacatgcagtacatcatagcacgacttaccattccctcaaacaggcggtagaaaaggcatatcattacaaatctattactagcatacatttggttattcatcggaacattacaataagttgcccactcacacaaatcagctagtagaacatactataagatcaaaactgcaactatatgattggaccaaaactcatttaatacctttcagccaacctggcagaaacgg

SEQ ID NO: 37627 - DNA, 1406 bp, Oryza sativa
actagagtccatatagaaatacaattaggaaataactgaaattcggaattaaaaataaggaatattagaagaggagactagagtccatatagaaatacaattaggaaataactgaaattcggaattaaaaaaaaaggaatattagaagaggagaatagagtccatagaaaaaggagcctccacgttcgctctcatggcctagaaattctcacattaatcggagaaaaagaaaaaacagagtccatatagaaatacaatttagaaatagctaaaattcggaactaaaaaataaagaatattagaataggagactagagtccatatagaaatacatttaggaaataactgaaattcggaattaaaaataaggaatattagaagaggagactagagtctatatagaaatacaattaggaaataactgaaaaagaaaaaacagagtctatatagaaatacaatttagaaatagctaaaattcggaattaaaaaataaggaatattagaagaggagactagagtccatatagaaatacaattaggaaataactgaaattcagaattaaaaataagaaatattagaagtagagtatagagtccatatagaaatataattagaaaataattgaaattcggaattaaaaataaggaatattagaagtagagtatagagtccatatagaaatacaattaggaaataactaaaatttggaattgaaaatagaagtagagtatagagtccatatagaaatacaattaagaaaaaaaatagaaattcgaaattaaaaaaataaggaatattagaagtagagtatagagtctgacggagcgtggggctcctcaccgggagaccgcgcaggcccccctttgccggttcggccgggggcgctgagtgaggttcttcaccctcgatctgtggaatgtacgcgagagagcaaacgcacgagacacgggcgatgtagacaggttcgggccgctgagaagcgtaataccctactcctgtgttctggtggatatgtgtgagaaagagttacagagagccggagagcaagagagttcaagctctagaacccctctttttccttctcttctggttcttttttctctcgatctcccctccaagctccagtcttctcagagtcgtcccccttcctttgtgggcaaggtcctccttttatatctcaaggggataccacatgcaccacttctacctactcttcttttgggtggggacccaccctatcttgaccaaatcttgactcgcgccttcgcctggaagctaaatcaccgcttgtccttgagtgatgcccagcgccgtcactcgtcggacacaggggatcaccctgtcatctcttcattaatgggcggagatctgcaatggccgctgtctgaatgaccctccgatggga

SEQ ID NO: 37628 - DNA, 1501 bp, Oryza sativa
tatacctaatgatgattgcttttatgctttggtgaatataaccaacttaattacctacttggaaatgacagaccgaaagaaacgtgcgaaagctaaagagaggaacatatacgtttatgtctaattcgccacacacaaggaaaaacggaagaaaaaaacaaatgctaacaaggagtaggattgatgggaggtggtagctagactgaattagtttaagacgtacgcaaccatctctatgatcgatcagcgttgaacatttgactactcgtatatataaagctaccgggcgtatgatttcctcgtgtagtagttagttattctcgcattcgttttttcctcgtgctatatgcacaatctttggatgcattcaaaacattctgattgtgactttctccatataccaatgggctcatgcttatggcgtaacattaaacttttcgccggtttttattcttgttctggtggtcagccggtttcttggaaagaggaaattgatcgtagtttcaaagtctcctatacgactcgtccagttggggatgaaacaatctacaaatcaaacactagcagagacgtacgcagaatttttttttccactggcagcaccatttttctttgacccgaggtagaaatcttcaggtctaccacatcatgattagatttcaaccaaccagtgctccaattcggatacccattttaacattgcgccactaattagtcagctttgtgttgcttagttgagccatactttacgcgttctgatccttcacatcagctaacaaatccaatccttcccctgaaccaaaatctttcagtactgctcccttcaattccctagcaagaaagcagagaacctttcgacaaacaaatagtgttgatactaattataagtgggtgctggacttctgatagcttcgtttcaacagtctacacccaagggccattaggaaaatttatctgatgatagcttagctccaatcttaatctggaacaacatgtctggtccattaggcctccactggaatagaggaatatcacgggagttgaactaattcttgtgaaaatcctgtagaagtcatgcctttatctttatgctatcactaccattctctaagtcatcgcggataagaaaccatgggcaagaaaattttcagaatatcaaaaagataaaatcctctctccggtttcccagccagctacgaatagttggaaacacacctgctgcttggctatgcttataatagtggaacatgattcatatttctggttttcaaatggagtcaggtgagaaggatggaacgagattattgataaagtaccgttccaaaaacgttcttatccttatcggacaattatcaatgatagataacagaaagtaaaatcacacggcatcatcgctattattttattaaagcaacatggcttctttttttttgtgagtattcatgcaaccatcgtaatcttgacgtgtaataatttggcttattgctatttgctacatcgc

SEQ ID NO: 37629 - DNA, 1501 bp, Oryza sativa
ggcgagtgcaaaaccggagcctgaaacagcccagcttctcgcacaaaccaattaacgacgaacacggcttgacgaacagtattaaaatgccctgtttccaatccactagccctgcccaagggtcaaagtagacggcccaaaacgtacgacacgccgccacgagaccacgatggcacacttgagttaacaacatgcccaatagcttgtacatgaacaatttgcgtggattttcctgtcttgcattgatgcattgactgactgcaagcagtcatgactaagtttgaccttggatatatgcgtaacatatgcgtgcgtgcagccttgtcgggcgacgggatcatcctccaggacctcaaggtggagaacacggcgggcgccgagaagcagcaggcggtggccctccgcgtgagcgccgaccgcgccgtgatcaaccgctgccgcctggacggctaccaggacaccctgtacgcgcaccagctccgccagttctaccgcgactgcgccgtctccggcacggtggacttcgtgttcggcaacgccgcggcggtgctccagggctgcgtgctcacggcgcggcgccccgcgcaggcgcagaagaacgcggtcacggcgcagggccggaccgacccgaaccagaacaccgggacgtccatccaccggtgccgcgtcgtcccggcgcccgacctggcgcccgccgcgaagcagttcccgacgttcctgggccggccgtggaaggagtactcgcggacggtgtacatgctgtcctacctggactcgcacgtcgacccgaggggttggctcgagtggaacggcgccgacttcgcgctcaagacgctcttctacggcgagtaccagaaccagggccccggcgccagcacggccggccgcgtcaactggcccgggtaccacgtcatcacggaccagagcgtcgccatgcagttcaccgtggggcagttcatccagggcggaaactggctcaaggccaccggcgtcaactacaacgaggggctctgattagaagggtagagattattgatctgccatcttgtacgagttgccatgttcgcatgcaccctgttggttccaatacggagtactaatcatcgtcatcatcaggaaataaaagcaataaagcatgctaatggcgcagatcagatcaatctgatcggaggtgcatctcaaagttcgttctgccacgccgtattcacgtgttatattccatggtccataccataaaggacaatacactagcgcaaattgctgggccgggccatgctcctgtactaagctaaagcctacctatgtagctaagacgaaagtaagcccaataacttgcttttttttttctttttttacgtggccgaatctgctttgaaaacgtcaaaccttatctctgcaactgatgcggagagtccctgaaagacaacgcaggcataatgtcagtcagactcagatcttagtcttacacaatcattctgttttgatctgatcgtttgtgaat

SEQ ID NO: 37630 - DNA, 1501 bp, Oryza sativa
cttcgagaaggtgaacggcgcccaaaggggttaccgttgctagcaccgagagcggagcaaggcttttgccttggagcacccatcaaccatagcatccaaggcgggagccaccaaatgttacctgcacaccgagagtacctgcaatattcacaccacctgcacagacgagatccaccccaatattcactccaatccaccccgtccccacccgaggacgcagcggatctgggcaagaggagccagatccggccgccctcctcaccaccaacgctggccgacaccaagaggagcgccggagaacgctagtggcagccgcaggatgcctgcatgcgctgcccaccgccggccaccgttggatccgcggcctccacaaccgctgccctattgctgtcgccatccccgccgccatcacccacaactccacccgcaactcacctcgaccaccaccatcgcccgtccccgccgccaaccactccaccagatccggccggaacggcgcggatctggcggtcaccgccgttgccgctctgggcagctccctagaccgcccgagcacaagaagacgaggagagccccgccgtcgccgtcgttgcggccgcgcggctttgccggcagccgcttaggcgacggtgaggcggagaagggaggtgggggagaggggcggccgggtcgtcgcctcccgagccgcccctggaggggcgacgtgagaggatccttgaccgtgagagttattctagttttaagacagtaaacttacatttgatcgtctgaagggagtatcatttctaatttctagtaatggaaatggggaccgtcaagccctagctaaaaaaaagcataaaaccttcaaatcgatccacatcaaactgtccatgtccaagctccacaacaagatacttgcaaagtgcgagattaactcgtgaggatcgtcgatgccaatcgtatgggggaagaacacatgcctattatctcatacggccatggagtatatagcaactgaatcaaaaccatacatcaacaccagcactaatcaagatactagctcatagtacaatggtctggttcgttcatagtacaatggtctggcagtaaaacaccacgtgctggaacgtatggcatatgggtatcatccaccgaggggacagcacagtgaactgcacgtggctgaacgaaaaacagaacgggtaccatctaccgacaggtcgatacattcagtgagctgaacgaaaaatcgaaccggactactactctccagtctctattcagaatcaggcgacgccagagaaaactactcctactccagttgagaacaattaatgcatgcaccggtgctaagtactagcgctaattaactatgttcgcgataaggtataacccaaaaccaaccgctgtccccagcagtataaatatgacctaattaagtctcatcatgagccgctacatcacaggttgcagcagtagttgtaaacaggttcacttgtcgcacagggataggacacca

SEQ ID NO: 37631 - DNA, 221 bp, Oryza sativa
accgggactaaagatcaaaacacactatataatccatagtaccgatcctcttttcccgtccacacaacaaactcctccctctatctctttttttcctctctaacttcttatctctttccttatctctaactcccctcctctccttccttttttccttcaccacagtgcaggcggccggcgcggaggcggcgacgcaggggacggcgcggaggcggcctgca

SEQ ID NO: 37632 - DNA, 1180 bp, Oryza sativa
cagcaagggcctaatcgcaattttggccgacggcggcagacggcgcggtcgacccaccgtctgccacgtcagcttgccgcccaccattagggcggcaggggctatttctgcaattttttttgtcgatagattatttctgtaaatattaaaaaaaaatctaaaaacaaaaaaaactcctgcgggctgtgtctgcggcgactcggcaaagaatggtgcgatccattggcacctcgtgtggtcggcgaaagcgctgcggtttccgctgtgcgaccacgcgaggacggcgccggatcgggtcgcctttccgtggccgaaagcaaccgccggctttcggtgtatggtggtcgaaggctcgctccaagcggctagtgggcaagcgcttccgaattatctttcgccttgtcagccaaatatttgggattggccacgtccacgtgtggattctttgcgtgcatcttccgaagcagccagcaatgcaaaggatcagtatttcagatgaaaggttggagtttgagatgatgtgcattgcaactttgcaacttcccatcaaataatatatgccgctactgtgatcaggcaatataggctgagtttagttccaaactttttctttaaactttcaacttttccatcacattaaaactttcctacacacataaactttcaattttttcgtcacatcattccaatttcaactaaactttcaattttagcgtgaactagacacacccatagtccgaaatgcagagattcatatccatcctttgccgcttttctcctgcctcccacttttctcattctctttttccgtgttcagctgaatcgtctctgcttttcgtccatctccgcgtccgcgctctcgtggctccacctccacgcactcgcgtacacgatatgggcgtgcgacctacgccaatatgcagaaaaaagaacggcaaagcatagcaacacacctcttcgatctcccatatacaaatcgttcgtcccatccgtcagcgcgcatacaaatagccggcgcgcccgcggcgagcgtttcgtactctgtctgttctgccgcacgagacacgagagccacggatagctagacacagacggcgcgcggagacaggggcaatggacgggcatgggaaggagggcagcagcaacggcgccagcggcggcggcggcggcggctggagcg

SEQ ID NO: 37633 - DNA, 1501 bp, Oryza sativa
acttgggggaagaaatatgatggtgaatctgagtttattggagtacttttatctgccaagacactcgcactatttggttctgacgtcaaggtatattcgcaaaagacaagcctgctgtcttttgttacttctctactcttttgttttgcaaaaatcttgactatatttattctagttaactactctgaatgaaaatgtgcatggcttgaaactataccaacttggtatctagggcttgtgtaaccgactagaatcttggggatttgatatggaaaaaagggttctattctggaaagatcagatcatagctgtgtctgtgtctacttgctgtatatcttttctaattttgcccttcgtatatgtgtcctgcaaaaagagtaagtttgctagttcagtaattagtagttcctttgatctgttagtttctcccatacaactttcaaagctgtcagctgtagtatgaaaaatttgtacgatatggtctcacggtaatctcatgggatgaatgtggaattttctttcacatgtcaatattacattgttattatgcttggagtttggaaatgtcctggttttagttcttagttatgacttgctcactcactcaatacaaggttatgttggaaaaggagctgccggcatgtccagtgtttgagaggctcacaactcttgaaattggtaagtggtgtttaactgaggatttctatactgtgcttcgtttccttcaactttcgccgagactaggagaactgacattgatgcaagaggaggtatgccgcacgtaaaaatcttgcatcatattggaaattcctcattaaatacacccctctttttatttatttcctgttatgtctctagcttcctcacgcagcaagaaaaggagcagaaacagatgctatgccaattgatggaatgaccttccaatgtccgttccttgagactgtcataatacaatgttccaagggcgatgatgggatcaacaagctggtgaatgttctggcagcaaatgggattaacccaaagaagatacaggttaatttctatgaagatatcgaagagatggagcgggctgagaacaggcgcatcatagaggagcgggagaaggagctgtgcaacttcgagaagatggcgaagaaaaacccagaatgggtcgacgaaagccgttatgctgacagtaaccctgaaactgatagcgatgagtatgatgatgactacgatgatttctagagtcctgcagggtgtgcttccatcctttcgcggccgcatgaagcctgcattttatcttcccttggaactgacttggtgtaatggtgttagagactttaagcatttgcctgtttctgtttattttgtgctcgtgactgctggactataatggagcaaacaagacaatttgtaggcactaatcctttgcggtttctgtttgatcatattgctttctccatggtacctctcagccttttgctgctcttgacatatcttgagctctttgaatttgaaa

SEQ ID NO: 37634 - DNA, 1501 bp, Oryza sativa
ggccgtttgtcagggaaaggaggcaagaccaaatacgccattgagaattctaccaggactcgcatagttattgctgacacaaagatccacatacttggatcctttgttaacatcaaggttgctcgggattcactctgtagtctcatcttaggttctcctgctggcaaagtgtattcaaagctaagggccgtttctgccaggttggctgaaaggtattaaatgagttttggtccaatcatatagttgcagttttgatcttatagtatgttctactagctgatttgtgtgagtgggcaacttattgtaatgttccgatgaataaccaaatgtatgctagtaatagatttgtaatgatatgccttttctaccgcctgtttgagggaatggtaagtcgtgctatgatgtactgcatgtaaaatgtttacatccagctgtgccactgaaatgaattcagtgccagaaacctgataagttgcttcctagaattgtcaccccgttccttcagaatgcaagaaatgttgatatcgtcaagctggtgatggtcgtttgttcttttgtcttgcctattatgctccgtcattctggttttagttcttattaccggtctattagaagaagccattgcaaatcttgtttgtgctgagaaactctgcctgtcaacactgcacaaattactaaccaacaaattgagattttttttcgtctggtttggttcgtgtggaagtctaaaaatgacttgtgctgggatgcattttcggatgcttgactatgatgccaaatagaacgtgtaaaaaagaagtgactagtttactcccttggtcccctgtctcaaaatgtaataatttataattctttaggtgatagcgaatgttaagaaggaattatggtagaaatagctacttatcttcgcaggatagataacccgctgactcggattataatagagtcaagagataatagatgtaatatgggtgatttatactctctccgtttcaacttataagatgttttgactttggtcaaagtcaaactactttgagtttgactaagtatgtagaaaaaagtagtaacattttcaacccaagacaaatttattataaaaatatattcaattagcgatttgatgaaactaatttagtattataaacattaatatatttgtttataaacttagtcaaacttgaaacagtttgactttgacaaaagtcaaaacgtcttataacctgaaatggttggagtagtaaacgttatctttatactccatgttctagctgctatgttttgaatagatttaaactctagaactttgctatattttttaatagtactataatatgtgaagcgggactaatatgacatccttcaccttcagatagatacgatcttcttgagaagactaggggctttcctgaaaaattcttgagactaggttggcaaaggctcgaacacctgaacggcaaacctctccgagactccgatgcgcgctctcctccgcctccgc

SEQ ID NO: 37635 - DNA, 1501 bp, Oryza sativa
tgatccaaatagcaacaagacaaagttagattcttgatggcttgatgtcggtggtcttcgaattccacagccttcgatcgccacaaattcaagtcagtttgagcgtggcatattggccctccggcgttgagtctttggtgttagcaagtctgcatgaggaattggttgttgttgagctagggtgccagctctaggttgatttggttttcggctaggtaagtttgcaggtggcaaacgccatttgttctctttggggaggttgtctctgtgttgtattatcttctctgtattcctcgtgtattctctactactatcctccaggacacctgcgattgcgtagatgaagcctgccctgtgtaaaatctcttgatgcaatatattctggtggagaaactcttctctctggtgacttgctaaaaaaaagattgcagatgctgtagtccaagcaatgagttggatgttttttagcttgagcagctagtattaccgtggtactagggtttatatttttgcgctccttaccgatttatggaaaccattaaaaattgacaactttggattaacactatacgaaaactaactaatattgatcggttttttagcggtttcacgaaaattaactaatattgatcggttttttagcggtttcacgaaaattaactaatattgatcggtttttagcggtttcacgaaaaccaatcaattttgtgaagcttgtccgctaatttttcagtcgattagcagacttacaaaagtatgcatagtgcatctttcgaagtatatgactcatctgaacaacttgcaaggatcctagttgaaactttgaaagtctgcactatgcggtatgcatatcactgaagtggaacgatacactacatcctactcaccactccacaaacatgcccatcgatgtggtaggctgtaggaagatcagaacaaatcagatccaatctcgtttgtcagattggctagctgtacagtactaacatcctcctaaaataacctcgctatgaaggtatgtggcgccaatgagactgtcacttttatccccactcccactccggcacttcaccagttcaccaccgtggcactccctgggactgaagtggaacgaactagtccaagactcggagtcgtctcctccctccgtcagcgcttccatcttccactccacatcacgatcgcgggcgccggtatgcttcttccattccacctatgtgtttcttccttgctaacaaatcaaccaatttgtccattccctatgtcatctcctatagaaactctagccaattcgttcgtttcttcttaagttccacagaatcccacctgatgctcgcccaacagttgcatcttgtctgctgatcagatcgaggttcagaaattagtccccattcctctcccataggcactcgaatccatcaattcgttcccaaatccagtgcttcccctttgtatgccactaaaaaccggagctttcttggtaaagatcgaggtttttggt

SEQ ID NO: 37636 - DNA, 636 bp, Oryza sativa
  unsure (1)..(636): unsure at all n locations
cgacgtgtttgaacccncattgagaatgacatacgacttacacnaggcgaattcnacccttgtactcccctatgcctattaccaggagggtgatgaggacgatggcgctcagtaggtcttagttacggtcgttgcctgtggcaatggcgtgccgctgccttaactccgctgccttacctacttctgtttttggaatgtattccggaccgctcggtccgatgatttaagactgtgcctgtgggcttatgatgtaataattcgtactagactctcgtgtatgtgcacttgatatttcagctatgagttcgtgtataccagactacttgatccagggaaatggtacggtttacacgattgattcctgttataaaaacgggggtctacagagctggtatcagagccatacgactgtaggaaaagaccaaaaggcaccccacccctttttaagttggccaagggagaaattcccatttagtaatactttcaaaaataaaaatgctatgtttacaaaactcggtacgattttcatcttactcttaactattttctttacaaaaacaagttttactctcaactgactttgggtttttcttaaaattagatggcaagatccggattcacccgccacctgggaga

SEQ ID NO: 37637 - DNA, 266 bp, Oryza sativa
atataataatgttcaacttcttcggcgggtaattatgttctcaattttatgagagagagagttgggtggcttcacagccatacgtcttaagattaataataaagaacttaaaaggtcttaatatggaaacgattgagaccgtcaaggcattaattggagcttcaaaaagaaactttaatgccctaatttcggaatattaacacctataatataaaggatgtttttcggtcaagtttgtcgtagaaaattgagggttttaataccca

SEQ ID NO: 37638 - DNA, 436 bp, Oryza sativa
  unsure (1)..(436): unsure at all n locations
ctgtcccttgatgaccactgttgtagcncncacncnattgcgttgccctgcatgataagcagcaaaattgcggccttgttgtggattgtgaagattttctcgaatgaattgttacattaggggatattcgccgtatgggatttgaattacatggggacagtttcacaagtggagaccagctcaagcccgctgtacgtttgaatggtgaaaatatgtatttccattagaatagttctacgtaaataagtaatgaattggtgtgcatcatttcacttggtctggtctaggctggacactgattttgtttaaaccattgccatttaatgcgatagcttaaaatgaattctaaattgaatgtacatgctttctatctctgaaaggtaaaaacaaaacaatttacacaggctggcaaggaatgtgtactaattaatggaga

SEQ ID NO: 37639 - DNA, 1501 bp, Oryza sativa
actaaggttggtattcaaggaaaagcgtgaatagtaggtcttcaaacgtaagaatgaggtcgtattagagaatatgtaagccagaagtcattggatgatggtaacccatggtggagacgatgggaggtgagcaggggcttggcctccctcataatttgaggtttgcaatgttaatcactattgcttaagtggttttgcgtaaaattactatctctctttgtcctctttagcagaaaaatgaaaatagaatttaggattcttgttgtgtcattggagccgatgaaggacccgatgaagagaactagggatgagcatagatggtgctttcaaaatggtgctgcaataaatgttcataattgaagtcaacagttgggaaatcaagcttctccaaatttccaaatttgtagtacattttttattttgaattccatcctaaaatataagacacgatccattttttcccgtgtctcataatataaggcgtgcatgtatgcatacattaactatcaccttttaggccgcgttcgttacctcccgttcccaacttcgctccctcgtttttcgcacgcacactttttaaactgctaaacgatgcgttttttgtaaaaaaaaattctatacgaaagttgcttaaaaaatcatattaatccatttttcaaaaaattagcaaatacttaattaatcacccgctaatcattgctccgttttccgtgccagggagtgagggttcccaacccttactcccgaacgcagccttagatctataaatttggtttattttaaatcatgtaccatcaagtattccaatcatattgcttgcatatatggatgtgattcaatcgaggaggtgattaatcttttcttggtttttgtgttagaagtggttgagccttatattttgggatgaagggtgtagtacacttcatattgaaaattcataattggttattccatgttccaccaaaactcagctaaccgctggttgaaaatactactccatccattccattttgatcaccttaaaatttttgaggtcttccgaaaacagtcattatctaacaagggtctctttatttatttgtgcagagagtacatgtgcataattgaatgtattgcatgcatccaaccaaaattaatttctattgatgcaatggcatacagtatttaaaacatgagaaatccgcaggacacaaagcgatgaagcaccttaaccgaggaggattaatttaagaatgataaatatttttgggatccatagtcttggtgtcatttgcttatgggatgatcaaactggtatggagggagtattactaaacactagacacttagggtccgtttgatgcataggagttatcaaaaacatattcacatgaacttcgtaggagtcaattcatattatctagatttcaagtgcctgaaatttcccaaaaaaaaatcatatgccttttctaatccatacttatcaactatcactccccagtagtttgaaatctaacataga

SEQ ID NO: 37640 - DNA, 1501 bp, Oryza sativa
gttattttactacttccttgattcttgtaaaaaaaaatcccttatattcacggatagagggagtactttggggtaggtaactttatacttttgcattatggaccactccaactcacttctctaatcatgtctagcctctcctttagtaaaggtacatgcataggtgatagagttcatcaacctacagggacaggtgtactcaagattattgatatgcaataaaaataaaattacctagctcaaagtgaagaaatattgattaatatatgggataatctaaagtgaaacttcaacgataaaagggtggtctaaactgcaattcactcaagtagtacgaagagaaaattctttatctgtgctccaaagttgatcggttcccctattgtccttacgaaattggctcccccttcgttctcaaaagttatttatcaaattcaaagggtttttcataacgcttcattactcaaaataacatttaggttcgtgagaaatattcaataaccgttggtccataataacaaagtataatcccacccaaaagaaaaataaaaactactgacatgcataaaacaagctgaggcaaagctgtcatttttacccacctacttgatggaaaacaaacaaaataaaagatggagccatggaggacaaaagttacgaatgcaaggcattagagggacaatcaatttcgtggggaaaatgagaaaatcgatcaactttggaggccaaatagaaaattctcttgtatttatgtatagctatgtttttcggctaaactatataagtaggaaaaaaaatattttcaagtgtgcattgtgtaacaggtggatggaggcatatgttagaataaatgggctaggcctgatttttctattaaatctcaaaaggcccataataaatgttaagaataatattaccaccttgggaattaaacgaggagtatctcaacttaaatagggagttattggaggctccctgttgaccggttgaggtggggatcggaaagccacacgcgtgcgcgcacgctgagccgagccggccagggcgagacgtggcgttgcgacaacgggtaggcgattcaatacccattgatcgcgtcgttactgcggcaacggacggatctctctcctgcgcccataaggaaagagggcgattcaatacccattgatcgcgtcgttactgcggcaacaggcggatctctctcctacgcccataaggaaagagggaacccgattcaatacccattgatcgcgtcgttactgcggtaacgggcggatctctctcctgcgcccataaggaaagagggaacctaatcatatcctctcggttattttccaaacgctggttcttcctccacgggcggatctctctcctgcgcccataaggaaagtgggaacccgatcagatcctctcggttattttccaaacgctggttcttcctcctccgcgtgccgccgccgctgcctgtgctgcttctgtctacatccccggttctgatcgc

SEQ ID NO: 37641 - DNA, 1501 bp, Oryza sativa
ggccacatatttgctttgcattcacctatttcttgcttcaattttatcttttttacatgttaaattgcttgcacattctatatattgttgtcaatttctgatgttattctgaaattgcaggcactgtgcttttcagtttgttcgtaccaccgtctcttatcgttatgcgatcctctgtttcaacctttcagctcttcattaaacagagttttttttttcttgaacggttaaacaaatactagagttggagcagtgcaacaaagcaagcagattaccacaaccttttttatgtgttccctagatcccaacaataaaaaatttaaatgttgattaagtgttgtggtgtcatcaccattagagtgtattactgaaattcctgtatttcctgatttttttctcttatggattaataaataatatttattggattcatggttatatgtagatccacacaataaatttgaaagcctcaccaaaattataatatgtagaccatttaacaggaagacggtgaaatgagttttagttggctagcgttcacagaacaatataaattgtcactgtacaatgtaaactatccctctataatgtaaactacattgtgacaacgttttatgagtaaacacacaacattgtatgttaactcatgatcccaaacaatatcgcatcttttgaagttttagctaaaatgtgttaacatatattgtttttaagaacttctgttcctctactaaaaaaatattgattcaaaaaatctatttattattatcttttaaattttccagcttgaggatgcatgtcctacccaatggatagcatattctttttttttacttaaccaatagctgaattttgagcatgtcccgcagcaacgtgcggggtatcatctagaaaaaaaatgttttcgtagtagtgctacaaaactaggaatcgatgctataattttttctgtggatccaacaatcaaattttcatgtctataaaaaatggcataggcgtggtttataacatgtttgtattcctgtttaacatgggatttcaaattttttacccgattaaaacaaagatttctaattgcaaaataagtatgaatatttgtagctttactaataactttctgatattgatatgaaagccgtgaattaatataagtaaaattttgtatgatttaatttatcagtctatatatgtacattgtttaagaagataccgacgatttcctgtaataataggtactcgtatataatattccgccacgaaaatgtgcattacactgttctcatgtacaatggacctaaaatatcgtttgtttttataatttatcctcttcggaggaggcccacaatcaatctattaaatggtgaaaatgattaatttaaagaaatggaaaataaattataatttcgttttttattcttgaagcggcagagagacatcactatgataacgactaaaccctcagggaaaaaaaacatagtaggaatgaaacaagtgacttaaa

SEQ ID NO: 37642 - DNA, 1501 bp, Oryza sativa
gacagtattgcctccgttggtgttgacgggaggctcctcctccttgtcaccagtgttgttgttgtcgccggttgtcgacatgttggtgaagatgatgcagagcagtcgcgcttgaagcgctacccaaaaacatgatcgcccgcctacccgtgcaggttctcaagcggacggagtttcggaggcacctgctcgttccgatcacctgtgtgcacgggatgaacagaaccggggaaacagagagacatcacaggaacataaggagagtatcaccaagaaacaatagcagaaggaagacacaatctttgagagcctctgttttgctttatatatagagagagatctccattaccatacaaataaatctcatttattgtgaaggttaccacaaaataaatctcatttgttgtgaaggttaccacacaatgaatctttcatttgttgtgaaggttacaacaaataaatctctcatttgttctggatgttacaacacaatgaatctcttatttattgtggaggttacaacacaaataatttcatttgttaatggtgactttattctcgtctgttacaaaacggaagagcagcaggcaggctcggctcggtcggccgcctcgtctcgctacgcccacggccgaggccgactcggcacgcgcgcatgcgtgtggcagtccaaccatcacctcaaccggtcaacaagaaatccccaatatcactctatttaagttgaggttcttccacctaaattttcaatgcagtattattgtctctaacattacttgtgggctattaagattttaatttaattaaattgggcctagcccatttattccaacatccattgctcctaatcaaaaggtcattccggtgttttattatgttttacaatcctatattttatacttatattttgtcaaaattctatatttttgttccttcttttttattcctacaattgaaaggggcatagtgtattctaaattcctctggaaaatactcaggacacttggcaagccaatcgagtcacggttgtccaagttaaaaaaaaaaaaagagccatggttggaagctgccgtagaagatcatttggtggcaaggaaagacaactgccgcgaagactacagacaagcctcgccgtgtcagtcaactccaccacactcatgtctccacgtttattattctgcaaacgattttccctccccaatttatattattccactcaaagagtacattagtaatttcgaacgaattggtctggtctagtttgaagactatatagtgtgaaaaatgtgttaccttaagaaaaaagaacttcactctagctaatcgataatacgatttatgtgtcgcgctcaaaaaaaaaaaaaagcccatcaatgccctcatgtacgcattgcatgcatatgctgttggaaatatggttatatatcggtatattttaatccaaaatattaagacaataattatggcatgaacaatgtggggtgatctagtgataaaatca

SEQ ID NO: 37643 - DNA, 1501 bp, Oryza sativa
gctcatgtagttacatcccaccaatgatgtaagcaacacgctaaacccacacacgcacaagcaaactaacacaacgaactacgataacggtctaacgaggcactaatcccgccttgcgtcggagcgaagagatggatcttcttcctctggggtagctagctctctttcttctggatcttcctcctttggggtagttgacggcggtgcttctctcttgagcttggcaagttccttctgcaagcgatacaccttgctctctagcttgaaaatcttgccacggttccagatttccctctcatgagctgctttctcccgctccacgccaactgcatccatggcgcaaagcatatacacggcatgcttcagagtggtgctatcttcatcttcagagcagttgtattctccatagttttgatcatgatgcttgtgtggatgatactggaaagctgatgactaattcctcatcaaagcgatgacgtagctctcgaatggccaccaaggctgcctcctgacaagcatgactgtactttcttcccccagcttcaaacatcattgacggaaggtcttcacgatcactagtcaatgtcacgtgaacacgacacttctcctcgttggggtcacatgaaatttggcgatactcgggggcaacgtcgtagcctacttcaaatgccatcattctcagctccctgacgaatcctaccgcatcgatcaagctttccggtggatggggcggcatctaaaggaacatagaaaggaagaattaatgcatatacttaagttagctgcacaatctagactcaattaatttgaaccaaaaagaaaaataaaagaaaaggagcaaacaaaactaatttttttttcgtttttttaattaaatttcgaatttttattttctgaccgaaacataaattctcagaaatcaattcgtttttttctttttttctttttcagaactttttttcccgagaattttatttaaacaggagtatagactttggaagtagacaaaaagaagcaaatatattttttttgtacagtactcgccagaacataacgaaacaaaattttttgttttggaagaaaaaaatcaacaatggacagagataaattgctttagataaattaataaaataaaactaaatacttaggatctatcataagcacggtacagtgtcaccattaacagggatgagtagtactagtgctatcttgattgaatcgatactacagtgccgactaaccaatgaaatcataaaattaaactatttaataccctgaacagtaaagtctttttttagaaaagaacaggttctgttttggtaaagtaggatttagaaaattttgtacctaacttgcatgtgctgccaacttaattaatttagaagataatagagaagagcagtcctatttttcaaaatattttgaaggctacttaagatttaccatttgacttgtcctaaggtcaaggtggctctgataccaatttgtcacgcccagaatt

SEQ ID NO: 37644 - DNA, 1501 bp, Oryza sativa
tcatcagttggtatcagagcgttgttgcccgttaggtaatttatcttcccataaccagaaaattgtcacacaaaaatagttattctttacctagacaatttgagcagttgcattgttctattagattttgctttgttgaattctagattgcatcgtcgtgtcgtgtgctggtttagtttttagatttaatttctacttttgagtattgcatatgttcttcacttaggtctagggttcatcactcaagcccgtgtgagttatccgtcagtttgggaccagttttgtatgtcgtcagttgatgccgggaccttgaaatattgaatcgtttcgtcgtcgagattccgtttttgtaattttcagaagtttttgtcggtcgagtttggagttgcggctagggtttgccagtgcttctgccgaattcctctttggccgaacacctccacttcacggccaaccaccccacctcctcttcacggtttcttccctgcctcctcctcggtcaccacattgttgggtattttggtggttgtagaatagagatatttttataaaaacagaacctacgtgacatgagcattccatttttgaggtgatccaattttagtttttcactttgcgtttgagtccctataatattcatatttacatttgagtccctgtttgaggtcagttgttagtgcttgttgaaaaaaaatagtaaaaaataaaaaaaaagaaaaaaaggcagaaaggtgcaaagaaaaagaaagaaaaatccgcacctaaagaaaagaaaaaaaggcagaaaggtgcttaaaaaaagttgcaccaagaaagaaaaaaaatcattcatcctttgagtatgttttcagagtgcagagttgtgcattgattcatatctagtccttagtgttgtcgggtgcttgcttgagctagagttgagtctaggctaggccagcacattgactagtactttgaactattattcaactttgcattttcttattagcacaattgcgttccttttctactatatattgtgcctcccaagctccacatatattcttctggtcagcaccgctttgatccttgcaatcgccacatcacgtccttcaaggtgtcactaacctgccaccggttgtactgtccttagcattgctggtaagacacttgtaagagctcggtaagacgcttccatttgctagcctccactacaatccatgttctatagttaataggaacaataatgttatgttgttctcttttttctactgacaatggcatgttacatctcttatggacatgagataaagttggatgggagacaaaccatagctgctacatcaccttccgcagatgcacgtgatgaaagtactttggtgcaacaaatgctaagttctcaaatggagaaagcggagcaaaggcagtatcacgaattatttgaaacaatgtttgtggttaaggatagagcatgtcgtgttataatcgatagtgagagttgcaataattttgtgagttcaga

SEQ ID NO: 37645 - DNA, 166 bp, Oryza sativa
tgaaactacagctaccaaaacatatgtacttaagtaccaagtgtcaaagtgtgtgtggttttctgcaacttggactacaaaacatgtagttctgtgaaatttactcttttttaaataatgatcaacgttagttgacatcacgaattctatgaagtcaagcaaaaaa

SEQ ID NO: 37646 - DNA, 1501 bp, Oryza sativa
  unsure (1)..(1501): unsure at all n locations
agggggagggggaggggagggaaggggaggaggagaggaggngagagaagagcaagggtaggatggaaggagaaggatggagatgagggaggagaagaaaaagagataaagatgggagatggaggctgcgcatgcacaggatggagagagtgaagcaccggagatggtgcactcgtgcgggtggacatttttcttcctggttggtgttaccaaccgggtataaagatcaacttgatcttcaatccctgttggtgttaccaaccggaactaaagtttccatctttagttacggttggtaacatcaaccggactaaagatcccctggggcctgacaaactctaacacaatcccaactgggactaaaaatcatctttagtcctaattgttattaccaaccgatactaaagatcgcatagtcctggttggtattaccaaccgggactaaagatcacatagtcccgttgcacttataaactggaactatttagtcccggtttataagggaaccgggactattgtgaaatttggtcgaccgaccaaatatcatttctctagtagtgtctccaaaagaagtgtcatgactatacttctataagtatttaattttggtaaaaactatattcataactcacattttatgagaacatattgattcggctaagcatgtttgaactggggtggttttacaccacaactaagtagtagggtggacatttgtaagaaaaagacttatgaggtagaatgtcagaacttaagttatttttagagtggtttttataactttaagtcacttgtttcattcctactatgttttttttccctgagggtttagtcgttatcatagtgatgtctctctgccgcttcaagaataaaaaacgaaattataatttattttccatttctttaaattaatcattttcaccatttaatagattgattgtgggcctcctccgaagaggataaattataaaaacaaacgatattttaggtccattgtacatgagaacagtgtaatgcacattttcgtggcggaatattatatacgagtacctattattacaggaaatcgtcggtatcttcttaaacaatgtacatatatagactgataaattaaatcatacaaaattttacttatattaattcacggctttcatatcaatatcagaaagttattagtaaagctacaaatattcatacttattttgcaattagaaatctttgttttaatcgggtaaaaaatttgaaatcccatgttaaacaggaatacaaacatgttataaaccacgcctatgccattttttatagacatgaaaatttgattgttggatccacagaaaaaattatagcatcgattcctagttttgtagcactactacgaaaacattttttttctagatgataccccgcacgttgctgcgggacatgctcaaaattcagctattggttaagtaaaaaaaaagaatatgctatccattgggtaggacatgcatcctcaagctgg

SEQ ID NO: 37647 - DNA, 1501 bp, Oryza sativa
gggaaataacagtgtggtaatgcctgtaatggttgtggttcatagttgataaagaagtcgccccacacagagggctcaaagccgagtacctcctcatggacagcactgtctctcgacaccataatatgtaatacttacgagcaaatatgagagattagcttgatctttatgaatgcaaatgtgtggcacctcaccttatatatagacacaccagaatactgtagttatgtgctctgtccgtttttgttgtatgacgtgcttttgaacatgacattcaaccgtttatcttactcaaataaatattgcaaatatgcaagaatataaatcatgttgtttgtcaaagaacaacactgctcttaaggatatttgtaaggaaacaactatagcgtattatattttcaaaaacctgcttattatggaaccatgggataatcctagagtttcctttacaagttgttctacattaatatcaattgattgggaaggttaaatggatactcactttctagccttcatggatctagtgggccgtagctgagctgcttctttttgatgggcaaagctgaaagctactttcctgtggccaactcatccgtagcgatcttgcccgcctatggtggttttcatcatcttcggtggtgcttcaccatctttggtaacctttggcatcctcaatgtccttggtagccttcgccacctttggctgccatcattacctctggtgggatttgccactcttgatggtcttcgtgatctttagtggtttcgaccatcgttagcggtctttcttaccttcggcctctacattcccttcagtagctgccagctgaagtagttcgtgacctcccaaaacaatgctaaaggacactgaatgataaaagaagtaaaagtaataataatatgggtggtcagacatcatgtccaaaggtgaaaaatgttatacatttgtaaattagagttatcactaattactttaaaggatcgtcaaagcacgtgtaggggcggcttatgcgggtgggcagccaattattgcttgcttgtaccattacccatacatgagagttgcaatcatgtcatatatcgagtcaaatgcgacgtctcttgtactccctccatttcaatctaattacgattcgagcaaccaaaagacaaattaggagtgtgattgaaaatgactttagatagctgtcatgacattacatatgggattgtcaggaatgggagcatgggcgaatttaatgttggggcttgttggggctaaagccccagctccaacaggacagggaatagcgtgtgctagagcacaaggcaggagaagcaggttgcagggaggagcactaagaccctgtttagatgagactaaaacttttaagtctctatcacatcaaatgtttggatactaatgataaatattaaacgtagattattaataaaacccatccaaaatcttggactaattcgcgagacgactttgttgagcctaattaatccatgattagcc

SEQ ID NO: 37648 - DNA, 1501 bp, Oryza sativa
ttcagtcacatcatctctaatttcaactaaaatccaaactttgcgctgaactaaacacacagcctaaaaaaatagagcaggtatttgtggatgtgtaagtgcggtgtatttatgtagcagtggagcatggcatggagcacgtagcacggacatgtgcaaaattaagtacgtccactgtgtgatgtgatgctaccaccatttaagccaaacaaccattgccgaagattttaagtgctttgcttttggggataactactctatgtttccacctgtgtgtattctagccaatggcacatcgatctgcacatgcgcaccatgtcaccaacaaccactggtaatcatttttctatctgcttatactatattagtcaacgaattagattatgagatccacttgttgattcttttccggttatttcgaagttgacactaactgtttactgacccaatcctacgtacgtgagcttagcggggcttatattatggagtatatcagtgcactacagtactgtgcctcgtacacagtactgtgtagactggtataccgattaccaagctaagtttagatgactagtgtatatcaagcaagaaatgcgtagctatccatgcatgtcagtaggacgttacgaagaaggcaatctgaaagaatacccatggtttagtttgaagaagagaaaagaatattcatgcgcgccaacgttcaggaattatcatgttgtgatttcccttttgaaaaggttgtattatgcaaagtaaagatgcggtttgcgaaatagtcgtagtgtcgtagatggaatgagtgcgaatttcagaaagtagagagagacaaagacgcagacggcgatcgagagcatcacctagcgtggcggagttgaaagttgtggagccgtcgaccacgttgcggctgccggtgatgaccgtctggtccatgccgtcgccgacgatcatcagcacccgcttcgtcttccccacctcgaggttctccttgtacacccccttcttcacgtagatcacgtaccggctcttgccgccgtcgggggccgcgtccaccgcctcctttatcgtcgtgtacttgccgctcccgtctttggccaccaccacgtccgcctgcacggcgcccgcgcccgcgtcgaggagcgtgcggtctctcgccgtcagccacgacgggaacctgtccacggcctccgcgagcacgtcccgagcgccgcggccggcggcgctgagcacggcgagcgacgcgctcgcgagggacttgagcggctccaggtgcgcccccacggagtcgcgcagcggcccgtcgtcgaggccgtccaggcacgtcacgtggtcggtgagcacggcgctgagccacgtcctcgcgtcgtcgacgtcgacgtcgacgtcgggcgcgcccgccgcgtcggcgagacggtcgcgcgcgagccccatcagctggacgcagtcctccagggccgcgcggtgcctcgggtcgctggcgcgccggcgcatgcccgccaccgct

SEQ ID NO: 37649 - DNA, 338 bp, Oryza sativa
ggtttgggcgccacgtgtgtgggttaggtgagcacagcggggctcacctacccgcatttatagcaggttggacgagcgcgccacgccgcatttaatgcggcgcagcgcacgcttatccggtccgtgaccagtcacggtgtgtgaccggtcaccgaccggtcagatcgcgggttaggtggcaacaggcggcctgtcacacgcctcgccccgtcccgtcggaatgatgagagcttcctggctctcgtccctagccggagccggcgtggtaactcctggagttggcacgtcagtcccggtcagatccattccaggcttcatcgcaaccatggcaaggaagt

SEQ ID NO: 37650 - DNA, 713 bp, Oryza sativa
cttagaataccgatctctagcctgccttctagttgccgatttgaatagcatcggagtttcagccgatcgtatctgatttaactatatttgttctatatgcttcaatgatatgttaaatctgccctttatattaagatattgttgtgtctaagaatgttaggcttttgctcgatatattatacttgctttaatatcttgatatagagtagtatcggagtattagccgatacatgctagatctatctgatcggctatgctataaacatatatagtcctgttattgatatatatttcaatctaagtgatttatactgtctcggcatggtgaccgatctatcccaatcacttgatttaagtatacatcgatataaggagtatatatctttaatatctacagccgatcgagtagatttagttcttctttacttattcatgactgccgatcgatacacatatgacatcggctcaaagataaatgatatgtcatcggcatctagccgatcagctatcatttatagatttaaccacggtttctttgcttctatttcttgttgattataggatcaaataaactggcacactaacaacatccgaaggcgagctttggacctgcattggagttaagcagatctcctaggccacgtgttttctgtcaacacgcttttggcatgcctggtgggacgtgtaagaagtcagacgtcagttcttcctca

SEQ ID NO: 37651 - DNA, 288 bp, Oryza sativa
taagtaaatgcctcatgtttccttgagcttgggtttgctgaactgaactgaactgaacggaagatccatttaagctaggacggtgtgatcgatcgttgagttgatgaacttggtctatggctagctggcttaagcgtggccttccaatcagtttgtattctcgtgattttctttttatgttctctatcagggcaagtaggttctgtagtttctctagtgttacagctgttggtttctctttcttaggtgtatacatgatgctgaatatgactaccttttatttgcagc

SEQ ID NO: 37652 - DNA, 182 bp, Oryza sativa
atgccatccttccacgaactctgcttcttgaagcacacttgtgatcatatttgtttatttggacctgcaaaagcaaacaatattagcaactatgcaaaagttactccaatctgaattcagcaagcaaggtgtcaaattgcaaaggtaatttaaatggttagtataataccctgacactctta

SEQ ID NO: 37653 - DNA, 1501 bp, Oryza sativa
tgcaatttggttgcaatctatcttgttcttgcttgtgttctttgattcgcatgcagggattagccttctcggcgaggtcaaccgggttttggcacggttgataaccagaggagatgtggtgctgcgattgcggggctcagtagcgtgttcgttcagaagccggatcgagttgtgtcgcgactccgcccaaatcgattgtttatcaatacctatcggaagatcgagacctacatccctcatcagttggtatcagagcgccgttgcccattaggtaatttatcttcctataaccagaaaattgccacacaaaaatatttattctttacctagacaatttgagccgtttcattgttctattagattttgctttgttgaattcgagtgctggtttagttttaaatttaatttttagttttgagtattgcatctgttcatcacttaggtctagggttcatcactcaagagtgtgagttgtacgtcagttttaggtccagtttttcatctcgtcggttgttgccgggaccttgaaaaattgaattgtctcgtcgtcgggtttccctttttgtgatttggtgaaatttttatcaaacggttttggagtggttatactgagcgcgcgttactgtgtgcatgaggggagtactgtgcgcgtgaggagagactccgggtcagatcagatctatccatgactgtccgtattttcctctttatagaattgttaagtagtggatttgagatatttttataaaaatggaaccaacatgatatgagcaatccatttttgagatgatccaattttagttttgcactttgcgtttgagtccctgtaatattcatatttacatttgagtccctattcgaggtcagtggtcagtttctgttgaaaaaaaaacataagaaaaaaaagaaaagggcagaaagctgcaaagaaaaagaaagaaaaaaggcgcaccaaaaaaaagaaaaaaaaggtagaaaggtgcttagaaaaaagccgcaccaagaaaaaagaaagagaaaaaaagaaaaatcattcatcctttgagtatgttttgagagtgcagagttgtgcattgattcgtatcaagtccttagtgtggtcgggtgcttgcttgagctagagttgagtctaggctaggccagcacattgactagtactttgaactattattcaactttgcattttctgattagcacaattgcattcctttgctactatatattgtgcctcccaagttccacatatatacttctggtcagcaccgctttgatccttgtaatcgccacatcacgtctttcaaggtgtcacgaaccagccaccggttgtaccgtccttagcattgctggtaagacacttgtaagagcttggtaaggtgctccatttggccgagttgttgaggggcaccactacaccgcgtagcagattattagggataaccttcattgtttgctgttgtctttgtgtttgcaatgacaggtatgagtggcgctcaaaatcagc

SEQ ID NO: 37654 - DNA, 336 bp, Oryza sativa
tcaagatctaacctaatcggctgccctctgcgtacagatattagccgatagtagattaggtggcgatattgctagagattatgtaagatatatgataactcgatgaattatataaataagattagagtatcataaagatggaagcactaatcctaagaacacaatccatcataacgaattttacctattgttgaagatcgaaatcgatgcagctcaatccgacagcaagaacacgttgaaacaaaactaaagcaaaagggtggcgatgcgccgaaattgtattgaacgtgtgtgttgttaattacatagggctcggggtctatttatacccgagaa

SEQ ID NO: 37655 - DNA, 331 bp, Oryza sativa
agtacgagattcgagtcaatccgcggaagacacctcctacttatttcgaacgaagattgacacgacttttctaaggaaaatcgctagcgccgatgtgaaattgaaagctgctgagttaagcacctccgacctagttactttcccgattgctagcccctggaagagtagtgacaataagcttactaagagcctctcacggaactccttaagaagagaatgaaaattcccccctcacttctcctcccttcctcgtcatcatcctccattctcgaagccagacccatacagcgatgagggtccctcttctcgtccaagctctcccgcgcgcagg

SEQ ID NO: 37656 - DNA, 215 bp, Oryza sativa
aaataatgtactaccaattattttgcctttcatgatttgcattgtttttttatctggttctcgttacttatcttaaacctgtgcagtatcaactaaaatttaagtaacctgaaaaattagaacaatgataattgagttgatgtcactatttcatcaaaactaagaacaatattttcctttgctgcagaagcgggctgagttagcagagcaggaga

SEQ ID NO: 37657 - DNA, 248 bp, Oryza sativa
ttgaatgtttggggttattattagttcttcggtttctataaccaattttctatggttgcaactgggccccatttttttaaggtcgctttccattccagtgatgggttctgtcgaggagcttccctctctagcgggtggtcgtgagacccccccccccctttgtgagttcgaccgggggatacagcgcgatgatcaagggcctacttcggcttggcgtttacctactaaatcgctctcggggctgtgtg

SEQ ID NO: 37658 - DNA, 180 bp, Oryza sativa
ccatttttttaagatgactttccattccagtgatgggttctgtcgaggagcaaccctctctagcgggtggtcgtgagacccccccccccctttgtgagttcgaccgggggatacagcgcgatgatcaagggcctacttcggcttggcgtttaactactaaatcgctctcggggctgtgtg

SEQ ID NO: 37659 - DNA, 1501 bp, Oryza sativa
aaccagcatctgcacttggcatgcctgataatccaatttgccgtcccttgtacgcaattccaactggatggtctatgtagtgataggctgatagctccgcgaccagggtgcagcatcaatgatgttttcagagatattggtgcaaacggccatcggtacatcatctttgcatgcatgttaatcatgtgggatgttactgtgtgtttcttggatattttaaattccaatactcaaatagtaatatgctcatgtcgcacggccgcagggcagtacaggtggcgactaggcgagcactgtccccacccctttcccctcctcccctctaccccgccactgagcggccaccggaggggctcttttcctcctctcatggtcatgtcggcctagggctctgccactattgaagaaataatctttgctgggtcgactaattttcacaatagtctcggttctaataagaaccgggattaaagattgtttttagtctcggttaaaaaatttgtcagaggcttgtcaggggccgagaatctttagtcctggttaataactaccaaccgggactaaagatcaccacttttttcctggttgatagtaccaacccgaagtaaagattatttagatctttaatcccgattggtaacaccaactgggagtaaatatttctctcccatatctgatcggttaagtatcagacaagactttcctcctcaccgagatatttagataagatcggatcattcccctctcctcctacccctcaggtccccttactcctcctcctcctcctccccttcctccccttcatcctcctcccctcccctctcctccccctcctcccctcccatccggcagccgacggggtcgcgcgcggtggcaggcagtggggcaacacccggcggggccgtgcacggggccgcaggcggcaggcgctggccgtggcaagcggtggccgtggcgggtggcaacgcgccagcctttctttttttttgataatttatgattcaccgagatgtataatctctttgtttagaatttgtgatttattgcatggatctgagatgtataatctgtgatgtatttgatttttgtgtaattttttaggatttgtgatgtatttgatttgtgtgtaaaagtaacttaggatttgtgatgtgaattatttaggatgttacaatgatttgaggatttggggtttgatttggggatatacatgacactcgatttgggagaaaatacagggattaactctggcaagtagcaaagaaacaatcaaaaaaaaaagaaaagtggaccaaccggaactgccgctaccctctcgttattcccggttggtaacatcaactgggactaaagatacaactttactcccgattatttcacccggaactaaagatgggcatctttagtcccagattcgtagccccggttggaaaaccgggactacaggggttcccaaccgggattacaaacggtttctccagtggtggctaagaccggaggg

SEQ ID NO: 37660 - DNA, 271 bp, Oryza sativa
aagaactacttcctccgtttcacaatgtaagtcattctagcattttctacatttatattgatgttaataaatctcgatagatatattcattctagcattttccacattcatatttatgttaatgaatctagatagatatatgaatgtggaaaatgctagaatgacttacattgtgaaacggagggaatatgtgaatccgccgctctatgcttaattagagggtacaaatctagtgacaagtggtagtggaacaagggcgatggtgccgtga

SEQ ID NO: 37661 - DNA, 1501 bp, Oryza sativa
agactgattcacacaaaaaactgtctacgagagaggttgtgacctgcaaaactgaatcctctactcgccgtctttatctcggctacaaatcgctccagcagcagcagcaatcaagcaccaacagaataccccaataaaccaccagatccgcgaaagccagcatctcttctaccgatttcccaactcgacaagggagttgttaccctcatccagatcccgacgcgtcgctggcctgctaccctgcacccctgccccgcgccgcgtgcccccgcggcccgcgccacctgcccgccttgcgattgcaagtcgccagccgccgctggtcattgtcatcgtcgtcgtcgctgcagcactgtagccgtcgttgcagccactgtagccgtcatcgccacagccgccgccgccgtagccgctcgctccctcctacctaagcctgccgccgccgctccgtagggcggaggtgggtggatctgcgtgttgccggcgctcccactcacgccaggccgctcccgaggacggaggccattggattcatgcgccgccgtcgctcccgaggacgggaggcggcgaatccgtgtgccaccgtccttccctggctaggggagcgacgtggggaaaggcgaagatggatggaggaggagagggatgttggcggtgagggaatggatggtggcggcggcggcatatggatttagtttgggctaaggtttgggggagaggttatatgggtaggaagcaatccaacgggagtttaccaaactgtccctggtatgtcaacagtagttatgaaattgtatgaacaaaatggacatttcaccttaaatttatgagaactttaaatttaattttaggctgatttttgtgtttcaaatgcaaaaatcataaacaacaaaattgtaaaactcatcgagatctacaactactgtattggtcctttttacaaataagtttatttgaacaattcaaattttgaattttcaaaatttgataacgtcaaacaaaaattgaggttaataaatgatttaaaatggaaaagtcaccaaaaccaaagttgtagaactcattgagatgcaaaatttttattttggtcatttctccatctgactctaattaaataatttgaaatttgaaattcaaactttgagaacttcaaatagaattttttattagtgaacgacttcaactgaaaaagtcatcaacaacaaagtagtataattcatctagatctacaatttttattttggtcatttgttcatccgataaagtgattttaatattgttcacaaaatttacatatctctcttatagttttataaaccatataagagatatgtaaattttgtgaataatgtttttatcactttgtcggatgaagaaatgaccaaaataaaagttatagatattgattagttatacaactttgttgttgatgactttttcaattgaaatcattcagtatttgaaaatgttgtttgaagttgtcataatttgaaattcaaat

SEQ ID NO: 37662 - DNA, 1501 bp, Oryza sativa
gtcatgtaactaatgatgccgagattagtggtagtggccggcaatatgcatccatgaaaccgcttttgtttgtgtggtgtgcaactgtgcatgtatagaagctactagagagacgtgcagttgcgtgctataatgctgcctactacactacgaattagtgtgtgctcacgatcgatctccctagctatatgacgaccagggaccatgcgactgcgagcacacgaacatttgctacgcgtgttgtgtggttgccgatgaacaggcaggcaggccaaagctacaggctactgaaaaacacagagactaatcagatatccctcacctaattcttgaccggccagggcacacgaccagttcaacaaaactgccgtgtaattaggccaaagcgcagtgtgcacaccagcagatatataatactactatcggcagcacatagtactacaagtcgatttgccgtatgccgtcgccggagccgcattacgtgtggcggcgtgtgtcgacgtgcggccgtaccagctgcgggacgtggtcgtgtacacgtgcacgctgcaccctgcaggcctgcaccctgctgtgcgtgcccttcacatgcatgctcgtctctcggtctcgttcccgtacacgtcgcgatgtgaaagagagggggaaaaatgcgtatcgatacgtgaccgtgttgccgtttcttctttcttttttttttccgtgtgtgtcgtttcgttcttgtttgttcgggtcgcggcgcgggagacgagctaacccaacggtgatgatgtcagctgacgtggcgccccggagcggtccagctcagcaccagacaaaagccggagcggcggcgtcccgaggccggcctacgtggcaggaggacgtgggggcccaccgtcgccgcgcggttcgcatccaacggttctttttttgaccgtttgagctttgcgacgccgcatgatgccccccccctcctctcccatcatttctcacacacacatgtaaaactcccccacgtggcccgtactcccccacagccttccaatcctggccgtccgatcatctcacgtggcatctcgaagcggccgcattacatttttacaattttttagtgcattagcccctgctaattaggggattaagtcggggggcgcggtgattacgacgtgtgtgtgacgtccacatgtcgccaccaccggccaaacaccgcgcggtcactcacacggaccgcaccgcaccgcacaggctggctctatctagaccgttccggtgcggaagaagaaagcggtgcacgctaagccacacggatctcccaccgtccaagcgcccggatccgacggctcacgcgtctccccgagcgagccgtgcccgctataagttggccgctgcgctgcaccccacctcgtgactcgcacgcatatcgctttgctctgcttcgccttcgcttccgcttccgattgccgtttccgctttcgccgcgcgaagacgtaaagaaggaggcggcggcgacggcggtggt

SEQ ID NO: 37663 - DNA, 1501 bp, Oryza sativa
tcttcgggcaatttatttaaccaatttttaaagcaagcaaaagggggaaaacttcagggcgtgacagtaagcatatctgctactatattaaaaagaattggagataaaggatctccttgccttagacctttgtaagtttgaaaattattaccggtctgatcatttactctaataccaacatgtcccccttgaataaaagaagttatccactcacatcatttaggagagaaacctttcattctgagcgtctgttgtacaaaagaccatttaaccttgtcataggctttttcaaaatcgatcttaaaaatcacacttttatttttgcgatgtaattcatgcatagtttcatgcaaaataacaacaccttccataatatttctcccaggtataaaagcagtttgagtagggctaatcaccttttgagcaacactcattattctattcgtagcaactttggtaaagatcttaaaactaacattaagtaagcagataggcctatattgttgaattttcatggcctcagcacacttaggcaaaagaataatagtaccaaagttaagggagaataaaggcaaagtaccattatgaaaatctctgaaaagatccaacatatcatccttaatgacatcccaaaagacctgataaaactcagcaggaaatccattaggagccggagctttattatgttccatttagaaaatagcctctttaatttccttttcagtgaattcttgtattaaaacttcattctctaattgagatacttgtgggatgtccacaaatttattttcatcaaactggagatcagaatcatcaggaggaccaaagaggcctttataataagtggtaatatgcgattttagatttgcatcaccatttatcaattgatccccatcttgaagttgaaaaattctggtttttgtatgtttgccgttagcaaccaaataaaaatactttgtatttgaatcaccctccaaaatatccttagttttagccctttgataccacttaatttcttcttctctcgtaggagtagataatctattcctacaaaaccatctaaaatcaatttcctcctgagttagaagaacagatttagactttttatccaacaaatccaacctatccaaaatctccctttttttttcttttttatacataccacgtgtatgtttagcccatcctctcaaaatgctgtcttaattggcgaatcttcgcctgccatcgctccatatgagtattaccctcatgtacactagaccagacctcctttaccatatctacaaagccatcacggaggggttaatgaatctggactacctttatctgcatgatcacaccattgtataacgtgtacacgtgtgagcgagcttagccgcatgcacgtcatatacgtacgtgcaaagctactctgtgtgtatatgtgtgtgtgtgtgtgtgtgtgtgtgtatatatatatatatatatatatatatatatatatatatatatatatatatat

SEQ ID NO: 37664 - DNA, 1501 bp, Oryza sativa
tctgatgagataagcctctaaacttaaaaagaaaaattctaaccccaagtatccgacagctgtccaccaaaccaaaactaatgggaagccaaacaaaagaaaaaaggcaaatggaggaccaactactgcacctgaccaatcatgcataagcaacatactgacatgggttccaactaatcaaatgcatttatgcattacatggaagaccaaataaaccaaaagggaaaaataaagggaaatcattaccactatcttgtcggttagaaataaaatggaaaggggaatacatagtggatggttgactaacaaagccatgggtgattacatgcggctgatcaaagagtggcaatagtacaccactccaggtcacacttcatcaattgctttcagctttggacaattcaagatggagtccccactttggactactgtatgttcctgtcatcttcaatcattttcactctcttctctcaagttactcctttcatcttgagtggttgccaacgaatgataacaaaaacataagataaaatttactatatttacaatagttgattttgggacgtacagcggtttgaagcgcaattaaacattaacaaagcatgacaaaaacctttacagatcatgccttctttttataataaaaataaaatgaatctcataaaaatcttgtaaaattcttatattagaaacgatcaatatatgtaagatcttcataatatttatctcaacctttattttcttttatattgttccagaacatataatgagggataacgtacataacttatattgttatctgacctccaaaaataaccacgtgcaattaattattgaatacgatgagtataagaacaaaaaaaacttgaaagagccaagcatctattttgtactgaataaaacatacacgggactataagataaaaaatcacgtcattgtattgtgttttgaagcttgtttgatcagttgaaaacttttcgggcgatcacaatattcatttgcaattttcatagtgatgttatgtttgttgttgtattgtaaaaactacagcaccatgatttattatttattatattggtgcaatagtcacgaacagaaaacaaacattaggtatttcgacagcatagcaactatacacaatatcctaataattcctttcaccatcaaatagaaattgagaacaagctggatggctaccgagaatattagttacagctaatcactactccggtcgaaagaatatcacgggttaaaacaccagtaaaacgtggtctgcattggttaggccagcaaacccaacgcgccgtcattatcacaccacacatttatttttttaaaaaaacccaaactgttttaaataattaattaaaaaaatatagaaggaaaaggaaaggaaatcggagggaggaggggaggagaagcgaagcgaggaaggtcaagccggggagggcacgcacgcacagatccctcccctctcctcgctgcccatctctctctctc

SEQ ID NO: 37665 - DNA, 1501 bp, Oryza sativa
ttagggttttataaatttggaaccgatccgagccgtccatcaaatgaacggcttagattgatcccaagttgggtcgtctcatgggccgcatgcgcgcgatccgcacaggaaggaataagtttactttagatcctttatctttacatcgagtttaaatcacatccctaaaccacaaatattttaagtattttctattttcagaaatagcattagtaccattttagttgcttaaaattgctgaaaaattatgaatgtttttctgacttccatcctcgggccgtagcacagttgggctgcgggcgcttcaccggctgtgtgcgcgaatgaactttctttctttctatctttcgttttataggaatatattttcttcaagggctcataacacggaaaactggaccctaatcagctaatatcttataattgttataattttagtttacccattgcaacgcaccggtattttttctagcaattaataaaaaacaaagaagacgataggtatgtgccaacaaaaataatttcagcttgcagtacacatgctaccaatgaatctgaattgtcgtgtttttttatggctctgcaattttttcttttatagtacagtccatggcacgagtaccattttgctggtgtagacattttgggtgtgtttagatggtagagaatttgggaagttgagagaaatttgatagtttggagaaaaaggtgatagtttatgtgtgtagaaaagtttctgatgtgatgtgatgtgatggaaagttgggaatttgggtgtaactaaacaaggcctttgactagctaagcgatatgcactagccgttcctatcgttctctaagagaaaaatgtggcctgagggctacatgtagctagctgatactatcatgctacatgctgatttgattcaaggatccaccaaacaatcatcaatccctttctggtcccctcttggctaaggctatattcttaggagcttgttcccaacttactattctcgtttttcacgtgcacgctttttaatctgttaaatgatgtttttttacaaaaatttctatacgaaagttgcttaaaataatcatattgatccattttttaaaaaaattagcaattacttaattaatcacgtgctaatggataattccgttttccgtgcatactgtttgggtcgggaaccggctggattgaacacagcctaagagcaagtacaatagcaggctataagccagctataacaatatatcgagaagaaaagggaagagagaggagaaagcgggctacagatttgtagcaagctgcaacacggactcaagacgttgcgtgtgtatgagaggtgggaccggatattaatggtgtagtatatttttgtatgtaactattatatgaatggactattagattagctatgaataatttgaagctaacatttggctatactattaaacttgctctaagaaagttttatactccgtaattcaaaaatataagatataaccaccctta

SEQ ID NO: 37666 - DNA, 1501 bp, Oryza sativa
aaacggagagagtaaaatttaggatttggttgtgcttgataagctgaaagagcaaacgatgaagatgtgctgacagtaataaaaatgggttcacaaattttgggatggagtaaaggttacaaaaatggcttccaaatttgatcttgagcttatctgtgcagtcagtgagctgtactgaactactgatgaacagttgctgaagaacatggaatttattagtaagatggaagagaggttgctttgcttcagctcgagtgtactgcattttcctatgctggattcctttgagtacgtgtaaatttaacacgccgccatcaataggaatctggtacaaagaatgatggagcaggggcatttgaatactgtatattttattatcaacccaattcatcaagcaatttgcagcaaatttgatgcaagtctgaagaacaaaacctgaatttcatctgaaccgaacccctgcgaactcctacattcgagattccagttagaaaatttgcattctgctgtcacaaattttactaggacaagcacgaattgctcctaaaagttaattttttttatatatatcgcacgaattgttcctaaaagttagtaagaaaaagagagcaaaaagcctttccaaccatggtgtttggtgggctcagaaaggaaaaaaaccagaatacctaacattcagttaaatttcggtcaagtacagtgcaaggcagatgcacgtaacaatgtaacatcacggcaatgagctggttaatctaatcccttaactaacaaattcccaatctcacagggccccagatctctgttgccaattcaaaaaaaaaaaacagcttaaaaattcgtaatagagagtagcctctctcaccttcttcaatggcaaagcttaaatagagtgaatgggaagctagagccatggccatcatcatcatcaacgatgcatccatggctatagcctaagaggaagaggaagaggagatgatgaacccatcacacccagcccagcactaactaaccctcccttcaatccaactccacctcaatccaattccattctctcgctcgcaccaaacagctgcaccgattttgttcttttcccacttaaaaaatttggatctttttcgggtgctaaaaaccctttctttcttttttttttcttttctgtccacttcgttcgtggtggagtggatttggaccacgcgcaccaccgcaaccaatcccccttcccacgacaaatcccaatcggaagcaagaatacaagggagaaatcgatagaaatcgaccctgaattggagccatttgccaccaagaactcccccaccaggagaggaatccatcatttcttggcccactccaccaatccgaagaaagaaatcgcgagaaatccccaccagattatagcgcatcattagcggaggattagagccaagagaagagaaaaaaaggtggaagaaaagcaatggcggaggtggcgctcttccggggcccgaccaacctcgcttcaccc

SEQ ID NO: 37667 - DNA, 1501 bp, Oryza sativa; identical to SEQ ID NO: 37440

SEQ ID NO: 37668 - DNA, 1501 bp, Oryza sativa
gtaaggtcaatgtacctagctttaattaataatggatatatcgagaggaataagtatgtttggaagcttaagatgccacttaagattaagatcttcatgtggtacgtgcttaaaggggttgtgttaactaaggataatttggcgaggcggaattggaatgacagcttgaggtgttgtttttgtatgaagaatgagtctattcaacatctatttatggattgtcattttgcaaagttcatatggagagtaattcagttctcttttggttttaaccttcctactagtatatctcatattttttatgggtggcttttcggggtagataagaaaaagagtaaactaatacttgttggagcttctgccatttattttgcaatatggttgagtagaaatgatatgatatttgataaatcaccatcaatttcctatatacaggtaattttcagggtaactcattggctccggttttgggcacaattacaaaggtgtgatgaagatggagactatctgaaagttgcatgtcgcaagttggagaccacagttatgcaactttttgccaattatggatggagattcataaatagactacaatgaatgtgttatccttattttagattgggtttttctttatcctgtttggtgtgttctatttgtttggaactacactcttttctggagtgctactatgtaataattggttgtagctctttttgagtaaaggccaggatattatattccattatctaaaaaaatttcaccagctcatttagtttgagttattttcagcaactcaaatttatagcttccttgttttctgttagcacgtttcctgaaatgctacaaactgtgtttcatacaaaaagtttctatataaatatttcttttaaaaaaaatcaaataaacctatttttaaagtttataataatttgtcatggttatagatactacatacctaatagtagttgattaaactcgacagagcccaccacataccatgtcttatatggaaacaaacctcgtatatagaaggagttgcggataaggaaggacaagaagagttctacatgaaaacgacacagactactcagatcgtatccatatttatctccctagttttacttggacaagggaacctatgggtataaatacaagctcctagggtataaatacaagccccctagaaggagagatgacacacccaccatagacgccacaaagccaccagccaatacaaaccaacacactaccagatatcgacatcagagattagcatagacaaacccaatccaatgcatgcggaggctgataagagggatctagcactatctctgatctcaacgagttcatgctcaaggaggaagactaccctgtcatcgactacgagttggttatctagccgccaagtcgacgacagctagatagtttatccagatgaataaagagcaacaccggcttcagccaacgggatgcagggctattacctgtcaaataaggggcccga

SEQ ID NO: 37669 - DNA, 233 bp, Oryza sativa
acaatgtttttatgtaccatataaattgttaaatatgtttcttaaaaatatgccttgaccttattgacaaatgctcttcagctcttgttttcatacattacgttgattctacgacaagttttgcaaacttaacctatttgcactgataatatggaattttgagcaatatcgattatgcttaatttttgtttgatttagcatccgagattgtggctgattaaaactttacttgc

SEQ ID NO: 37670 - DNA, 1501 bp, Oryza sativa
ttagttagtttttagccaaaattactattgttgacttcttctaaaacttgaggactagggcatctagtctagattaaccaacatgaccaagcagagaggatgttgattgacttcattgtataaaggtgatcaattgtaataagatcgctgggagtgcgaggatagccaggcgtaaacaactctagcgtatttcttggtttccaagacactttgagagcagaataaaataggtatgcgtactgtgcgagaacggcaaatacacagtagcaaacttgtacgatggattagccgattgagtaccgcctgatttcccaaactctccatgatacccatacaactggactatgacgtataacaatgcattaagctcggtgccacacgctatcgtgtgtagatagcaaagaatcatatgacagcgccaaatcaagccggtcgctattgtgcttccgttagaaaaacaccccgtttttgcggatgaatcatttccaagcataatgggccgaagttcatgaccggtaggagatatgggcccctacacaaaaagctacttacatataggaatggaatacactagggccgtagcgcattgcaagccctggaagacaaggcgtccacgtcccaagaagaaataagttcactttgactcccttaattagtgaccaaatccgattcgtatcctggaaccgtaataccggatatctcgaccccccccaaaaaaaactattaaaactggtgcaatttaactccctcagtggttttagaggacggtttcgctgacgtggcgtccacatgatagtgttgacctggtctgtggcgttgatgtggcgcttaggtggcattaaagttaaaaacatatatatgtgaatcatttgttattcacaaaaaaaatatgaggcacacgtgtcatcctttatctctttcttcttcctccccctctctctcccttctctctttctttctctttttcggcggatagtggcgcgtcgccattgcagcggtgggcaaggaggctcgaaggtgagcccacagcggcgatggcaaaggacgccgaagaagaaaagaagactggggagaaggagggagagagagccgtccccgtcatcaccggcgccgctgccctagagctccctgggcgagctccatcctgttgctaccgtcgtccaccataggttgctgccccgcactccctcgctgtccccacgaagaagaaaaggagactggggagaaggggcgagtgagagccatcctcatcaccatcggcgccgccgccctagagctccccgctgagctccgtccagtcgctgccaccgtccaccactggtcaccacctcgcactccctcattgtcccccgcgctccggagcggcggcagcgggacaacaacggggagcagcggcggtgaggacggcgtgtgaaggcacgtgctcacgccatgcttgaggaaggagaggcgtctctgctgctgtgccatctgccgcgcccaatgcatgtgtcatcattgg

SEQ ID NO: 37671 - DNA, 1501 bp, Oryza sativa
catggataattatgttggtacttgtgtttattctcatttcattgtgtacctctttttatctctcattcttctggaatctggttggatcaaccaactgttccagcattttcatcttgtttgcaagtactctgttctcatatgtttgaaaatttaagttctaagttttgaacattggatcctcgattccaattcacattgcgttaattcatccacttcatgtttctgaaagtatcgtaatttccctatactgaactatctgaaatgtaactctcaccatcttatccatgtccatccattgcatcatgtagctttgtcctactccctccttcacgctttgtcctaatcgtcaaaaagaacaatagtataagcaagaaacacatctattgcaatttcatccagacatccaggtacgcttcagaaagaaaattcagacagataagaggcagccgagaaatgcaaatttcagcttgctttctgcctgttcagctgtaaatgggatgaattgcactccattgttgtgacagtcacatcctttattccctgtcagttttgaaagcagctacacattccatcttcaagatcacttcacagcggtgtgattctcagtgacaagaacactactggttggggaaaatcatcgcgccattatcagatcagttcttgcaccacgtgaaattggaattgttttttgacagaacgaatggaattctgttctagtgatcttatcagagtttacatcacgggggaatatccggtgaaaaccatcgaataaaaccggacctttttcacgggtttgatggttttcactggatatttccactgcatcatggtctacaatcatatctcagtcgcacacagaagtggtaactgaagcattttttttataatacaaatattagcctctacatccaaaatacatgtgaccaagtaaactgtgtgtaaaaagggaggaaaatacctccaaggaactgacattaagaggaagaatatgtgccctatctcgagacagagagaactcagaaaattgatctagcttcttacttcatagagacataaaagcatatggatcatgcatgcaagtcacagcaagatcatggcaaacatgaggacaggtcaactcctgttccagaatcagaatagtgaagcaactgacgtgtcaagtacagataacagatttcatggggctcagagatgcctcctctagctgcattattgcacaccttttacctgctagtagcttctgaattctgatcaagcaagccaaaaagtacttatattatataagatcctgaattctgaacaccaacacttgtgcttgcagcttgctgttgcagtggcagtcatacagaagtacagaatcgagtagtagtagtagcatttgcaggcaaaatgacaggtctcctcaagtagttgctctccacttgtgagaaaatattccaattccacagccacatacatatgcctgaatctttctcagcctcttctttttctctcacaatat

SEQ ID NO: 37672 - DNA, 1501 bp, Oryza sativa
cgtctcctccctcgcgtcggcgcggccgtgcggcggcggcggcggcgccctggccgccttgtcgagcacgatgaacgtcgtgttcacgttgttggtggccgccggggcgaggtctttgagcttcaccgtgctgccgctgctgatgccactgacaccgggcgcgtcgggctgcagtcaatccattctaattgttagtcaaagttacactgtaaaacatcaagaattggccgcttgcacagtcgatatctatatcggtagagtgatgtgttgttgctgaagcttgtgtaggcgtacgccgaagcagcagatcattggctctactgagcattccatcgaacatcttgaggtcgtcccaagatcgacacaacttctcaacgcctcgacacaacaacaacaacaaaatcaaatcccacatgtgaggtacttgggaggaaactgcggggttacccctttgtgtgccatgggtgatgctcggtagccgggagagcgccgccgaagtgatgtactccgcccggcggcggcgccgcacctaactgcacacacccacacctctccctcttcctgtacgcgttgttgccaacggcttgtttgatgggccggttgacgggcccccggccccgctccaccgacgctttctgaggccgggtcgccgagaggtgagccggcggcgggcgagtggagatgagcagaggcggagatggggaatcggttgcgacttgcgagctggctaggccgaggcgatacggcgtcgtggtcacgagctgagctcgcgccttcgcgcatgggtgcgtcacggaacaggcaagaagggaacgtacaccttaagatagtttcatactctgtgctgatagaaaataacgaacaccttaaaggcaaggtaacccgcacacaactatactctatgctcatccaaaggtggctttcgtaaaaaaaaaaagagatcatatgtgtacccttatgtgcataccctctaaaatatgctcccctaccataccacactgcatagtaagccaaagcacctgctaatatgtttgaactcacaacaatctatttatcattaataatctacctatttaatatcgaagaaacaagaatacttaaatattgtgtgcaaagataaatcaatagattattagtacttgtttggtgattaaatattgcaacacacagcacagcagtggaaggcagccaacctctagttgctctggtaataaggagctatcgtctcgagagattataacccactcccctctactgggcattctatcgaacactttaaggtcgtcccaatcctgacacaagttctctaagagtttttacattcatgcgaaaagacagtagtaggcttacctctttatgcgccatgggtgatgctcgacagacagggaaacaccgcccaggtgatgctccgaccaacaacggcgacgacgcagacctccgagagaccaccagacgttggattgggaagaagctaaagccaatgggcgtgtctgggccgagg

SEQ ID NO: 37673 - DNA, 1226 bp, Oryza sativa
tcacccccccccccccccccttccttctgtccattcgaagcaagaggattgattatacggctcaccgctcacgcccgcacgcacgtacagcggacggagtacaggagaaaggagataaatgccgtgggtttatcgctttttgtttaagcaaagctcgatcattaaacttctcaagagctcaattagtactatattagcttatcttgaagctaacattatagatatataatagattagctataaaatttggctataatttttttcttctctctatctctcacttatatatttaatgtatttatcttgaagcttgtgttaagctagttcttacataagaaccaatactcttatttttttttgttgcctctcttcttcgtataagtttatagtagacttataacttactattatatttgctctgaaaagtgtgggttggatggtgggtgggccccgtgaggtgggttgggatgttttccgcacaattgttaatgtcgtgtttctagttcgaaagaagctcagaagctgtttcctcgtagtcatagggtgatgtggcaattgttccttttctttttctgtttcgcgcatcgagcagggtgagcattttagttgtgacgggaggtaatcaactcatgactacacaaacgttaaccagaaatgagatgggcgctcttccaacacccaccagcccattctcgggtgtcacgttcacttatggaaaaagtacaccgaaggtccctcaatttgtcatcgagttacaaaatcgtcccctaaacgcaaaaccagatatatgacatccctcaactcacaaaactgttcactttatgttcctcggtggttttatctccggttatatccaacgtgacggctgagtcaacgtgagacccacatgggccccacatgggccccatatgtaagggagaccatgtcaccgccctctctctttttttcccctcttctcccctcgtctatcctttttcctctgggcgtggatggcggctgacagggaaggagcgcggcggagaggagggccgtgcggcgccattgtcgtggctgcgcgttgttgtcggggtgaggcggcgacgcatggtggcgcgggcggcgtggcggagggcaaggccggttcggccggcggttggcgagggaagagcgcggtggataggagggccgagggccgatgacttggacacggtgagctccgccggctgcggtggagacggctacgacca

SEQ ID NO: 37674 - DNA, 321 bp, Oryza sativa
ctcctactagtcaactgttgcaacatactgattgcagcagaataaccaaaagtctttcagacccaccaacaatgtgtgcaatgtcagactttagatgagttgctagatctgaaaagacttcatttctaggtagtttggacctctctttttctgggcgtcagattcacttctattctattagatagcttttaaattcaatccaagatgttctggcactgaaagtgtagattctgttccaacttttagctactcattaactttagaactgtaaaatcaacccttttatcaatcgaaggcactcttttcgaaatgaagggcttc

SEQ ID NO: 37675 - DNA, 1501 bp, Oryza sativa
aactaaatatgcattgggccacatcacccacaaacaagagccattggatcattgcaccaaaaactaaacatacattgagccatatcttgaatcagaattaatgcgtaggttcaaatgaaaatatatgtattctctaacataattaatgcgtaggtgagttagtaaaggagagcacgtgtgaatgaaatatcttggattcaaatcctagctatgaaaaattatcaaaaataaatagttaggatgatagattaatatttaaagttttaatttggtatgtagaactaatgtaacacatggagtaatgacaataattatttatgactatgtgaagtgttgcaatatgatttttttgccacatccattttgtggcaatatcaaaatttattaccactaaataaaaactattgcaataacctattaccacgctatttattaccatggctagcaacaattttaaaatggtggcaacatgtatctattgccataattttagtattcatgccacgatttttttcgtggcgacaacttatttttctattagtgaaatttatagttgcattgcacatatgaatagttcgccgcgacttgtggggagtatcatctagtatcatatataccccaggccccatttcaacttgttgaagatgaaaattaagtagcgcatgcaaaacgagaaaactattagcacatgattaattgagttttaattattttaaacttgaaaaatataattatctaatattttaaagaaactttagagtgaatttcagaaaccccaggttttggggcacctataacacaaaaccccaggcattacgatttgttttgaagaaccctaagttttggggcaaaatgtttcaagaaaccccatgtttaagcttatatcatcgtttttgctaatatatttatggataataattgaaaaaaataatacgagatatttctgagtatatataaatgctagcctcattttaatgagcaaaggtcattggtagtataattgtttatatgtataaataataggttagtgtgtcattattaatgatgttctattgcgtttttatcaattgtgcaactaaagagtaaggaaaaagatatattacataggatcgggtgtgtatttggagcttactaatgtaaaaatatactaaaaatcatatataatatttaaattatgagtatttgagtaaatatggggtttcttgaaacatttaccctaaaacatggggtttctctaaacaaatattataacgtgggttttatgaaattcactcaaacttttatgtataaagttttagtgcaaaatacgtcgtttaaaaaacgtgctagcattaactgagataaaatctataacttcggcagtgtttagttcccttcaaacttttaaaaattctgtcacatcaaatatttggacacatgtatggagcattaaatatggaaaaaaacaattgcacagtttatatgtaaattgcgagacgaatcttttgagcctaattacgct

SEQ ID NO: 37676 - DNA, 1501 bp, Oryza sativa
attagtacaattggtactttatcatgattcttttggaatacagtttttggcaatattttcaaaagacctagtttaattccgacaaatattcttcaaaatcatctattgcgaaagagagaaaagcttttgtttcctattcatagtataacctactccatccgttccaaaataaaccaatctcgtgttattacatcatagtacgatgaatctaaagataaagtatgtccaaattcgttgtactaacataacgttagtttattttaggataaatgaactataataaaatctgaaaaaaattaggaatcaaagcagtagtttctacaactgctaactactacaagggaaaataaaaacaacagcatatctcagtgcccaattatgaaatttgtgtcaatgctagaatttagcaaccgttttacagaagttttgcgagatcaatttgatccccacagtaataacagagataaatctccaaacctccaaggaaacatttgaaacggagaacttatctccccatcagatccaggaaaaatctcgcagttcaaaacggtgccttctgttgctgacccgatctggcgacgcaactacagccagatacgcgcacgagcctgcgggaaggagagccacaagagccacaaggagagtccgtccgagggggagagagagaagcaaacgtagacggcgaggcaacgatccgaacccgaggtgaaagagattatcccctcaaacaagccaacggccccaccaccacacccctttaacattctccgcttccttcccttgcctcgccgcttcgttctcctctcgccgaatcaattcaccaaatcgaagagaaaaaaccgcaaaccagcaaccgattgcttcgttctcctctcgccgaatcaattcaccaaatcgaagagaaaaaaccgcaaaccagcaaccgattgcttggactaagcgcatcattattttcttttttttttctctcagagagagaagtagtagtaataaacgtaaccttttcctcctattttatttcacctaatcccaatctcctccccccttccttcctcggccagagaaaaaaaaaagagaaaaaagaggagaggcctcgcaactgcaaaccctcgctttctccgatcgaattgctcgcccgagcaccaccagttcgccgcccttcccaccaccagtcgcctccctcccccgcgcagggtatctcctccggccgccccagtggcgattccccccgagctcccccgcgcggcgccgtggccatgtcgctcacctgaggatacggtcggtgggctgtttcttgcaagagtctctcccccgagccccccaagagaaacagcccgggggacgccgagttgttgattcgatcgccggagttgcgccgaggtgaacctgttttttgtttttggtggtggttccgtctcggttaatctgctttaacttggaggcaaaggctcggtcttcgtctgaggaacgcgggggagcggtggtagcgtcgcgtgcacgg

SEQ ID NO: 37677 - DNA, 574 bp, Oryza sativa
tgttctgaatgttgcaagtgttcgacaggtgaaagtattattgattcttcggtaggcagcacaaaacaactgttactttgtgcctgcatccaaagcttttcagaattcagattgacttgtagctaaggcaaagatttgggcaatggatttagctttcattaaattaagctataggataacttaatcatgcagcatcaagtgtagtttgcgtcaccatctcatgaaaaaacagttatgagttaaccatgttcgtggtacgaagtttcagtggtatgtgtgtcttttccccttcaataaaaaaggttggtgatagtgttgatgttctatgcccatccatcgatatctccaggtgggttgtttataaaagttttgaaggtctctggagatattttgggagtaacttctccagcattgtctttcataaagaaaagtttcaggttgcatttttttaagtacttacctttccacctatcatgaaaatgtctattggaaagatagaattctttgtatagtggtggaaaatcacaccagcctcctcaaatcctagtaaagatttggtgcaatggcttttcga

SEQ ID NO: 37678 - DNA, 1039 bp, Oryza sativa
tactttctcatatatgtgttgtgactaagccatccttctctattccccctctctcatccaagctagtaataataaatattgtattgtcatgcatatcattaattcattatagttattgttgtacatgcccttaactatcatatattgtgttgtcatgcatatcgcaaaaattataatggcatgtatccaattaacccttaattatattagtccggacatacaggtctcatgattagcaataagagatttgctctggtcttgcaaaaagtacctcgaggtactagtacctcacgatactggatcgttggatttagctgggcaggatgggcattgttagatccaacgatcgaaaatgatttggtactttttgttaaattggagcaaatttctatcatcaaacgattggaggaacgtgatatcaagcacataaataataattagctggctggccaataaaatgaaaaaaaaatcttgattagataatattataaacatttgtttttcattcaaaacagtggaacataaaaaagtttcagtcacacatttatgaaaacttacagtatatatggagtagtaaatacactgtaacttatttgccacactctgaattcccctctttcatcttctgcctaagatcgtaggtatattctacgttaaaatgcagaggggtaacagcaaagctgtcatacacgatgttgtgtaaatgtacttctaacactccgaataaaggatatattaagaaagtacatcaatgcagaaaaaaaggtgacacgccaatcaagccattttggttctatgaatcttcatcaatccaggcaatccaaagataattatgcaggaccaaactcttttccacgtgaacaggagaactggccttgcttgggacatcgctgcccaaattcccaatctaatcctcaatgtgtttgcgatagctagggataccccgatttccatatttccaggtagcagagaaacaaatgctatgatgcagacagacactgctgcattaagagtaacaggagctagcaccaggtacatt

SEQ ID NO: 37679 - DNA, 1286 bp, Oryza sativa
ctttatgtttcctgcaataagcatgcattcaggcgtttgcaggccgcagcagcaatctatctgctgacaagagaatgattcacagaagatctatccgcttagtgaacgcagcctttcggcgccaaaaaggctacatgatatgagttgcaacggcaaacggtccatactacaatctttttttttatttgtgttgcccattgtgatggaagtggacagtgtgtagtgaatttctgcttgaaaaatgaactagaaaaatgttcttttaaaaggaaacttgtgttttgaagactaaaagggaatattgaatcggagatatgggagatactgatggctccaaatctagagggaaattatgtgttattaaaaataatttctttaataacaattgttttttttaaaatctcatagtcaaataacccctacaggaaaccgtaggcagcatgccattacatacacactcaactagctagctagagtcggtttgaaagaaatggtgccgatcagtctcaacaaaaggtttaaaatgcataggtttacaagctggcgctgaaacaagcagaagcccgctacaagcaataagagtctgtttggtgtggtattttttttaaaaaaaagtactatattatttcaaatgttagtctttgttttaaattatgtttataaccttctgcttctccactttgtttgttttattgtttagtcttattttcatgatggataagatatataacagaaagtacatatctaaaattattcttaagatcacattttagcttttctcataaaaagtaatgccaatcaaggctttttatttttttaaaaaatattgtaggaaaaggatccgatcaaaacagtgcagggcctactttttttttgaatagaagtgcagggcctactttttggaaccatccacacctcatagcccaaagcaaagctacaccgaagccaccttgcaaagtagtgtcatactcatactagtgcaccacattcaacacgatgcaatgcaaggattcgatttccatccatcgattaattaccagctattataattataaatatcttaggtgcggtccctgtatgcatgcatccaaaaatcaattagatttggccaggttgttgttggagctggagtactgtttctgggttataaacaagatggacctaggtcaacccggaaattaaaaacaatcgatcgttcactcaatctgtttagccatatatattgattaattgatatatacgttgccccaacactatcatacatgagtctgtaaaatccccacagc

SEQ ID NO: 37680 - DNA, 1344 bp, Oryza sativa
ccccttattagtcgtgccaaatttcaaccaagcattatctgtgtctttaaggcccctaaaaatccgctgaatagctttccagtgttctttacaaggattagccatgtatctactaaccaaactcatagcatgagataaatctagacgggagcaaaccatggcatacatcaaagaaccaacaacactagaatatggaactctagacatgtattctacatcctcatcagtactagcacattgtaaagctgataatttaaaatgaggtgcaatatgagtactaacaggctttgtatcatgcatgttaaaacgctgaagaaccttcttaatgtagctttgctgactaagaaataaccaaccggaatttctgtctctagtgatttccatacctagaattttcttagcagcatcaagatccttcatatcaaactcactactcaactgtttcttcaatgtagtgatttgttccttgctcttggcagcaatcagcatatcatcaacatataacagcaagtatataggtgacacattaacaaatttaatatacacacagctatcaaattcagatctcttgaagccatgtgacaacataaatgaatcaaaccttttataccattgacgaggagactgtttcaaaccatacaaagatcttttcaacttgcaaacataatcctccttaccaggcactatgaacccttctggctggtccatgtatatctcctcctcaagctctccatgtaaaaatgctgtcttcacatctaactgctcaagctcaagatcatgcatagcaacaatactgaagaatgtgcgaattgaactatgctttacaactagagagaacacatcattataatcaacaccagcaatttgactaaaaccttttgctactaaacttgccttaaacctcggagggtcgctagaagataaaccctcctttctcttgaagatctatttacaatgaacaggcttcttctgttttggcaagtgcacaagctcccatgtgtcattcttctcaagagactgcatctcctcctgcatagctgagatccacttctcacggtctccagaaacaacaacttcagtgtatgtggctagctcaagagtattctccacctgttcagcacaaataaaagcataataaaccatatcacattcctcaataaggcggactggagctccacaactcctctttgttctgcgatgtgcaataggttcatcttgtggctgcaaaacaggaggtgagtgctgaacagtatcattaacatcattaccaacaatttcagttttctgatcatccacgtgctccacctgcacgctaacatattgctgctcctcatcaaaaccacc

SEQ ID NO: 37681 - DNA, 1501 bp, Oryza sativa
aacctccctaagaggttgtaatcaggggaaaaacataccaccaccaccacatgttagcaattccaaacatacccctagacaaaagaactagcaccaagccagccgccactatccgtgactgaatgccgctagtcttgcaaacgccctggcgaacactagctccaaaacagaagatcgtcaacgggctcccggtcatcctcacggagaaagcttggggagggagaggacaagagagaagaacacccacttgtccctcacgccaacctggtgacgacaactgacaaaacgccaaaaaccaaattgagagaagcctgtgacggcgggaagatgagatctcaaagacgatgccttcaaggagcatgatgctcaagacgccaccgtcatccgtccaggaggtatgatgctcaagacaccaccgtcatccgtccaaaggactaggttttctcccggagaatctcccaaggaggaagagggtgtcagcttgacagcgccccaaaggggtgaaacgctgctagatgccgacactgccagcctagagaactccaagcaaggcgttcgcctacagttcactctattcaacatatcatcaacaacctaacacaaagccacccaagcggtctccgatagcacgcagtcttgctgcgtcagctatcttgcgtcggtcaaccaccttcggcaccttcggttgtgccctgctagccccaccgtccagctcctcgtggcatcagcgaccgcctcactctgtagcctcctagtcatggcctcgcgcgccgtcggtgtgcgtgccactagcatcacgcaccgccggcctccacctcgcacaccattagcctactccttgcttgcttgttgcgctggccacccataggcgtcgcagcccaggccacgccctcgcacgctgcgccaccgccatcatgttgtctttcatgttgccacgccaccccttatcgcagtgcagccctggtttctactctcctcctcaccgccgcttaaacttgtcggctggggcaccagaacgatctggcagtgaggggactaggtctagccccaatgatgccaaatctagccaccgatgactgtcacttaaagctctccctccggtcttagccaccactggagaaaccgtttgtaatcccggttgggaacccctgtagtcccggttttccaaccggggctacgaatctgggactaaagatgcccatctttagttccgggtgaaataatcgggagtaaagttgtatctttagtcccagttgatgttaccaaccgggaataacgagagggtagcggcagttccggttggtccacttttcttttttttttgattgtttctttgctacttgccagagttaatccctgtattttctcccaaatcgagtgtcatgtatatccccaaatcaaaccccaaatcctcaaatcattgtaacatcctaaataattcacatcacaaatcctaagttacttttacacacaaatcaaatacatcacaaatcctaaaaaa

SEQ ID NO: 37682 - DNA, 1501 bp, Oryza sativa
gctagcagagttgacccaagctggctggtagattattttgtgtgacacccaacaaaattacagctgcatgccagattgttttcataaaaagatactgtgattgtagactttatagctagtttctcgatccacaagccacaataatcttgtaacttcttcggctttgccttcccgacatagttcatggcttaacgtacctaaagattctaaaatttcgtaagttgcaaagctcttggaagtgctcaagtactcaagctagcgcagttaattgttctatcgctttaggtttcatcaaccaatttgacttcactaatcaggcattagagcaagtttaatagtatagccaactactagctccaatttatctatagccaatctaatagcttattcatacaatagttacatactacaccattaatatatggtcccacttgtcatatacacactgtgtcttggagtccgtgctacagctggctataaatttgtagcccgctactcttctctctccttatttatctccttaaaatatgtttgcagctagtttatagcctgctattgtacctgctcttatatctctttacgtgtgtacatggctactgtcgcacactcgcatttatgagctatagctacgacgatggctgatcgatgtcgatctataaaagataaatcaaattacaattcatcaaaatttgagcctattaggatttgttttccgagctcagctaatcagattacctgtggtgcaatctaacgacccaattcaagtttcaggtggtacggctgaccatggtttaaaattcctgaccgaaaattttgaaattatttcgagggaagtattatatattttttttctgatttggtcaaatttgttcaaattttgttaaaggttcaaattattttgggcttgacaaagtatgtacccgctacacgatgttaggccttcaatgagaaacgtacaggggtctttcggccacttccacaagatggtagactagacgacctggattcgaagtctcaccccttctaattatctaatataaggtcattctctaatattcgcgtctttatgttaggccttcagtctctttagatttgtgctagctaggatatgtccatgtgtgtgggtgtaaccatgtcagtgcatccgatttgtactcgaaacaaataattacaattttcctttttgtttttccttctagtagaaaatactccatccgtttcatactataagttgtttgacttttttcttagtgaaaattatttagattttaccaagtttatagaaaaaatagcaatatttacaacattaaattaggtttaataaatttaatattgaatatattttgataatatgtttgttttgtattaaaaatgttagtatatttttctataaatttgatcaaatttaaagaagtttgactagaaaaaaagtcaaacgacttacaatatgaaactgggtaattaaagcaggaaaaaaaatctcggcgcggcgacttaccga

SEQ ID NO: 37683 - DNA, 1501 bp, Oryza sativa
ccgtttcatcccaacttgaaccactgtcactttatatctgtcttttgcttatgtccatagcacttcaactaactcattactcatgggaatcgtgttaattatcaaaagagcttgacccaccagtggaagtctcacataataatgtactttattcgacgagaataaatgggtttcatttacttccgatttttcattgagaaatacataaggtatgtaatcttctcacctgtatgtcggaaaaaattgaccttaacttgtcaaatacaataatcttctgtttcttctgcatattctccaatatctcaattgtgttccatatgggtcttcctagggatgtctaattagatgaggatataaatgaaaattttatatatatagttcaaatttaaactaaatcctacagttttagatccatctttactttcttcggaacaagccccaatgagaaaagaattattggtgagcatggtttacttataaaccttaaacaccccaaattcatgtgattgaatcaagacaaatttcagaataacccaaaagcgatttgcaaatttttccaattcaaacaaatgaagaatcatatccatgcatattttctagaaacgaaattctcatgcagctagctagctagctagctggaagaacaattaaatataaccatcaataagcagttagagtgacagcaacctctgtgcctgcaaacaaaacggttggaaattaacccaacttgcagatagcccactccatcagtgcatgggcagtgtgggtcatgccaactgaaaccaaacctacggcacatgcagttcagtgcacagcatatgggacaatgcatcttagagattgtagctagtataggatgtaaagaagaaaaacaaatctgaaaatggtagcagcttcagaattctcaccaattgggatgcacaaaatgtatggcttgtttgatgttgtaacagatcaaggcactgcagagcagtgactcaacacctacctaacacgcatgtttgttgctccttacagtgtcgttttcctgctggtccagcgcacgcacaaacctgtggctttatttttctttctacttcagtctattggtataaaccgaactaatcgaccatgccatacaagaaatgtgaagctctatttaaaatgtagaagtattaacatatggtgggtgtatttaaagtttgatttggtgtgaaattctaacgaatgacagactcgaaacatgtaacaagttctatgcgagaaatatgaagcttcattcgaaatgtaggagtattgacatgtagtgggtgtatttaaagtttgattagctgtgaaattcttagggatcacatactcgagacatgttacttggaactgttagaactggaacagtagttgattggataaacttggtttgcacatggtgacaacgagaaagtaaagggtaagaaacaataggatgaaatgatactcagccattgaccaacatgatatagattgacatcagattcagatgcaa

SEQ ID NO: 37684 - DNA, 1501 bp, Oryza sativa
tttatggccctatttgtcagcttttgtagtggatttatttttttttcgctctaggtcatacgagtacatcctagagatctgctaacgcaccaattttctggttttgataattacttgtaccacaaatactccctccgtattttaatttatgacgcctttgacttttcgatcaacgtttgaccattcattttattcaaaatttttgtgcaaatatgaaaatatttatgtcatgcttaaagaatatttgatgatgaatcaagtcacaataaaataaatgttaattacataaattttttgaataagacgaagggtcaaacgtttgacaaaaaaatcaacagtatcatacattaaaatatggaggtagtatataatggggtcactaatcatcattaccattgcttcctttatgtgatgtactaatatgcatttcttttccatcattttatcactaccctccttttttagtggtagtggtacaccatcaccatccctctctaatccaatacatacaaaagcactaattaaatgactgctggtactacataacaacagaacaacgatcagattaactggacagattatcacatcaaccaaatccaaatcacccatcacaagttgcagttattgagccgttgagggagttaaaaaatagtgttaaccctgtcgcaaaacaaaaaataaaaagttgttatctcttggtgggcactgcagtgcatttgcagctgctttgtctgcttctaccaaccggaatctccaacccagagatgcagagcacgctccctggccctatccactacaccatcaccttttgttcagccaacaaatcaataattaactaacaattaacaacagtaattaaagagacgtgtagtcttcagagaaacaatattcagagacataaaattgttcacatgatcatttttagtcccggttctttttaagtaccagaactattgtggttttgggttgaccgaacaaagatagttttccagtagtgtgatgtagttcatttgaagaaataatttaggaacttcagagagactgaatttgtggatgtgcagaggtaggtataggaaggcgtcagttcgcatggcagtagttagtactcgattacacgatcggagatacgttagttgtgggcatgaatcggatcgtgtaggatggggatagggagggggatgaacaagataagatgagatggaagatggccaaaatctcaataatttccctcagcagcgcctatctggggcacatgttagtgttagtgctgcccctctcctgcactcttttttttattttttatttttttggttctaagatgcttctctccctgttctaatactattactaccacacacatggttcctccttccctttgactccaccatgctgcccctgcacaaactgaaaaaacatagagagaaaaccaaacattggaaaaaaatataatttatccataaatgtacatatatatgtttttcttccaacagtcatgatatag

SEQ ID NO: 37685 - DNA, 1501 bp, Oryza sativa; identical to SEQ ID NO: 21396

SEQ ID NO: 37686 - DNA, 712 bp, Oryza sativa
  unsure (1)..(712): unsure at all n locations
cgtaaactttaggatgcgggcgcgataatgaatggtgaaacacagtggaggttgaagatggagagataggagtgagcaatacaagaaatgtgtagatgaagtacaaagaagacatacaaagaaagaaaaatctggggagtacgtgtgaatanaatgggggaggaaaaaaaaaccgccctagggggtctcggcggcgagcggcgggcacggcgacggcctacggcggcggatccggcggcgccgtcctcgggaaggccggatccgccgtcctaggggctctcggcagtgagcagcgggcacggcgagtcggcggcgccgtcctcgggagggccggatccgccgccctacggaggagcacgacgctcggcgacgatgacggcaggcggcgagggcagcaggcacggcgctgccccgcgacggccggcggccgcagcggcgtggatctggcgccggtcacgtggtgtccggcggtgggcggcgggcgacgggttagggtttcggggggtttttggaattttattttttttggctgaaaaatatctttgcatgcggttggctttgtggaccacatgtgaaaatcccctttttgcatgcggttgtgttgcccgcatggagaaatatcgatttttacagacctcttgttccatgcgggcaggctagctgcatggaaagatccatttcgcccgtatggaaaaagctcttctgtactagt

SEQ ID NO: 37687 - DNA, 1501 bp, Oryza sativa
cgtgcttgcattgcacacacccatgcatgaactaactgagccatggatatgcatgtgttggtgttaatttgcaggtaactagctagctagtaactgctgtttcatgtaacagtagtagtactgaagaagaagatgcagtgaggaagacatgatcaataatcaattgatgtaagaatcatatgtagttgttgttaacttcccctcctcttcttttctctatctactatatatatatcacttcttctttattaattagcactgagagtttcagatcatgcatgagtgatgcccgagttgagggtaatgtgcatatgtaagtatagtgtcatgtaacatatttgtcaggtgattcgatctttttcttttctacaaattgcatgcaaaccttgtatacatgtctacgtacgtaacagctatgtataaaggatgtcgtaacgtatgtgcaattaatgaagcagttcttttggtacaagtgtctcttcactgtatgactgtatgtaatgcatttgttctgttgagagtacggcaattatctaagctaaaaggaagaatgacagtactcccaatactccaaacattaatccattaattaaggtgcaattaattatatttttctccatttactgcttggtttggtgaaaaaaacacgaatattagggaatgatctaatatcaaataattagaagaggtgaggcttcgaacccaagtcatctagcctaatgtcttgtggagctagccaaaaaatctctaagtgtttctctgcgtgacactactcaagtgcttgagctgagccaggtcagccaactataactgaagacaagcataatcgcttttcagttttctccatttagctatctgacacctgacagagagtcgatgctctctcacttcactaaaggggtgtttaaatccatgggtataaagttttagcgtgtcacatcggatatacggatacatttaaagtattaaacgtacactaataacaaaataaattacagattccgcatgtaaactgcgagacgaatttattaagcctaattgatccattattatcaaatgtttactgtaacaccatattgtcaaatcatgtagcaattaggcttaaaagatttctcgcaatttacatgtaatctataattagttattttttttatatttaataatgtatacatgtgtctaaatattcgatgtgatagggtgaaaatttttattagaggatctaaacatgccctaattacaatattctttctgacgtccattgacagtcagagcctacccacagtccagtacagtagttgaagcttgaaggctgatgacatgcttgactcttattgccatctgatcgatatgattcgctgggtttattcaatgaactgatcactgtgctgttcacattacaattgcctaaaccttatccggaacactagcggcagcgatcagtggaacgtacagtagtcagagtagtgatcagtagtcttcagtttatatatttatatatagc

SEQ ID NO: 37688 - DNA, 602 bp, Oryza sativa
tttcattgtcattttgcaccacatgcccagctgtgaactccgattctactccctcaatcgccagccatctgtaccggactgaattccagtgtgcacgcatgccacctatgggttcatcctccttccgttccttgagctgccagaggttgccggcgatgaagcttaacccgtcgttttgtatgggtgctatggatacaaatccctgcctaataagatgctcaaggttcggacctagctttcgtcggtcggcttcccaaggagaaagtagcaggagagcatggcctctaacctttgatccaattgctgccactggtagctgatacctgatatttcctcagttttgtgcccattttgaggtttaccatgtatattcattggttgcattggtctggtttttgccgatgtgagatgaacttgctggtcccaattccttgttgatatcagtagcagcatgtaactactcctttctcttgtctgtaaataacctttgtattgctgtgtattgtccggaaatgaagaaatgaaatgcggatgagttgaattattttcttctctgcacttttgctggaaaccaatgattcagattctgttagtggcaggca

SEQ ID NO: 37689 - DNA, 1501 bp, Oryza sativa
gaggactaacaactgaaaacttaaaggagctcagcctattcctgcctgcgggtggaaccttcttgtttcctcaagcagtgacgaggtcacaaaactccaagcctagggcgccctttgctctcactagtatcttctagtgctgcaaaagggaaatcacacgatagattatcgtgagcggcgacccaatcaatttatcacgaaaaatcatgtcattcctagttagccagagttgccagctcacagctgccaaaaacatccaactcagagtattatgagaattgtcattaggtttcaacattgatgcaaaaaagtgatcaaaggatgaaggaacaaagttccagctaaacccatctctagcaaaacaccatataaaagatgccatgggacaagtaaaaatgacatgttgagcattttcagtgacaccacaaagctcacaagcctctaaaccttcccagtttttttgtcacaattgttcagtggtttggatccgatctttcattgctagctagagaaagtgtttttgcttaagaggaatcggtagtctccacagcatattcattttggggtcaagtatacctctaaaatttaacaactgatataacgatttcgaggtatagactccattctttccatgaacccatttgagcacatcagcctcgtcggtgcaagcaatctcttgtgttagttcagataactccactcagtcagctctacattaccaaaaagtcttctgaaagtaaggcattctaacccctcttgagccacctctttcacaattattctttgttggttgcaaatttcatagagccccaggaacctaattctcggggggcaattacctatccaaacgtcatcccagaacaagatatggtccccttttcctagagcccattctcccccaagaacaaaccactttatgatatttagtaatcctctccagaattgggagatccctacctctgaaccatagaaaaagcctctatctctcatatacttgtttcttaaaagatcaagacacaaactcttttcttttgattcaagtttaaagatccatttggccaggagggctatattgaaagctctagtttcagtgaaacccaggccaccaaactctttagggaaagctaaattcctccatcttatcatgtgatactttcttttagaacttaggcctgcccaatagaatttgcctctaattgagtccattttctggtgaatcccttcaggcagtaaatataagcccattgcataagtagggatagaagagagacaagagttgataagaacagctctaccactatagtacaaggaacatgttttccaaaaaccgagtttcttgaccaacttctgtggtaagaagtctaggtctgcattcagcaacttgtttgggctaataggaagtccaaggtacatcataggaaactctcctaggggacagttaagcatatttgcaacactctctctgataatttattttcatcccagaaagctcttcaaaaca

SEQ ID NO: 37690 - DNA, 1501 bp, Oryza sativa
gagaaaattttgcgggcggcgaaacaaactagtaatcgattcgaaatttaaacgcattgttgttttattgtttgattagtttagctcaagaaagattcatagctcagctatgaccagccagattacacacaaaaaattcgagggtgtgaaacgttatggagaacgaaatttacagaagagcatggagaagataaagggaaaaggaagagaaaaatgctgctctccattgctttcttcttcctccctcccctcccccaagaaaagaattccccccagtattccaaagaacatcctaaaatatttcccccaaaaaaaaagtcgaaataagaatgttaatgttttgatcctggagtggaatcgaccactggatggccagagaataagaagaaaaaaagaagaaagaaaaagaaaagaattagcagaagaattagggcggattatagtcacaagttcttggatcccctggtgtagccgtagtaggagaggtaccacttgacgaacttcttgagcccgacgtcgaggttggtggtcggcttgtagccgagctgctgcctcgcgagggagatgttggcgtgcgtgaatggcacgtcgccattgccgggcatctcgaccacgttcttcttggccttcacgcggaggtgcttctccaggatggacaccaggttgggcaccgtcaccggcgaggtgttgccgaggttgaagatcctgtagggcgccggcccgcgcttcttgcccccggtgccggtgctcttcccggccgtgtcgagcgagccgaggcagcccttgacgatgtcgtcgatgtaggtgaagtcgcgggcgaggtcgacgcggttcttgccgcggtacaccgtgatgggcttcccctgcaggatgttgcgggtgaaggagaagtaggccatgtccggccgcccccatggcccgtacacggtgaagaagcggagtccggtgatggagaggccgtagatgtggttgtacgtgtgggtgatctcctcgccggccttcttggtggcggcgtacagcgacgccggctggtcagtgcggtcgctctccgtgaagggcaccttgtcgttgaggccgtagacggaggaggaggaggcccagacgatggccggctgcgggtcggcgtccttgcatgcctcgaggagggtgacgaggccggcgatgttggagtgcacgtaggacgccgggttctccatggcgtagcgcacgcccgcctgcgccgcgaggtggagcacgtgcgtgaagggcacgacgtcgaagagcttggcgaggaggcggccgtcgttgatgtcgccctcgatgacgaacaccccgtgcgaggcgagcagcgacctgcgcgccttcttgagcgaggggtcgtagtaggagttgaagttgtcgatgccgacgacgccgtcgccgcgcttgcggagcgcgagggagcagtgcgtgccgacgaacccggcggcgcccgtcacgagcaccgacatccccgcgcccgccgccgacccgggcggccgcc

SEQ ID NO: 37691 - DNA, 1501 bp, Oryza sativa
catatgcggttacatgattaaaaaaatcccctgaaattcactagccaaaagccgtacacccagctcgatcgtacggcctctaaaaattgctgcgagagggggcggcagatcagatcctgccgcccggctaggagcaagtacgtcggccggttggcacttggcaggagggccttttttggaggcgacgtgtagacacgctgttggtgcaggttggtatccttgttcaccgccatttgtagaaaatttcgaggagcgtgcagctgtatgcgctgtgcagtgtgcgccaccacacacgcgagaatctatcgatctcccgatttcacgcggccttacctactatactcatctgcaccttgtcacttctgccatgcatgtgtgcgtccagtagtacgagtatcagcaaccggccatgggggacaaattcaactaaccatgtgaaggtgatcgagattaaagtgcaactaatagattgttggatgtatcacgatgcagattaagatatactaagattcaggggctattcaaatcacagtcaaaataaacattaccaaatttcagaaaaaaaaacattaccaaatttcagcaccgcaaaaaatttgataagttagcaatactaccaagttttggtaggattccttatatatttaccaaagtctggtaaaaaaatttaaatgtatgcacatctttaacaacttaaaaaaagtatagtttgaaataacattaatatgaacaatctcttatttttgtgtggataggacacgagaatcagttagttaagtgaatagagcaaaactgcaaggtcaatatgagtagagagtcagattaattatcagtgatgccgagaagatctatcttacgtatgaattaggtggtgttcttttctcctgaaaatgaagatgaaaattaagttttttacacaaaacgaggtggtattaacgtatgattaattgagttttaattattacaaatttgaaaaaaatatgatattttagagcaactttcatatagaaagttttcgtatgaaatacaccgtttagcaatttgaaaaacgtgacacgaaaatctgattcatccaactcttgttggagaaaagaacgggcctaacctcactagtactcacgcatttgatgcaacgggatcatcggtgcacactgcacgtagctgaaggccataggagagaggcgacggtggagacaagataaaaagaaggatagcaacacatggagtcagggtcgtccctgcaacggacgccatatatacacatctgtcatggatatattcgtgctgcaggtcaaagctaaattaatgccaggtgccgttcatgtatgttaatgttatccttctctatctgcttcacatgcatgcaaagatatatcctgcacattgaccatggaaaaagggtacataccaattgatgttacgtaagtaattaatcctgatcaatctttttatccaatgcttaattagatccttaatctcactgataatttcgtcgccctcg

SEQ ID NO: 37692 - DNA, 1501 bp, Oryza sativa
ctacctggacgccatggagaagcggggggagctggtggaggaggcggaagcctgcgcgttgcccatcgccgccgccgccggcgaagtcggtgttgcggccgcggcggcgaagtcgcgattccttctctcttggagagttggagtgcagcagctgcgcggcccgccacgccaccaagagacgcctttctttcttttaagtatttttttttaaaaaaataaaatatatactcctccgtttctaaatacagttgactttttaaaatatgtttaatcgttcgtcttatttaaaaaatttaagtaattattaattcttttcatgtcatttgattcattgttaaatatacttttatgtatacatatagttttacatatttcacaaaagtttttaaataaaacgaacggtcaaacatgtgctaaaaagtcgacggtgtcaaatatttacaaacggagggattgcttaaacaaaaaaatcacaaaactagagatttattaccaattttatttttacaaaactacaaacataataaaactatagctttctaactttgtaaaaataataactttattaatccgtactaacttatacgcttatactccctccgtcctgtcactttcaaccaaaatctcttatataaggattttggtacaactagaatcccttatatttagggagagagagagtagatatgtagttttacatagtacacataatgttcaatctgtgattatgatatactccaacacatcaacctgccgttttgtaatagtttggtggaattatacttagtttgtgaaatttattttttttcttttttgagggatgaaacatttaacgtttcaaaatggaccactggcccaagaaagggagaaggaataagttcgccggaggtcccttaatttaatagcgagattttctaaggccccttaaccacaaaaccagaaatcttcacccctaaactatacaaaaccattcaccggaggtccctcggcagtatttttgcccggttttactgacgtggcatcctagtcagcaattttttttaaaaaaagtacttgggcccacatgtcagctgcatattctcttttctcttctcttctttggagaggcgggcagatgcgggtgcgggcacggcggggcgtggggaaaaagcgggagaggagggcaggaggcgggcgtggcaggcggcaggcggcgcgcaacgagctgcgagttaccactcagggtcgagcttgagtagctgcgtgaggtcgccaatcggccaatggcggatggaaccacgatggagctcaacatcacgccggcgaacatgttgccgtcgaggaatatctcagccaaggcgttgcagttggtcaggttgtccaagaactcccaggcgccgccgtcatcggtcggcgtacggctctgacaagatggacgccccgctcctgcggagcttcccctccctggggcaggcgctcctctcatcgtctcccgcgcccgcgcggatgctctccgcggcag

SEQ ID NO: 37693 - DNA, 1501 bp, Oryza sativa
tttgtaaaatcaaaggtgtttttgatgattattctgtgatgaacaattgggcatcggagattattggttttgttatttggaatttattcacgaagtggttttggagatgattggatttcacaggtgatcgcaggattcattatttcatgtgaccggtcagaccgggctctggtagccggtcggaccagcggtatgcgcgcggtcagaccagccagcccacggtctgaccggccgacactgtgtcggtttcggtttcgggttgtttgtttggatatccgtgattatttcatgattatgacttctagatggatactatacatatgtaatactgttgtttgctactaatgagtcaagttggagatagcttggtctcggaatatggtttctttgtttgttccatgtgtaggtgactcgatgtctcgggagagtatttgcggtgatggaccgggagtcggcttggggataagacgacgtctgtggtgatcagagatcatgcgggatacttaggctagagttgatgcacgtggttgatggagattccatatggcatacgatgaagttattgtgtgcgtatgggatgtggagtcaaatttggaaggagtccaaatttggtacgattggttatgtaatgtttctttcttctactagagggtttcctaaggtgtttaggactcttagtatgagtttggttcgtggctttaggctgcctacctcatgtataaatagagggggagcgtgaggcttcccggtatcgcttttgagagcaattgagttgagttttgagttagagtttcgagtttagtcgaaatttttgtaaggagtgctgttggtgcactttgtaaacatagagagaagtaataaagtcgtcatccactttaagagttcttcgatttgtgtttcactgggtttcggcggtctaaccggcaacgcaccggcggtcagaccggcggcatcgcggcggtctgaccggcgggcacacgacggtcagactggcggtgacaggagtcgacagcaggcgttctcggcggttcgaccgatcaatctacatcggtcagaccgacgttcatcaagcggtcagaccgacagatcaatctcggtctgaccgcgatccatcgatttcgagggtaacttttatttccgctaaaagttttcggtttttgggtataccaaccattcatcccccctctggttggcttagttcttgtgattcgatcctacactatttaggtcggcaggagagagagagattaactttggagcaatgtacaaacaactttctccaaaatcaattccaatctctcctcctcttactctgaaactctctgttctttctctctgttcttcctctcgactccgttctatctcttccgctatctccaaatctctccaaaacaattgaatcgcagttgagaaaatcgagttcgtgacaatttggtatcagagcaaccaatcctggagaaaccacgctacacatcccggctgcaacttcaagtggaggcga

SEQ ID NO: 37694 - DNA, 361 bp, Oryza sativa
ggctagttttctatccgttgcagaatagcacagtctgaccggccacatacctccggtcagaccggcagagcacaatgattgggggatttcgcccccaacggctagttttggtgggtgggagtataaatactcccccaccagcagcaaggggactctcttggcacccaattcaattgcatacaccccttacacctctctcacacccacttaagctttgtgttcatccatctagtgtgttagagatttgatctagccaagagtcaagtgcatttgcttccattgtagagttagtgtggcacttgattgatcatctccacgccgggtcattgcttgttactcttggaggttgccgcctcctaga

SEQ ID NO: 37695 - DNA, 1501 bp, Oryza sativa
ttattcagagaactgaacacacgtccagccaaatcccgaccaaaaaccatcatcaatcagccgatcctgatgttgtccctgccgcacacgagcgtggtggcccagttgaccgccacgtagaacctgttcctccagctcaccaccctcggcccagacacgcccattggctttagcttcttcccaatccaacgtctggtggtctctcggaggtctgcgtcgtcgccgttgttggtcggagcatcacctgggcggtgtttccctgtctgtcgagcatcacccatggcgcataaagaggtaagcctactactgtcttttcgcatgaatgtaaaaactcttagagaacttgtgtcaggattgggacgaccttaaagtgttcgatagaatgcccagtagaggggagtgggttataatctctcgagacgatagctccttattaccagagcaactagaggttggctgccttccactgctgtgctgtgtgttgcaatatttaatcaccaaacaagtactaataatctattgatttatctttgcacacaatatttaagtattcttgtttcttcgatattaaataggtagattattaatgataaatagattgttgtgagttcaaacatattagcaggtgctttggcttactatgcagtgtggtatggtaggggagcatattttagagggtatgcacataagggtacacatatgatctctttttttttttacgaaagccacctttggatgagcatagagtatagttgtgtgcgggttaccttgcctttaaggtgttcgttattttctatcagcacagagtatgaaactatcttaaggtgtacgttcccttcttgcctgttccgtgacgcacccatgcgcgaaggcgcgagctcagctcgtgaccacgacgccgtatcgcctcggcctagccagctcgcaagtcgcaaccgattccccatctccgcctctgctcatctccactcgcccgccgccggctcacctctcggcgacccggcctcagaaagcgtcggtggagcggggccgggggcccgtcaaccggcccatcaaacaagccgttggcaacaacgcgtacaggaagagggagaggtgtgggtgtgtgcagttaggtgcggcgccgccgccgggcggagtacatcacttcggcggcgctctcccggctaccgagcatcacccatggcacacaaaggggtaaccccgcagtttcctcccaagtacctcacatgtgggatttgattttgttgttgttgttgtgtcgaggcgttgagaagttgtgtcgatcttgggacgacctcaagatgttcgatggaatgctcagtagagccaatgatctgctgcttcggcgtacgcctacacaagcttcagcaacaacacatcactctaccgatatagatatcgactgtgcaagcggccaattcttgatgttttacagtgtaactttgactaacaattagaatggattgactgcagcccgacgcgcccggtgtcagtggca

SEQ ID NO: 37696 - DNA, 1501 bp, Oryza sativa
  unsure (1)..(1501): unsure at all n locations
tttagcaccgacaagcatcagactcggtttcaaacggattcacgaccgcacagatcaggtctctcgtactcgttagactcgagtgagttggtttggacgctggtcaaaaaaaaaaaaaagtaaactctcgaataaagaaaaggaaaaaaaatatagctctagtgacagtactcactctagttctatattaattgacgttttggataaggttgaggttaaacttttataattttgaccaccaataactttaaaaataaagaaactagaaaaacatatataattttgtctttcaaaacactataataaaagtaaacatacatttatttattgtatatattataatagaaaaataaggttaaagatatatcttgtagagcgtgtcattgtccaaagcgtcaattaaaatgaaacaaagggagtagtattagtatatctcgagcattaaggccctctttatttaggcttaggcttattggcctagacttttaagtcagcttattggcttatatgatttataagccggtggatttaatgtcctaagtttagtagttgagtcatatatctacctcacataaaccaaaaaaacttctctaacctaacttttggcttaatagtgttagagtggcttatggctttaaaaaagccaaacggaaaagctgcttgtttgtttaggtttagacttttcgacttataagttggcttataaccctaaacaaagagggcctaaatccaatccgacaaaccaaagtagtactccctctgtcccaaaataagtgcagttttgcactattcatgttcaacgtttgaccgtncgtnttatttgaaatttttttatgattantatttttattggtattagatgataaaacatgaatagtactttatgtgtgactaaatgtttttaattttttcacaaatttttcaaataagacggacggtcaaacgttgaacgtgaatagtgtaaaactgcacttattttgggacggaggtagtagagtacaaaaatctttgctggaacaaagagcgagagatcccgtatgctgtacgttgtcaacggagtaaggatcacgcctcagctacaggccatactgcgccaacatcacaagttcacaaccgaggcccgagggcaatctcggcattcgcacaaccgattcaacgcttgcaagcggcaacaaacagccgacgcccccacaccgccacaccacacgcagtcggcgccgcgatgataaaaggcgagagaaatttacccacgagtcgctcgcgcggtgactgacacaccgtggcgatgacacacgccgaaaggaaagcttggccgcggcgcgggggcattttcgggaggagacacgaccacgaccccacgaggggatcgaaaagttgcggagcttttatttaaccggccggtttgtgccactctcgccactgtcctaacctgcacttcgctctctactcctctcgctctcggtcatgggtggtggtgcggcggcgagcagggtgtcgtcgg

SEQ ID NO: 37697 - DNA, 1501 bp, Oryza sativa
tgggttgttagattgcttggtttgcatgccgcaatccgcaaatgttttgctccttgtcccgatgatctttttttttgtctaattggattgctgatgaaaaagctaatttcaagaatgggctcgaggcctaacttctcggcgctaatgatgctaacgctcacaccctaacagttgagatgtactagagaggttagagccaataaaactgacgttgagaacctatctataaaaaggaatttctaaaaaggatcatttttttttaaaaaggatgaaagttcatgtaatctgctcgatttcattgttgctttgatattttagatcctggataaacagtaatgcggccctctcgtttaaaagaaaaagacaatttggacagagacatcatgcattgttctcatgatactgtaataactgatggattagtactacagtagtgaccaagaacagaacagttgctaacctcacaccatcatcccctaatccatctagtgctgggtacagttacaatcactccgtggagtactgtaacctgctggggcccacttgctctgctcccaggcccacctggtggtgggccgtgggcccagtgacctgcccactctagcagggtatccagcggggtcagaggggcccccagcgtactgcaggagcggcatcggtgtccgtaattatcgcaggctggtcgttgtcggcgtgaaacgtgtcgactcgacaccggtgctgcagtgacacacgctgtgtagtggatcggactattggcctatgggaggccttgaccgggtatagccggttggttcctggtcgtgtcaaaacaaaacatcctttccaaccacatctgaggtttacaggcgcattaactcatctataatcttcgaataaactaaaaaaaactgatctaatctcactcaccgaggtttttcagaaataataataaaaaagtgtacgaccagttcctaaatttatttcatgcgttatataagttttttaactctcaatatatttttaggtttgtgattttaggtttgtgatttgttaaagaatgtcaatccaattccaaattgccacgacacctctaggatactatgtggtgacgatggcgctaacgtggcatattacctggatatttcaaccacattttttttatttttttccttctcctctaccttctcctttcttttgccatacaaacaggaaggaagaagagagaaaaaggaataataataataataataataataaatgtcatgtggcatgcgacgtcagcgctatgtaagatcccgaaggtgttgtggttattttggaccagaatgacacacttaacaagtttggtgatgtaaaaatacattttgggagtttaggtaactactctagttaaaagtaacacagatgaacaagtttaggtgctaaccatgcactttacttaaaaaaaagtttcttacgaatgattctacccctccagcttcaagttctagaccttaacacatgtgctcttatttataac

SEQ ID NO: 37698 - DNA, 614 bp, Oryza sativa
cccccaagtcttgcctttggctttgggttttttcttgcacgagtttcgttactgctgggttgttagattgcttggtttgcatgccgcaatccgcaaatgttttgctccttgtcccgatgatctttttttttgtctaattggattgctgatgaaaaagctaatttcaagaatgggctcgaggcctaacttctcggcgctaatgatgctaacgctcacaccctaacagttgagatgtactagagaggttagagccaataaaactgacgttgagaacctatctataaaaaggaatttctaaaaaggatcatttttttttaaaaaggatgaaagttcatgtaatctgctcgatttcattgttgctttgatattttagatcctggataaacagtaatgcggccctctcgtttaaaagaaaaagacaatttggacagagacatcatgcattgttctcatgatactgtaataactgatggattagtactacagtagtgaccaagaacagaacagttgctaacctcacaccatcatcccctaatccatctagtgctgggtacagttacaatcactccgtggagtactgtaacctgctggggcccacttgctctgctcccagg

SEQ ID NO: 37699 - DNA, 1501 bp, Oryza sativa
gcgaaggcagatgattcacatacaaaaatgatggtggcgagatggcggcggcttcgacttctcgggatagctacagcgagaacaacggcagtagcttctcgagacagctgcggcggctgcccgcacggcaacaacgcggcggcggctgctcgcgacggctgcggcgacaacgcctgcagcagctttgtctggcgacggcttcgtgcacgcgtgcagtcgaatggaatcccctcgttcttcctgcgtggaagacggattacagtagcaaactgaaatcgtggatgcgcccggaccttagccgaccaattatctatctatctatcgatctatacttatacttatactaattggacactttctacgagctctcacgttatagaaaaaactatccgtctattaaaggaatcatgtaatcatagccgtacatcttatatccaatctggtttaacactgtgggccaccttttaatggccatctaatgtacgtaacgtcgtcgccgatcgtatctctaacgaaagaagagacggggattctatcgcgatcacacctgcgaccatctgggaaaacttttatcagcgatggtacgtagatcgatgctccagtcgtccttcatggcttcatcgttattgctgtaatggatttagagatcactgcaacgttgtgaattgttggtagatcaattaggttcgcaccctttttttctttcgtagtaattttcttcaactcaatctatctggtaaatcgatctccgtcacatgtgcaaacgaaagcaaaatgatcagaatctaaagaggtggcctgatagcaggtttgcaggccgcggcaggcagtaatgaccccaacgatgaggcaggcatgtaccttccgttttcttattctgatactaattcgctctccttccgtcagcatcattatttcatttgaaattttttggtaagcattatttcattttattttattatatctagaaaaatcaattaattggtgaatggttattgcacaagtatgttcatgatctttatttttttatgattttttttatcaatttgccacattaaattctttcactattatcgatcgtaatatactatactagattagctatatgtatatgcgcacattctttttcctggaacaaccttgcaccatagccattgtcagttgtgttgtgagataatttttttgaatactacggattaggtgtttaaattattaattattcgagtaaacacatgcaattttttctggtgtctctttggctaaactatctatttgtacatttaactaggctccctgaaagttagcaaatattgttatagccttccggtgactatggagttcaattataaagatttacatccataaaaaagttgatgccatgtacaattaaaaaaaattcaaatcgataaaaaataattaaatgcaattgaatacattaaaacaaaattacatattaggtacaacttatctattacaatttctagactcataatttaataat

SEQ ID NO: 37700 - DNA, 306 bp, Oryza sativa
ccaggacccatcaagatcatggcacttgaggcaatgagatttgctacaataacaaaagtttattttttttcatcttccattgaatcaaagcaaagagaggccagaaactaacctggatatattagtagttgaggacatgtgtgcattagccgcgggccacgtagaatagacatcacattgggtattagtttacatcaaccagcgacaagccaccacaaaaacaatcttcgaagttcgtacatcttaattaaaccaacaccattcctaataataaaggtgttgtatatatgctccccacgtccatca

SEQ ID NO: 37701 - DNA, 1501 bp, Oryza sativa
tagctccagctttccacctctcctagaattggagcccaatcaaatggtttcaactccactcaaaatgggagtggagttggttggagttctctcacaaaatgaactagtagactactaggtgacgtcctacaatatatgcttcaaacatcgaaattgtaagtcatcaatgcacaaaattattgtgtacaaaaaatgacattagtagatttgtcgtgaagtctagttatatcttttttaataatttcctttgataaataaatgatatgataaaataatggtcaagtatatttatcggagattgatttggggctcataaatacgaaagaaaattgcctgttcatataacaatattcgtgttttacatttcagagggtagagtttcgagcaatcggcgatgaagtgttcgggctcgttgcaatcacagcatttccttgaggaatatctccacttcgacttgtgagaagagagttaatttgtatttataactaaatatgacgtcttacaatatatgcatttaagtttctaaatcttaagccattaatgcacgaagttattgagtatgaagaattacattagtagatttgtcgtcacctattaaacctattagtaaatttattaggtatttgaaaacatataacacgtagtataaattttactatctaagggacatgttttagttattgcgtactctgcgtgtgttttagagcacctgtaatttccttttcatattatatgataaatatatgatacgataaattaatgatcaaatatatttactggagattgaggggttgtttgacatcgctccagctttctacctctcctagaattggagcccaatcaaacagtttcaactccactaggtagagtttcgtgcaatcgacgatgaagtgttcgagctctttgcaatcatagcatttccttgaggtaggggtgggcagaaaaagactgaaccaaaaagaacgagactgagaaattcggtcatcaatttggttctaggtagtgaaagacccaattttgttcagtcaatttggttattttcctcgattaaccaaataaaccgaattaacaaaaaaaagtctaaatgcaacctacaatccactaagtttaatacgattaaactctaattttcacatccctacttcttctaggcatgcaacctagtaagagtctttactcatatgtgcttacattttttttgtgatttttgtgttgaaaatttccattatttctttgcgtatatgaaaatgttgttgaatttcggtcaaggaccaagactgagaccgaatttgttggtcctgacatttttgcgttgaaattcagtctttactttactttttaaagacctaaagaccgaagacccataacgaaattttcagtcaaaccaaatgcccacccttaccatgacgaatatctccactttgacttgtgagaagagagtttgtatttataacaaaatatgacgtcttacaatatatgcatttaagtttctaaatcttaa

SEQ ID NO: 37702 - DNA, 525 bp, Oryza sativa
aggagaagaagggagagaaaaagaagaagggagaaaaaaaattccatgtcatcgtccacgtggcgtgccacgttggtaagaccacggtcaaacgagactttggaccgggatgatacaataaaccaagtttagggatctcgacgtacgttttacaagttcgtggacctaagtgaaacctcacgacaagtttaaggaccgctgctgtattttactctaaatttaatatcaatcatcatatttctaagtcctacatttcttctccagattttagtacttaagggaagggatgatgagccatagtaatttataaaaaaatacaaatcaaaacaattattaaacctatatccagaatatatcccggtagcacacataatacatcaagctgccactcaaatgaacaagagtacatattaacttttgctaaaaataaaccatcccttaattcttacttcaagatcaatcacaagaaaattgcatcaaattaaagcatatcatcataaatcttgagcactactgattaaaaga

SEQ ID NO: 37703 - DNA, 1501 bp, Oryza sativa
tatatttattcatgtataaggttatcaaggttcatgtgcacaatttttaaacttttttgtgaacaacataactattaccttcttttctatctaatgcttacaccgtcagattacatatataacttcccttactgaaaagattgcatatataacatgaacaagagtttgacacctcatatgtccaccatggatgagtctgctaagtttgaggacaattatcatttgatagaaatataagtagtctgatactgatatccctctaagtaaccaagcatgaatttcacatggaactgttaaatcccttgggaatgggtaatttttccctcctttgagatgagcctaattcagcttaaatatatgctacagataagcagatgcttcttatttttacctgatgatggtgattgaaagttgaaagtactaatctttaatttccatgtctcatgtttacaacttttaggtcagatacacttcacttaaaatatgtatgattttaattttacttgttctttaaaaatgagatctaggtttttcatacatacatattttttggagctatattatgtgagcacaagttattcagagtactggtattgttgcttgtctcgtcctggttcctgcaagatacactcggagtcaaccctagaatgctatagagcttcgttgtcagagcaaactggcaagaataaactcctctttgactaaacgagcagagccccaattacatcagcaaatttaagcggtacatttataaaaataaccaactaaaaagcagtaaaagaaatcaagcatagatgcgatagggttctaaaagcttgctggtgagatgtcatttcacaagctgcaccttgtgaaacatcaaatgaagtattgaagttaatgggctgctagtttcctataacttcattgaagtgtaaagagcattgaaggagaggctgcaaagacatatgtacgacctcgccgttcaattaaagacactatttacctaaagtagcacatctcctatttaagatctatttattcacataaccagtgacacattgatgcacatttactttgctagatagaatcagctgtggccataaattctgttcataaagggcattcaagatgttaacactgtcatacagctattgccaactgctgcatggtgtaaacatactcacaggtattggcaatagcatggtggataagcagagggggcaatcaccagcaggacaagttgatttggggctcaccaatatgacaggaaagtgtcttaagttcgtatcacaggattcatgttttacatttcaatagggagtttgtatacttagaatagatgatgcattcaaacatcgaaatcttaagtcattattacacttactaattaagtactctctccgtcccataatatagcaacataagaccgtataagacatttcataattcatagcacaatgaatctagacgagaggttatctagattcttgtactatgaaatgtcccatccggttctagg

SEQ ID NO: 37704 - DNA, 333 bp, Oryza sativa
agggtgtggttccggaggccctgctcgtcccaatcacttgtacgtgcaagcgatcagaacaaataatggagaatttgtggagaggctccaggtgtgccaccaccagtagacattgcgcaatgtagatagaaccgaacgacgacgaagaagcgagcagtcgtgcggaagcactccccaaaaacctgatcacccgcctacccgtgcagatctcaggagagggtgtggttctggaggccctgctcgtcccaatcacttgtacatgcaagcgatcagaacaaacaatggagaattcgtggagaggctgatcgtcggtctctgtctcgtcctaatagc

SEQ ID NO: 37705 - DNA, 263 bp, Oryza sativa
atttttgaataagacgcatggtcaaacatgtgagaaaaagtccccggcgtcatctattaaaaaacggaggtagtatattctatgccaatagtgtcacctatatacatatgttagtgaattatagggaagtgttctacatccaaaatagctgcttactgctaatcatatctgccatgtggctatttactggctttctttttttggtaattgatatggtccaagtgttcaatccttatcgatgagatgttatgtatattgtcagg

SEQ ID NO: 37706 - DNA, 404 bp, Oryza sativa
atattcaaacctaaattaatcatcaagggcataacagacatttgcaaccaaacgcaacaatgaaaagaaggaaaatataatggcaggggtatggaagggatcaaattaaaatttcaagggtatagaagggttaggtaaatttcagaggtatgaaagggattgagtgagtttttataggtacacatggaatttactcaaactgcatgtgttatgttggtctgaatgtttgggttgcggtaatacaggattccattaagaattttccacagctttttcgttaccccaaatcctctttcaattgtatttcgccgcgagacatgcacctagttgaatatttcactagtacagaagagctttttccatacgggcgaaatggatctttccatgcagctagcctgcccgca

SEQ ID NO: 37707 - DNA, 543 bp, Oryza sativa
gggggaggcgtcggtagcggcgggaggaaggggatgacgggtgggccccacccgtcagcgagggtggcgggcgggcccgcccatcagcggcgcgcgcgccgggagaggccgagtgggccgcggggagaggagagagagagggggggggagaggagagatgggctgggccggcccaagggagggaagggggacttttagggtttttctttttataaaatcattttaactttgtttatttcttaataattattatttgtgctctgaaaattccactaaaatttatttacgcattttaggcttttaggaaatttacaaaaatcctccaagccttatttgacttttaactttgcacattttaattgttggaggctttcacatggattttaattattctaggcatcatttaagggatatattttagagtcgttttgggacgtgacaattcttctcaaaaacagtcagagatgtcaacgatctgattgagaagaggctcacaaatacaggttggagcaaggaacgactccaaaccagtcaaacgcggta

SEQ ID NO: 37708 - DNA, 1501 bp, Oryza sativa
tttgtaaagtctgaccaaacttagaaaattgtaacaatattttcaatagaaaataaatatactagaaaaatatactagatggtggatttaacaaaactaattttgtgttacagatattaacacattatccaattaacacggtcaaatttgtagatgtttggcttacaaatggaaaatacctaacaatatgggatggtggaagtactccatccgtaagaaactatcttctactcactctgttccatgtcatacattgttttgactattcaaatcttttaacaagtttgatgaagtttatagaaaaatgtaataatatttttaacacaaaacaaacgtatcaccaaaatatatttaatgaaactattttgttgtgttagatgttgctattttttcaaatttaatcaatttagtttgactaaaaaaagtcaatgcaacctataatattaaactgagggagcagttaaagataaagtttaggagttaaaagattagtatctttattaatgttgagagagaatctgagagaagaaaacaaagaggaggaggagaacaattggttcgggggttaaaataaggaaaaaaaatgatgaacagaaatacaatctttactgaacaaaataaccaaaacaatattcttttaggatggaggtctagtggtgaccctaatatgaaaagacactctttattggataaattttccaatgtcaagcattttcttaacaacttggaatgtaaccctttttcctagattaaaatgaaaccaactatgatcgcaaaataacacaagccaattagtactatatccattcatttatacatgatgctttgaactttttacatcatgtttcaccattcatcttattaaaaaaatttaagtaatatattttctttattaactaggtgaaaccccgcgcgttgctgcgatagtttagtataatagcactaagtaaaagtaatatgtaagatagctagataatataaatctacgtaagttaatgtggtttataataatttaaatttgaatagtatattgaatgatgatttaaatgtaaaagtaagttgatgcggctttatgagagaagaaaaggagtaagatagtttgaatcatagattaatcatctaagggctaaaaataattaaaatgatatgacttaataagagaagaaagagagggagataatttagaccatagatgatgtgatatgacttaatgagagaagagatagagcatattaactaaattatgagttaggattaactatatggatatataagatattttaaaataaagatgaagagacatattgaaatattatactacatgcttacatttaaaaagctataaaatctaataaattataaaattataaataatatacatgcttgcatgatgtttaaatgtaataattattagtggatgatgatgtggtatctttgcatgttaagctataggatttagtgggaataagtgagtggtcaaatgttatatcaaaagtcaact

SEQ ID NO: 37709 - DNA, 1501 bp, Oryza sativa
cgggcgtcttccctacagtttatatacaatttcttggggttggatacacctcgtatcctacttcggttggagggttatgacaggttgtcgtaagaaactcggcaacccgagtgttggtattttttaacgacattactagaaatataatttccagcaatggcgcagaaatacttctggtatattatggttacagagttcatccgcaagcgcacggatataccattgtagcatttcaaccgagagtagagagagataatcatattctaaaaatttatatattacttgtgataatcatattctaagcaggggttaagataatccaagggtagagtgacacacaagcattactactcattctcataatatattatctgagctaagtggaaagaaaagagaaagaaaatctattcctatagttctaatatacatagtatacatacattctagttaactgatatactagctaataccctctatccaatgccctcctggtacatcgagaagccacccctgactatcgagttccttacgacagtccgtcatgaccatacagccggagctaaatacggaggaataccctccccaggaaattaacttacgactatataccggcgcggaggaatacccgtactgagctgtcaccatcagcggcccacctcccatccgcaatatataaccccaaataatgatatcccgtaatctagacaccacgtctaaactaccagatactactataatatcatcgtcatgacatagagtaattgcataagcaaacattatacccgcaccaaagcatctcctagataagctagccgtatattcagtatatgtaacatactagatttttcaagataatttttttgcgaaaatatttaaagtcgatgttcttcgttctttcgaattggagcctcccaatccttatatttcttttgttccctctaagtttacgactcccacataaccttgtttagtttccctcaccaaacaaaatccgagatatcctagagaaaattcccaaaatcattagaagagctgatgtttattttaagttaaaccggagtcatcatgcaattgttctaagatcccaaatcctatcaattcctattaaaaaatatcctaccaaaattccatacaaaaatctctccaaaaattcaaatagaacactgtgtttctgctcgggccatgttccttgcaatccaggccatattccggatttccttttccttggtcactctctgtgttgggctgttctagcccatgtcctggcccagcctaggtaggccggctccagccgagccgctgcaggccgacgccgctcagggccgctcgcgctacacgcgtgccgcctcgtgcctttcccgtgctcgcacacgctcgcccgtgccgcctcatacgagccacgcgccgatctccgatagccgtcgcgcgaatcttagcgagaggcttttctcccttcctttttccccttcttcttctttctctggaaacaccgagcactcaa

SEQ ID NO: 37710 - DNA, 921 bp, Oryza sativa
ccacacgagaaattcctcaccaagatatttagataagattggatcatcccttctccttctaccccttagatccccttcctcctcaactcccctctcctcgtccaccctccccttcctcctcctcctcctctcccctgtcctatcccatccagcggtcggcggcggggggcaggccggccagagcccggcagcggccggcggggccggccgtggcaagcggtggccggcgcgcatgcatggaggcggccggtcgccctctcctttgtcgatgtccccttttttctttttttttctttttttttgataatatgtgattcactgagatgtataatttctctttttagaatttgtgattcattacatggatctgagatgtataatctgtgatgtatttgatttgtgtgtaattttttttaaggatttgtgatgtacttgatttgtttgtataagtaacttacgatttgtgatgtgaatgatttgggatgttactttgatttggggatttggggtttgatttgggatatgaatcctactcgatttgggaagaaatacagggattaaccttgtaagtaggaaagaaacaatgaaaaaaaaagaaaaggggaccaactgggacatggctcagccactaaagatgaatatttactcccgggtatttgaaccgggactaaagattgtcatcttttgtcccagtttctttctcccagttcgctacctgagagtaaaaggggttgcgaaccgggagagaaaagcgtttatctagtagtagatactattggaacacatactctatatatatatatatatatatatatatatatatatatatatacacacacacacactagcaaaatgccagtgcttcgctacggattaattgtttcttaggctaggtattgattataaattttaatgataatt

SEQ ID NO: 37711 - DNA, 1501 bp, Oryza sativa
gatgctttggtgcgggtataatgtttgcttatgcaattactctatgtcatgacgatgatattatagtagtatctggtagtttagacgtggtgtctagattacgggatatcattatttggggttatatattgcggatgggaggtgggccgctgatggtgacagctcagtacgggtattcctccgcgccggtatatagtcgtaagttaatttcctggggagggtattcctccgtatttagctccggctgtatggtcatgacggactgtcgtaaggaactcgatagtcaggggtggcttctcgatgtaccaggagggcattggatagagggtattagctagtatatcagttaactagaatgtatgtatactatgtatattagaactataggaatagattttctttctcttttctttccacttagctcagataatatattatgagaatgagtagtaatgcttgtgtgtcactctacccttggattatcttaacccctgcttagaatatgattatcacaagtaatatataaatttttagaatatgattatctctctctactctcggttgaaatgctacaatggtatatccgtgcgcttgcggatgaactctgtaaccataatataccagaagtatttctgcgccattgctggaaattatatttctagtaatgtcgttaaaaaataccaacactcgggttgccgagtttcttacgacaacctgtcataaccctccaaccgaagtaggatacgaggtgtatccaaccccaagaaattgtatataaactgtagggaagacgcccgtactaagctgtcactatcagcggcctgcaaatcacctagagaatatacccccaaataatgataagtgataacctaaaccacatgcttatgttactacttattactctacagccttgcaatcagtgccgagcatctgagtccccgagacataactctcggcctagccagagcagacttatgacccggtaatcagacattataccagcatcaatgcaaatcccagaaggtttaaccacacagattatactacttacaaataaactaagaatggtactcatactctatgatcgtaataaagtaccgaacttgtatattatattgataaatggaagtcttacaaagaagaaaggaaaagctatagaacctttaccgaactccccgaagcctccgtggacttggaactactctaactctactctactaacactaatactaactttgtagagagctttgatccttccttgagtgtgtgttgaaagtgaaggaggtgaggtccttttataggtaggtatgatggatgtagagtatgggaattgtcggaaatgctccgcaaccgccatcaggagttcatccggagcgtccacgccaaaccccaacctcaatggctgtgatgggggttcggccgaacaatgatctggcccaaacggcctaatttttggcaggctgactcctcatttgctcctcaatccaaaacatggaatttt

SEQ ID NO: 37712 - DNA, 1501 bp, Oryza sativa
gagaatgagagaaggcgcgcgggcgaaagagagaggattagtgcgagagaaagaaacgaggcgcggtgggcggaagaaacgaggcgcgcggctcccaccgctttctcgacgtatgcggatgcaaaagtcacggactgtgacttttagtcactcacggtgtgactttcaggtcatatccatccgtccgttcctttttttttgactaaaaaaattaaggttgcaatttgttattatgtgaaataacgatatctatatctatctactctatacctaattacaaaataagtaaggattccgtaaatttgttttgtctgtcgttatattattttttttcttccacaacgcggtttttttatctggtttattttccgtctgattggttttctctcaggttttttccgttcagctttttttttggcgcgtgggtttttatggtttgtttttttcccgtccgattggttttctctcagtttagggtttagggtttagggttttttccgtccgattgttttggatcgaaaaaaataactaactggcaacacaacaaaaaaacatgtatattattaaaaaaacagatcaaccaaatcaaacgaaaaaaatgagcgacccagaatagacctgaaaaaaccatgtttattattaaaaaaccagatcgggcaaaaaatactcggaaaaaaccatgtgtattcttagtgggtcacgatttttttgttgtgtttttttggtgggccctgttttttccaacggctgttttcgatcagttttttcttgtgcacacggaaggattgaatcccaaatagagttacctaatctctatctttacctattataaaaattgaagatgatttcatactcaccttaattttcatccgtcatctgtgttagacacgtataaaaccaaattggaccggaaaaaacaaccaactggaaacacaaccaaaaaaccagatcgaacaaaaaaaaccattgtattattaaaaaaaatcaaccatgtctattattagaagaaaaaccaaatcaaatggaaaaaatgagcgacccggaatagacatgaaaaaaccatgtttattattaaaaaactagatcgggcaaaaaaaactcggcaaaaaccatgtgtattgttataagaaaaaccggatcggaccggaaaaaatgagcgacccagaggtcaccgttgtcgtttctgtctctatcaataaaaacaattttgttagtcgcgttctgctgttcaggtgttcttcgttgccaatgtccaccatcaatagatgactccaattgttggacacatcctaccacagtccgcaccaccgtttgatcgtcagactattcacgctcatcttgagtactatgagaatatgagtatatcaatgtgcaatggtggtttttatccatcctaattatcattaaaatttataatcaatacctagcctaagaaacaattaatccgtagcgaagcactggcattttgctagtgtgtgtgtgtgtatatatatatatatat

SEQ ID NO: 37713 - DNA, 645 bp, Oryza sativa
ggaccgaatttctcggtcttggtcttttcgtttcggtctttttttgcccactcctacctcaaggaaatgctatggttgcaacgagtccgaacacttcatcgccgaaccctttgaaatgtaaaacacgaatcttgttatatgaacttaaggcaatttcctttcatatttgtgagccccaaatcaatctttgataatatacttgaccattactttatcatatcatatatttatcaaaaggaaattattaaaaaaaagctataactagacttcatgacaaatctactaatgttattttttgtgcacgataattttgtgcattgatgaattacgatttcaatgtttgaagcatatattttaggacgccacctattctactagtttattttgtgagagaactccaatcaactccagagtacgcaataactaaaacacgtcccttacaaagtaaaatttatactacgtgttatatgttttcaaacaactaataactttactaataggcttagtaggtgacaaatctactaatgtaattctttatactcaacaacttcgtgcattaatgacttaagatttagaaacttaaatgcatatattgtaagacgtcatatttagttataaatgcaaattaactctcttctcacaagt

SEQ ID NO: 37714 - DNA, 1278 bp, Oryza sativa
ggaccgaatttctcggtcttggtcttttcgtttcggtctttttttgcccactcctacctcaaggaaatgctatggttgcaacgagtccgaacacttcatcgccgaaccctttgaaatgtaaaacacgaatcttgttatatgaacttaaggcaatttcctttcatatttgtgagccccaaatcaatctttgataatatacttgaccattactttatcatatcatatatttatcaaaaggaaattattaaaaaaaagctataactagacttcatgacaaatctactaatgttattttttgtgcacgataattttgtgcattgatgaattacgatttcaatgtttgaagcatatattttaggacgccacctattctactagtttattttgtgagagaactccaatcaactccagagtacgcaataactaaaacacgtcccttacaaagtaaaatttatactacgtgttatatgttttcaaacaactaataactttactaataggcttagtaggtgacaaatctactaatgtaattctttatactcaacaacttcgtgcattaatgacttaagatttagaaacttaaatgcatatattgtaagacgtcatatttagttataaatgcaaattaactctcttctcacaagtcaaagtggagatatttctcaaggaaatgctatgattgaaacgagcccgaacacttcatcgtcgattgcccgaaactctaccctctgaaatgtaaaacacgaatctttgttatatgaacttaaggcaattttctttcatatttgtgagccccaaatcaatctctgataagtgtacttgaccattactttatcatatcatatatttatcaaaaggaaattattaaaaaaagatataactaggtttcacgagaaatctactaatgtcattttttgtacacaataattttgtgcattgctgacttaagattttgatgtttgaatgcatatattgtaggacgtcatatgttctacatacaaactctccacattgaatgtaaatcacgaatcttgtaggatgaacttaagatattttcctatcatattgttgagccccaaatcaattcagataaatatatttgatcattactttatcctaccatatatttatcgaaagaaaattattaaaaatataactatgtaggattgaacaacaagaactaagccaaccagagaggggtgaatggttggatatcaccggccctatgcacctggtctgatcggtcccacacaaagaacaccacttctctctattttt

SEQ ID NO: 37715 - DNA, 1501 bp, Oryza sativa
atgttcattggacaagacaaattaattggagtaaaattgtctatctatagttgatataaaaatgatcagaatttaggaaacacagtcatgtatgtgcctttcctctatataaaaacagtcaggtatgtgcctttcctctatataaaatgtaaaatgtaagatgtaatttgacaaagcgatttgctagttataaggtgagacctcacatgctccctgaccgatagggagttgtcttcaagagttgatttgtgtgctggggtagggtggggagaaaaaatacgacccacttgtgatggtgacttcccggcgatgatgtgctcttcttcgatgacaataatgagatggctatgaggttagagtttagcgctggggtgggggcagaggtgggaggggattccctggggtttagagggatggctttgggtgacggcagtggacggggggtgtcactgaagtcacatggatgaaggatagcggtgggtggggttgacgatgtatccagctcaaaggaggtgaggcaaggcaggggtggggaatagtgtcgccacccaacttagggaggacgagaaggagagaggaggaaagggaggaggccgactggtgcgttgggccttactaataactttcacgcttttcggttagtcggtgagaccggggaggggcgttgcagtcgggcaggggagacgacggcaagcgcttcaatctgtaaggcgtcaaatgaaatgagaacgagcggacgagcttgcggggaagaatatgaggggataaagttattgtatccacgaatctcgagtaatcctagccattaattttatggtattttccaagtgatcgaaaacctgacaatttctttgagaaaatgtacaaacctgctctttttatccttctatttcacattcaggtaggaacagaattcaaactcttgacctatggtgcagccttgagctcatggacggtgcaacgcaatctcataccccacacacacaactactcacttaaagtcctgtggtagatcacgtaattccacggagaaatctcacccacatgatatgactaccaagtcactatatatgcaccgaatgctccgtgtaggatcttaactagtaccacgaaaccgcgagacacaggtcccatttgaacttggtcagatgaagacgaagattaacacacttataaatagtattttataacatttgccttttaccgttaagaacatgctatagattattttttatttacaataagcgatacaaataagtataagaataggtgaaacaatgatgttgtagtaagatcacgtaaaatgaaaaaacaattaacatatgattagttataattattgtaaacttgaaaaatagatttgtttgatatttaaaacagtttttatatagaaaattatctggaaaaaaacatactgttaaaccgattgaaaaaaattgctaacaaaataaaggtaaaatatgtatcttaacaaaataaataaataaataaataacaccac

SEQ ID NO: 37716 - DNA, 1501 bp, Oryza sativa
ttcagcatacttctcctcctaggtaaataccccgctgcaaaaattcacttggcataatgagaatattgcatctcaatccaaaagcagtagatcaaacttcaaagtcgccttgggaataaaatcctgaatctgctggtacaatttgttaaaccctagcagaaacgcgaaacactatgggtgcatataacgaagttgatctacgtatacaacctcctggtaaacatggcttgtgaacgtagcacaaaattgaacctgaattggattcacccaaacagaaccgaagcaccgcaattgaattgaatccctggtacgaaggggcatgtgcatgcagcaaaaaaccaacgtgaaattcaatacacgtgaacagtaacaaggctgagtgtatctgctgatttttctttccttgatcaacgtgctggagtagatggattgctgctttttctccaacacgctgcgcggcggcaccaaatcccgatcggagtcgacggctgactccgcttcgtaccagctaatcttatctcagcaaacaaatcaatctgacggcagcgatagatggaacgacgcgacgacacgcgcctgctactgccgatcagatcttgcgacgagcgtaccggcggctaaaacttgcagatggggtctccaagcagactaactcggcagccaagatggtagtagatcgatgctctgataccacttgttatgaaaatagatgcacaacggagacacggatttttacgtggaaaacccttgcgggaaaaaaaccacggacgccgaccggcaataatcactgtagaggaattggatacaaacgcaggggatacattgggatgtcgcaccctccctgtgcggcttacaagggatatatataggagaaatctaggagtcctaataggaaactaatcctataatacagagtcatattagataactaatccgaatatattgtgggcccaaaattcggatcacatatttaacattcagcatataatcacccttatagtttgatatatcttcaaaacatttcaaagaacaaatttcacagtttaaagaataggccatagatccagggacccgtatgctcagttggatacttggatgtggacagtgacgggttcgaatgaaatgaaaggccgaagctttaaattcagagtaaatccagctttcaagcccagttcaaaaaaaaaagaaagtcaaagcccaacccataacatagcccattcattctagcccatgggccgattcagtaagacgatcaggaagtctcctcgtggtgtcttcctctcgaatccgagcgagacattggccttcctgattcctcccttcctccttgctttggtcaaccgcgtgtgtaccgtagcgcccagctccggggggagtcgccgcgccgaggaatatccgctcgcgactcgcgaggatgatgacgacacggaacgaaaagaagcggggcgcgcgcgccgtcgctgtccgcggcagcgtcagccgcctcgcctcgcctgccgag

SEQ ID NO: 37717 - DNA, 1501 bp, Oryza sativa
cccatcctaccttgttgattcgctctgacgttaattagctagcatcatatatatttatcagggatagctagttgctagcttaatatattgcagtaagtaacatgcatgcatgtatggggatagatccctttcctaaaaaaatatataggttaattactaagtaagatgtgtgagaatatttgttcatatgtagcttgtcgatatccttaatttgcatggtaccttgtgatagcgaagaatatatactctgccctttcgaatgatcgcaaatctaaatattagtacgccccccttgcatttggtataatatctcttttttaaaataaagatctaaagaaaggcactagttattgttcatcccttacagctcccatagacataaaagcatcatcaagaccttaattcaactcaagctcaatagctacatcaaacatgttccgaaggattttacaaaaatttcagtaaaagccacacagcagctaaaacgaacattttggattggtgtcgatttatgccctaccaacattttggtagttccaataatgacttattggttttgattttggattaaagccattttttgtccacactaaattattgctcgtagcaaattactataccaaatttgatagtaccaaaacttgcttagttttcggcaagctatgtaacataagcgcttacaacacgtgcgcacacactctataatatgattaagtcatcatagacatctcattgtatagaacttaaatccggatgaatagattccaccacaagaaaatctaagatatactccaacgcttcgacaatatgaattagaagtctatctttggcagcatcttgctggtaggagtataagcataattttcctctgtaatccaacctaaaaagtggtgtgatcactgcaacttgttggcagcataataatacatactctacacattaaatttgggtaagtttgggtttttaatatacagcaaaatcaatcatgctttcatgcatgccaatgtagccgcataaacagtatagaagcatgtgtgcagcaacaaaaactgtgggcgctctcaagtatggactagctagtacctgtcacttttggagagtggtatgcagctcaatccaaagctggtcctaaaataatggtgattaggtgcaagatcggcttctgtagtggaccaatatgctagcctaagaacaagatttggacatttgatttgatgcgagcagtggccattggttcagttaggtttgttgttttttgcatgcacatgttgactactccagctcacaagtaaattaatgaaaagatcaaggtagggcttctaggaattcagtgtgttaagataaacagaggtctactgaggatttaggcacaaagcagcatgtatttatggactaattgcaatgcattctaacgagactatactagtgttcatcgatcgtaggtggcccgaagttgttcgcgttttcctctcgaattaatgtgacactcatatagctcatt

SEQ ID NO: 37718 - DNA, 1501 bp, Oryza sativa
attagaaaaagaaagagattcgtgtgccggcctcctattctagctatagctaatatattccccagaattatcctctaacatcaaagcctagaaaaaaacttttttccccttggtttttaattattagcctaggagagtgagactacaatgtcctatttgggaatctccgttttttttctatagatagattcctttgatagctttgataggtagtatcccctctgtcccgatatataacaaattttaacattgaaaatttattcagaatattgcaacttctctctatacttctcatctcaactagtgataattatctcacatttaatgtttctcaaccaaactatcaaaaatgcttatatgtttggatggagggagagatgacactgggcccagccatctcagagagaggggaggtgtacttaccgcgtcgtagggaagaagcatggacatggaagcggccatgaggcagtagagcagtgtgacgagcacgacggagccggagacgccgatggggatgtcgcgtgacggccgctccacctcctcggccatggtggacaccgcgtcgtacccgatgtagctcaggtacaccatggcggcgccgttgaacaccccggcagcgccgtgcgggaagaacccgccggggttgtgctccgggtcggcggggcgcgtcagattccgggtgtcaccgcgccagaatcccatcacaatgacgaacatgatgaacaacacgtgcactgccgtcagcaccatgttcaccgacgagctctccttcgtgctgcgccataaaaaatcccatcaaaataattctttttcttaaaaaaaattgtaagaatattgtcatgctgaccaaaatgaatcttggtcatggaaacatagctatcagaattcaatcataatgtactgattgattctcctctgcattcaccaatcatttcaggaattgtattcccaaaatctcagcacacatttgtgcaggggacaagaacaaaaaagagtggttcttgactgttttgacttgatacgatatgccagagcatgggaacacaaggacacaggccggacggcttcttttgcagattcttcctttggacaaagcttgccaacacattcgccacagaaaacacattcgatcgtgaaagaaaaagggagggtaaaacgggcatttggaatagcagagaccgaccattcaacaagatcctttctttcagaacaaaatctctgaattttttttttctctgcagaggaggaccatgcagccatggagcaggagaaattcgaccaaaattaaattggcaccatgcacattgtgtgaactttgagctagaatttgccaagaagaaagacacaggactacaggagcagttgcagagaagacaagggaacagacaacgcaacaaaagttgcttgcacttgctctgcaaaagccttgcagtacacatccgtaggaagagacaagaactctgacacttgtgtcataagcaaaaccagcacaatttctatt

SEQ ID NO: 37719 - DNA, 1501 bp, Oryza sativa
tcatcattttttttccttattttaacccccgaaccaattgttctcctcctcctctttgttttcttctctcagattctctctcaacattaataaagatactaatcttttaactcctaaactttatctttaactgctccctcagtttaatattataggttgcattgactttttttagtcaaactaaattgattaaatttgaaaaaatagcaacatctaacacaacaaaatagtttcattaaatatattttggtgatacgtttgttttgtgttaaaaatattattacatttttctataaacttcatcaaacttgttaaaagatttgaatagtcaaaacaatgtatgacatggaacagagtgagtagaagatagtttcttacggatggagtacttccaccatcccatattgttaggtattttccatttgtaagccaaacatctacaaatttgaccgtgttaattggataatgtgttaatatctgtaacacaaaattagttttgttaaatccaccatctagtatatttttctagtatatttattttctattgaaaatattgttacaattttctaagtttggtcagactttacaaattttgatgtttgataaatctaagatgtaatgtaatatggaataaagtagtactattctttttttaataaatgatggtgttgactttataatagtatttggtgattcgtcttattaaaaattagtgtaaatatgctaaagtataagccatacataaagtttctttaatgataaaacatatcaaaacaaaataaataacatttttataatttttaaataaaataattagtgtcaaaaaggttaacggttttattattttaaaaaaacttttaaaatttaaaagtaaacacttcctaaacttatgtccaagatacgaaccttttggtcatgtcagctaggctaacatgcaaaaccatactgccacatcggtctcgctcatgtggcaacgttatttggtcacaccggtttggttagcgtggcaacattatttggtcacgtcattgttaacatcaaaatttgttatgtttttttagtgaattcggttaagaaaagaaaccgattggatatgaaaatttatatagataaggttgaatttaagtaggagtcctgaaaaccacagcaagacagttttatatttcttttagtatatctcttaaataggtagaactaattatttccttttcttgttatgaaatcttatctcatgttcaatatggacatgtacaaacccaagagtataaatatgtacacccatggtctctgtaatctctcatatcaatatataaattttggcgcatcgcctacttttaattttggcgagttcttagtttcaagcggagctgcattatttcattcgctgatgaggaactacgctatgccaactttgattgtaacaatttagttagaactttctcgatttagtccaatattctaattagttgctacaatcgctgcctatcttgatataccggct

SEQ ID NO: 37720 - DNA, 606 bp, Oryza sativa
gcgcccttagatcactcgttcccttgagtgataaaaccctttataacaaaataaattataattacgtaaattttttgaataagacgaatggtcaaacatgtgagaaaaagtcaacggcgtcatctattaaaaaacggaggtagtacatactttgtacgtgccccctttcacttcttttctttttcctttttctttttcactctcatgagataaaaaaatcaaactaataatttcagccaatagttgtaaaaatatatattatttcgagttgcactctacaatatacatgtaatcgaaacttataaaagatctaaataaatgaatagtatgcattgtataaatgtatattgtatagcaagattagacttgcattttcaaaaataaaataactccagttgtgagtaaaatttcccaaaattactcactccctactataaaaaaatattcactccctactatcaaaaaatattgatatatccaaatactaaatttattatgaatgtattttcatgtattgtgatgtttctttatttatatattattataagttaaggatcaaatatattcttttgacatcgtgtcgatgtcttttatctcctgcttagg

SEQ ID NO: 37721 - DNA, 1501 bp, Oryza sativa
cacacatttatatgagatcttgtgattgccttttacattgttagttaaaaaagtatgggtggctgaggcggcggcatggtgtggcttcttttaccatccatctcattaagagtggtcactacgtatatgctcaatttagaaaaaccttagagcctggaaagaaagagaaaactaccatatggggcataccatatacacactcttctttttttctttttatatttcttgcgtatgtatgtacataggagttgtgtatgtacataaggagatattagacggtttttagacggagggattactgttatagatctaatttaatggttgaaaataatggatcattgattttgagtgtaaatcgatgaataattgtttttattttattttatagtttttcttagtttctctctaattagagcatcacatgacatctaatgagcgtttgtaggagtatagaaatgctattactcatagtcacaatctacttgtagtcaactattgtttgtggtggattggttgcatcctctacctatcatttgttgatcattgcacacttagtatttccctttattttcggtgcctgatgatatatatgctcattagatatcaactaaccattaggtgcattgtgcatggatacctcgtgagtaatatgacttggcgatcaataaatagtgacttgtatataaaacctacatatagggggatcaatgaggacatatgattgatattttaggctaggattgtccaagtatattgcatactacatattgagtttttataatgcctaagtaataaatttaaggcagcattgtaaagttcttatagcattagctactccctatttataacgagtacgtttctcaaactactatacggtgcattacacggtatgtgttctacaaatactttttatataaaagtttttaaataaatcaaatagattcattatttttaatatttaatacacagttaatcctatgctaatacctgtatcattttgcatgtcatggataagcacacctaatgagctaaatcgaacgaagcctaagcaggagataaaagacatcgacacgatgtcaaaagaatatatttgatccttaacttataataatatataaataaagaaacatcacaatacatgaaaatacattcataataaatttagtatttggatatatcaatattttttgatagtagggagtgaatatttttttatagtagggagtgagtaattttgggaaattttactcacaactggagttattttatttttgaaaatgcaagtctaatcttgctatacaatatacatttatacaatgcatactattcatttatttagatcttttataagtttcgattacatgtatattgtagagtgcaactcgaaataatatatatttttacaactattggctgaaattattagtttgatttttttatctcatgagagtgaaaaagaaaaaggaaaaagaaaagaagtgaaagggggcacgtacaaagt

SEQ ID NO: 37722 - DNA, 832 bp, Oryza sativa
ttaaaaaacggagggagtacgtgcatgcacatacactgatacacgtattgggccgatcaacatgatgcggctttctaaacataaattaaatctatttggtatttttagatctacccaacaaaaatataggtcccccagattaaataaaaatcaatggttagatatgttttgttttttcttagaatttgtctaatttataaactggagttgttcatttgtttttgaaaatgcaagtaaaattttactatacaacatacaattatatagtgcatattatttatttatttagaattttttatggggaagggggatagttacaaagtatgtacgtgcatgcgtacatatatgggagcaatcgacgtagatgttctaatgataaattaaatctatttgttatttttagatctaacggttaaaaatatggtgtccactacattaagtgaaaattaatagctagatattttgctttattttttcttagaatttctctaatttattagagcgccacttggcagcctaggagcgtttgtagagatgtcatgtgacggcttaggagcatttgtagaaagttttataaacttttagtattatttttttcttagaatttttctaatttattagagcgccacttgacagtctaggagcgtttgtagagatgtcatgtggcggcttaggtgcatctgtagaaaatttctaatagatagatagatagatgcactgacctgactgaattgaaatatttgcaactaaatattttctcatggactcggaatatccgagtaggatgggctccatacccatgtgttaggttataaagggatcaatttgtaga

SEQ ID NO: 37723 - DNA, 152 bp, Oryza sativa
cgaggggcattcttctaataggctccgagggacttaccttctctctgagggcccaacagcccccgtcaagttggagtgccctctcgaaagaatggttcgagaagaacaggcaagtcggtgataaaaccggcaaatctcttaagaaaagggaa

SEQ ID NO: 37724 - DNA, 350 bp, Oryza sativa
cgcgttggggctagcagggcacacccgaaggtgcctaaggtggttgccctgacgcaagatagctgacgcagcaagactgcgtgctatcgtagtccgcttgggtggctttgtgttaggttgttgatgatatgttgaatagagtgatctgtaggcgaacgccttgcttggagttctctaggctggcagtgtcggcatctagcagcgtttcacccctttggggcgctgtcaagctgacaccctcttcctccttgggagattctccgggagaaaacctagtcctttggacggatgacggtggtgtcttgagcatcatacctcctggacggatgtcggtggcgtcttgagcatca

SEQ ID NO: 37725 - DNA, 980 bp, Oryza sativa
atctgattttggaagtagtcaagtttgttttggaaagatatagtagattggattggttaaaaatcagtttcctttttatcccatacaccaaattcggctgccatccactccacctcctggccgagtcccactcgcccctttggccgagtccgactccctccctctcttccacggttccgagttgtgtcaaacaccttggcgaatttttgtttggtgtcggtttcgagatctgtttggaaaaacggaaccggcataaattcagcattccattttttttttgtataattttaattttgggtttagacttttacatttgagtccctgtaaattttatatttatgtttgagtccctgtaatcttacattaaggtacttgagtcagtttttgttaaaaaaaatcaagaaaaaagtgagaaaaaaaaaggcagaaaggtgaaaaaaaaaagaaaacaaaaagccgcaccaaaaaaaaacagaaaagaaaaggaaaggaaaaaaaagaaaagaagaaagaagaaagaaagaaaagagaaaatactgttatgtttgagctgaactttatatatcagagttgtgcatgagttgttcctagtgctatcttgtggtatcgtttgtgtctaggctcgcgtctctagtacgttctagcctaggaccagcacggtacttgactttgaacgattattcaactttgcattctctgatttgagcatttgctattcctttgctacatatttaagcctacccagagctccacatatttgattacagccgtacaacaagtgtttgccaaggcattcatacatccaaacttcgttgtggtgcttggttgagtcggtgtacatcaccattccgcttgctttggtaagaacttgtaagagcttggttaaaagcttgagtgtgtgtgatatttgagctaccactacctagtagttgataggaacgtgcatattcttgtgtgtgtttcttgttttctactaacaa

SEQ ID NO: 37726 - DNA, 1501 bp, Oryza sativa
gcccgtaggactcctattcggatccctatatgaattaagctcatattgtatctccatccaatccccttattccggcccattaagcgtgcgaccctgtaggttcatgtatactcggctgtaatccgaaaaccccttttcggtccacgcgtcaacagcggcccctaacagaacgtattgacccaccgggcatacataaagatcatatcggctgaatctctagtgtatacttgtatgaacccctttgcctcacgatatcgattaagctcaaggctagatatgtgccatcctctaatagctcaatcattcacttgaacctgttgatagattatataacttgtgattgactcctcaatcacctttggcatggctatgcacttctataatctacaacatcgaggggcccagagatatctctccataggtggggtaaatctcatcttgattattcatatcctattacatgtttcatagcatacccgaaaactacttttataactacccaattacggagttagcatttagcagtccctaagtaagctactacacatgttgggaaccatgataatctcaagtctaaggattcaacactaacactaaataagatcactgatgacacaacacatatggttcttgcagtgtctcatgttggatctatccaacaacatgttcactaacatgtacccacattattaatttggtatctctataccatgatccatgagacatgatcatcaattaatacatgtgctgatcatctaaacatatttgttccacatatgatatttgatcagggatcctttagaaatagcaacacataacataaagagtctcataaaagaatcacacattcattaaccaataattagtttatctattttaaggagcaaagtcggataaatatgtaaacatagtgtgtgatataatcatctctatgattgcctctagggcatatcactaacatctgtgactacggacatgtatggtatagggttctaactcttaaatttactctaggagcgaagtctggagtgaaaatatagctagagtctatatatagttttttagcaatgatgaatgcattgtaatttgcaaagcagcagcacccatgcatcatatcgaaaacaaaaggaacagaaaagaaaacaacaataacagtatccatcacatccaaaacaaaaggaacagaaaataaacaaacaccgaaaactcaacagaaaaagctgtatgttactgccgtagctttatgacgataaagaatcacgcttacgtgagtgtgcagaggacgacgtcgtggttgcagtggtgatcagtgaagcaaagaagaatatggaaacgcagtagcccgccgcgacagcgacccaccaaccgacggctgccgagacgagacgaactagcgctaagcctataaaatcgcatcaacccacacgagctacctatccatcgtcctagctatctcacgtagtctccctctcccggtcttcgcgacgacgctagctttaca

SEQ ID NO: 37727 - DNA, 795 bp, Oryza sativa
attcataagtaattcatcttagctcggatttagttggttcgagtctctaaatttttctaaaattgagatctacatgttaaaaatatccacatgtattgttcatgcttgtttgtgtgctgttttggtgattttgctcatttctatttagattccgacgtttccggagagtccgtttttgcaggagaagaatttgaagagttccaaggccagcaaggcaagtcacatagatcccaaacaaccctttgagcatgttgatcccgtttaaagctcttgtttctattcaactattgcatttattttcgaatgtcattgggtggaattaacctattgtttgttatagcccttttgttcttgattactttattccttgataccttgggttattataacttgactagttgggctatatatattggttcagctaaatattagatatgattgcttagccatgcttagaaacattagcacactattgggataacttatgactcactattatttaattatggcttaatgatagttcacgatggtcaatcgtgattggttaattaattacttgccaactaaaacttgataatggtgggttgtgagcacatggttctgatggtcgtgctcatgacaattaaggaccggttcacgagtttcggttgtgaaacattaaccgtgccaaccacaagccagcgtgggcaacggctttaccttttgtatagcatggttcattgcggagcaccagactgagaagtggcgaagataagcccacgggggtcgctggggagtccatgccttgtttataag

SEQ ID NO: 37728 - DNA, 438 bp, Oryza sativa
tgcagcccatagttaagtaataattaaacaatattaatccaacgctagacaacataccttgttgcataggcccaaccattctgaacaaccatcccggctgcacagttctatctccaaaccaggaatatgccattccaaaccaggagctaatcaaattattaccagttatagcatcttttattatgatgagaagtgtgagactaatcacgaaagacattgttagacccgcccataaccgcgggcacggctattcgaatagttttactctggccagaggtgtaccactgtacccacaagacacagccccacaacatgtcaccatgtgccttcataccaccacggtacctcggaaaggagctgtgacagtaccccttgcacaacacaatccaccacagcgcacctttcctggatcataatcacccccttataaacaaggca

SEQ ID NO: 37729 - DNA, 1501 bp, Oryza sativa
tgtcgagaaccagacttatgtatgaatgggccaagaactcagaaataacacaacacattgggccaaaattcacaagtctacgaaggaggactacgaaggaggccgctagccaaagatgggctgggttgagccaacccatggttcggggggttcggctgaacctcccgtggcgccgatggatgcaaggtttggatggacggctgggattgatccccaatgacggtaggagggtattaccgaccattccaaccgtcgcaaccgtcattacctacctataaaaggagctcctcttctcacttcactcacacacctcaagcaatagctctcccatttctctcaagtttagtttagtagtatctagctggtggaataggaatagagtagaaatcaggagtccggaagtcttcggaagagttcgggtatggctctagcagctttcctttcttcttttgtaagctttgtacttttattagaataatcttctatatacatttacggtattgaaatactttccgagtatgtgagtacctattttacattatgttcatgttatactgaatatacggctagcatatctaggagatgctttggtgcgggtataatgtttgcttatgcaattactctatgtcatgacgatgatattagagtaatatctggtagtttagacgtagtgtctagattacgggatatcattatttggggttatatgttgcggatgagaggtgggccgctgatggtgacagctcagtacgggtattcctccgcaccggtatataatcctaagttaatttcctggggagggtattcctccgtatttagccccggttgtatggtcatgacagactatcgtaaggaactcggcagtcaggggtggcttctcgaaatactaggagggcatcggatagagggtattagctagtatatcagttaactagaatgtatgtatactatgtatattagaagtataggaatatattttctttctcttttctttccacttagctcagataatatattatgagaatgagtagtaatgcttgtgtgtcactctacccttggattatcttaacccctgcttagaatatgattatcataagtaatatataaattattagtcaatctatctctacatgatcttcccacgggataaaataaatacgatacccttagaatactctcgggtgaaatgctacaatggtatatctgtgcgcttgcggatgatctctgtaaccataatataccagaagtatttctgcgccattgctgggaattatatttctagtaatgtcgttaagaaataccagcaagcatttttggcaccgttgccggggaagattcataatagagattgcttgaactaatactttatatttacctctgtataatcatttcctttgcaggctaaccttggttgttttcactttttgttgtgaaaacagggtagtgcatgactggtttcaacctgccggaaaacttcaaagaatatccagaagctttcttc

SEQ ID NO: 37730 - DNA, 1501 bp, Oryza sativa
atagaacgataaagctttaaatctaccggtttacccccctcctcctcatcaaggtcgagatgcccgttggttgccataggtgtcttgatgggcttcgcatcctccaagccaaacctcttgagtagatccttgatgtacttggtttggctcatgaacgtcccgtccttgagttgtttgatttgaagttcaagaaagaagctcaactctccaatcatggacatctcaaattccctagacatcatatcaccagactccttgcaaaatacctcattagtagaaccgaatatgatatcatcaacataaatttggcaaccaaagaaatcatcaccaatgatttttgtgaaaagggtggtgtcaacttttccaattttgaaattctttgacaaaagaaaatctctcaatctttcataacaagctctaggagcttgttttaaaccataaagagcttttgagattttataaacatggttaggatttttagggtcttcaaaaccgggtgattgttcaacaaagacaagttcggcaatttcaccatttagaaaagcacttttcacatctatttgaaaaagttttatatcaaaatatgatgcaaatgcaagaaggatacgaatgggttcaagtcttgccatgggggcaaaagtttcaccgaaatccaagccttcaacttgtgtgaagcctggcgccaccaatcttgccttgtttctcaccaccaacccgttctctcttgcttgttcctaaagacccactttgtccctatgacattgtggtctctaggtctttcaaccaaagtccataccttgtttcttgcaaagttgttgagcttttcatgcatagcatttacccaatccggatcaccaagagcttcatctacatgttttggcttaagacaagaaacaacaagtaatgttcacaaatcgaagcgacacgagatcgagtttggacacccttactaatgtcacccaaaacctcgtaaattgggtgatccttggaaagagcggtgtgtatccttgttagcataggtggatcttgtgccttctcctcctccacttaacttgagcttttcttggcatagcggaagtagataactcatcttgagtggaggtaaatggcttgttttccacttcaattcgcttgacatctccaatagacatgttcttcatagctcttatcaagccttcatcacctacatcatccaaattcccgtgcccctcttaggagccaatagtctcatcaaattgaacatcggcggtttcttacacaataactttgttcttgttgtagaccaggtatgccttgctattggaggcatatcctagaagaaacccttttcatcacaccgactttcaaatttggttagtctaacaccctttcggtgtgatgaaaagggtttggccccttgatgctggtgggggagtactcccacccaccaaaactagccgttgggggcgaaatcccccaactctatgtactgccggtctgaccggatgtgtgtggccggtca

SEQ ID NO: 37731 - DNA, 247 bp, Oryza sativa
ctgtttttttttggtgcggctttttgttttcttttttttttcacctttctgcctttttttttctcacttttttcttgattttttttaacaaaaactgactcaagtaccttaatgtaagattacagggactcaaacataaatataaaatttacagggactcaaatgtaaaagtctaaacccaaaattaaaattatacaaaaaaaaaatggaatgctgaatttatgccggttccgtttttccaaacaga

SEQ ID NO: 37732 - DNA, 1501 bp, Oryza sativa
gtggctaacgcttgatctctttttgtggcctcttgcctcatgggtggcttttagtgtgagaaatgaacaaggctacgaagcagtactttgttgccctctttagccgatccttccatcgatttcaactgtcaatagtgtcattcgctacagatctcgacgccaaaccaaaaaaaaataaagtttcgagccaatgttggaacctctggaaggtagacttttcgaaatggaggacgatcagatgcgtaatggaaggggaaaacagagtataagatcgcaccactgagcagtgagcatgagggttcggctttccgtgacaggtactattggtgcacgcgttggaggggacgagagttgcaaaatgccggatgaaagagcttcacgacttcacgtgtggtttggtttttatttactcgacgggtccctacacgatgctactgctacacatgaacgtgatgcgcgtgtcatccgcctcgtacagtcgtacctccaatgtaccgccaggcggtgcgcgcgccggcaaaatcctttcggtcacaggatcacggccggtaacactcgtacacggtcacacggatacgtacatctcggaacaatttgatgcgttcgggtcatctgaaattaataagtgcagtgcttcatcctcgttgtaacttgtaacccataattgtgcttcttactagtgttttttgttcccttcctggagcaacaatgcccatcagagagaggggagactgcagttcacagccgtgcgccagacattcccagtgtcccagcaccgtgtaccctctttctcgttaacgatcgattgagcaaaattaatgggactcggtgttgggctggagactggaagacaggcacttccaagtatgtaaacgtaacacttatcaaagcatcctgctttaagctagcctctaacccggcctcattaagttagcccaatttcctggcccatgtacgcagataggctagatctattatattattaagacagctcgaaaagaagacatcacgtttaccgtggaggctagaaattctcacgttaatcgaagaaaatataaattatttacaccgttggattgtaagaggcatagatttcaatgtctgagatttaacacaaacttagcatgttaactgaattagaatcaatctctaactaggatctttacatgcaaacggactcaaaatagttttgtccgattttctaaacttaagttaggttctagaatagttaggctataatgtatagtagcaacggaaatccacagcagcaggtcgagccgcgcggctgcacgatgagcaagaattggacgatgcacgtcaacaaacagaaggaacgatggcatgtgcacagcagctagccaggtgcacaccttaagcgatacaattaaaaagttttcctttgaaaatataggttccaaaataaacttaaaaataaaatttggaataaaaatataataccaataataaatatgtaaatattctttgccaaatatgtacattt

SEQ ID NO: 37733 - DNA, 1501 bp, Oryza sativa
gctggtagaaccaaccgaacctagtaggctggtagaatcaaccgaagtggttatcgctgttcgagttctagtgcgtgaatcattcatagttatcgttaaaatgttctaatgcgtagagtccatggattggaggtatctgttttagagatcctttcgtaacttgaggaatcgtttcgactttcgactaataccttaagataaaaattatgacaggttagtatgtcatataacggattcatttgctactgtctactggttattgtttgcgtgatactcttaaacttaagcttcttatgcttccatgaccagagcattcttaattgataactgatagtttgcgttactatttaggaaaatatctggctaagtttttactactttagatttgatttttccatcagtggtaagcggtaagtgtagatacctagtcttgtagtgaagctgttgcactgtgaacagtccaagcatcatcgatcatactgaagtctcaatgatgtatttgttcaattcctttgtactgtcaatttgcagaaattggagctacctgatattaggaattcaaacaatttattgaattggtggcatttctttttggaagatgaggattgggtgatattaccacagaaagctctaagcactgtatacttgcagaaattgtagagttgctaatattaggaaagtatctgtactatagtttcgtcatcctcatcaaactactactagtatttcttttatgaaagtaaaaggaactggcagtattccattgaaagttgaaacctttacatggaattctgtataaactacaaagcccatcgtgccgaatttagagtcgattttcttttcattgattcattgtataaatttcaagtcagtgtctcacatctcatagcatatacagcacagtacctagcatgatgaaaatctaagctatttttccatttcagtatgcatatatctgattcacagctgttcatcagttcatttcaggggaaagtatgagattcacagggtgtatgtgcgaagcacagctcggatttatgaaatatactatacaactgaccccaaggatagctctaaggattatctatgcactgtgcgttgtggacctgcagttaaagagccactcccctctgctgaagaaagtatgccccaatggagtagtgatgcctcaactagtgaaaagcatgagcatgaaaccaaaagcgtaagcagtagtattgatgaagatagctgggttgatgtcaaaatcccagagttacatgtggaaaagaacagatctaaatctcaagaacctaatgcaattggagtcaaacaggaaaccactctggtaaagccttatttcttggtttgtatcatgaaagattgttaaatactcaaccataaacttctgctgggagtgctcctattgtgatattagcttctaaaatttttctgtaactttgtttcgctatgtggaatgcaggcacactatgaagcaactgctgagataactgatgcaagc

SEQ ID NO: 37734 - DNA, 1501 bp, Oryza sativa
tagcagtagtaggagtagtgaaattatggagaaaaaattcatagtagatgccccaaggaccattaaagaagtgatgtgccacaagcaatgccgacacctggggattttcatgtcctgatcttttactagtctattaatggccggtctctacctttctgttccctcgggaaggaaaggcacaacaaaagttagagtgtacaagtgggctcaatttgccctaataggatacaaagaaaaaaaggctagctaagttgatggtctaaggcacacaaaaaggccactaaactccaataatccgccagattccccacacagcatgcaggtatcaaaagattaaaaaaaaatggagatctgtctcctgcttttgttgcctatgttagaaaggtttgtacgaggctaaaccacagatttattgctctgtccggtcaataatccaaagcagcagatgcctggagaaaggaacatggaggcctaactgaactgacgtggtgctatcagcctcttaattaacttcaggcagttacctcgtgtcaactaatgaaacacaaccatagctaattaaaacaaaagtactcctacctgaagaatctagagtgaaagctttgcattacctagctaggccaccaagctaatttggaggcaagagcaccacttggtatgtatgacgactgagcaagctgcaagttgccctaagaaggtaggtacacaatttctacatgcaggacagattaagtataaaactaaggttagtactagaatagagatttgattaggaaaataaagaatgagatgcaggtctcagattcatctgaatggggggcttcctcgcggcaattgtgctagtgatgattaaacttaataggttaactaccgtatcaacagcaagatttcctgtctgcttgcaagaaccgtagccatgtgcagggggagctctccctaatgacaaaagatgaaccttatccgaggcactccagggttgcatgattaacgcctttgaaccccaaataatatatcttagcattagcagaaaagagtcatgtgagtgccataatgataaagtagaccctcacttagtctacttaacgcataccgagaaaaaggatctgtttttttatatataacaaaaaggaggccttgtcaaaggaacaactgccaagtacagactaatcacgtcatctatgttaaaaatatacagctgattgtgcatctctgtctggaactaaacccctgtcctacctgcctaattttagtctctactcaatgtagttactgccagggatagagaatacaggtttaggcaaaaaaaaaattaggtgggttaaaccaaagaattactaaacacgatgcatggtggtgagcaggcaatagaattaactaccacatgattaaaaacggttatacgagatgagattgaggatgcgtcacatgagtgactcagtgacccacacacccttggctactgggactaccagaacctgacccacaaaactggatgcagcca

SEQ ID NO: 37735 - DNA, 1501 bp, Oryza sativa
tccaatctaaacagaaatatagccacaagaaaatgtaggggggtgctgtttgtcggaaaacacccttatcaaaaacattggtattatcaaactttggtacgataacaaattgaacaatgaaacagctccaactatcatagcgctaccaaaatttgataatttttggaaccttacactaaatctggtaagacctcaaaccaaacatcaccatccctatcgttaccttaccaagtaaagcaaaacttgttaagattattttggcatttctgccctttcgtccgtcgctcttctcatgcggcatattcgactcttaattactcggcccagacccaacgctggccttacaaatctctcgtttatcaaccatcatcaataaccttatcaaatttggataattatagaactttgcattctacatcaaaatctgataaggcctcgaaccagatgtcaccatcacatctttaacatattaaaatttggtaaggtttatttttattacaaaccaaacatgcgcataaatctcatcactctcttcactgtgcccaatttaaacggaatattttagtaagaagaaacatcttaatcttaccgcacaatggaatctgaatacggcttcagtttaactaagttatctgaatacggcttcagtttaactaagttaaaaaaaaactcgaatactccatattaaaaactgctataaaaatccagagatcagttttttttttaaaaaagcagagatgcagatgatgggataatccaactgtcgactggattgcaaatggcactttcagatatactggtaccataatagtactgtttaataactgcagttcctctcgaagtctcacctttgttagtgtgagagcgagctgatgtgacatttgacaaacaactcaatcctcaattcaggcactttgtcctcgatgtgttatttacagctacgcagtaaactcgtcaggacaatatgaaagatcaacacacgttctaatgctcaaactcaattattcaaagtgaaaccgccaaaccggtgggtcacatgccggaatcaaggcggtagggttcagtactctatgctcaagtcctcttcctaaatggtgcattcatgtccttttgtcaaaatattgttaagcacttatgaagccataaaagaagcaggacaaggtgccggactgcagagaaacttcactcgtactcctacatagaatgaagtgaaggaagccactgaaatggtggtcaagcaattacacaaaacaggtagctccatatcttgttcatattgacatacacaatccttgatgatgacaaaaaacaaattacaggcagctcttgtccccctcaccataagctataaggggcagagcaccatccaacttatgctatttacttgttctgtctgtccctcccaactttgcaatacccttatcaagcacaagaaagtaaagagaacaagaaaaaaagaaaaaaaagagaggatatgatgacagtacatcatacatgtgga

SEQ ID NO: 37736 - DNA, 1501 bp, Oryza sativa
cctaatgcaattggagtcaaacaggaaaccactctggtaaagccttatttcttggtttgtatcatgaaagattgttaaatactcaaccataaacttctgctgggagtgctcctattgtgatattagcttctaaaatttttctgtaactttgtttcgctatgtggaatgcaggcacactatgaagcaactgctgagataactgatgcaagcccatgtgtatctctaactgttcgcctcctttcacttcagtcaaaaacatcagtgcacatcgaggagatttacatatttgctgatcctgttgagccaaccaatgatgaatcagaaacacgtcctggaaacatgggaggtagttctttgttggctatgcttgtccctagcctcatgcaaatgtccaaatcaaggaaccagaaaacggacaataaatatttttctgatgcctcaaggactcagctttcccaaggttgtgcaatggcagtgaataatagtccatgtgaaaatgtagtgcgagatgcagagccgtgtagcacagatgatttaaatttcaagtcagcagggatggaaagcaaactaaatgctatagatggcgatacaataacttatgaaaaaggcaaccattatgagctaaaggattccaagtctattctattgcctatacaaacaacagaaaatacacaagctcctttgacaaagaaccagagtgtgtcaaatacagatcagcctgttactcctctcatggatgaaaatccaaatccttacagtcgcattgagggaaagctggatactcttctctctaagatggagaagatggaactatactgctccaggtttgacgatggtatgatgaggcctatctgtagcatcgagtcaaggcttcagcgattggaacaacagtttgatgtgttctctatggagattaagactttacaagcttcttctgcaagaatgacagccccagatggtttatctgatatgattaatccacaggataaaacagataatgatggtaaggctgaaaattctgcttccacaaccaacaggcagccaggtctggttgtcagagcaccagagttttctttagaagaatccttcagttgcgataagtccaatgaaaatgcagttaccttacgtggaccgagcatggtgccaaggcttcttgttaaggctcctgattttgtttctgaatctgagtttgcttgtgagaagcttcatgatgggtctttctcaccagttgattttgctctgtcttctgagaaagaacctaaaacttccccaggtttagttgtcaaggttccagaatttccaaatgattcagatgatgaattggaggaagagaaagaaacagaagttggtgatcatgatgatggtcatacaaaatctgatgctgctttgagtgaaagcactgttgacagcttcaaaagcaaatctcatgtatctgtcgatggtgctctagcatcagccttggaggcacttcttggttcaaccaagaaaacaccatcttcgc

SEQ ID NO: 37737 - DNA, 649 bp, Oryza sativa
ggggggggggggagattgcgagaaaggagggcgcactcggtggtggtggactggtagtagtagctttcggtggcgagcgtctccataaagcggcggcggcggcaaagatagggtcgtcgtaggaggggtgctgtggcgacaagaatctgcaggtatcggattataatcttctttcttttctttctttctttctctcttttgttctcggtcttcttctgcatcttctcgcttcctggcttcccttttctctgttgcaatctgttttttggaggtaaaataaacatgttcttgggttatatctggcgtgttcgacggatttcttttggagactgtgctgttgcgagtgattaaaaggggattttttttcttgatgtggtggatttcttgccgaattttggcacctctttccgttgcgagattcttccagcgttggcattgcttgccattagccaactttgttttttttttccttcttctttatctgtcctgttcctctctgacgccaggctgcacctgcaatcctcagatattcatcattcggctgggcgctcagagatcaaagcaaagttggcgattactttcttgatcattcctcggaagtgctcgtcaggtgatgcccgcattggaagatccttcatggatgttcgca

SEQ ID NO: 37738 - DNA, 216 bp, Oryza sativa
acttggggtgaagcaggccaccgacagacggcaatcccccatccgccacccgccggctcggattcaccgacctcctcgagcaactcgatcacacatgtcattatcaatatttttttcaaatctggattatcaatgattattcgcagaagtgttctctttcaggctagcaagctgtaagcctagcagcgattaagaatgtgactctgggcttctcga

SEQ ID NO: 37739 - DNA, 1501 bp, Oryza sativa
cttgaatagtggtgcttgaatgtatgttccaacatttcctttctacatatgccatagcttttgctattgtgagttagctacatgagatatcaaggtcatctaccttccaactcactttgacttggtgtctttttgttgctaacttgtggatccataggtcatcaggtccacatgtcataacaaaagtcatgtgactttaaagatatatgatctttatctatctcgatcaatatgtgtttcgaggagcaactagcagactgggagagtagaagcctcaaatggcaactactgcaaatctgcaatgtaatattaaaaaaggtcagtggagtaggagtttgagggataggggggagaggtggagggaataatagatgtagctttatggataatctcgattataacaaaaagataaaacaaccagtcgacaatgaaggagttagagggtgaggggggtgagggggatgagcatctttgaaaggcaacaaagaatcaaatttcatggataatcctgactaaaagttagaagttagttaatactaatacatgaaacttagatattacaacaaacgatatataggtatcagaggaattcaaggatgactatccttgaaaggtgacaataaataataagagcaagaagttaactaatacgcgaatgaatatgctagctttgttgaccatcacacgataaaaaaaacaatttatagaaaaacatggtgaaaacaaaaaaaaacacatgagtatacttatattgacatggttcacatgaacaaaactatgacataatatgcatgaaaacgtttcgccgaacgcaataagaaacactttatatgcacggtgccgatctaaaacattattgttttttttttctatcatgtcacgcattgcaaaagttatagaaaaatattacttcaaccgtttcacaatgtaagtcattctagcatttctccgtttcacaatgtaagtcattctagcattttccatattcatattgatgttaatgaatatagacatatacatctatctagattcattattatcaatataacgtgaaaagtgttagaatgagttacattgtgaaatgaaggaagtacgaggtggaatactatacgagagcccgcttgtcttctggcaggcccactggcccactcaccttccacacggattctgtaacaaaatttcgcaggtatccaccgcggggcagtcaactggcagcaaaacagtagcagaggagaagcgaagcgatccaccgttccaccgatcaaggcaggtatcaaatccggcgtggaaaagccaatttcgcaaaatggtcctcgcgatctgctgccgagcctgagcctgaagcgagacaaacagatccacccccctcgtcctcctcctccaacccccacaaagctcagatctcgcgccccatgagcgctccctctcctcggatctaaaaccattcccaccccctctctctcctctgccacccaccggaggagatctgcggccatggcgg

SEQ ID NO: 37740 - DNA, 512 bp, Oryza sativa
ccccagatagggacctaaatgtaagaatgacagatcgctataattgatagcgatcctcccaaatatctgcgtcctataaaggccttcgtcggattatggaccggactttgtgttcgcgttgtaaactttgggccttagtgaaggcccaacgttccatacgtccgggaggcccatcgcttcggatatcgtgggccggaaactgttgctccctcgcttggagccacggaggcccagagtagatctggcccgcatgttggccagtatcccgttccgaaggcccaactgctttattatccgttctctacttatgggccaaattcgtagtagctccgaattttgggcctcaaaatgggctgatcgatcctcttgtaccatcgagaagcccagagtcacattcttaatcgctgctaggcttacagcttgctagcctgaaagagaacacttctgcgaataatcattgataatccagatttgaaaaaaatattgataatgacatgtgtgatcgagttgct

SEQ ID NO: 37741 - DNA, 1193 bp, Oryza sativa
tagtatatttcagtagtgggaattgggcgtctgttatttactcacttattttaggtattttgttcttctacttccttctgcaattggtagcgtgaagcatacttattgttctgttgagattgtgtggtagtattttggtacaaggatatattggtagcgttattatgtttatagcgtggtcattgctctgctgagactgaggtagtacttggtacaaatatatatttggtattccactttttcatgcccatgtttaacctcaacatctcttgattataaatatattttgggtgtcacttctttgcagttatggcactatttttgtgtttgatcatattgtactgtgcttaattttgtgcaatgattcatgtgtttctctgtgtaagaactcaatgttccttttgctcttgttccttgtgttctttattataacctcttgtgctctttattattaccttttcccccctgtagtcttattctattaatgttggtttctaaaatcttttattttgaaacttttctgctgcttaaaactctgttggtgttttatgaatcattgtgtctagtccctgtcctttttcttgagtttttgaggggacctgattatttttctcgaactgtacagtttaagttttcatgccagcttgattactctatgcatattatacatacttatattttgtattcatatataagcttaatgcattaaagtgctggtcaatttaatgttatgtacttgggctggaaaaatggtgttctaacgacctttttgggttatgctcctaagtttccaagcctaaaagcatccatgcttttgcatcatgcactgtttgatatttcttgcttgtttgaagagaagaaaaaccaacaaaggaagtgtagtttctatcacacagatataagactttgcaatccctgctgttttgacatcaagcatctcgttctggtgatctagtcttgcatcaaattttaattatggcatgatttagtgtagagttgtacacatacaatgcaaaaagaaaccatgagggtcagaaataattgaactcccagttatatttttcttctgagaacactatgttttactttcatctttgctttgaacaatttccatgcttttccaggagcaattttctgtcactgtctgtctgagagcctcattttctttttcatcctgacacaggttgaggaga

SEQ ID NO: 37742 - DNA, 1501 bp, Oryza sativa
gttacacttgagcatgatgttgaaaagaaaaatgtagccatgccctctcctaagcaataaaagaaggatttttgggagaagaaagtaagcacaaaggagaagtgttttctttatttttcttcatgtaccatttccaccatacaccacacacacattttgcacgatcttgatcttgagtatgtttagtcatctgctttagtctaaatttttgacttagtaataaatgtgaatgcaagtatgccatgtttgatccctaccgagctccacatatcaaactctagagtaggaatcataaaggcaacatttggtgaggaattcatattgatacacttagagagattgagtgaatcaattgaagaacttggttttctttttcaaaatcatttgaaaacttccgaaagaagagttgaataaagattgggtgattggtactctaaattgctgttctttcttttaaccgcccaaggcaaggagaagcagtgtctcgtgggaatcaggggtaagggtaaccaccgtgccaaagattatttaatctcagagagagtacatataccttacacctgtatgtttgagatatgcagcatagtagcaactcctgatcaacaaccaagtctttgtttactttcgtccttcactcgggacgagcaaaggttaagcttggggggtgttgacggtcgttatcgatcagttgcgaccgtcaatattaccaaaatagaggagaactagtgatgcttgcaatgcatatattgttaaaataataatattccactagtattaggtacactaaccttttgtagagaatgacaataaagtggaggagaatcgacatcaactcagacgataaatcaatcggacggtgtcaagaaccagacttatgtatgaatgggtcaagaacttagaaataacacaacatattgggccaaaattcacaagtctacgaaggaggacaacaaaggaggccgccagtcgaagatgggctgggttgagccaacccatgtctcggggggtttggctgaacctcccgtggcgccgatggatgcagggtttggatggatggctgggattgatccccaatgacgggtggatggtattaccgaccattccaaccgtcgcaaccatcattacctacctataaaaggagctcctcttctcacttcactcacacacctcaaacaatagctctctcatttctctcaagtttagtttagtagtatctagctggtggaataggaagatagtagaaatcaggagtccggaagtcttcggaagagttcgggtatggctctagcagctttcctttcttcttttgtaagctttgtacttttattagaatactcttctatatacatttacggtattgaaatactttccgagaatacgagtacctactttacactatgttcatgttatactgaatatacggctagcttatctgggagatgctttggtgcgggtataatgtttgcttatgcaattactctatgtcatgacgatgatagta

SEQ ID NO: 37743 - DNA, 1501 bp, Oryza sativa
aaaggcaatagtctcctgttcttatttagctcatagtatttttttatcgttgttttgttttactcacacgtaggaatagaaatggcccccttttctatttcgaaagttcagcggcaggactgggaagcaataaccgaaccgaacttccctggcagaaaagaaaggaaactggtttctcgaaaagaaaaaaagaaagaaaagggaagtactatagcagtagtaatatcatctccaattcgttcccttctgttctcaaaaagcaaaaaaaatcgttcccttgctccatcacctcacccctaaatggaaccacatgtagtattcggaggagggggttgggaacccctcctaccaggcacgcaaaacgaagttcattttattgcataattaattaagttttaactatttttttaaaaaaatagattaatatgatttttttaaagataactttcatataaaatttttttatataaatcacgtcatttagcagtttgaaaaatatacgcgtggaaaaccaatggggcaagaagtagcgtcaatgcgtgatacagtcccagacgcacaaaacagctacagtgcaacatggactgtagacagctaaggtggtgtttacatccagggacttaactttagtccctgtctttagacactaatttagagtattaaatatagactacttacaaaactaattacataaataaaagctaattcacgagacaaattttttaagcctaattaatctataattagagaatgtttactgtagcatcacataggctaatcatggattaattaggctcattagattcgtcttgcaaattagtccaagattatggatgggttttattaatagtctacgtttaatatttataattaattttcaaacatccgatgtgatagggacttaaaagttttagtctcatctaaacagggcctaatactcgcacgcacgcattcccatgctgcccacaaaaaaacgattggaaagcacgcgcaaacgtttccatcccgtgggatgcttccaaccaacggcagcagcaagctgcagccgccaacccaacgtcccaacccacgcgacgcgacgcacgcaggcaggcaggttcgttcggtgccaccacccaccacacgccgctgcgttccagtgccagtccatctccagtggtcagcggcgcagccaatttcccttcccccgcaagctatagccaccctgaccgaaacgcggtttttattagcgggggaatgccaattccttcctcacgccttccccccacccacatttagactctacgagacacaccatcacgccaccgagtggtactagcctctttgcacggcaactcggagcgaaaagctctttttacctcatcttctcctcttgttcgtcttgctctgtttctttcttgttctctcctggacttgtggtcggaggtgggattgatttgggtgacatggtgcaacaccatagggccaccctcctgctgcaccagcagcagaggaaagggga

SEQ ID NO: 37744 - DNA, 162 bp, Oryza sativa
atttgcccccgcaaatctcgccggcgcattgatgcggccgacctcccgcgcggtttcttcccctcggccgctctttcccccttccaaccctatttaaaccctccccgcgcctccttcgcccgtttccgcccttgccgcaccgtctccccgctggaatcgagc

SEQ ID NO: 37745 - DNA, 1501 bp, Oryza sativa
tacaagatgttctaaatctgaacaaatgtaaactctatgcaccaaaaatattcctctatcattatattcgccaaagatatgaaaaatagcattagttggacatggcaaatcagatttagcaaataatttctccttcaaattatcgagctcacaaaaatcatcaaactgaacatagcccaaagtatttaaagaagatagcaatttgcgttcctctacttcattagcaatgtgaacaacatgcttagaatcagcacacaaagaaatagtagaactaacatgttcattcactagttgtggcatggatataagtgaaacattatcacacaactcttctttatcacaaggaacagcaagtaaatcaacttgtgacaaaggcaactcagtaattgattccactaatggttgctctactatagcatgaaaagtggacaagtgtagctcaccttgagaatactcaccttcatttctctcagcaccatttaatttaccttgcgaactttcttcaaataatgtagcttcatcagccttctcctcattcgcgagtgatggaagtgacatctcaaacatatcgttcttctcattttggagacttttctgaacttcctgcaaaacatcagtgataggaggcacaagcatatcttgttgctccattggattctccaaaattttgcgctcaacaatgcaagcaagcatgaacaattggcctatatgattatatgtcacattaacaagcccagcctgaatattgaaattaagccctctgaaaaatctagtcattgtgttctcattagattcttgtaaaccactataagtgatacaaattttaaaatcataaaagtactccctaacagttttgtcaccttgttttagatgttcccatttctcaaggagagcacgtctatagtatgaaaacacaaatctttttctcatcagtattttgcattcatcccaagtttcaagcttattccccacagtatgccaccaaaaagatgcagaaccggtacacttattactagcagccttaatcatttgagcattagaaaaatcatactcatcaaattgtttttctactgctagctcccaattaatgtatgcagcggaatcatactttccatcatagactggtaacttacatgcaacttgtgcaaaattatagtcatgtacctcatatgcatcacgtgaagaagtcgtcatatctcgtcgaaggtgtagatgttgacgttgagcatgaccatcttgtttccccttgcgcaatcctgccatggttagcagcaaacaagaaacatacacaagaatatacacgctcctatcaactactaggtactggcagctcaaatctcacacacactcaagcttttaaccaagctcttacaagatcttaccaatgcaagtggaatggtgatgtacaccgactcaaccaagcaccccaatagaggttggatatatcgatgcctcggcaaacacttgctgtacggctgcaatcaaatctgtggagctctgg

SEQ ID NO: 37746 - DNA, 1501 bp, Oryza sativa
ggagcaactcatgcacaactctgatatatgaagttcagctcaatgataacaaaatgattttctccttttcttctttttttctctctctttttttttgtctttcctgcttttcttttctttttcttttctttttttggtgcggcttttgttttctttctttttagcacctttctgccttttttttcttttttttaaattttttttcagcaaaaaccaactcaaggaccttaatgcaagattacaaggactcaactgtaaatatacaaattacagggattcaaatgcaaaagtgcaaacccaaaaattaaaattatacaaaaatggaatgctgaatttatattggttccgtttttccaaacggatctccaatcggacactctgaaaattttcaccaagctatgcgggaagacacggtatggatctaaatcgatagaagagagggaggagtcggactcggaggaaggaaggcaccacagagaggtggagctgaatattgcggccagcactagtgtttggattcagtgcacaaaataaaaggaaacggatttccacccgatctaatcttctttttctttcctattctgttctttcctttttttttctttccttccacccaaccgaatccaaacagatcttctatattcctttccccttcttcttcctcaagggcaaaacagaaccacagcacaagcactaagcctgggtaaacaacaaacccttgatgcaacaccaaaaccgaccgataaaaacttttgaaaactacaaaaatagaaccatggcagcaagccgattccgttttcgtaggtcccgacgataacagagacacggaggcggcaatgactctggtataaaacgtgaccagaacacgaaacactaaacgaactagacgctaaggcgcaacacaacgtcttgtacggttgtagtcggatcgccaacgtttctcccaaatcgtagttacctacaactcaccgaaagatcgggccaacaatagccttgagtgtcgagaggaactcagggttcagcaaaaactgaatagaacaaagcaatggcacaaagatggctagggacatgatgtaaatttttttgtatggctattttctgcttataggtagaaaaaaactcaccgagcaccgaaagctctgataccacctgatgaaccctgagttcctctcgacactcaaggctgttgttggcccgatctttcggtgagttgtgataactacgatttgggagaaacgttgacgatccgactacaaccgtacaagacgttctgttgcgccttagcgatcaatacagctctccatgggttgttgatcttgtcgatgcagatcaaccctattcctgcacgcaatcgagaacaagcaagaacaagatagaaagcaactgaattgctagatagacaagacgcacaaatatgaattgatacatgataaagtggggttccgaacaagcagacggacggtctagccgacacgcgcgctgcaagcgaagtagcaatggc

SEQ ID NO: 37747 - DNA, 1501 bp, Oryza sativa
  unsure (1)..(1501): unsure at all n locations
aagaaataaagtagctgagtgttttaatttgtacctatttttcagatcactgtcacttatgtganattgtaatttcatagtaaaaaaacaaaaaatatttagtgactgagtttttccttatctatgcgtcatcgcctttccgattagtgttaacctatcctttttttcatctcganccgtcatcactcatgtggaattaccgttttggaagtgacaacataaagatatttaggtgggtaccttctcacttttttcttatctacatgatatgccattgccttgtcaaccaacatattatctaggtgataccccgcgctttgctgcgagatttatggataagtatatattaaatattgtcgaaatgatgaaagttgaaatgttgaaaaaataatgtgagtaagatgatttgacacatgcttgttgatgatgtgttatacttacatgagatttaaaataggctagaatagtactttctagtgagtgaagatgttgcatgcttgtataggattttaaatgggctagaatagtaattgctagtgggtgatgatgtggcatacttgcatgttgagttttaacttttaataattgttagtgggtaccgactatatagaagactatatagaaagtatcgatgtgtagcagcactcactcatgctttgccaggtgaaagagaaaaaaagttattccaacttaaaacaaagtattgtaatttggcaaatatctacaagctagtatagatataaaaaagctaatgtgcaaaggcattcataaaaattaaaatacatttaggtgaatccgtacatgtaaaaatccacactaaacttaaatcaggttgcaataaaaaactatcaaattaatttgaaatacaagcttatgcatgcatgttacttatatgcactacaaattaaacaggagtgtttttctgaagataacttccatatgatgcatgcgactgttagtatagggtatatagcccattctttgactgccaagtgcaaacggaaatgttggaatagtgtcaaccattcagggcatgcgtggactattccaaatctaatacaggccattcaacagtctttgcacggttattctaaaattaaagcacctagagggtgaccatagttatgcatcgaacaaaatctaatcttataactagggcaagaattctccagtgaaattcaaagcattggtcttaattccatggtctaaagaatgtatggatttaaaaatgtgaaacatttgtgtggagattatgggtaccccatacccacacgacatggttatccgactagtcttaggggatagcttatatctatggaatatgtaacagatcatgacttgggtattacgtttccctgtatattatggaacggcctaaagtcctggtttgataagattgtaaagtagatttaggaaaccgataccatgttggttaaggtttctatcttgtaatcctgccctccaccctatataaggtgggcaggaggccctctagggggca

SEQ ID NO: 37748 - DNA, 1501 bp, Oryza sativa
agtacagcgtactatgtaagtgccgttctatcagcgaattactcctacgtatatacaaggatatatatcaattatatatatgtgcgcatgaaacatcaatgcatgctattaccaggggggctctagatgcatgactttagaagggcaaccccaaaggtatataaagttcatatctcatgggataatgatgaacagtgcaactagctactttctgcatccgctatatatggtacaaacgcatgaagctaacaccatatctatgtgttagctgcagcactactttctgaatgcgatatatatgatgcaaacgcatgtgaaggcaaagccatatgatctacgtgtttgcatgcggcttcttctccttattctgaacatgatctagctggttaggtcacttacctagttcgtacaggtacgtgccctaggagcaatgcggccatatatatgtagtgcatgcattagtgttgtgttcatgcaactactcgatcagtgctcactgaatgcgactgccacacacattagtgtgattaattactagtaatgttgtgctactacttgaaaagccatgcatgtatgcatgtgcatatatgtgtatgcataatgccggcaccttttattcaggaatcccaattcaccctggagagttggaacggatgctggaaattgcaggcggctgctgctgctgctgactccgatggcaacgaggcacccatgatggcttggtgttgttggtaggttgcaccctgcacgccgagaggattgataaatgcaggcatagtgtttgcgccattggcggcgtcgccggtgtcaatggccacggcgccagcctcagacaggctcctgtccaccgtcgatgacagcgacatgtcgccgatgtctctgctactcctgcttagcccactaggaaactccttggcccgtggaaggaatgcctcgaaccagttgaatggggttggagacggagcaagaagctgcttggtggcgtcgcacggtgtcgccgccgccctcgccgccgcggcgagctggctgagagagctggcgccggtcgagaggccggcggcgtcctccgcggtgagcaggccgtttacgaggaaggtgtcctcgtggctgtcgtgatggagcagtgaactgtagtcgccgccgtgcgctgcagcaactcctccggcgccgtccgaaccggccatgccagcagcagccgtggcatgctgctgcgacgacggcgcgtacgcggccaccgcgtcctccacggagtcctcgcactccatgctcctctgccccgcaccggccttgttcgtcttcttgtatatgcggcacagcacccagtcatccagctgagacactaatcaacttgatcagatcaatcagtccaagactccaagcgagactgtcacgcacaaacgtatatacgtacgtaccctgagagagacggcgcccttgctaccgccggtgatgggcggcggcggccgcctggtcgtagcgacggcggcggcggagctagacg

SEQ ID NO: 37749 - DNA, 1501 bp, Oryza sativa
tcttactgatttaagtatattattattgcttaaagtcaagacaaaactaagtatggtggatattcagagtttataatggcattattaacgaggccaattaatccacaatcgtcaagcatctctgtccgtcgcaagtgacaatgacactatctagcaggtgacattgaccatgctcaatgctgcatgatctggcaaggtttcagctggtttttctgaagaaaactaggggcggccaaatgcctaagctgtttcaggcttcctttcctgtttcaggctgttgcctatcctcttcctactgcatctgttttcatgaatccatgacattgcaacttggacaagatatacaagttataatgatgtgttcatttttcattaattattgcttagccaatagctagacatgtcctcaatacatgaccttatcttgccaaattcggtgaactctcagcacacttgattaatttagtttagcgtattttctacatcaatttgatactagcttgcaccaacaagtcatttcaacgtacaaagaaaaggttaaacgacatatactgatataccgaatttggtttgctccgacatttggttcacacagagtatatctccatgaatgcaatttagatttgaagatcatgacataaacgctccgttggttaaattccttttggtacatgtgggcttgagtctccgactcataacagatgatcgtatttacaattaattatttttctagtaataaacaaaatgacgatcaatagtgaggtatttgttgtgacttgactttgccaatcttagtctattttctcgaggatgttcatatggataacatttgcgtgtgccgattgttgggaacaatctgcgtgtgcctatatagggcctgtttgggggagctttagattctgagaagcagctgtttggtagccagcttctgatctgaaaaagttctaaacccagcttctccaggttctagcttcttagttcatttttcagaatatataactacagattctcaaaagttgtggactgtttggggcagcttctagcagaagcagcttttggaaaaagctgcagctgagataagctcccccaaacagggccataagcgtgcacatttgcattatatttttcccaaaaaaaacaacatattacgcattacaaaataaatttcaatacccaaacaaaatatcttttatatgtttaactcaaaattttccttcagtttttactcaaatttgtgccacatcacaaaattttttttaaaaaaacataaacatgtacttactcgtactacatacacaataatggaaaaaaaattatcattattaaaataaggtagggtaaaacaaacgtgaggaggtggatgacactacgcgcccaaccttcccccccccctctctctctctgcttcgaattcctcacctcacctcacctccaggcggcggcgaaaccaccagccgcttcgcttcgcctcgattccaaccctagccctacccctatccga

SEQ ID NO: 37750 - DNA, 1501 bp, Oryza sativa
aaagagatccccaaatcccaaacgcgatcgaccggaaagaaattccgctcgcggcgacggcggcgaggcggcgcacggcgtagccgagcctcgtttcggctcagctgcagggccgcccgcctttcggcgtcagaatcggcgccttttccgggtcgccggatcgatcccattcccaggggggttcccaggggaggcagctaacgtgagctgtttgttggtagccatcgattttgcgccgttggatcgagggatggacggctcggattccggccttcattccaaggagaatctagaaaaaaaaggcgtttgcttgctggtgctaggatgatccacggcatgatcacgtccacagcggatggctcctttgtttaatgcattggcccaactgctgcctaccgtttctggcttgcacgcttggatgatgggcgtggatgggatcattaggggggcaacaatggatgatggggtttgaatggttagtaccacttgtttcttaattagcagattataaataataacgcagcgggccaagattctgacggagtacgatatttttctgtagctggagtgacgcggctgatggtgctgtgctggctgcctggctcgcgtttgcaacctcaggcagcccatgctcgcacggcgcagcacacgcaagactgacagcatcactgcaccaagccgttcgctgtaccttgctgtattatttggaggatgatactgtgcgagctcagtttcccgaactaaacctcaaatgtctatttcggccgtaaaagccagattaaatccttgcaactaataatcctattgatgctaaactggtttttggagtattgcaaactctgcaagtcgtatgctaacataacacggtgtcacatcagcaatatcagtgctgaatcagcaaagaaaaaactatttgaatccatctgtcaacgtcatgtttatctaattatcttctttctctttttctggctgttgcatactagtaggtcccaacttgaagtggcaatcatagataattccgcatgggctcaggccttgtattttttaggaataagtccattttgcctccctcaactcatgacccggttgaatcacacccctcaaccacaaaatcatgtataacacgtcccctaactcccgaaacagttgcaaatcaactcctcgagcggttttggaggcgattttgttctacggtggcacttacgtggcgagttgacttggtcttcatcctatgtggcatcaacgtggcgcttacatggtactcaaataaaacaaacataaacgggacccacctgtcagtgaataaaacaataaaaatacatatcggccctgaagatgcacttaaaccccctagggggttttggtgattaatgacaaggtggttaaaggggactaacgtgtttatcaagtttattcacaggagtttagtcccaaagcgagttgtgatggctaagaatgcaaggagacccccccaattcaaatgttcctaagtgcaaaaatc

SEQ ID NO: 37751 - DNA, 1501 bp, Oryza sativa
ggtgtgttcgcatgtcatggtgttgacgaaaaaaatcgaacacaccggcctgggagatctgcttagctccagtgcaggtccaaagattgatgagatgcgggcgtgccagttagtttgatcctgcaactgacaagatatgcaaatagtagatcaaaacagccgatcggctaacaagccgatggagtagttccagccgatagccgataatagccgatgctgataccagccgatagcgatagggtgtaagcaatcggctatatgtccaatgtagataatgatatgaaggcaatcggctgatgataatataatatagcaatataatccagtataaatcaatcggctaacaataatatgatagaataaacattgatccgaaggttcaagcacacatcggctggaagaccgatgtcaataaatccacagattagattaaacagtgaaacctttgttgtcatcggctaaatcaaacttatatgtatatgcaatccttatgagccgatgcaacgtccagataactcaccggttgaaaccccgatgaaacccttattggcaatcaagaagcaggctagagattatggttctaagcatgacttattagatcaaacttaactgatgcggcactaagtatgaaaagaaacataatatctagacaatcaagtcgttgattgagttttcagggtggtagatgtctaagctaatctaatctagcaacacgatttagccgataccggcagaaaccctaaaacgagaagcagccaatagagctaaattgatatgctaagactagattaacagagacatatgataaataggtaggcaaatatatcatccaaaccagagtaatccaagaggtcgaatgtcttgatgcagccttgaacgacgccgatgtagatgagacaattgcccgggccggcagaacattggacttaccccttcgccggagatcgaacaccgatgcagccccgcgtcgggtgccaagtcccgccgaacgataaaattaaatagaaaaggtaaaaggtggcgatgcgccgaattgtattgatcgtgaggatagattacatagaccccgggtgtacatatttatacccatgggttgatacaattccttgtcggacaagaaagaaactaacctaaagataaaaggaaaatataaagtccttattggacactaaacacactttcctaaagataaaaggaaactaacaaactattcctaattaatagataaactgccatgccgcatcctctttaaactcggtcacttagggataagcttcctttagtagattgatttccttaactgaatatagcaggaatccgactattggcgacttgataactcccatcggctgattccgagatgctgcagccaataatgattctaagctgatgacgtctttgccgattaccaaatttcactgttaacacatggtttggaacccatctccccgcacgaaaaacggagcagcccattagcgcgtgactaattaagtattaacaa

SEQ ID NO: 37752 - DNA, 645 bp, Oryza sativa
ctatagggcgaattcgagctcggtaccttccggcccaacccactgggctgaaagtacttactactagtacatgttattactagtcaatggtcaaataggtctggaaaattgtcaatggtcaacacaggaaatttggtagctatatctgaaattttagtgtacctaacactaacgaatgctccatcgtgcaactctctggattattatgccaactgattagcacccagtatttccatttcattcctgcccaggaaaccaaatggtcaaactcgtgtcacggattcgcattacatttgaccatttagtcaacatcatttctatctcttagagcaggtacaatagcaggctataagagcacccgcaatagtaaagtaaggtgctatctataaaatatgtacatctcagcaatagactagattaatagtaaaccatttcaatagtatatctacatgggtatctatagctctctaatccattgcctcgtttttctctatagactatctccatgttagtagatagctttgctctctcgcttcatttaatctcttccaagtagaaaaatatgctgacatggatcttttgtagagagcttatagataactattgtgggtgccctaagccagctgcaaacatattttaagtaga

SEQ ID NO: 37753 - DNA, 1501 bp, Oryza sativa
agcacaaccacaatactgagctccccacacgcacaaaactatttgaacgagcatcggataccatctttgctccttttgacaaatatacaagccggcacaataataaaattgacgatccgcgctgtaagtaggtgctatcaattgaatcattgacaacccggcaaacaagaatccctataacttcatcaaagatcacatgattgaagtagggcgaaatctaattcgcgcacgctctctgttttgccttatcacgcgacacgctcatcggctgtctgatcccacaagcgctggtgcgtctgtacatggcctggtgattcacggacgtggcatcatccagaggaatccaaattggaagccatgtgatgctctacgctacgccggcttgaaaaatgattttatcttaaactaatcatccgatctacgatccgattacaccggtgtgttcgtaagaattgaatctttataacaagatctcacatgattatattttgatgaaaaattagaaattacttttataatatatctaaattacttttagatttcactaaattacttcttagacccataaaagtaaattcaataaagcctaaaagtaatttacatatattatagaagtaacttagaacaaaaagaaagtaaccttatcacgacattaaaagtaaatccgttatggaggtaaaaacatgagtctatataaaaattaaatttaatcagcacaaattacatcattgactaaacatgattataaaataaacaactcacaacatgaatgtaagatttcttttaatgccgtaacaagttacttcacttttgttttaagttacttctataatataggtaaattactatcaagctttattaaattacttttatgactaagaagtaatttaatggaatctaaaagtaatttagatatattataaaattgatttctattttttcataaaaatatagtgatgtgagatcttgttataaagatttaattgttatgaacacaatagtgtaatcggatcgtaaatcggatgggtaatctaagagaaaattccataagaagaaaaaaatacatgcacttttgagtatactagtagcaattagatatgagattgagatagctggttatgaccatacaaagaacggtctcgttgtagacacgtccttgaagtagctatgaccagggtttacaaaatcgaaaaaaaaaattctcggtctttcggactggctggaggacacaagccgctcggttttaaaatcatttaaaaaaattcaaactggattagatttttttagagtcaactttttcatgaaatatataaaaaaaagtaaacccaattttttttcaaagaggtaggaaaaaactgtagacaatcccctctcgaaagctagaaggaaaaaaataattcaacaaataaatcgaaaaatctttattcaagtggcaagggcgtgtgtcagggttacgggtaaggtataccctccacccttcgatatacgttacatatcgata

SEQ ID NO: 37754 - DNA, 1501 bp, Oryza sativa
tcggcagtcaatttcaggtcacaaatctatgaattaatggggggtagctttgaatttccgattacgacggttcttgcatctagaactggtcttatccagcaatcagggactcatgacagtaatgttgcaataataattagtatcctacttagttaatttatttggaagaccaattaagcagaaatggacggaagaaattcaaaccttcaactcggcgacggcgagcaatttaggaataccaggaaagttttcatcagtttaattattttatatgcagatggatgaacttactctgaaacctgattttctgaaagggaaacagacaaaacagaagattaagaacgtacatatgtccagaaagcacacacattaaactactttgtgcatttgtcggtgtcgcttcgcaccgattagaccggagttcatcaatccgcaattatccgtgctcttactcctcctgcttatctagaaccaaaatccagaagcagcatttgtccgaaattcaaacccactcattacagtgtgtgaacctttagcatttggggtcatagttctattaaaccgtaccgtgtctcccgggtatatcgcagagatagaacattctattggtaatttggtatgcaaccagtcacagtaaaaaacaacggaagaaatgataataatcaaaggttacacgctgaattttcatgctaatcaacgtccaaaaggttgtgctttttctcagggaaaaaagttaccagtatacttttactcttcgactcgcggcccatggcctaaactgcttcgcgttgtccaaagcgagacagtgtcctaaacgggccaacacaaaaggaggcctagtaagccggtgcaaattgggccagaaaagacggtggaagaggttaccatacgctgggccgtgtgtagcccaggaaatgggtggacgttggcgcgcgaggggcgggcgggcgggtggcgaggtgatcgatcgacacgcggtgggggagcggcggccggcatacgtgtccagcggcgacgggcccgtggcggccgcgttcggtacaacggagccgtatttctcggggccaatgccttcggcgcctctccccacaccgcgcgccgcgcgcaccccccttgcctgccttgccactgccagcccgcacctcatccatcgcctcctcctcgatccctctcgctcgctagcttagcatcctgcatgcatgcagcgcagcggccgaaaccgcccaaaattcccagcgcagatcgctcgcctgccttgcctgcccgtccgcctaaccgacaccgcaacaaaccacagccacacagcttctctctgttgctcgctttactgtgcgtgctgtatatacacccggtggatgagggatctagctaactagcttagctagacagcgtgtgttggtggtggtggtggtgtgtgtgtgtgtgaggagggtgatcgatcgatcgagcgatggagagcccggactcgtcgtccggctcggcgccaccgcgagtactacgg

SEQ ID NO: 37755 - DNA, 1501 bp, Oryza sativa
tcttttaaaaaaaagtaaactctggctatgcttttttttacggagggagcacattagttactaaaggatattatagtctttttctcttaatcttagtatatgctaaacaacctagaattatatgtattttgctacggagggggtatattttttaacttatgggtgtatttagttcacgccaaaattgtaagtttgattgaaatttgaacgatgtgacgggaaagttggaaggtgtgtgtaggaaagttttgatgtgatggaaaagttggaagtttaaaaaaaaagtttggaactaaactcagcctatatttaatactccctctgtcccataatataagggactttgagttttttttcattgtttgaccactcgtcttattcaaaaatttgtgcaaatataaaaaacgaaaagttgtgcttaagtgctttggataataaagtaagtcaaaaaaaataattctaaatttttttgaataagacgagtggtcaaacagcaccagcaaaaacttaaaatcccttgtattatgaaacggagggagtactttggtatatgtgttcagacgttcgatgtgacgggatgtaaaattttaacgtggatctaaacagacgatcaaacaacatcgacgaggagtaaggccctgtttagatgggactaaaacttttaagtccctatcacatcggatgtttgaaaattaattataaatattaaacgtagactattaataaaacccatccataatcttggactaatttgcgagacgaatctaatgagcctaattaatccatgattagcctatgtgatgctacagtaaacattctctaattatagattaattaggcttaaaaaatttgtctcgtgatttagcttttatttatgtaattagttttgtaagtagtctatatttaatactctaaattagtgtttaaagacagggagacagggactagtccctgatgtaaacaccacctgaaacaacgaccgctacgctaggtccatggtcgtggcaacggcagcgcgtcgggagacgagctgagcaagcgagacacgagaccatcggcggccacgctcttacacgccatcaaccgcgagacacgactcacacgagactccccacccatcctcctccgtgcgcgctggaggaggtggaggtggaggtggtggtgtccgctgccccccgcaataaataagcctacctccatgttcccacccccctctctctctcttctccgtctcgcctcgtcacctcacctcggcatcacccaggtgggagggggtccgccttgacttttcgtgttcgggtttgggtttgagtgccgcatctgcaagcttgtgcgaggggggaatctctcttccttgctgtggtggcggcgggcgggagggcggcgttgatttcgttggggtttgcgttgcgtgcggaggacggggttgtgtttgtgtgtgtgtttgtgctgatttgggcattggtgttggtggtggaggaggatggggaactgcgtggcg

SEQ ID NO: 37756 - DNA, 1501 bp, Oryza sativa
aaaagagtatagttttgcattgtttatgtccaacgttcgactgttcatactatttttttaaaaaaatatgattagtattattattattattagatcataaaacatgaatagtactttatgtgtgactatttttttatattttctcataaattttgaaacaagacgtacgatcaaacgttgaacacggaaacccacaactacatttaaattgggacggaggtagtatcaaacatcaaaattgagttgaaaaggcaaccttctctctctcactggtcgtggcagggcgacctcagactatagatggccaaaaggcccgcccggcacggcccggcccaggcacggcccaccagccatcgggccggcacggcccgatcggcacttcgtgccgggccgtgccggcccatgggctgcgcctcccgcccagacacggcccaccagctgtcgggccatgccgggccggcccgaagacgcgggtggcccaccgtgccttttttaaataagtctagttttcgtccctcgtctttgggctgtgacataatatagcgaaaataagtctattttccatccctctactttgggctatgacatatatatatatagtgaaaataagtctatttttcgtccctcctctttgggctgacatatatataggtaaaataagtctattttacgtccctattctttcgaccgtggcatataatatgtctatttttactccctattgtttatgtgtcgggcttagcatgcggcccatcgtgccgtgccggcggagaggcccaggcacggcccggtggtcgggccgggccggcacgggcccgacccttgacgggccgggccgtgcttgggctgggccaaaacgccgtgccgtgggccgggccgtcgggcctcgagccttttggccatctatacctcagacgcccctccagatcccctccttggctagggctgtggtctttgctccatgttcccaacccctctccctcgtattccgcgcgcactctttttaaattgataaacggtgtgttttttgcaaaaattttctatacaaaaattgcttaaaaaaattaaattaatccattttttttaaaaaattgttaatacttaattagtcacgcgctaatgggctgctccgtttttcgtgcggggagatgggttccaaaccatgtgttaacagtgaaatttggtaatcggcaaagacgtcatcagcttagaatcattattggctgcagcatctcggaatcagccgatgggagttatcaagtcgccaatagtcggattcctgctatattcagttaaggaaatcaatctactaaaggaagcttatccctaagtgaccgagtttaaagaggatgcggcatggcagtttatctattaattaggaatagtttgttagtttccttttatctttaggaaagtgtgtttagtgtccaataaggactttatattttccttttatctttaggttagtttctttcttgtccgacaaggaattgtatcaacc

SEQ ID NO: 37757 - DNA, 193 bp, Oryza sativa
ccgacctactcagtctacgtgctacatatgttacttgttaatataaacttatttatatatgtatatggaaatactttgtatattgactgtgtgtgtattggtggtaaacacgtactgcagctgcaaggccatgcacgcggcggtcaaggagcgcgacgtcgggaaacgtgtgcgctggagaggctagataaca

SEQ ID NO: 37758 - DNA, 1501 bp, Oryza sativa
tacgtaccgcatactccatgttgtactcatcggacggtccgtcatcggatcggacgccttttcaccggcttaatttcttcgcaattttgctatatatttgtcgacaaattttcccctaaaaatttgacagatgtaattacagtacaaccgtaatgtaattacactgtaatttgcatgtaattacactgtaactataatataacttgtatgtaactttcaaaaaatctctccataacatattattttggtaaaataaaggttgtgggaacaattttttttcagatatgtgtgtactgtgattttttttcttcctcaccaaaacaaatctttataatagatctaataatttaaaattacgtgaaacttacataaaagttacactgtagttacatgcaagttacagtgtaattacatacaagttacagtgtaattacattacgattatactgtaattacatctgtcaaatttttaggagaaaatttgtcgacaaatgtataggtggtccccttcttcgagttgaaaaggagtaaagagagtagatggcccatgagagctgaggcccatgacagcaggattcgccggtacaaacaaaagggttggtatgtgggccatacggctcaggttttcggtaaacttagcggtccaaagaatgactctggtgaaaagtgatattttgataggatggcaatattaccaaaattttaatatgatttattatgtgtttatcaaagtttagcaaaaaaacctaaatgaaggcacatttttagcaactttgaaaaaaaaatggtatggttgaaaatatcatcaatctgaacagcccctaaattttggttccaaatttgttttgaaaaaaagttaaattggctccaattcaaaccaagacccctatattggaagtttataagcagctcatcttagagcctccagctctcctcatacagcctacattcttattcagattttaaggattgtattatatatttatatatatttatatatatatattctcccaacttctattctctcgtttttcatgcacatattatttataatgtgtattttacaaataattttataggaaaattgctttaaaaatcatattaatgtatttttcaatttttttactataaattcttactaacactaattcgtcgtgctatgagtatctagattttttttataactttcatctatctaaatcaaacagttgagaagatttgtcagtaaaagtttagtttgaaaattttagtccgtgtaacagtgctctcttttcagaaagcccaacattgtcgataatttcgctatcgcattaacgggcctgttagaccggaggcacgagcagttccacccaaccccaaaaccgaaacgccgaacgaaacgaatcgtaaactcccctgctgctacgcaacgactccccaactctccggccaccaccaccaccacctgttccccatccgcacgccacgcaccggcccaaccgattccccaccatgccggacg

SEQ ID NO: 37759 - DNA, 351 bp, Oryza sativa
attttggtaagattctttagtgaattcagttaaggaaaaagcacaaccagtcgacggaaacttatccaaaagagacatagtttaagaaggaaccttgaaaactttggcatgacggtttaaattctatctattaattagacaagatttagtaatttccttttatctttaggaaatgtttatttagtgtccgatcatgacttgtatctttccttttatctttaggaaatatgtgtcatgtccgatatggactagtatctacccatggtataaatatgtacaccgatggtctttgtaatctatctcttgatcaatacaactactctcgacgtatcgccaccctcttttccgagg

SEQ ID NO: 37760 - DNA, 1501 bp, Oryza sativa
ggcatagtagggtttcatttgcttaaacaacatttattaaacatttcagaatttaataaagcagttaagtaataattaaacaatattaatccaacgctatacaacataccctgttgcataggcccaaccattctgaacaaccatcccggctgcacagttctatctccaaaccaggaatgtaccattccaaaccaggagctaatcaaattattaccagttatagcatctttttttatgatgggaaatgtgaaactaatcacgaaagacattgttagacccgcccataaccgcgggcacggctattcgaatagttttactctggccagagatgtaccactgtacccataagacacagccccacgacatgtcaccatgcgcctcaataccaccacggtacctcagaaaggagctgtgatagtacccctcacacaacacaatccaccacagcgcaccgttcctggatcataatcacccccttataaacaaggcatggactccccagcgacccccgtgagcttatctccgccacttctcagtctggtgccccgcaatgaaccatgctatacaaaaggtaaagccgttgcccacgctggcttgtggttggcacggttaatgtttcacaaccgaaattcgtgaaccggtccttaattgtcatgagcacgaccatcaaaaccatgtgctcacaacccaccattagcaagttttagttggcaatttaattaattaaccaatcacgattgaccatcgtgagctatcatcaagccatcattaaataatagtgaattataagttatcccaatagtgtgctcatgtttctaagcatggctaagcaatcgtatctaatatctagctgaaccaatatataaagcccaactagtcaagttataataacccaaggtatcaaggaataaaataatcaagaacaaaagggctataacaaaccataggttaattccacccaatgacattcgaaaataaatgcaatagttgaataaaaatgatagctttaaacgggatcaacatgctcaaagggttgtttgggatctgtgtgacttgccttgctggccttggaactcttcaaattcttctcctgcgaaaatgaactctccggaaacgtcggaatctaaacagaaaagagcaaaaacaccaaaacagcacataaacaagcatgaatagtaatgtggatatttttaacatgtagatctcaattttagaaaaatttagagacttgaaccaactaaatccgagctaagatgaattagttatgaatttttaaagattaaatcggattaaaacacttatatgggttttaattgaattatgacgcaataatgaattatttttgaaaaggaaaagggaattattgcgtcagcgactagggtttgcggtggaccgggtgcacggcgacggttcacgggaacggacggccgagatcgatcctaaccacaacggacggctaagatctaacggtctacgactggtctacgacggatggcaacga

SEQ ID NO: 37761 - DNA, 578 bp, Oryza sativa
cggcgaacttttgtcaattattgttcaggactagactgagcaccgagttaagccttacccattagacatgtggttagtacggtagtgctttgcaacagaggcccgagcttaatccttatattggccggggtgctacttcccataactggcatgcatacaataccccaccagaaaacatgttttaggggttttgaaagaggaagagaggggtatgtccaattccaccataagccaaccatttcatagtatccaagtgatttgagaattcccaaagtctaaagttataaaaccacctaatgttgcctaattaatcagcgaagcatctacctaaattcatactagtggaaccatgaatagagtacccacttgttggggttttgttttcctagggtgaacaaggtgataataaacaatagcaataataataaggtcataacaaaggattaataggaagtgctaaataaaacagtgataacgcaggaatttaaataaagcggtaatgcaataatttaaatcaaaataattttataaactgggattcaatatgctcaagggtgatgcgacttgccttgctcaga

SEQ ID NO: 37762 - DNA, 1501 bp, Oryza sativa
cccgtgaaccgtcgccgtgcacccggtccaccgcaaaccctagtcgctgacgcaataattcccttttccttttcaaaaataattcattattgcgtcataattcaattaaaacccatataagtgttttaatccgatttaatctttaaaaattcataactaattcatcttagctcggatttagttggttcaagtctctaaatttttctaaaattgagatctacatgttaaaaatatccacattactattcatgcttgtttatgtgctgttttggtgtttttgctcttttctgtttagattccgacgtttccggagagttcattttcgcaggagaagaatttgaagagttccaaggccagcaaggcaagtcacacagatcccaaacaaccctttgagcatgttgatcccgtttaaagctatcatttttattcaactattgcatttattttcgaatgtcattgggtggaattaacctatggtttgttatagcccttttgttcttgattattttattccttgataccttgggttattataacttgactagttgggctttatatattggttcagctagatattagatacgattgcttagccatgcttagaaacatgagcacactattgggataacttataattcactattatttaatgatggcttgatgatagctcacgatggtcaatcgtgattggttaattaattaaattgccaactaaaacttgctaatggtgggttgtgagcacatggttttgatggtcgtgctcatgacaattaaggaccggttcacgaatttcggttgtgaaacattaaccgtgccaaccacaagccagcgtgggcaacggctttaccttttgtatagcatggttcattgcggggcaccagactgagaagtggcggagataagctcacgggggtcgctggggagtccatgccttgtttataagggggtgattatgatccaggaacggtgcgctgtggtggattgtgttgtgtgaggggtactatcacagctcctttctgaggtaccgtggtggtattgaggcgcatggtgacatgtcgtggggctgtgtcttatgggtacagtggtacatctctggccagagtaaaactattcgaatagccgtgcccgcggttatgggcgggtctaacaatgtctttcgtgattagtttcacatttcccatcataaaaaaagatgctataactggtaataatttgattagctcctggtttggaatggtacattcctggtttggagatagaactgtgcagccgggatggttgttcagaatggttgggcctatgcaacagggtatgttgtatagcgttggattaatattgtttaattattacttaactgctttattaaattctgaaatgtttaataaatgttgtttaagcaaatgaaaccctactatgccatcctttgttatcctgtgcacttgcatatttgctgcgtggcttgctgagtatgtcatatactcaccttgcaatcattcatcag

SEQ ID NO: 37763 - DNA, 1501 bp, Oryza sativa
ctagacttatgtatgaatgggccaagaactcagaaataacacgacacattgggccaaaattcacaagtctacgaagaaggacaacaaaggaggccgccagccgaagatgggctgggttgggccagcccatggttcggccgaaccatagggttcagccgaaccacccgtggcgccgatggatgcagggtttggacggacagctgggattgatccccaatggcggttggagggtattaccgaccattccaatcgtcccaaccgtcattacctacctataaaaagagcttctcttctcacttcactcacacacctcaagcaattgctctctcatttctctccagtttagtttagtagtatctagctggtggaatagaaatagagtaggaatcaggagtccggaagccttcggaagagttcgggtatggctctagcagctttcctttcttcttttgtaaattttgtacttttattagcatactcttctaaatacatttatggtattgaaatactttccgagtatgtgagtacctattttacattatgttcatgttatactgaatatacggctagcatatctaggagatgctttggtgcgggtataatgtttgcttatgcaattactctatgtcatgacgatgatattagagtaatatctggtagtttagacgtagtgtctagattacgggatatcattatttggggttatatgttgcggatgagaggtgggccgctgatggtgacagctcagtacgggtattcctccgcaccggtatataatcctaagttaatttcctggggagggtattcctccgtatttagccccggttgtatggtcatgacagactatcgtaaggaactcggcagtcaggggtggcttctcgaaatactaggagggcatcggatagagggtattagctagtatatcagttaactagaatgtatgtatactatgtatattagaagtataggaatatattttctttctcttttctttccacttagctcagataatatattatgagaatgagtagtaatgcttgtgtgtcactctacccttggattatcttaacccctgcttagaatatgattatcataagtaatatataaattattagtcaatctatctctacatgatcttcccacgggataaaataaatacgatacccttagaatactctcgggtgaaatgctacaatggtatatctgtgcgcttgcggatgatctctgtaaccataatataccagaagtatttctgcgccattgctgggaattatatttctagtaatgtcgttaagaaataccagcaagcatttttggcaccgttgccggggaagattcataatagagattgcttgaactaatactttatatttacctctgtataatcatttcctttgcaggctaaccttggttgttttcactttttgttgtgaaaacagggtagtgcatgactggtttcaacctgccggaaaacttcaaagaatatccagaagctttcttc

SEQ ID NO: 37764 - DNA, 1501 bp, Oryza sativa
cactagtatgaatttaggtagatgcttcgctggttaattaggcaacattaggtggttttacaactctagactttgggaatattctcatcacctggacactatggaattgttggatcattgtggaattggattcacacctccccctctattcaaaaccctcaaaatggttttaggctgggctcggggtgcatggttttgatagtagcacctcggccatataaggaccggtcttcgggcctctgttgcaaagcgctaccgtacttccacatgtctagtgggtaaggcttagtttgtggctcagtctggttataaacaaaagtacacggatggagatggacgaagtcgggggtcgatggacatctctaggacaaatgaaggctacacgagctacggcctggtagccaagatgtcatggcacagggccggtgtcctgctgctaggggctcagtcctgcctacctgtcccgggggttccggccgtaggtggggttgggtcggtactcttgtctatggctaggatgggttggaaactatgtcacgtcttccgtccgtataccgtggtggtatgcggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccttgattaataatattgtatagctctggaatcgtgtttacaaaatagctttgagcaactaagtgtcttttaatgctgtttactgcaaaacctaaccctttatattacaacccccttgtactcccttgcatttatcctgcacttgtgggtgtgtcttgttgagtacggtggttgtactcagtcttgctcaatttttcccaaacccagaagaggagcccctggaagatgaaggctttggtgtctagctcgtgcctgccgtcaagcgcctgtggtcgtcgccctagtcttccgctgtttcttgtttgtctttgtgtgtgctgggccttcgccgcccatgtaataaattaactatttacgcttccgcttgataaactctgaaatgtatcaacttttggtgtaccttgcctcctgggataaggaataatacacgcacgtaaggaacgcccgttgggtcaattccggtcgtgacaagttggtatcagagcccccttgaccctaggacgagccgtagatcccaagccttagcaatattttcaaaataaaaatcctttcttatttgtgaaaatcctctagtctctctctgtcctgctgcttcatttaccgtcaaaatctgacctttaaaatgttgcttttctcttttgtttttgtttgtagatg

SEQ ID NO: 37765 - DNA, 1501 bp, Oryza sativa
gagaatattcataatcacggtgttatcttcttttgcttctatcacggtgctccctgtcacgatcatggtccctatcactatcaccatttttaacaaaccatgagaacattatttcagcagcacggaaggtaatagaccgctaattttgcaaacatgcaaggaaagggatcaataaatataatgagaaccagggagtatacgttttggccccaaggtttgcacagaagaaaaataccagcatttgtccacaaaaacatttcaagcgacgcaaatctagagaatatatttaccagcctaacgatgagatcctcagctaacataccaacatataagctactgctcaatgagcaagtagtgtgtaaagtgtggcctattggtaaataaaacaactggtttgaaatttccaacttagattattgacatccttagtgcaccacacatcacactaagtacgagcattgatatgttaaaagcatggaaataattactttaactcgtcagaattgataataaaacacgttcttcatccctctagcacgagggggagggggaggcggaggcggcatgaggcggcggcggcgggagctggagagggagaggagaagacgagagggaggagagagtgtgagcggcggcggcggctaggattatggtgggtgggttagggcgtcgtttgctagaaaccccctcggcttccacgttttagagcgcggtcctaattcgtgaattttctctccttcgcatgcaatatctaacttatgtaagggcctattcgtgaattgacacctcagaggaacttttcactgggtactcgattgaattacacacaaaccgaagggcttttctgcaaaagtaaaatccaacgtggcacgccccagcgtgcgaacctttataggcttcctaatgttttacatgtttattcttatcatatccctactctatgttttttcttagagaaatccatgaaacaccatcgataaacatacgaatccaagaaatgtcatcatacaaacgcaccatttcatttagattttcgttagcagccctccgttaagtgctataaaaaattattttacccataggaattgctaaaaggcaattaaaatttttgctctttccataagcttacactaatttgtaggttgttctttatactaaattattatttataagttgactaaaaaagaaaaaatttaatgagcttttaacaattcgtagggtaaaatggtcttttgatagtacttaatggagggctactaattaatggaaacataacaacgataaaattttggaaataagatgattatatagtagcatttataggaagttgggttcatcaatggtttttttaacattgggatgcttgtccattgtttttttctttttggattttctccttttcttattactagaaaaatgcccttgcgttgcaacgggtgaagattattgttgtgcgggttaactaaggtgaaatttactgtaggaattcgcttgaatattc

SEQ ID NO: 37766 - DNA, 1501 bp, Oryza sativa
tggaggctttcacacggattttaattattctaggcataatttagaggatgtattttagagtcgttttgggacgtgacaccgtcctcctcctcccgtcaacggcaccgcgctcctttccctagtcggcgccctcacctggtcggcggcgcgtcctcccctcgtcggcactgtccaccccccttaagaggcgccgtcctccaccccttctcgccgcccacctccgcgcgctcgttgcccgccggccacgagcacggcccccatctggctcagccatccccggcgctcctctctcccttcctctctctccacgattgcgggtattttggtcttaaaactcctcaaagtggcaaagtatactgatgataatctatttagtggcattttatcctttgtattctaatggatggcatttttgcactcttgtggagtggcatattgtccgttttctccaatttgcccctgttctgttagatcggtttgacggtgttaattctgggataaaaagacatatataccctttgcatattgttgcagtttgtctgtacttctgtaaaaaaaaaagtcgtgcttttgcgatgtgtactcctactgtcctacatgcggcgatggctagaaacgtatcgagcatgtttgatgctccgttggtgttggtgccctgacacaagcgatcctccaaacagatcaatttaattcccggctttcatgaacaaaaacgttgcatacatcaggaagggaaaaggaaccgagaacacaagcaaaaattattccccaaatccatgaatctatcacaacctaaaaatgaattttcccagctgcttgcaaattgattcgatcaatagaacgaactgtgaaaacctactgctttgcacgatgtcaggatgtggcgtggctgcatcgccagcttcatgcggatggtggatacagcgaagtgaagcaacagataaaggccgggaatcggaggggagcttcccggcgccgacgttggtggacgacgcggactgcagcgtgtcgaggccactgggagtcagcgccgtcgccgtgctacacctccccctgctacacgtttgccgtgccgcgtcccgtacggccgtacctcacctcttccagctgaaactcaaccctgccgcccctccacatgcgcgcctagccgtggagctacgtcgactcacccctcccatggcttaccgtgtcgcctccctgatcgcgcaccgcttgcctgagcagcagtgctgcctccgccgtctgctcctccctagccagggcgttgggtttaaggggataagggatttttggtcgggagtagaacgattattttgcattttgtaaatcatttttcttttctttctacttttaattgattgaatcggagcacacctaacagccattcaaaataggggcaaaatgcaggttcagtctaaaaaagtaagggcacaaaccctaaaaataagaggtaaaattataattgcatagctaacagagaaaatgtgaaaatcgaaccaat

SEQ ID NO: 37767 - DNA, 1501 bp, Oryza sativa
tacctatcacttatttggaaaattctgcagtaccctagagtgaaatgcaagcattgtgttcatatggggtttgttggcatatttcaactaaatccaatttttaaatgctacagtgctacaagaggctagaaaacaacagttgcgctattgttggtgactgacatgaatccatcgccgctcaattttaacaaagttgcaaagaagtttctaagacaataggggcttttttttggcgctgcaggctcttgcatcacccattcatctgtcattacggtttttgatgcacactgcctaattagttgtttttattatacttggattatttttctgacagaacaaatcacttcagttcccctcctgccaatgaggagtgtatgcttatacagtgaaagtattatgaggtttcatcaaggtattgtaatttgtaaaaccaatacaaatgctatgctcaataattgttttgaaattgcaatttttgatgaatcttatgctcaaaagatgattaaaattatctccataatgctcaagagaatacagatggttgtttttgtacagaacttagattttattataagctgttgtctatcgacaatatccatcattttatcagtctatcgacaatagtaggacgagctcttcagtctaaataacagttatatgtttgctgatgcgcctcttataacttttgctgccatgacactagccccatgtctcttgctcttgatcttcctttatgagtcactccatctaatttgtgtttgcttcctgatatttttgtagatgcaacaacatgaagattgaaaaggctgctgcctgcaaggtgtttgaaatcactgcctctggaatttaaatgtgtgaaagtgattgaatagttctgaaaatttatccttgctttgctagaagattgaatgggcggctattggaggaagaagaagcatgctacaggggtaatgacaaaggtagcagggtccctcttttgtgctcatggcatgtcaatttatcctttctgttgatttcgtgtctagaccagaaattttttaattcctacttgaaatcatgctaaaatggtttggtatcatatccaagaccaagcttaaatcatcttgtatatggtttcatcctacatttgttgctatgaagagtcaacacaaatgttgatattttccaaaaatcaactgaagcgtcgactctaaaatcaagttctagaaaagagtaagaaggatgtgctccgtcaaataatagaactgtaaactatagaaactagaagtcttaaggacactacactaaccctaaagtcactcgtcatcataagcaaagtgcaaatattgtctgtctggagtctggactcatcatttaggtgctctttggcagggcagcagctgtatgtttcagcttttgagttgtccttagaatccatctcattgagtaagcgcacttcaattgaaatctataactttctcgcattctgggaagttcattttcttattgcctgcaatttttg

SEQ ID NO: 37768 - DNA, 1501 bp, Oryza sativa
gtcgctccactatgatgacaaagttgcatcgccgtgatgaagtgaacatgagtcggcggcaacagaagcaaactggtagcgaagacgcgcagttgtgaagataaaagcactagtcggcggcggcataaccagtcggcaacggaagacgatgatgtccatcagtagtggtagctgtataaaccagacgtagaggtgagggcactagtcagcagcagacgagacgaccggcggtgaagaagataaggccaatcaacactggcagaatcatgcagccatggaagtgaagaaaccagtcggcagccatggcaaacgtaggcagcttgtgttgaagatactgatgcctattagtagtgacagcgatgtagccagccgtgaagaagatagcatcagttggcgttataacaggccagccgtgcaggcggtgacaccagtcagcggcggatgcggcgaccggtcggtgaagacgtagacgcccaacaacggcagcataataagtcagccgtgcaggcggaaacaccagtcggcggcggtcgaggcagccggtcggtgaagacgtagacgcccaacaacggcggcataaaggccagccgtgcaggcagaaacaccagtcggcggcggcaaaggcaagccggtcggtgaagacgtagacacccaacaacggcggcataaaggccagccgtgcaggcggaaacaccagtcggcggcggcgaaggcaagccggtcggtgaagacgtagacgcccaacaacggcggcataaaggccagccgtgcaggcggaaacaccagtcggcggcggcgaaggcaagccggtcggtgaagacgtagacgcccaacaacggcggcataataagccagccgtgcaggcggaaacaccagtcggcggcggtcgaggcgagccggtggtggtgttctgactgatccattcctggagcgtaagagataagcttaaagccatgaatcccttttatgcatatctggatctggatcctgcagaacaaacatataggatgagtagtatctgatataaatataatactcgagaaaaaatcaagtattttaaaatatttataaatatgtatttctcctcttgtcaattttgatttccccgagcagatgactctgtacgtttaaacactctgtccgactagtcatagcccccaagcatcgggagtcggcctaggcatttcccaaacatgcatatgagtgacatgagttcgtcattaatggaacaaagtttcacggatcagaatttactactcaggtacttttgcaattattaagagcagaaaataaattatattatctctatgcttttgatttcttccgagtaatacttagcaccttgcgttactcggtccatccaacgagcccccgggtgttaggaatcggcccaaaggcaaccatccattggcaaaccaaacggaaagcataggaagatagaactccataactcgataggtacttttgtactcagattatgtcgcaagcaatcaagataaat

SEQ ID NO: 37769 - DNA, 1501 bp, Oryza sativa
tctcccgtttgccctcaggaagcccatgaaacgcgctgttttcgcggacagaatcagccaaagcctcagcaaaaaaaatccaccgctgctgcctatccagaaccccgccgcggctcgcatcgtcgcagccggcgtcgagccgtcgggagggaaaaaaacatctctagctctccttcgcggcgccgccgatggctgccgtcgcgcggatggccgccgcggtcgtctgccttccctcctcgtcctcatcctcctccgcgtgccgcgcggcgccattgccgtggtcccgcggcgtcgtcgtcggggtgaggcggcggcgcacggtggcgcgggcggcgcggcggagggggaggaggcccggccgccgcggcctcgtcatcgtggacgagttcgccgggcagtacgaggaggggttcgaagacgtgcacacggtgcgtgtacactactgatttcgattttctttttttttgaaccggcaggggataatcggaacgctatctgtaaacgacagcaatataatggttaattttctctaactgcaaggttaattgggtttagattgcatggaactctgaagattgttctctccattttgcaggaaatcatgaattacttcacttacaaggccacaagcacggtgctccaccagttgtatgaaatgaatccacctgcttatacttggctgtataagtaagtcaccccattgcaagaaaatctcacattgatatattgtgctatgttgaaatgaaatctaagtagaataggttaatgttggtgtcagttccaatctgcatccttagcgtctaaaatacgaacacttacgatttgtcagctacgtcgtggttaacgatccaaaggagggcaaacatttcctcatcgcactcgcaaaggtatctttttgcatcttgttactaagcaatgaagaaaaatatatatgatgttcagcattgtgccaaggttcattctctaattaatttgacttcgtatgcaccaggagaggcaagatttggcagagagagtgatgatcacacgactccacttgtacagcaaatggatcaaggtaataaaaaagagtgagatattccagagtaatttgagacatctttgatgcataaattatttaattagttacctcttcatcaatgcagaaatgtgaccatgcaaaaatgtacgagaagatttcgaatgagaatctggagataatgcgtcagaggttaatggaaactgtagcgtggccaacggacgacacaaacaccagcgacacggcgaaatgaacgatcgattcatggcagcaaacttgaaactcatgttgagtatgacagatccactcaataatgtactttacgaatattccttgcaggttttgagttaatcatttgtgtatataagtagccctgcatgaatagaacaatcgatgtatattctcctagtaaaaagaacagttggtgtatattttcttctagttactgagattatgatgctgatccttgtgtactacacacta

SEQ ID NO: 37770 - DNA, 1501 bp, Oryza sativa
cgcaagaaggtagagcgctctaccttatagtcatttcatttatagaaatgaggtttagggttacaagattattagttaagagagaggtagggagaagaaggaataaaaaagagtgaagtggaaaaagagttatagaggttaaggaagaaagaaaaaaacgggggaaaagaaagaatttacagaagcataaacattaggctgttgtttaggacagtctttcacaccatgatcgaattttgtgtctagtgtcttcattacttcgtacacaccagagatttagggaatcacagatctgttgcatgataccctggagattgtccatctgtctgtcaaaaatcatgttgttgcgtgatttccacagagagtaagcgcagactgcaaatcagattggtatcaccctttgtgttgtttcctgtcaatggctgcttggatgaaatcagagattgtttctgctttgtttgccagatgcaagagtcctagttttctccagagattgtcggtatttttgcatcttaggatgatgtgatcagctgtctcaagagcaaggcaaacagggcagtgggggtcatcattccactttttgctgaccatattggcttcagtatttaacctatccttgaaaaccagccataagaatgccagctgaggctgtgtttactgtttagttcagcgtaaaatttggattttggttgaaattggagatgatgtgactgaaaagttgtgtgtgtatgacaggttgatgtgatgaaaaatgactgaagtttggatccaaactttgggtctaaacacagcctgaatttatatgggtctacacgataccacagaattgcagagttagtactttttaagtagctttccctcttagagacgtggatgctccaacagttgaaccagcgacgctggtatggcatgaaggtcatctaaccactaggctacttgtcatattgcaggcaatgaagcacattagattgctcacactgaatcatgccgacctggattctgtgccagtacgttagagctgttagggccagagtacataatgctgaagtacactttagcgtgagggttcattttttttcgttgaagaatgtcaaaatttcacaccatgtttagttgtaaattttttttttcaaactttcaatttttccatcacatcaaaactttcctacacacataaatttccaactttttcatcagatcgttccaattttaacgtgaactaaacacacctagttaagacggtgtcttcgcactagaaccatagtagtaatttctctgtttcacaatgtaaaactttctaatattatccatatttatatatctagatgaatatactagaaagtcttgctatatatgaaaataaaatggagggagcggtacgtagctgttgacttgagtacacttgacttgggctttgaacaaaatgttgccccgatgtcgctgtggctcatccggcccaagcccatttccccacccctctccgccgcgaagacaccgtcgt

SEQ ID NO: 37771 - DNA, 246 bp, Oryza sativa
tcttttgcatgtattatatctaataatatatattatttatttattgcgagtagttaaacgtgcacgcaaacaaatatagaacacttcagctctgtactgcacggaattatcaaaatcctagaaataacaaaatcgtgttagtaggtaaaagtagcaactatattttacccaatcaactcaaattgaaatataaaagttatagccaacatgcatgacataattgtgcatgacataattgtcgaaaca

SEQ ID NO: 37772 - DNA, 366 bp, Oryza sativa
ccgatcgccggaagcgatacagcctccgccgggagcaaagccaacatactgccattctcgtgcgcagcactatcgccgccgtcgggcccagcagcagccgtccgcttccaggaacttgcttccgtcagtctctctagcgatataagttcttgagtattaaaagcctgagcccgtgataatatataactactgcatgtttgcatcagacttgtttgatgattcaggcttcatccgcttcaataacaatggatacaagcaataattaagttaattaacaagtctaattctctacaaacacttgtgaatcggtacatatgttttttttataaaattcttcttcacttttttaaaattgctgttgtcgca

SEQ ID NO: 37773 - DNA, 1501 bp, Oryza sativa
aagtcgcggattctgcaggcccccacgagaccacggtttcctacggccgatctcgcggggacgcagccggagacgacgcggtcggtcgcgtcgcaccccacgccccggccggttagtggaccgattcccgcaccggcacaccgcgcgcgcaccgcgtcttcttctctatcgcgacaagtctggcttggtcatcgcgtgagtcgatcgcctcgttgctttccgtggccgcgtccgtcgccgcctcgcgcaccagcgaatccggacgtcgaccgctgcctgcggatgttgtggacagctcacagttggtgttcctctgaatgcacaggcgccgtggttcctctcacttggtgtgcaatttaccgtgaaatcccagtgagatataacctacgtcttcgtaacggtctcccgtcttaactccgagtctctgactaaccgtgaacctgatgatgcagttgctagcctcatcgcgtgcgacgaaatatcaaatgatgtcgtccgtgtttagatgacttcttttgtactcctgcactgtctgtcgatgtcatggcagtaggtgcctcctttcaccgactccacctgctccagaacaaagcaggtaccaactgttacaaggaaaaaaaaatctgtattttccaatactgtctatttttattatcttgctttgaatactaaccgggtatttattttggattatagaaaagaagtacacaccattatgcacacacttcaaatattcgtaagccagtagaaaacggaattgtgcaggtggcaagcattctcttttctaaaaaaaaaatcaatatcataaatcacattcatttttctaaaatatttaatttattattaaaattaaatcaagtagataataatacatggtaataattcaatgaataacccatgccaaatagagtcaacaacattgttcacgttttcgacaaaaacaaaatgaaagccaccaaattataaggtttcgacgttgaacacaagcagattctaagtaacttttcaaatgattttcaagaatttaaatttgaaataataaatttgattggaatttatcaaggttcatgaaaaccgtcataagatcgggatccaatgctcaattgaaaatgtgagaccctgccaacaacggctgtgtttagatccaaagtttgaattcaaacttcagtcttttttcatcatatcaacatgtcatacatgtataacttttcagtcgcatcatttttaattttttaaaaaaatttaactttacgctgaactaaagacagccaacgaatcaaagagggttatagccatcccggccgttttcggcccgggtcaaaacgttatgtatgctactcgatttcgtgcccccacacccttgacgagcgagccttgccctcttctcttcccttctctcctaccggcggcaactaccgggaagccgccgccgaccgccggagcggagtcgtcgcggcggcgagggcgaatcggtaacccccccccctccggagttccggga

SEQ ID NO: 37774 - DNA, 1501 bp, Oryza sativa
agagatcaagggtattaagcaccaaggcctgactgcactaagattatcgtcaccaacatcctgtatattcataaccatttaagggaagcagctaactacaactaaaatcacacatccacgattaccaatttctcacgttttatgcaacaagtcaaaacaggaagctcaccaaggaagtgtgcaagcccagggagcccctcggggtcgcagaagtagcctaccgagacgttcatcgacgccgccgcctgcaagcaaacaaacaagtcggggttcaagccaaaaaaccagagagataccaaaccccggcggcccatcccgatcgaaggagcgagcgaagcaggaagaccttatcggtgtcggggtcgctgatgacgaggcactcgagggcgttggggagcacgacgcggcggtacccgcgcttgtcgttgcggggcttcgtgatctccacctcgccgttcgccgcagccggggccgcgccgccggaaggctcggcgggggcaggggcttcccggggcctcgagtccatcgcggccgccgactcgccgccgcgggcgtggactggactgaccgagaccgagtccgcgcgggcaccaggcgggcgaagagccgaagacgaggagttggcttggcacgagcacgacggtgtcttcgcggcggagaggggtggggaaatgggcttgggccggatgagccacagcgacatcggggcaacattttgttcaaagcccaagtcaagtgtactcaagtcaacagctacgtaccgctccctccattttattttcatatatagcaagactttctagtatattcatctagatatataaatatggataatattagaaagttttacattgtgaaacagagaaattactactatggttctagtgcgaagacaccgtcttaactaggtgtgtttagttcacgttaaaattggaacgatctgatgaaaaagttggaaatttatgtgtgtaggaaagttttgatgtgatggaaaaattgaaagtttgaaaaaaaaaatttacaactaaacatggtgtgaaattttgacattcttcaacgaaaaaaaatgaaccctcacgctaaagtgtacttcagcattatgtactctggccctaacagctctaacgtactggcacagaatccaggtcggcatgattcagtgtgagcaatctaatgtgcttcattgcctgcaatatgacaagtagcctagtggttagatgaccttcatgccataccagcgtcgctggttcaactgttggagcatccacgtctctaagagggaaagctacttaaaaagtactaactctgcaattctgtggtatcgtgtagacccatataaattcaggctgtgtttagacccaaagtttggatccaaacttcagtcatttttcatcacatcaacctgtcatacacacacaacttttcagtcacatcatctccaatttcaaccaaaatccaaattttacgctgaactaaacagtaaacacagcctcagctggca

SEQ ID NO: 37775 - DNA, 1501 bp, Oryza sativa
gtggcgccatggcccggtggtctacctctttaccgagaagaagcggcgtgacaagaagtgaagaagctcttccaaaaggtaatgactgcctgctcgattgtgttcgtcatgtgttctttctgtttgttgtgaaagatcatactgttagaattcaaacagagaaaaaaaactgagggccaaaacttggttgtgtggttgcatatggatttggatgtgtcaggtgctatcctttgttttatttatggattctagttaattctcatggagtcacaatgaagtttaggatttcactatcttagaataaccaatctaataatagacgatatgattatgaggtggtagtagcagtacaggactttatgattggcaagggactgccgaaatttgtagtttgaacaagacaaagtttttggttctcaagaacacaagtctagcatgtcttcgtactagcacttcaaatggtgatggacggtctctagagaaaagatcaatggcacaattcctctgcatgcaaggaaggaatgacataaaacattatgttacttaacatggaaagttttttgttcttttgtgttacttttatggaattgaagtggaggcccaagaattatgtgttccattgctgctattttccttcaaattgttcatacatttagtagtaagttccttttgttatgggaataaaactgtagaaatccatttacacgaggaactgacctttttcttgttaacatgcaaagctatcaatatattgaaagcgagaaaatcagtacattacaaattaaccccaagagaatgcagatacacaggcttacaccatgacatttagctatgaaacaataattgaatcagggatgttcacagcatttagctagagtcaaatacacgtctgtttgcagttaaacttgagtgcctctcaaaaacagtcagcactgcacaaaggcaaacatgataacacaataggaatacacggcaaacctagtaaccaacctctggcaaccgaacagagggaggggcacaagaatcattggttgcactggacgagctcgtatttccataactgttcggcctttccagctccttcagtgtcccattagatgactgtgaaaatctgcagagagaaattggtggtgcaaagtacattgccactggcatctttggtggaaggtctggtaatggtgcttcaaacttcagtacgcttatgacctggcgaattgaaggccggatattataatctgggtgtgcacaccaaagtccaacaaccatcaaggaaataacttcccgctcttcaaattcaccatcaagccttccatcaattgcattaagtatctcatttcttccataaagatcccaaacccattgaaccaaactgatcctgtcattatcttcctttggcacaacgggcctccttccacaagctatctccagagcaagaatgccaaagctgtagacatcagtctctttgcttgctttcccagtagtgacacactctggagccatg

SEQ ID NO: 37776 - DNA, 609 bp, Oryza sativa
ctagatgtgtatatatatcacttcattttcttaagcaaataatgaagtttagaagacttagctagctgttagtctttgttatttttgctcatcacgatggtgtcagctccttcccatgtggtacgtaggtgtatatcatttctttttcattagcaaataataaagtctatattgattctcttaaaagattcatattgacgtaattgttagattcatattgatgttcctgtagcccatccgaaaatattttctcgccatcatccaccattctgccaggcttgagtcgttgatcgtcggcggcaagaagccaatgccaatccatccttgcatcagcgcccatactcgtctagtgaagtcgcattttacaaatagatgcaagcagctttcttcctcccgttggcagagggagcagagatcttcgtgcggccagcctctcttttcaaaaaatggtttcatgacaacaaactttggtttctcccgctaaagcctagtaaaaaatggtttcatgacaatacaccattgaatgatttcaatccgtttaaaaactgattgaatggtttcgacggcctcacgctacacaagctgctcgtctggggagccttcctgttt

SEQ ID NO: 37777 - DNA, 1501 bp, Oryza sativa
gccaaccacaagccagcgtgggcaacggctttaccttttgtatagtatggttcattacggggtgccagactgagaagtggtggagataagcccacgggggtcgctggggagtccatgcctctggtttttgagggggtgactacgatccaggaaagatgcactgctttgagttgagctatgcgagaggtcttgtcacaactacacaaatggtgacatgttcagcatgggcacatgatgatatggtgacatattgtggagttgtgtcttgtgggtacagtggtacacctctggcttgagtaaaactattcgaatagccgtgcccgcggtcatgggcgggtctaacaatgtctttcgtgattagtctcatacttcttaccataataaatgatgctataactggtaataatttgattagctcctggtttggaatggtgcattcctggtttggagatagatctttacagccgggtatggttgttcaggttggttgggcctgtgcagcatgggtgtgctgttcagtgttgattaatattgatgattaattactctattcttttacaattcttaaatgtttgctaaatgctgcttttgcaaatgagccatatattttgccattgtttggtatccttgtgcacctgcatatttgctgtgtggcttgtcgagtattccatgtactcaccttgcaataatcaatcaaacctcggttgaagacaagttgcgaaggagaagacgtttggcttataccctagttgagctgcctgtgggagtagagtcggagcttcgctagaccgtaattccgctgttgttttctcttttcttttgtaagtatgtaacgttattattatgatgaatctgtatattaaattatcggtttgtgtacctcggctgattcctggacgaggatttcatgcacaaattagttcagaaattactagtgaatttatgggcgtgacaagttggtatcagagccatctcgactgtaggataagtcaaatggtcaaactttaaggaggaattttccgaaaacatgatttgtgaaaattttcctttcttccttctccagaattctctgtaaatcattttatcatcctctcccctcccgctttcaacttgagtagttctgaaactagttgtttaaacttgaagacatcgatgtggtcttcttatggagattgagtcaagtggatcgaggaaaatgaagttgatggtcaatctgaagtgcccaaatgtcaagatgggatcgtgcattagaacctaaaccaccaaagtgactctaaagaatagttagtagggtagaacgtttgttgcttgcttctttgtaggtattgttgcatttcccatcattggtgttgttcagcgatgagcatgtaacgatactaggttgcttgtttaatcaacttaaacaatataatggtctacatacaccagattagtattaacctggttaaggtctgtctttagtgtaacccctctctttctatcttctctaatctgcaacaaa

SEQ ID NO: 37778 - DNA, 1501 bp, Oryza sativa
ggaggcggccgggctggaggggaaagaaggagggagagggattgggccgagggcggcccaaaaggatggagagggaattttatttgttttttctttttatgtaattggttaaatgaactttgtgactttaaaatcatttcatgagctctgaaaattcgcggaaaaatccggagagtactttagggcacagagaatattgcaaaatatttccggccaatgatttttaagggaaaattttaattctcccattattccacttcattaaattgctttaacttttatttaatttatagaaaatgatttattaattgatttttaatcccgaacgaaaatcggggcgttacacctggccattcagaccgggatcagaccgccaggcccgctgccggctgtgcacagcccttgcacaagccggcaacccccacacaataaaatccaacaaaaaaaatttttttggagcaattttgaaatgtatgagttgaaatatttcttatcatccataataattgaaaattatgaagacttgcaactaaactcacttaagtgctaggaggtgacctattatggtctatagggtttttttggctaaactgattttcaaataacttttaaatgatttggtttttgaaatagatttgaataccaaaaacatttgaaaccttctcctctaccaactttgtttaacacttttctcaaattcctcctcaaactcattttgaagataaatcccattttggccaaaaataaaaatctagtttcttcaaaagaggaccaaaagggcattttcattgaaacttcatttttcttgcaatgtgaggcttggaaaacatatggggaaccttttgaaatatttttcaagagatagttttcaaattactttgattttgcaaaagttttgacttatgttgacttctagtttatttgctcacacacaaagagagttagagcacatgtaagagtgcaaaactcccccttaatgtgacatgctccattttcgcaaataagagccaaatgacaataaatccaaagcataagcacaaataagagcaaataggcaaaatgaacaagaagcaaccatcgtgcacaatctcaagccacattagagaaatcaatcacatttaactcattcctcaatttgcaaaagtgggtttcatcaagaggcttggtaaagatgtcagctagttgatcctcggttcttatgtggctaatgactatgtcactcttggcaacatgatctcttaggaagtgatggcgaatgtcaatatgcttggttctagaatattggaccggattgttggctatctttatggcactatcattgtcacataggagtggggttttggtgaaggatataccatagtccaacaaggtttgtttcatccaaagcaattgggcacaacaactacccatcgaaacatattccacatcggcagtagagagggctacggagttttgtttcttggatgaccatgacacaatggatctaccaagtatttggcaa

SEQ ID NO: 37779 - DNA, 1501 bp, Oryza sativa
tctatatgtgaagttcacatcatatgttgtatttgtgttgaactatgttgaaatgtgcatttgttccaaatttgttctttgagattgatatgcacatgtttagggggagtattttctatacattgaaaaatatatccatgtgctttatatttgattatatatgtttgaagtgtttgtcatcaattaccaaataaggggagattgaagcatctaggcccccgttgttagttttggtaattaatgacaagcgctaattgtggactaaccgttctatcgagttatgtgttttgagttaggtacacatcatgtgtgcgcatggttgattatcgatggactaaaaattgatggcgcaaagcaaagtatagatgacggtaaactagtagttgaattctaaattgatcgaggtattgggcaatcaaactgtgctagtttatttatagctttgccgtactattaagaggggtaatgacctagcaaagagatgatttaaatttccacattaggtcattatgcatttagatttggcttgctctcattatcctgttgtgcctgctgtgtgaccagggccggtcagaccgaccacctagtggcggtctgaccggcgtaggtcagccggtctgaccggcgggtgaaccccggtctgaccggcctagggaacctctccctgtggctctcggggtggcgatccagagccgccagagccgcattcggtcagaccgagctaggggcggtctgaccgagccgaggccggtctaccacccaactgcggtctgaccggccaggccgatggggcccaatgacagccctacaacaactagaaaactagccgttgcagagtagcacggtctgaccggccacacaactccggtcagactggcagtacacagagttgggggatttcaccccccaacggctagttttggtgggtgggagtataaatactcccccaccagcagcaaggagactctcttggcatccacttcaattgtatacaccccttgcacctctcccacactcatttgagcttgtgttcatccgttgtagtggttgaaggttgttctagccaagagtcaagtgcattgcttccattgtagagctatctccgagccgcgtcattgcttgttactcatggaggttgccgcctcttagacggcttgtggagtagttgcccggtgacctctccgagaagattgcggaggaaggccgacgctggttgtgagtggtttggagttcaccaccttcggagtgaaggaagaactacccctagtgatcgaggcttgggtaatcctctccgtgggccggtgttggtatttcttaacgacattactagaaatataattcccagcaatggcgccgaaacactcctggtatattatggttacagagttcatccgcaagcgcacggatataccattgtagcattttacccgagagtatttcaagggtatcgtatttattttatcccgtggaagatcatgtagagagaactcaactaataatt

SEQ ID NO: 37780 - DNA, 1501 bp, Oryza sativa
ccccggcaccgcagtcaccatgcactgcccgtccacccctccctcctcacgaatcatcacgggagaccgctttcctccgtccaaggtgagcttcgctgatccttgccgctttcggccgccatttccctcggcgtcgtgcctcctcctcgctccctaaatcccctgtcttcttctccaggttcttccggccactgtccgccagttcccgctcgcggaaggccgccggagcaccgtccgcttcgcctccttgaggagcaccgtcgcctcttcccatcgctggccacctccggctccgcctcgtcggcccacacgctcggtgagcccctcctcccgctccccttcccttccgtttgcattgccgctgcccgtgaacgccgccgtcttccggccgctcgccactgttcggcgtcgtcggctgttgccgccggtggccgtgccgctgccgtgccatggctcgcccgggccagcttcatgccgtgcctgtgtccttgttgcgccgcccgtggccgcccgatcggcttgggccgatccgggccgtcgattcccgtggaccggtggtggaccgcctcggtggtcccggtccacggtggaccggcgcccttgtgccgctgacgtgtgggtccacccctttgtggacgcggtccacgcctcaccccttgctgacgtcagcaacccccttttccttgtgaaaaataatcattaattgcgtaataaatcaataataattatagaaatccatttaaatggctcaaaacttctaaaattcatatataattcattcgaactccaaattgggccattcaacttgcaaaattcatctaaaactgagatccacatgtttgtttactctttatgtaccgtttccttggtttttattagagtttttcctcattttgcatgccagcacgtagattatgccgtttcggaagatcgcgatcgcaaggataagagttcggaagatccaagtgaagaagcaaaacaagtcacacattccccttgagcatgttgagcctactttacaaatgttttactgtttgcaaataaatatgcatgttttgccaattacatgggaatcgggtttacctatctgctcacttgtgccatgtttacttgatatttgtcctttgtcaaccttgggtgataaatcgactagctcttgttacttatgtgacccagctagaactatatgcttagccatgcttaattaccactagctcagttgatgggataattgaagtattagacctttttagcatcagaacgagctgcgtgctcgagacacctggccatgtttcattggtcgtaattatccaactaaaatgcgactgaatggtgggctgtgggtgcatggttttgctagtcacacccatggcaattaaggactggttcgcgggatgccctggaagaacttatcgtacttaccacaagccagcgtgggcaacggctgggtttgtagtgtagctttcctctagccgacgtatccaggcaagggtgggcatga

SEQ ID NO: 37781 - DNA, 1501 bp, Oryza sativa
caaagtcagtttctggcagccgtgcagattacaatatttttgggaaagcagttgcagggtttacagttcatcaatacaggaagagtcagcaaaagaataatcgacgtgtgatgttatgtcatgagaaggactcttgagtttgatctgttaagtggtcagtatgtgtttcaaagaatgtcgactatgcaatctgttcaagcatatgacaccgaagtcaggccagaagcatgctaaatatgccagcagtagaactgattgggaagtagtcaagagttagtaagatcaagagctaaatgagaatttctttatgtggaatttcctatcagcaactgagggttaagttccaagccttgacctggatgaaagtgcatcgtcattgctttattttgattgatcgatgaagttttctgttttcaatgtcagggccattcgtaaatccgagaagtgtcgattgttcttgaaggacaatagttcaattattcccggtcacccgaaagtatgactactctctgtaaggggggtaggtcgcagagatgaattttggttcacctcgtcgccatttcccttaaagattcaacccagtacaacaatttaggtagtactcgaagaagccagctacaaggtgtcaatagagtcatgccgatctcaagtcatccgattgaattctaagatacacccgtgaggccaggacaacaattcacatcagagaagtaacatcaggtacagttgcagttcagacgaaagaccggtcaagcagcctcttagaatagttctggtagtcaggagcaggtcaaagtaaagttagaatctgtcattcatgcaggctcacatacaagatttcatgaaagatctgccaatttctagtctgcttggtgagctctcaggttaccaaaaggtgataatgctagcagttcagtacagggacaggaagttccatgagccctcgtgattcaggtcagggtcagatcgagtagagctaatcaattaagttttgcgaagcaatagaactccagggtcgaatcccagtcagttcggttgttttgagcaaaagaatagaatggtcgatgccagtcagttcagttaagttatgctggttggtcagtccatcagtcagtttaaaacaaaagggatcaatgcagtgtgcagatcggccagatcgatcagaccgcctacacccagctttctttctaaccatacccgaatcttaggacttgattcctgtaaggggggtagatttgtaacacctcgatttcgttcgggattaaaaatcaattaataaatcattttctataaattaaataaaagttaaagcaatttaatcaagtgaaataatggtagacttaaaattttcccataaaaatcattggccagaaatattttgcaatattctctgtgccctaaagtactctccggatttttccacgaattttcggagctcaagaaataattttaaagtcacaaagttcatttaaacaattaaataaaaagaaaaaaaagaaaa

SEQ ID NO: 37782 - DNA, 272 bp, Oryza sativa
gcttgcatgcatcaactttccaaatgaatatttgtcacgtcccgataaatttatcccgaaataaaattcattctctaaaacgaaaaatagaattaattaaaattcgaatgtggcccggagaatttttgttaaattctccttggtctaaaatgagcccttaaattttacttgaattttcagagcaccagaaataattattaagcaacaaaaacaattatcagagtttattaaaaagaaaaactaaaaataaaccctctcctccctttgggcca

SEQ ID NO: 37783 - DNA, 1501 bp, Oryza sativa
ttaacccattcaagtttgtagtgaatttgttgaaatgtctagaatccattaaaattggtttcttttgctgtttcaatagccttattgcttgtatttcttgtgtgctttgtttgtcgtttagattccggcagttccgacgctccagtttattttgaagtggttgtcgaggttccgtcagctcaagagcaaggcaagtcatacatacagcactgatcatgttgaacctattttataaaatcccctgctttctattaaatagcagtatttttgaacgtcatgtgggatggatgtctatcgtactcagcctgttgatatctcatgccattgataacttgggatataattgattagatgattggtttaggaatgcttaaccatgcttagatcaattagttcacaatgggattcataataatttagtccttaattatatgatgatgtaccaccatggttattgtttaattaaactaaatatgcttagaaggtgggttgtgggtgcatggttttgctagtcttgcccatgacaattaaggaccggttctcgagaatccctgaaagatataatcatacttaccacaggctagcatgggctccaggctaaatctagagtataacttaacttagctaacatactacggcagtgatagatgcgatggtgccgttcggacctggctttggtctctgttgtttccggatttacctaggcacgagaggggactgcccgacttggctaaaaaggagtagggctggacgaaaagctcgtggctcttgtctggcttggctcggctcggctcgtttgaatttgctaccgagccaacctaaggttttagctcgttagctataatgagccagctcgagctagctcgcgagctgctcacaagctaaacaagtctagcccaagtagccatctatgactcatttagtgaaggagcctgttgacggccgttatcgaccagtttcgaccatcaatattacccaatgtgtgaagactagctattcttgcaatgcataaattccaaataaaatatctacttccactatatactatgctactaacatgtatgcaggagaagcacatataaatggaggagaatcgacagaaaatagaagaatgatcaatcagacgctgtcgagaagtagccttgtggatagatgggctgataatacagaattaacatgagtaaacaagcccataattcacatcactaggctgaggaataaacgaggagtacacttgccaagttctgggccagatggaccagactagggttcggccgaacccctaggttctgccgaaccatggcccagaaattccacaggccgatagttatcgacatccaatggcggttatgaccgtttctacctgaagcaaccgccgtggacacttttcacaaggagggagaaagatgctctttggatgcttcaccatgccacatgtcaagaggagagcaaaaatgctcctaggatgcttggagcatctccacactcccaaggcacctct

SEQ ID NO: 37784 - DNA, 1501 bp, Oryza sativa
tttagtagttctagtgctagtggagtaggaaatagaataatcttcatagtcctcgagtctttaggagatttcgggtatggctttaatagctttcctctcttcttttgtaagacttattgaattaatagcatattcttctttatacaagttcagtattttattccattcatattacttgagtgccgactttactttatacttgaatcaatatagtcgtgtaactagctttccaaataggtgtattggtgtgggtttagtgtccgattattcggttgctctgtgtcggttgcaaggatgtagagtagtatttagtaatgtaagcgcagtgcttagattattagataccattaattggggttatatactgcggatgagaggtgggccgctgatggtgacagctcagtacgggtattcctccgcgccggtatataatcctaagttaattccctagggagggtactcctccgtatttagccccagttgtatggtcatgacggctgtcgtaatgaactcggcagtaaggggtggcttctcgaaacaccaagagaacactgggtacggggtattggttgcatgactgtataatagcaagtatagactaaaaatgtatgtatactagaagtacatgaatgatacttttcttattctttcaccacttagcttagactatattttagagagagtagttgttagttctttcttctgtgtgtcaccctaccctttgaactgactttgatgtatataagtaacgtataaactattagcatagtactctcttatcatatcttcccttgggataaaataaatacgataccttggaatactctcaggtgaaatgctacaatggtatatccgtgcgcttgcggatcacatctgtaaccataatataccatgagtatttctagtgctattgctgggaattatatttccagtagtgtcgctaagaaataccaacagagcccacgtatgtagccaacgagcccaagtgaagtggctaagcccatgaaggaaaaatgcaaatagccctgtagcatctagtcctttactcatttacttgtctgatgtctccaactctggatcgaatcaattgattccttctcttctcgttcacctagtgacgctgcttccttgttctcgttcccctcttgccgattctctcatctcgcgttgccattgattatcatatcttctcgtagtgccgttctaggcccccaaccatcgacgcctaccctattcagattctcctcgccgtctccttcaccggctttgcctcgcggcactcgacctctgccactcaacctctgcttcgccggttgaagcactgccacaccacgccatcatatcccctctgtcggatattcctcgtgtgctttttcctcgttgacctagctagcctgttgccagtagccttcactgggcaacaaagtcgtggaggtcgcggtaccccacctcgtcgccccacgcagcagtcatggctccacctcgtcacctcactagcttg

SEQ ID NO: 37785 - DNA, 192 bp, Oryza sativa
aatttcagatggatgtctgatggctggcattatctcattgacaccagatgaaattcagctaggttctcaacataacatagacatataaactgaaccatgcaattagctgacaaattaacagtagtttttcttattgagatttgcttcaatacgatgatgctttctattgataaattccatttgtttgcctgc

SEQ ID NO: 37786 - DNA, 1501 bp, Oryza sativa
aaagtagatacgatattgaaagaatgattcaattagccaattgtgttgtagtaaattgtttgtcttaatggaaccaaccatagctcttataaagacaattggtcttaccttccataggactctccaaatcctactaggtatataaaccaattagtactcgaaaaatctcagctcgagaaagaataccctagaaccgataaattagagtcggggtcggactcaaacggtctgaccggccaaatgccgctggtcagaccagccccacaccatcggtttgaccagccctatggcaacgatcagacgacatcgcacaccaaaccaatcctttccaaattcattcatatttttcctatttttacgtagatgctaaatttgagtattaacaaccatgtctcactttctagattcccattgctgttttcaccatataaatacttttctagaatcatgtttaacataagaagtatacatggtatactatctttgtccttttttttcttcacccatcgtataagctaaaaaaaatcttgtatcatcttaataatttgctattaatattatctatttctataatttatcgatttatcatcattctcaatatatcattagactgtatattttttaaaaacatacccaaaatactcttatagaaaacaagattatcaattattttatcccattatttttttaaaaaagtgacttttagccttcttacacaaccatgaagcatgcatataagttttaattttttttattgtcattttttttaaaaaaaagttaatttttgcgtataagagaatttactcacacaaaagataatgacacaatttgtgtatgatataaaagatgttttaaattaaaaaaaataacgcaaaaatgtattctatatagtatataacggataaatgcaaaaaaatcttgaaaagtatgcacaaaatttcatattttttaaagaggctatataaagaacatagtttttaaacttctgatgggacaaatcaactgttaacctgatgtgtattttgggaaaaaaaactgacaaaataacatattgcaaaacaattgataactcggcgttatattatacaagggacaatacaaacagcaaattgttgaattggactaaatcaatggcaaaagtagattctctcatccaggaagccccaagacaatcaagcgatgacagtggcgaattcccgtgagcttatagtattatcaattagttgagataacgaaattatatattgattgataaatattgttcatcaatatttgtaacatcttgggaaaccatatatgctttagcttttcttatttgaattgacaaacattgtagttcaataattgtcacccttcgttacaacctaatcacgtaatgattaaaaaaaacgactgcaacttccattttcaagtggtaagggatactgggacagtcacttggacaaagtataagagctaaaagtagacatagcaaatctacatttctatctttgttgttagc

SEQ ID NO: 37787 - DNA, 1501 bp, Oryza sativa
tcaacaccaatgacatgtacaagttgaagaaggagatggaggaagcctcaccctccaagaagtgcgttgctctccaagccaaagttgaagacaagagcaagagcaaggtgaatgaagtcaatgaggacttgtaggaagagatgatccttcttgctagaaagttcaatgatctcttgggaaggagaaaggagagaggaaggggctccaactcaaataggagaagaaatagaagacccaacaagactctctccaacttgaggtgttttgagtgtggtgagaagggacactttgcttccaagtgcccttccaaggatgatgatggagacaagtcatccaagaagaagactggaggctacaagctcatgaagaagcttaagaaggaagggaagaagattgaggctttcatcggggaatgggactcaaatgaggagagctccgtctcatccgggtccgaggaagaaggtggtgatgatgcaagctccaagaagaagaagatggccgttgttcccatcaaggaggctccatcactcttcgctccactttgtctcatggcaaagggctcctctaaggtaacatcccttagtgatagtgagagtgatgatgattgtgatgatgtttcctatgatgagcttgtgagtatgtttgaggagctccatgcttatagtgagaaggagattgtcaagttcaaggccctaaagaaggatcatgtttctttggaggtcttgtatgaggagttaaagacctctcatgagagactcaccatttctcatgagaagcttaaggaagctcatgacaacctcctttccactactcaacatggagctcacattgatgttggcatatcttgtgatttgcttgatgatagtgctacttgccatattgctcatattgcatcatctagcatttctacctcttgggatgatcttatggatatgcctagccctagctctagctctagctcttgtgtttctatttgtgatgcctcacttattgttgagaacaatgagcttaaggagcaagtggctaagctcaacaagagtttggagagatgcttcaagggtaagaacactcttgacaagattttgagtgagcaacggtgcatccttaacaaggagggacttggattcactccaaagaagggtaagaaaccttctcaccatgccactcgttttgtcaagagcaatggtaagtattgctccaagtgttgtgaggttgggcatttggtgagtgattgccccggtggtaagcctcctaagacatgcatgttcgattctcattatatgcttaggaaggcttatgatggtagtattgttgctagatatgtgggttcccctatactcggtggtaaaaagaatgccatttgggtgcccaaagctttggtctctaacctccaaggacccaaacaagtttgggtacctaaaagagcttgatcttcttttgtaggtgaactaccgcaccggtgggagccattgggtgcttgatagtggatacactcaacaca

SEQ ID NO: 37788 - DNA, 803 bp, Oryza sativa
ccgcctggccccgcggagaccggtcaaaggtctcccggtccaccgatccaacgcgccgccttgcgtgcaccccgctcgcgtgagccgtgtcgccgccttgtgggtcccaccttgcgcccggcacggtggaccgcgtccaccggcttgcgtcgcgtgggccgcgcctcgttcggccttgggccgcctccctcccgcgcgccggcccgctcgcctcggccgcgcccgcgcatctcttcgggccgcgtcccttcgctcggcccaagtccaattaacatccctccatccttttctttttcagggatttaataaatcatttttcctttgtcccataaatcaattccttattccaaaatcccataaaccatttcctttggtcccgcgtgacaatgactgtcaataatattcttgagaatattataaatttcataaaccatttctcctattccagaaactccaattaaacttctaaaaattcatatcacccaattcgcaactccgattgactccgttccacttccagtattttcataaaattgagatctatttaatggcactactaattagtctaaataggatctttcttttggtctcttgtttaggttttcgattgttgcgtatagttgcggttatcggtttttcgtcgatcgcgggttttcccgaagattcgtgaagcttcgtgaagaccttgagcaaggcaagtcaccctttgatcaattgcccctataattgaaaagtcattattattttatttgcaacttgcattattagaatcacacacttaacttgcttggcctcggtttgcg

SEQ ID NO: 37789 - DNA, 1501 bp, Oryza sativa
atccttctttagggccttgaacttgacaatctccttctcactataagcatggagctcctcaaacatactcacaagctcatcataggaaacatcatcacaatcatcatcactctcactatcactaagggatgttaccttagaggagccctttgccatgagacaaagtggagcgaagagtgatggagcctccttgatgggaacaacggccatcttcttcttcttggagcttgcatcatcaccaccttcttcctcggacccggatgagacggagctctcctcatttgagtcccattccccgatgaaagcctcaatcttcttcccttccttcttaagcttcttcatgagcttgtagcctccagtcttcttcttggatgacttgtctccatcatcatccttggaagggcacttggaagcaaagtgtcccttctcaccacactcaaaacacctcaagttggagagagtcttgttgggtcttctatttcttctcctatttgagttggagccccttcctctctcctttctccttcccaagagatcattgaactttctagcaagaaggatcatctcttcctacaagtcctcattgacttcattcaccttgctcttgctcttgtcttcaactttggcttggagagcaacgcacttcttggagggtgaggcttcctccatctccttcttcaacttgtacatgtcattggtgttgatcttccccaagaggcttgcgggtgtcattcttgacatgtcggagttgatgagcatggtgacaagggtctcatacttctccggtagggctctaagcatcttttgggcaacctcaagatcggtgtagtttgccccaagccccttgagatcattcacaatgacattgagcctcccatacatgtcattcacactctcatgaggcaacatggagaatgtctcatattggatcttgaggaaatgaagcttggcatccttgtactcacttgtaccctcatggatctccgccaacttgttccaaatctcatatgcggtctcaaggttgctcactctatcgaactcctcttggctcaaagagttgaacaaggcattcatggcttgggcattgagttggaggttacggtgatcactctccgtcaagggtgtgccggtgatatcaaagcctacatccacaatactccaaatatggaagctcatagctttgaggtgagtagacattttaattttccaagtggagtagtttgtgccattaaacatggaagccttccctacatggttcacctcgttcgacatcttctctctaggcggtgaagcccaatcaagagagaccaagctctgataccacttgcaggatcgagatgtcgactagaggggggctgaataggcgatttaaagaataaataacacctaatcaaatctaacctaagttgctaggcttggtgagggtgaactctaactaagcaactaatttatgttttgcaaacctagggtgatagtggctcaattatatctctaggaaagt

SEQ ID NO: 37790 - DNA, 1501 bp, Oryza sativa
gaatttcggttgtgaaacattaaccgtgccaaccacaagccagcgtgggcaacggctttaccttttgtatagcatggttcattgcggggcaccagactgagaagtggcggagataagctcacgggggtcgctggggagtccatgccttgtttataagggggtgattatgatccaggaacggtgcgctgtggtggattgtgttgtgtgaggggtactatcacagctcctttctgaggtaccgtggtggtattgaggcgcatggtgacatgtcgtggggctgtgtcttatgggtacagtggtacatctctggccagagtaaaactattcgaatagccgtgcccgcggttatgggcgggtctaacaatgtctttcgtgattagtttcacatttcccatcataaaaaaagatgctataactggtaataatttgattagctcctggtttggaatggtacattcctggtttggagatagaactgtgcagccgggatggttgttcagaatggttgggcctatgcaacagggtatgttgtatagcgttggattaatattgtttaattattacttaactgttttattaaattctgaaatgttcattaaatgctgtttatgcaaatgaaaccctactatgccatcctttgttatcctgtgcacttgcatatttgctgcgtggcttgctgagtatctcatatactcaccttgcaatcattcatcagaggaggagttctacagtgatgctgatggtgtggaggattaggtgtagccctggtcaagctgcctgtggagtggagtcgtctgcgccgtttatcttttttttccgctgcttagatctttattgattgagaggaactatctacctctgtaatgacattttattcgcttattaattagagtaataattatactctattatcaatttgttattgtgtgcctcggctgatttctggacgagggttcacacacatgtaagcgtttggaattttggatagaaattccgggcgtgacaagttggtatcagagcctccttgaccctaggttatgccaaatggtcacccatagaagccctctaaaaatattgaaaaagtagaactgttctcctccctttctcttttaattaaaccaaactaatggcacatgcacttcataatctcttttagtggttctcattcaaaatttattccagtgttgttagtactatacatctattactgtactaatggctcatttactagcaaatgtttataacattgttttattttgctgcaataaaataaatttcgcatgttgattttataactttcttttatttcttttggaacctgttgttcaaaagtgcaaaatttgtgatcttgtttccaactgtttcaacgtatcttgcaagcttggtttactttatttacttaccttttactttgattttctaactttattcaaattaatccaaaaacttgtgctattaattggataaatgtcttaacttcctcctttcacttgtctttaga

SEQ ID NO: 37791 - DNA, 529 bp, Oryza sativa
tacaaccgtacaagacgttgtgttgcgccttagcgatcgataatgtaacaccccaggtagccacatacctagagtgccacaccaaaatacactaaaaaaaccaccaactcccaaaattattagaaatttcggcagagtaacctaaaagtacggacatccatgacaggcagttacaagataactcaataacgatataaaccacacaatccaacccatcctatctccacaaattccacgtgaaaataaggaccagaactttaaatgaccttcacaagttctacgcaaaacttatgctaagtagaaacatagtctaaaagtaaatttcaatagtgtgcaataataatgtgtagttcaagggtgctactcccgtcccatgccaatcaatatcattaggtacctaaaaaccaaattaaatacaagagtgagtaaaaatactcagcaagtacaatattgaactagtaaaacatacacaggtttaatgcaataagaaaaccaatatgaaatatttgtcttcctttaatttaaaagg

SEQ ID NO: 37792 - DNA, 1501 bp, Oryza sativa
ggcatagtagggtttcatttgcataaacagcatttaatgaacatttcagaatttaataaaacagttaagtaataattaaacaatattaatccaacgctatacaacataccctgttgcataggcccaaccattctgaacaaccatcccggctgcacagttctatctccaaaccaggaatgtaccattccaaaccaggagctaatcaaattattaccagttatagcatctttttttatgatgggaaatgtgaaactaatcacgaaagacattgttagacccgcccataaccgcgggcacggctattcgaatagttttactctggccagagatgtaccactgtacccataagacacagccccacgacatgtcaccatgcgcctcaataccaccacggtacctcagaaaggagctgtgatagtacccctcacacaacacaatccaccacagcgcaccgttcctggatcataatcacccccttataaacaaggcatggactccccagcgacccccgtgagcttatctccgccacttctcagtctggtgccccgcaatgaaccatgctatacaaaaggtaaagccgttgcccacgctggcttgtggttggcacggttaatgtttcacaaccgaaattcgtgaaccggtccttaattgtcatgagcacgaccatcaaaaccatgtgctcacaacccaccattagcaagttttagttggcaatttaattaattaaccaatcacgattgaccatcgtgagctatcatcaagccatcattaaataatagtgaattataagttatcccaatagtgtgctcatgtttctaagcatggctaagcaatcgtatctaatatctagctgaaccaatatataaagcccaactagtcaagttataataacccaaggtatcaaggaataaaataatcaagaacaaaagggctataacaaaccataggttaattccacccaatgacattcgaaaataaatgcaatagttgaataaaaatgatagctttaaacgggatcaacatgctcaaagggttgtttgggatctgtgtgacttgccttgctggccttggaactcttcaaattcttctcctgcgaaaatgaactctccggaaacgtcggaatctaaacagaaaagagcaaaaacaccaaaacagcacataaacaagcatgaatagtaatgtggatatttttaacatgtagatctcaattttagaaaaatttagagacttgaaccaactaaatccgagctaagatgaattagttatgaatttttaaagattaaatcggattaaaacacttatatgggttttaattgaattatgacgcaataatgaattatttttgaaaaggaaaagggaattattgcgtcagcgactagggtttgcggtggaccgggtgcacggcgacggttcacgggaacggacggccgagatcgatcctaaccacaacggacggctaagatctaacggtctacgactggtctacgacggatggcaacga

SEQ ID NO: 37793 - DNA, 1501 bp, Oryza sativa
ccttctaactatatttaactgcagagagcgatgtaccactgggtacttgaccctgttgagaggcaggccgtgatggtgaacaccgcgacgaaatgcatccacgaggactacgctgtcatcgttgagatcgcgtgcacgaactcgtcctcggagcttctagcggtaaaacgaacctaccatgtcctctacaagtgctccctagaagaagacgtggccgctcgcgccactggaaatcttcgcagtgtgcgtactctcgctagtacagaatatctctgttatgtgtttcatcgtccctgttgcttcgagctaattaatctactacgtatcctcgtctgcttcagcttctgcttgctctagtgagcacctacaggtacgacggggacgaggtgaacgatgcattggctaaatcggaggcaaagattctccatgagactgtaacgaatggtgacacagatcacggcgaactcattcggatagtcggtacaagaagcagagcgcagctcaacgccacattcagctggttcagagatgagcgcggcactagtatcaccaaggtttacttgagcttcctctgtccaaatatataatatgcctgatggttaacgcagctgcatgctccgcgttttgatcaccaggcactgcagcatggagctgatccaacaggctactcgcacgcgctgcgaaccgcgttaaggtgcatctctgatgcgaacaagtacttcgtgaaggtgaggatgagctagctagctggagtagtagcgaagcatcgagatagataaactgaagctgaactgaatttcgcgtctgcaaattgtgcacgtatgtacgcatgcatgcaggtgctaaggaacgcgatgcacaagtcagggactaacgaggacagcctgacccgtgtgatcgtgctgcacgcggagaaggacctcaagggcatcaaggacgcgttccagaagagggcctcggttgccctggagaaagccatcggcaacgatacatctggtgactacaagagtttcctgatggctctacttgggagtggcatctaagctgactgtcaacgaatatattggaccatcgatccaagacttggcctcctcttcaataaatctgttgaagtatctatctaaataaggttgttatttagtaataaattctcctgttatagaattcgatcggcagaatgtaggcttcatacatgctctgcatttcttctccactaaaatttatcgctgatataaattcatgtcaaatgtaatcttgtggacaacctggaccttttgagagagactcttgtgacaaaatggattgcctctctcgcaatatgatattttggcccatgcatcaccatcacatagattaagcctctactgcaatctatttccacagcagagcttttggcacgcaatacttaggcagagtccaaagttgaaaacctactaaaatgtcaaaccgtaacacaccgtcaaattgaactgtaaacatgctgagctgcgttcacaaactg

SEQ ID NO: 37794 - DNA, 1501 bp, Oryza sativa
acaaaccaaacatgctagagaagctaaatattgcagatttacatcagtggtacaatgctgttcatatcttcacccgttacaattatactgaggaaattaacaaaggcaaaaggatttttgtgtccggataaatgaattatagccgttttcttttaatacatggatcacgctcttaatagaaatataatcaattcaaattgcttatacgtttgttatattttgcggtgtaaattatacatactgcaactttttactctatggtatagaaaatttttaaataatatttatcatatttctttgtaccaactattgtaccctgttagttgtaatactcttttgtaattgtttgttcatctataatttctataaatttacaacccgctaagtctaaagcttaacataaaaccatgccacattatcacccactagctataattatatatttaatctcatgtatgcatgcaatatcatctacaatatatttaattatataaattaacatgcaagcatatccaatcatcatgacatcacccataatatttccatagatctatctttttgtaatatatttaaaaataaataaaaaaatgtttcacattaaagtgtgggtatcatttttttttactcctaactcgattatctaaaaaatatattaaaatttactccctccatttcaggttataaaacattttgaagtcaaactgctttaggtttcaccaagtttttagaaaaaaatagtaacattttcaacccaagacaatttttttatgaaaatgtattcaattattgatttgatgaaactagtttagtaatataaatattactatatttatttataaatttagtcaaacttgaaacagtttgactttgaccaaagtcaaaacgtctaacttaaaacgaaaatagtacttagcgatttccacaacaaagcacagaaatcacctggttttcctcatgtgtatggcctagtgtgttttcgtgaaggtacttattttgttttgttcaggcttggtattccttccaaaaacacgtaaaatttcttaagtcgaatgaagcccacttattaagatggaagaccataccagaaagctacaaaataaggccgacatagctagcgcagaagtccacaaatcggggggtaacaaacagaagcccaaacccgttcaaattgctcaataagtttgtgcagaaaacatggattatctaccaccataggttataaaatcaaacgggtacaaatgtgactgaaatttactggaaaactaggttcaaatatttggtgacaaaagttcattatttgcatataaaagggtcttcaaattgtgcccacatgtcgtagatacacgagaacccatatgttatagacaacgagtgataaattcttaactgccacatcttaaaaatggcaaaaaattaaatgccctttttgtctcgattgtaaagactgaacaagttattagttccagccttccagaaacgaaaagttattcaacactagcac

SEQ ID NO: 37795 - DNA, 804 bp, Oryza sativa
cacaagtttttggattaatttgaataaagttagaaaatcaaagtaaaaggtaagtaaataaagtaaaccaagcttgcaagatacgttgaaacagttggaaacaagatcacaaattttgcacttttgaacaacaggttccaaaagaaataaaagaaagttataaaatcaacatgcgaaatttattttattgcagcaaaataaaacaatgttataaacatttgctagtaaatgagccattagtacagtaatagatgtatagtactaacaacactggaataaattttgaatgagaaccactaaaagagattatgaagtgcatgtgccattagtttggtttaattaaaagagaaagggaggagaacagttctactttttcaatatttttagagggcttctatgggtgaccatttggcataacctagggtcaaggaggctctgataccaacttgtcacgcccggaatttctatccaaaattccaaacgcttacatgtgtgtgaaccctcgtccagaaatcagccgaggcacacaataacaaattgataatagagtataattattactctaattaataagcgaataaaatgtcattacagaggtagatagttcctctcaatcaataaagatctaagcagcggaaaaaaaagataaacggcgcagacgactccactccacaggcagcttgaccagggctacacctaatcctccacaccatcagcatcactgtagaactcctcctctgatgaatgattgcaaggtgagtatatgagatactcagcaagccacgcagcaaatatgcaagtgca

SEQ ID NO: 37796 - DNA, 1501 bp, Oryza sativa
gatggatgcaaggtttggatggacggctgggattgatccccaatgacggtaggagggtattaccgaccattccaaccgtcgcaaccgtcattacctacctataaaaggagctcctcttctcacttcactcacacacctcaagcaatagctctcccatttctctcaattttagtttagtagtatctagctggtggaataggaatagagtagaaatcaggagtccggaagtcttcggaagagttcgggtatggctctagcagctttcctttcttcttttgtaagctttgtacttttattaaaataatcttctatatacatttacaatattgaaatactttccgagaatattagtacctactttacactatgttcatgttatactgaatatacggctagcttatctgggagatgctttggtgcgggtataatgtttgcttatgcaattactctatgtcatgacgatgatattagagtagtatctggtagtttagacgtggtgtctagattacgggatatcattatttggggttatatattgcggatgagaggtggccgcttatggtgatagctcagtacgggtattcctccgcgccggtatataatcctaagttaatttcctggggagggtattcctccgtatttagccccggttgtatagtcatgacgggctgtcgtaagaaactcagcagtcaggggtggttactcgaagtaacaggagcgcatcggaaagagggtattagctagtatatcagttaacaagaatgtatgtgtactatgtatattagaagtataggaatagattatctgtctcttttctatccacttagcttagatgatttatcatgagaatgagtagttcatgcttgtgtgtcactctacgctttgattatcttaacccctgtttagaatacgattatcacaagtaatatataaattattagtcaagctctctctacatgatcttcccacgggataaaataaatacgatacccttagaatactctcgggtgaaatgctataatggtatatccatgcgcttgcggatgaactctgtaaccataatataccagaagtatttctgcgccattgctgggaattatatttttagtaatgtcgttaagaaataccaacaagcatttctggcaccgttgccggggaagattcataatagagataacttgaactaatactttttatttacctctgtataatcattttcctttgcaagctaaccttggttgttttcactatttgttgtggaaacagggtagtgaatgactggtttcaacctgtcggaaaactttaaagaaaatccagaagctttcttccggagtgtcaggccgcgagtcgttgctccgaagaaaagtttaccgatagaaaaactagcaataccagtgcccccgaccttcaagactatggctagcagaactcttcgtgagttcgctgctccctctgctgacaatgtggccactaggctgcaggtcaacataggagacgtgga

SEQ ID NO: 37797 - DNA, 1292 bp, Oryza sativa
tccgccgtcgccgccgagctccggtccgccgccgtcgtcgcctcggaccacctcccacctcggcgccgctccttcggcttcgccgcatcctcgccgacctcgtccacctctccgtttcggtcgccgaccgccggagcaccatcgaccccgtccacccgagccgcgccgccgccttcctccgctccggtcgccgtttccgtcgtcgccgtcgacccggggtgagccgtggaccgccgcttcgtttccccctttccctcccctctctcggccgccgctccgccgtgcctatggccgccgccggcgactataggggcgcgggtgcgccgcctcccgccggccgcaccgacgtggccgcctccgggcgcgcctagcggctgctgcgtggggcccggctgtcagccgcccgcgccctcgggtgcggctgacgcgtggggcccacggcgccggccggtgtgagccgggtgcacccggtccaccgtggaccgtggggctgccgcgtgggccccactcccgtggacccagtccgcgcgcccctcccctcggctgacgcaataaaccctttttaaaattaaaatttaaatgaagaaattcgcaaatattcatttaaagagcatataaacttcaaatggccatatcttagccatttgaactcggaattggaccgttcaagtctctaatttttccttaagaagtcaagaacctatttttgtgctttctttcagctggttatacggattttattagagtaaaagccttttcttttccgttggtcgtgtagacgctgcagcttcggaagatccgctcttcgtggaagttgaagccgacgtttgggaaagcgagcaaggcaagtcacatcatccttgaacatattgaatcccagtttataaaattattttgatttaaattattgcactattgctttatttaaattcccgcgttatcactgttttatctagccatgcctatttacctttgttatgaccttattattgttaatgttattatttgcttgttcaccctagcataaacaaaacccctactagtggacactctactcatggtaccactagtaggattttaggtagatgcttcgctggttaattaggcaacattaggtggttttacaactctagactgtgggattttctcatcacctggacactatggaatggttggattattgtggaattggattcacaccgccccctctattcaaaatccccaaaatggttttaggctggactcggggtgcatggttttgatagtagcacctcggccatttaaggaccgtt

SEQ ID NO: 37798 - DNA, 501 bp, Oryza sativa
cagtatataacatatattaatctatagctggttgaccatggtctatttcatggcaattcctagcagattctggttcatgtgtaagtagttcattatatctaaaagaaaaagtgaaaacagttatgatttgtcctataggtggcccaaaaactcactcaatcttttatggtttcttgagaaggaaatagttgatcctatatatcaactatgagtgtactcaaggtggtcgaaattacacaaattatccgctgaaaaccctaattttgaccgggccatgaacctgtgacctttggtttataaaagttgtgctgaactcctcagccaatgaacgatgtgactggttgaccaattgtattttcaggtgtacttaggtggtattctcatgttcccatttttatgttgccaagcaaatacttagtattagctgctggaaattcacaaacaaatgctaccattgagggtttgctaaattgttcttgcatcttctcatccaaatccagg

SEQ ID NO: 37799 - DNA, 1501 bp, Oryza sativa
atagcagactgcaaagatggtgaaatattttgatgtcttttacctttatgattgtgatcaagcagtgtgatccatgaaatgtccttctatgctaattgttactaatggtcgttatattccgaacaataatccacatcatagttaaatttagtttaccatatcacttaaacttcttatctattgatttgcatcaacttgaccattatccagatatcatagttaaatttagttgctgatttaaactatagtaccaaggtaggctagagttttcccctttttttttgggaactgacttcacttgctattgtttcttaacaaacatgttgaatgtaacctggtttgtgacttatatctggaaataacattacttgtttacaaaccctctcaggcataatattgatcgacgcatttctctcgtcttagaagtatatggctttaaacaatgagatatgaattgctatgccctttattatttcgtgatatcaatcttttttttgacacgttgtgatatcaatctggcgccgttgattctttacagggcaaacagaatatctccgacgagtcaacaaacggcaatcttaatagcaatactgagcaaatggttgacacacccaagaaggatgatgaaaagcaaggagactctccacaggagggtgaacaaagagtggatacacccagaagagatagtgagcacagattagacacgccggagaccacaataaagttggaagaacagttggaagaaataaagttggattgataatcacaagcccacccatcggcgaatttttaccaatatggttaactactgccgtggtattaaagggtagttcaagccacaatctacggccaatataaaagtatgtgttgtatttattctttttatttattttctcctactcccttttccttcttaattttgtctttgttttgcaaccattttttcctaggtttatagatttaatctttttagccacgggttgatgggagagaataaattgtgtttattcattcaatcaggatgagttgtaagttatcgataggcacatgaaaaatgtatgaaatgaatgaatctaccagcaatttatgaaagagaacgtcactattggcatcaacatcaccgagaattactgttgctgttgcattttctggttgcctttcttatttgctacttcgtactcctgtattttttacatactgacacgtgacatgtaaaaaagactttacatttttcccatttaatacggagtatttgaaaggcgaggtcgtccacaagcatggacgttagtactttatccagtatggtcatgtgtggtgatgcagatgcaagttttagtgctactgtgctgtatatggctgtggaagctggaagcatggaatgaccttggcaattttcagcagatggtccagatattactatggagccaggatcaaaatgatcttttgataacaggaaaatatagagacttgctattggtcagttcattgaaaataaggaaaa

SEQ ID NO: 37800 - DNA, 1501 bp, Oryza sativa
tcgtcagcaacaagaaatagggtttatcaggttagtggtgactactctgttgatctttgttccaaagtgaagttgttctgcagttacacttaatactgcccttttctccttgccaaaaagaatataagttcgaatttttcattgtgataaaactattgaatgcggagctacagccttttttttaatctttctgaaatagctacatttttttaaagaaataatttagcgtttgagaatagaaatatagcacaactgatggtaggatacaagcttggagagtagccttaaagtatccagatcttcaagaatgttactttgcttatttgtgatgagaagcaaatacagtgcttcaattggttgatagacataacgaacattttcagtctcaacataagtatgttgctttccacttccgaccagcttcggaaatgctgcaagcagcccatcgatccttatccgggacatgtcaacaaattgtctcgaaacaagagctgaaatcaaaaaatgacaaatttcttgttcataacattataagtgtagacataaacagactacaaaatgcaaaaattctaaagaccaaaacttgtgcatataaaagccattttagtgttgttacttggatagaattggtgtacttgcgtataagaaaaggatgttaattgctattgttagcaaaattgtattgccccttttttgggctgcaagagctaatataagaggacatcccattagagaattgtgaatccaacaagtcaattgttcgagaaagttgtgaatccaataaataaatcaataacaaaagatactgtgaattggaaattttcaacaaactcaccttttccagacttcgatataatagaagctgcaagaaccacctgtatgtgtataaaagaaacaatcactcttcttaatagagcaaaaaaatgcaacagtttaaaatgaaacaaggataatgctcattcctttgctgtgatgcccttactaaatgtcctttcctgaatcaatttacaacacagtaacattgcaaatgagcaattcgaataaaccagccataccattttgaatggcctttttagttccagggattaccaaatccaagttgacaagatatagaactgcaagacggaaagtaatgagttccaaagcaatcgatccatgcgagacaactgaacaaaataaatttgtcaacactgcagatgcataaccacagaaaacataaataatgagtttgtcaataagtacaatgtttcttatgcttttgcgtcacatgtccaacaggatttaacaaactttattaatgaccagagaatactgccgctgttgtgatgcataaactaaataaaaaccagcacacttgaattgcatcaaaagttcaagatccaattgaggccaatcaaagttactaaaacacaataacaaggaaaaactgcatgaagttaagtgaccatcgtgaacacagatgaaatcagacatatttgggaatattggttattaggaattt

SEQ ID NO: 37801 - DNA, 1501 bp, Oryza sativa
cagaaggggaagggaattccaatcctgcaaccaaaatgaagaaaaactgagagcaagtacaatagcaagctacaagcttgcttacttttttttttcttctcaaatatggagaagagagacgagaaaaagagagagcatgcttttatgcaagagtcaatcttgcaggcgatccaaaagaggtgaatgaaatagaggaactgaagaaagagaggggaggataaaaattggagacagctttgtagacaaactattgtactcctagatgttagctgcagtatactacgtgtaagagcttatagacaatagttaactctgctattaaacttacttggagaagaatggtgctttcagcgaagcaaaagacttttctttcgacaaatgattagtaagtgccttgtgcatgtttctagtttaagtcggccaccgatactactaccaaccaaataatcggcgtacctgaatacattgatatgggtatggagatgttcaggtaccaaaaccagcagaatctaccaagaacgatagacaagtactagtgtcctatataggacaagcatctagctgaactgttacgacgtgtgtaagcaatgcgtctgtcggctgagttatttggagtactagccaagcaagcatgattgcaagagcatgcgcatgcggcgtgctgatcgttgggaatacagcattctgaaatcctgatcgtttgcccttgtcgtttgttaacagtgttaccaaagcattgtgccttttgtcgtttcacagagacagccaatacagtagataagataactggcattactctgcattacctggatttctcttcttctttgaatgcaagttagaaatactgtcctgttctttctttttctgcacaatgagtccctcttaattaatttgcctgctgcaactcacagattcccagtccaccatggagtataatcttgtaataatgctaggtactagtacatgtacaaaccccaaacaaaattgtcagttggcgcaaactcacagtccacaagtacagtgcaattaagatcttatgttctctggatacaaataaaaggtggtagcaagcattcatcatccatacgacatatatatttggcactatcacattcagcaatcgcatttttggtatatgagtatgcatcaagtgaagatgtcaatgttacataatctcgctgcactgctagcagcactatcacattcaacaatcgcatttttggtatatgggcatgcatcaagtgaagatgtcaatgttacataatctcgctgcactgctagcatgtaaacctttttagcataaactcttaagtcactgaaaaaagaactggaatcacagttccatagtttccatagccaactgggtcagcacatcgggcacacatatttcataaccagaaaaacccatgtcttacaattaataggtcaacccatagttcatggagtattgtacattggaagagaagcacacacaatattagaacacaccaccatttttttc

SEQ ID NO: 37802 - DNA, 1501 bp, Oryza sativa
agttccacattgcattgattttcgtcaaaacttttcacaactatagtttaatgaaaggcatgcaaacagttttaacaagcaaaaaataacgataactacgttcaaaattagatgcacttagatacaaaccaagaatcctagttcatccccactaagtgtagataatgctacttctctcttctctcattaagccacatcaccccaataatttatagcctttggatgatagatctatggtttaaattgtctcttctttcttctctcttaaaaatatgcaatatcaattatttttagtctcaaaattatatcaaattattttagttttgataatcaaattacgtcttatttgtacatattatgcaacttaattttccgcagcacacggcgggtagtcatctagtaatattatatacgagagatagtcgtagttgaaacaaagcgactagtaattaggcatttaaatatttaacgtgcacaactaatgctacaaaaaaaggactcataattcttaaatgaaaaataatttgtgtataaaatatttatatacgtgttcttagcaatttaaaaacaaatactaaaaaataaacttcgaaatttaaattttaactgataagtataagcaaaagcgaaaaatgtgaggcccagaaactcccgcgatccacttctcaacatctgggccgtcgtccatccagcacggatcttgaagcaggaaggcccattagcaaaccctagacagcaacgccaccgcaaataaatagcttcgctgcccttccccctatccctctcctctattgccgccgccgccgctcccagctcgtgctcccctcgccgccgccgccgccgccgcctcgcctcctcggagatcttcgctgcccttccgccaacatggggtaagctccccgtcactctcctgcgatggatttcgtctgtataggtttagcgatctggaatggcttagtcgagttccctcgtagctggatgcttgaatataccacttgagttttgtatgcgcaatacttgtaaattggtaaatttgcgtgtgatggaactaagcttattgacggtccagtgctgatcagattataaaccgtcagcactaaacatattcataagcgatatcaatccgttgctgctgtttaatcagaatttcttggatcaatttacttggatctgggaggttatgcatggtagcatacactgttatcatttttattgtttaaaggaatcgccatttgtttagctgtcaaatcttaagcctgactttgcaaacaactatcgacttctgatggcaaatttattacatattatgttcatcaaagaacactgtttcttatgcttgctaatagtctgaatctggatggcatacccctttcaattattcatttcatccctttacattgtgcacgcgttcttttctagcactatgttatatgtcaaccatcgaattgtagatcataatattgttttaatatagttgcattgaccatgaattcttcaaaat

SEQ ID NO: 37803 - DNA, 1501 bp, Oryza sativa
actactgtgtttaatgaggtcctgtcggccgtggcacgctgtatttaatgtggcgagcatgcacactgacaggccactagcagcaggaatgacggatgtgacggcggacaggcataggacagggcgctgtctgcacatgcctactgctagcaggggacatggcctacgtctaccctgtcccgtcgccattgatgaggttttttttcctctcacttggactcggtccagcttttctctgcacaggtccgttcaagagatctctaccccttggtggggctggacgcccaaaagtcgtcgatagttaagaaggaatgacatgggcatccacccgtactgctcagcatgatgggatggggcccatgtcgtggtaaggtgcgcatggcttcacacgtcgggaggacgagagacacattaattacctatagagaatgttttcctttcccttgaagctaagtcttgggccttttgtggtaaccccttaagatataaaaggagatccatgcctgaggggaaggagaggccgaagaaaagaaagcacttgtattctcctagcataatcaaccacacataggagtagggtattacatttccacaacgcccggaacctgtataaaccgattccgtccccattgcccccgaggggcccgaatcctctctgaatcgccttcccttcatttctcaaaccttcacccgtattcctggtctgaaccataaaggggacccccacagtccttgcttgaggagtttaccctccaacagtgagcaaatgaacttatggttttgaactttagtgggagaaaccaaccactgtaccaactctaggatttttgtcttttaacagagccattagtcttttgagtagagttatgggtttcatttaccagccacctcttagtccacacccaacttgaaaagtgttatcgatacataagtcgcctttgccatcataatattttcattttttctcctttttctaccaaaccatcaaacttttattacattcaaatacaaatagtttgctgaaaaaaatacactatattcctggaaaagcaatacaaataatctgttttaccaaatcaaaagcatcttgtttttgttagtggagtgtggagaagagaccatgggcataaccaaaccaaaaaaccaaaacaaaaccgtttgtcacaaaaaaaaaacaattaccagacgccacaaaggccacggcctacagccttttcagcccacgacccaaagacattagccggaggcccagccaagttcccctatcaccatccaactcgtttccccacgaaaccagtccaccaccatctctagaactttccatctcgcctccgcctccgcctccgcctccccccacctcctaagctccaaacccaagaaaccctcctcctccgccgcccgccgcccaatccgacccgccggagcgcgaagggagaaacagggcagccagaagaagaagaagaagaagaagaagaagaagaagaagaagaagaagggagga

SEQ ID NO: 37804 - DNA, 1501 bp, Oryza sativa
tgtaaacttaggtgcattgactagatgcacctaataggtgtagcctccgactatgtggttagttaaacaaaccaagcatatagtcaaggaataaataatcgaaccaactgagtggttctcgataattatagtcaaccaagtgacttgatatcaatatatagcatatatggagtgaatccaccaaataacatgaaccaagtgatataccgactgctttgtaaacatagatgcgagcaacctaaagttgactacatcattgaaaattcacatagcaaaacagctataaaaaagcttgaatgctgtgaataaagaaatttcaaagtattgggcatacaccatgcgcacactgctttaacagatgtgcttaagtccctaaaagagacatggtacacacctggaaatatatggcatatgtactaacatccgagtaaataaactcataaaagatttaccaaccacctagaaaatgaccaagatatataatcagcctaagccataatattggtcaataaaaatgcacacttacgtggcaaaaagtaacgatattgtattcaatcaattgcttaaaaacccaaacaacactttgacttatataaaaaagtcaacggggcagctatataaagctttactgtttgacaccttttaagatacattgtaccaactcgtaaaaagttgagtgactgcggtataaaaggattttaaggtattgggcacttgatcacacgcactttggcctaagcaaaaagtgcctaagtccctaaaagaacgtgacaggccacacctgaaaatatgggctgcagacatattagacctaggccaaaaaaatatgtcttcgactccctttaaaggatgacgcatgtaacatgctcccgagtaataaatcttccgggtgatacagaccaagtgtagctcatatcaatagcttctgatctgagtgattatcccttatgggatactccaaaatagatataaaaattgaatcccgactggcgcaagtattcggttgatagcccttacggggaataatgaataatccagtcgttgagcataagaaatcgactcatgaccataaattcaagctgaatgtatctggaaaaagtccaaattgaagatataatcctcgcgcttgagttgatgagcccctatgcatgtagcttatctttccgtcgtagtcacaattgtccattgattgtagctgatgcagtcggcatggagatgaaatgaccaacatgacgatgatattgctcatcagaggtgatggaagatgtcagtggtagtaaaaacagtgacaccaatcaaaggtgatgaagtcgcatagccgtggaggcgaagaaaccagtcggcagcagtcaggtcagccagcaatggagatgaaggcgcccattagtggtgacataattagccatccgtgaaggcgaggataccggtcggtggtgacgaaagcaagccgacggtgaagatgtagacacgcatcaaaggcgatgacgaaatccaccaatca

SEQ ID NO: 37805 - DNA, 1501 bp, Oryza sativa
ttaatattctaagcacgacttagtagatcaaacttaactgatacagcactaagtatgaaaagaagaataatatctagacaatcaagccgctggatgtttcatagggtggtggatatcctatacaatcgaagccaacgttgctatttaacctaatcggcttccttccgatgatagatgttagcccattgtaggttaaataacgatattgtcgtggattatatagaatatataataactcgacgaattacatagacaagattagggtatcataaagatggaagcactaatcccgagaacacaagccgccatactaagttttacctctagttgaagatcgaaaccaatgcagctcaatccgaaagcaagaactcgtcgaaacaaagtgaaagtaaaagggtggcgatgtgccaagattgtattgaacgtgtgttagtttgattacatggggcttggggtctatttatacccaagattacaaaatatgtccatgtcggacacgactcttgtctctaacaaactctaagatactataagtctttgcagcagacttttgcccaaacatatctctaaggaaattccatgaaatatcctaattaatagatacaattgtcggattcggcttgatcggctaaccttgtccaactcggactctgccgatcccgattgtagccgatttggacttcagtcgatccttactctgttgccgaaacaatcttggtcttggattccgcttcgatctgatcttcatcttcgatactttaggttaccaaatttggtcgttaacaaatattcaaccgaatacccaaaattaccacgggggttacttgaattataattaccagcctccatcacctcatgtccaccaaggggggtcaactcagcctcagtatgctcctcaattcaatcagttcgagccgatacagcagcatacacaaggggtacctcagcagagaccttgggccgatatgattgcagatgtgatgagggaacagttcgggctcaagccaaaggacactgggaacttgtatatgcatccgtatcctgagtggttcgaaagagttgcatttcctgctaggtacaaggtgccagatttctcaaaattttcagggcaagataatgtttccacttatgaacatgtcacccgattcttagctcaatgtggagaagcatcagctgttgatgccttgagagttaggttatttcctttgtctttattcggatcggcttttacttggttttcttttttgccgtacaactctgtcaatagttgggccgatttggagaagtagtttcacagttatttctacagtggtattcatgagatgaaattgtccgatttaatagcaattaggcagaggcatgatgtatgtcgaaacatgaattcggcaataataaaagggggtagcgcacgagacctaaaagtggatggatgcagagacaaggatttagacaggttcaggtcctctcgatgagaggtaataccctactcctgtttggggat

SEQ ID NO: 37806 - DNA, 1501 bp, Oryza sativa
ggttggaaactatgtcacgtcttccgtccgtatatcgtggtggtatgtggcacgtggttacacgtgaggaagatgtgtcttgtgggtaaagatgtacacctctaatcaaagaataatctattcgaatagtcgcgccctcggttatgggcaagccgagcaatgtacccaagttagtgttttaattcttaaaacctgcttaacaactaaaatgtggaatggttggcctgggttcgcttgggacgagctgggacccagggtcgggttgccagttcggtctgaatcatcgtaggccttgggttaaggcaggttcgtgtgggttcacggccttgattaataatattgtatagctctagaatcgtgtttacaaaatagctttgagcaactaagtgtcttttaatgctgtttactgcaaaccctaaccctttatattattacccccttgtactcccctgcatttattctgcacttatgggtgtgtcttgttgagtacggtggttgtactcagtcttgctcaatttttcccaaacccagaagaggagcccctagaagatgaaggctttggtgtctagctcgtgcctgccatcaagcgcctgtggtcgtcgccctagtcttccgctgtttttcgtttgtcttcttgtgtgctgggtcttcgccgcccatgtaataaattaattaattatgcttccgcttgttaaactctgaattgtatcaacttttggtgtaccttgcctcctgggacaaggaataatgcacgcacgtaaggaacgcccattgggttatttccggtcgtgacaaacattaaccgtgccaaccacaagccagcgtgggcaacggctttaccttttgtatagtatggttcattgcggagcaccagactgagaagtggccgagataagcccacgggggtcgctggggagtccatgccttgttttctaagggggtgattatgatccaggaacggtgcactgtggtgaattgtgttgtgcgaggggtactgtcacagctcctttccgaggtaccgtgatggtattgaggcgcatggtgacaagtcgtggggctgtgtcttgtgggtacagtggtacacctctggccagagtaaaactattcgaatagccgtgcccgcggttatgggcgggtctaacaatgtctttcgtgattagtctcacacttctcaccataataaatgatgctataactggtaataatttgattagctcctggtttggaatagtacattcctggtttggagataggtctgtgcagccgggtatggttgttcaggatggttgggcctgatcagcatgggtgatgctgttcagtgttgattaatattgatgattaattactctactgttttgcaattcttaaatgtttgctaaatgctgcttttgcaaatgagccctatattatgccatcctttggtatccttgtgcagttgcatatttgctgtgtggcttgctgagtatgtcatatgctcaccttgcaataatcaatcaaactc

SEQ ID NO: 37807 - DNA, 1501 bp, Oryza sativa
tttctcttcagtttttccagcatcatcaggagcatgccccaatattcccttgccgctgacttgtaattctgtttgtaccccagcttttgagtacccttcttcaactccaagacaagttcctcctgcgttttggcaagagataaagccgtatcaacagtcctgggcctatgcagcttgatagctgctttgatttcagtttttagacccccaacaaactttgtgacaaaataggtttcatcataggcctgattataaactgtccctatgcattaattcctcaaacttggtataatactcctcaacaccaacaattagcctaagcccttctaactcttctaaatgttcctgatatttgtcctggccaaatttgctatgcactgctatacagagttcaggccaagtttcaacactatggagggcctcatttgtttggagccgcaaggcagcatttcctacaaagtggagggtagaaaattttgcccaattttcataagacacttgatacatttcaaaatacttttcagagttcttcttccagagcttaggattgtcaccatcaaactttgggaaatcagactttggaagcctaggaccatggaatctattgctggattgattctgaactgaagactctcctatatcaaaagtgatgggagagttagggaatcgggacttacccttgaccaggaatcgatcctgagccgcgagggctttggattcgtctccctggtgattctcggtttcgccgtgcccgatgggcgttggggtcgtcatccccgatgccgctgcaggtgagttctccagaaccgtcacccttgcggcaattccttccacggccttgttcagagcttggatccccgtgtccaccgatggaatccacgtctccagcttggtcagtgaccccaggaggtcgttgaggttgcttgcgagctccccaactcgctgattcagatcgacgagctctgccttcacagcaaccatcctctccgtgagatttggccccttcttcatcgccagcggaatcagattgtgacgaactcctagactccaccggcgtcacgccaagctaatccagaattcgctaggggatttggattgaattagagaggaaggggatgacctgagagagagagagagagagagagagaggtagttcgattgtatttgatttcttctcatcgatacttgctcatcggcagggagtttcccttttaacgggtacaaggcacacgcactcgacgcgaccgccagcccagcacggcacgtcaaaagcacacacacacacccagtccacagcccacaacaagccaggccccaacacactgttacactcaatacagggaacggcaacagctgacaagctacagcaaacacaactcataacaccctagcgcagattcctcctccaaatccaccccattcaagccggctctttccaaattattagggggttttaatccccattgatttctctttgatttcccctgttttcccccttgat

SEQ ID NO: 37808 - DNA, 1265 bp, Oryza sativa
agtataatatatttgaatagccgtgccctcggatatgggcaagcctatcaatgtacccaagttagtggtttaattcttaaaatttgctaaacaactaaaatatggaatggtaggcctgggttggccttggacgagctgggacccaggtcgggttgcctgttcggtctgaatcatcgtaggccttggattaaggcaggttcgtgagggttcacggccttgattaataatattgtgtagctctaggatcgtgtttacaaaatagctttgagcaactaagtgtcttttaaatgctctttactgcaaaacctaaccctattattattactccttgtacccccttgcattaagcatgcatctcccggtgtgacttgctgagtactgtggttgtactcattcttgctctatctttccccccttcagtaagagaagctttggagaagaagtcctaggtggagtcctggcttataccccagttgagcgcctgtgaagatggagccgtaggcccgctagtccgctgctgtttatttttgattgtcaggcgttaagtgccttggtaataatgtaaatattatcgatataataaagatgtgtcttttgtatcatgtttgtgtggtgtaccctggcttttcctgggacggggattaatacactagcgctcgggaaaaggcaatttttcccggcgcgacaagctggtatcagagccatctcgactgtaggataagccaagtggataaaacctaaggacatattttataaatgaaactatttgcgaaagttcccttttcctcctttcccctatgccatttgcaaaatgttttctcttttcttccttcttcgaatttcaactagtactagatggccagctttgcgaagaagatgtcgtcaattgtttgcggaagctccggaagactgcaggatccgctagcgaagtggagaaagcagtggagccagctatgaagcaggagtgaagatcttgggaaccagtcgcagaacctaagccaccctctagggtagagtcgatagttgtgtgttcctttgcttgtgtgtgtagcgcgtggtttgcatcggtgggttgtgatgtaaccatgctaggttgtttgcttaatcaacttgcagaataagtgaaacaaacaacacatcaacaaaaagagttagttcctataaggtcctatccctagttctggtctattctttccttgtatgcttcctctctcaacctctaccttgtgacagatggataacactggtaacaaaggctatgggaa

SEQ ID NO: 37809 - DNA, 166 bp, Oryza sativa
gcccccgcaaatctgcgccggcgccattgatggcgaccagacctcccgcgcccgtttccttcctccccggccactctctcccccttccaaccctatttaaaccctccccgcacctcctccgttcgtttccgcctctcgccgcccttcctcctcgccggattcgagc

SEQ ID NO: 37810 - DNA, 1501 bp, Oryza sativa
atggagaacgcagcttagaacctcgtaagcaacgttggtcagttgctgaccgaggaataccggcagctcaatggcgtcggtagcgaggtcgctgagctggccaccatgaacaccctccaccgcatgcaatccgaggccgacgacggcaccgtggaccacttcgtcctggagtggatgaagcagctccgcgagctcgcctacgactcggaggactgcatcgaccaataccgctcatccagctacagcatatgaagaagaaggcccactccagccccctcctccttctccgcatggcggcaacgccgcgtacagctcgtagagaccacctacgtttgctgctccccggtcttcttctccaggtgcaagagcgtcgtcatcttcacggggaactaacaaaaggaaaggaatttgttagtgttagtatcagaccacgatcgagaaaataaccaaatctcacaaaaaagaaatgcatgccaaacttaacaccacctgctcgccacgctcttcctgcgccgctgcctcgccgtcgccatcagcgagcgccacgccgttcccagtcgccgcctccccggtgatggcggcgttcgcgtcgcccacgcagctgctccaccatgccaacaatggcggcaccgccgctaggcaccagcaggtggttagcatcggggacgtggtggacgtcctggttgagcgtctcaaggcgcgggaccgcccgcccccgcgcatcgccgtccgacgcccaccgcccgctcccacgcggcgtcgtccaccgtttgccgcccgcccctctgtgcagcaggcaaccggtaggctgtgacgggcgtgacgctgaggcgggaggccgccgggacagaaggtgggcgcggaggaaatggcgagcggcggtcgcgggaacggcctcctcctccgccgccgctgtctccctcttccgcctctcttgctcctccccgtcctcatcccgacgccgctccagctcccgacgcgcgcctttgtccgccatcccccgtcctccccccgacgcttccggccatggctcgcctctccgccatggccgccggcgcccgtctctcccccatcccctccacctccccgcgcaccgcgtgcgcatcgaccgccagcctgcccccgcgttgctgcccatcgcccttccccgcgccgcgccatgcatgccggccgccggcgtgcgcggcgctgccgctgaccgatgaagagagagagagagagaaagagagagatagaggaagagagaaagtggagtctgacatgtgggtcccaccattaaaaaaactaaaatgctgactggactgccatgtgtatgccacgtagaccaaaaccaccgcggattgggtcgaggggggtaattcttccggtttacgtagttgggggtgaagaatgtccagttttgtggttcagggggtaattcggacggccgcgatagttcaggggggtatttcgtactttttccttgtcattcacacacacaagattgtggggcccactgaca

SEQ ID NO: 37811 - DNA, 1501 bp, Oryza sativa
cattcactagtcccaagtaaacaatggtggtactccctcatcaaaatataaggcatactgttttctctgagttctattaaaatatagagcttgcatgcaaatttattgatgctttaccttattttccccgatgtatactttgaatgctcactaatcattttctctataattcattaattccctaggcattttaggtaaacaaaaatggcatgctcattttcagttatgttctcttgattttataatcatcgtaatatttctgcacacacaaaatccaccttaaattttcaggagagtatatgagtaccacatggacatgatattcaaacaaatatcttgggtacgagcaggccaagtgaagtaaaaaataatgggcgccacagaacaatagtatccaggtagaaatcagcatagtggaataaaacaaggttcatgcaaaatgatgtgattcacaaaaaaagatagatcgaagataaaaggttggaatacctgattgacaaatatacgctgaaaaggactcttatcctcattcaactgcatataaagaggaataaagttaaaaagagagataagcaattgggccttttttttgcaaatctcaattaaaccattatagcaggaagcacaaccaataaaaaagaacaagttcaaacataactatgtaagcattctctaagttctctgctaggatgatgccatgctcacaaagttctgtagtacacaactataacgatgacggtcaacatttagtctccctctcatgattttctttcatattgtcccaagatttcagcggcatctatgggataaagtgaacagagtacgcaaccccgtttttgcaatcaaactaagagttcataagctttttctaaacatacaggtactggtgtactttaagacccaactcacaaaaatacggtgtctattccattaactgattcatcaaataaatcttgctgaatagcaaggcatgtaactgtccacgaatgataccccatagcaaataatatgtttggcataaaatggtacaaattacaaggcaaagattcatgcatagaccgcaaaacaatgagacctgctaggatcagctaagcacataaatgtatttaaaccatcaccgctccaactcatgcttagagcaagtttaatagtatagctaactattggctattagctcatactaaactaacatgtatagactctattttttgtgttgctagctcttgcatgagagccaacacttctcatttctctctctctctctctctctctctctcttccacataagcttatagttagcttatagcgcactattgtccttgctcttatcataggataatctcgcgcaatagcacattgtttgattcgctccctaacctaatgcatttatatgaacaccgcattcattccctctgatctaaaacaaccccgccacccactatccaatcaacgtagcagcccaaaccagctcagacgacagaaacacgcgagccgtcgcgat

SEQ ID NO: 37812 - DNA, 1427 bp, Oryza sativa
cctgtttgttagctacactgcaacatacactaatacgctaagatatatagattgattctgttcatggtcaactctatgctaagtgtactagtttaattggtacagtactaagtaaacactgaatccactactctactattataaaattgaagatgttttgccggtattttagtacgttatccgtgtatgagtctgtttttaagttcgtttgcttttggaaatatatatctgtatttgagtcggcttttaagatcgttcagttttggtaatacagaatgaatcatataagaaatctgtttaaaaaaactcgcatgctaacttgagacgatcggactcctaactgtagcccatgattttctaaaaatatatatatctaatcgaactcccatagtgaatttcatcataactaaaccatataacaatagtaagattaaaatagacttcacccattgcaacgcacggatattttttctagtctttacatatatttaagctagcaattttgatgagaacatatcgctcttctttgcacacacataatactcaaattactatgcaagatccaatcactagagttcgcgtccggcaattaaatttacaagtgagtttgtttctaagtatttctttatatgattttgaggatatattgctacctaataatttaattatgattagaaactatggaaagaaccatagagcacttgaaaagaggcaaggagatgaacaagattgtcatgagccttcaagccaaaatgtaggcccaattcatatatcaatttcgagttcaccttggactctatgagtagcccacactaaaatcatcggtcagattgcatttggacttcgatttcaacgttctacatacgtatgtaaagctaacggaaccacatttccaatggatctggtccacgtcaaaattccttccaagttgacaggaatagttgaaacaagaaggcgttcaaattctgtctagatgttgcgtcactggctttgggcccgttgagccgtgtattgtgtcagagttcaatagggacgcgtccaggggtctaatgtcgaccctaaaacctatatattcagtagtcatcgttaatttagtgttgggtttagcttagattacttctgccattgcagtttctcctatagttcagtttaattgtaaaataccaactttgatatcttaatcattcatcagtaaattgagttgcaatatactttgtttttacttttgttatttgattcgcataaagagattagccttctcgcacgacagtggaccaaaactcaataaagcaaaattgaatgaaaattgcaaggctcaaaactaatgtttggtaaaggaaaaagtggtgcggctgtatagtgaatgatgggaaaaaattacaaaactaaaatcctcaccaggcaactgaagctctgataccaactga

SEQ ID NO: 37813 - DNA, 1501 bp, Oryza sativa
atgcgcgcacgtcgctgcatctcccacgataatatatactacctacatgtctcaatatacattatgcttatacacataacaaaattaaattagactacccatttcaataggaattaaaaaaatatcctaaaatagactaattattgaacgcacccatacaaaagtgtgacatgatcccaaaataaactattttatcacaccacgcaaaaaaagggccatgtgacataaatcacactgtagtgctttagaatgggcggcttcaatatgaatacaaactaattctaaaataaaatatttatcaaatgtgtggcaaacaataatagagatatgtgacattatcctaaaataaaatattttatcacaagctcaaaaaaaaaatccgtgcatgacatgagttataattgagagatctgcacataaaaaatccactgagctctggatatagcctttcttttatatattcattcattcataccagaccatctccggtttgaaaaatatatttgttaacaaataatattgcaccttaacatttagcatgaacatattactatcaaataaaggaaaaaatcgtgctatacgtccattctccacgtggcatgccaggtccaccgtcggattctatcacttcccgcgatccacttctcaacatctgggccgtcgtccatccagcacggatcttgaagcaggaaggcccattagcaaaccctagacagctacgccgccgcaaataaatagcttctctgccctttccgttatctctctcctctattgcagccgccgccgctcccagctcgcgctcccctcgccgccgcagccgccgccgcctcgcctcctcggagatcttcgctgcccttccgtcaacatggggtaagctcgctgtcactctcctgcggtggattttgtctgtataggtttagcgatctggaatggtttagtcgagttccctcgtagctggatgcttgaatataccacttgatttttgtatgcgtcatacttgtattttggtaaatttgcgtgtgatgatggaactcagcttattgacggtccagtgctgatcagattataaaccgtcaacactaaacatattcataagcgatatcaatccgttgctgctgtgtaatcagaatttcttatatcaatttacttggatctgggaggttatgcatgttagcatacacactgttatcatttttgttgtttaaaggaatcgcccttagcttagctgtcaaatctttttgtggtttatgctaagcccatcactttgcaaacaactatcgacttctgatggcaaatttacatattatggtcatcaaagaacactttcttatgcttttgctattagtctgtatttggatgtcatgtctctttcaattgttcatttcatcccttttcattctgcacacgttcttttctagcaccgcactatatgtcaaaccgtcgaattgtacaccataatcttgttttaatatagttgcatgaaccatgaattcttcaaaat

SEQ ID NO: 37814 - DNA, 174 bp, Oryza sativa
accaatgcacttgttatcggatggcatgtaattgttgtctccctcttacatttttcatgcatttgttgtttaacactataagtctaaaaacattctttctttgctgagaaaaaaaaaactatgcttgaactgcatgtgtatcaactattatgcatggtcttttaattttaaagg

SEQ ID NO: 37815 - DNA, 1501 bp, Oryza sativa
ataatgtttcattaaataatgtaaacaacccacttatatactaagtaggaattcacacagttacggaagaagaagaagaagaagaagaagaagaagaagaagaagaagaactcagcaacatgaatctatcatgttcccctatatacgatagtttgcaattgagaaagacacacaaacacgggcggagccaggattttgagttgttggtgtcatggcacgtgaaggttgcaagacgtcgttttctcccatagagtcatttcaccgaaaatggccctagtgatgtcgatgtactctttgattaacttagttacagtgagaaggggatggaaaaactgcatggcgttttctgaccagcacaaagaactgccatgtttatataatggacaaaaactatgtaatggtaaagaccggtgatcatatctccgcacagtaacattatggaaaatgttcaatttggttgaaatggagggtttttcctagcagtcaatggatggtttatttagccttaatgcaagaggacgcggtggccggtgctgatttgtggaaaatggatggcccaacgtgtgggtgtcttttttctcttgtttatgtttcttcctgtgccccttctgttacttaatgacaaacatgtgactatactatgagcttagcttttctcacctcctcctatccttcattattgaacccaaccccacaacactgcccagtgggccacttatctgcatgtcagtacactcctgcccagtggatcaaagatcaaaactatgaagaaattaatattgttcaggagatgacactatgagagtttctaaaaataatgcattagtagtatcataagaagataacagactatataatcccgttgtgtaaagctaatgaaaggcccatgtaccatgcacgagtaccatgatagtatgcttgtccaggcagggtactcaagaacagtaggagtatgacggtaactgatacgattggctttatctgcaagcattgcagtttggtttgcgacgtcgaattattgcatgccggcttttccctcctgtagcacggtcggtgaagcaacaaggaaatgtaaagatctttcacaacaaaatggatgccttctttctgctagtactcctcctctgcacccccaaactgtctcaggcaacgactgtcacctggcaactaccgaacctgcctctcggagtgccagtattggaaaaccgtgcttcaaagcaatggcatattgacaggtgagtgagtgataaccaacatcaggctcgtgcgttgcaggggatgccaccataacggcatttacaatgcgcccaacagttttgaggagccacagctgccatgtgcgctgaaaccacgccctaaaaaaatttctctcccacagtgcaagggtcttcatgcgtagctttggttttttcgtttcagcccctcgtattttctatttcagtcccttgctatctttctattaacaaagaaatccaaattttacactttgcaccccaaaagt

SEQ ID NO: 37816 - DNA, 1501 bp, Oryza sativa
tacgttatgtatatacgtgcgcgccatacatacgtacttatgaaaaccacgtagagattgcacgtagagagtacgtacataatgcaatgcatacagtacatctcccagttgtggttgtactgtacagtgttgtgtacactgtacagttatacgtgtgctgtgcgcaccctgtgatatatatatatagagagagagagattctgtttatatatggtttctttttatttatgcttggatttctaatatgattttttggatttttacggtttataggttgatggttttttaactttattactcccccgtcctattttaagcgcaaccatgagtttccgtgtctaacttgaatcgtacatcttatttgaaattttttattattagtatttttattattattagatgataaaatatgaatagtattttatgcgtgacttatgttctttattttttttcaagaattaagacagattatcaaaggttgaacacataaactcatggttgtgcttaaaatgtacggaagtagcaagtttaaaggtgaattaactaactccaatcctcatagaccggaaaatttactcaaacctggcttttgacttaatacagtaagagtgccttattgctttacaaaagtctaattaaatagaatcatctacgaaaatataatcattatgaaatttggatatgctgttcatctcatgctcttggcaaagtataaaattaactctcgtgttgaaaaatgcattgtacagccctcctagcagaacatggtctttttacatgggttaacagagtgaaatgaatagaaccccgacagtgatgatatctttgggataagttatgatatctctgggataagttggctcgtataatagaatttcttggaagttgcattcgtcgatgaaacgatgattttttgaaatgaggtatttgtcaatagtatttgttagattttatttttttatatatatacttctaatttatttatgaaataggagtagtgatattaaaacgatgcaaagtaaaagttagcaagcactgaagcaccgtcaaaagtgaattggtgggagtactacagaaggattaacagtgcccttcatacaagtaaattggcgatttgattttaaaaaggttcgtcggcaatttcacaagtaatcacaaaggcagtacccaaatgcatagggaacaacccatccttttcaattttcttctttgtcagttacttccagactttttctgcttacaatacagattcaacagttcagatgtcactttctcatctcgatcttttctaattctaaccttctagtactatctacataaactacggaaagaagctagagttctactccctgaccctttctaggttgagttttttttggatggaatgagtacaaattaatgctaattaataattcatatacactccacgtttgagcagaaaattaaactgccaaaaaatacaagtaattgcaattgagcatatgttcggatgattaatata

SEQ ID NO: 37817 - DNA, 1501 bp, Oryza sativa
ctgacgaggaacttgagaggggaggaggtctggaccttgaaggcgacggggagggacgggtgcagcgagcggaggcggaggtcagcgcggcacttggcgttgggcttgaagtcgatgacgacctcgtcctccgccacctccaggagctgctcgaccgccggcttgtccgcggctgctgcggtattggcggccgggacgacggcggtgctcggcggcggcgagggagaggctggcttcgcggtggccatttcttggaaggcagagagactggtagtagcagggggtggaatcggcaggggaaggcatggaatggtggctggcttcctaggacgccgcttttgatgtcacgctggatgggcatgatgggaatgttgatcgtttgtgcatacggtgtcttgtgtggagtagtttggctttttgatggtttggcctctacatttctacaacttgtccgccacttgatgagtaatgtacaagtgaacagcacacgctgccaaattaacacagccggggtgtattgccgagtatgtaacgttatacaagcagtattacaaccaagtggccgatcgaacatactcactgactatatacaaacaaaagggtgggttttttaaaattttaaaataaatggtagggagtatttagctttggttaggaattttacggagtatttaggctagcatgttcatacacttctcaacaaaagggtgaaattgaaaccactcgtcatgaggtagtacatactcatgctcatacgtccacacacttcttaacaaaatgtagagttgaataagacgataggaagggagagcaacatgggtttatccaaaatgtttatacggtaatagagtaaatacctcaccaatatcctacttccttcatcccaaatgataagttgtaaagttgcatagataaaaatcaagttgcttttacggaaggaatacttccaacgttacaaaaatattgataacaccaaagaattcatctcacattggtacaataatcttgatataagaaaaaaaaacgaccatttctggaaacctctttgtcataagtttctagtagtttgaaagtcagtttcggggaaaagtggttcaaacaattcttttatttgattgaataggtttcctctccttgttggaaaggtatatatgtccctactatttgaggataaattttttaattcggttgaactaattagaacaaatatatgcaggtgaaaatgcaaagatttttctgaacattaagagataatagataaaaaatgcccatgcattgcaacgggtgaaagctattctaataatattattattgttatatagtttagttaaggtaaaattcactgtggaaatcagcttggatatatatatagaaaatcattagctataattaggagtccgatcatctcaagttagcaagcgagttttttaagagatttcttatatgactccttctgtgtttctaaaaacgaacgaacttaaaacccgtctcaaatacagat

SEQ ID NO: 37818 - DNA, 1501 bp, Oryza sativa
agactagctatactttattagtgagtatgccaaagatagaaataagacaagcttaatgatggattttatgtgttccccagatgtcgatgcgccaacaacaaatccatataagaaaaatcaatacccaacttaaaaatgatctctacaaaaacccaccacaggcccctctacactccacagtccacagcacacaaacgaacacagctccacttggcacggataatcgagatctcggtgtggccgaaccccgcccagcgccaagtccatgtcgacgaggagaaacccacgaggggtggtcattcccgagtccccatctggccatctctccaatctccatgacaaaaaaataaccaaccggtcgaaagaaaaattcaacgagttgtgaagacttgtcctccaatttcccaactccccaatctgtcacctcgcagcttcacgcttccacgcacacagatcaaatctcgaaatcctacgactcgtaggatggaggagtcggagtagtagtaaacggcgatcggatcgaatcgaatcatcggcgctgctgcctccccgagccgtgaccccccccctccaaaccgccgataagctaaattcattcacactccacttcactcgctcacgcttcgccgtccgcgtcgcgtcgcgttgcgtcggcggcgccgctgcactgcacgcctcgccaccggcgagcgaagggaaggaagaggaggaggaggagttggtggtggtggtggtggcgcggagtcagtggcggcggcggcgcgggtggagatgaaggcgaagagcctcccgttcatcgcctcggagcacaagcggttcgtttcgtctcccgccgccgcgggcgcgcgcgcgcatctcggcgttcgtgccggtgtttgctgtttctgatgtgtttcttcggaagtttttcgccggaggttttttgaagtttctgctgcacgaaacttccgcttgcgtgtagtttacttgctttttttttcttctcgtggtgatattttgcgcggggatctcgatctgatgcgagatgttggggccaaatttgggcaatgcagtcctagatctccgtgtgtacgatgtgattagtttttttttttttgctccctcagaaaggagtgtttgaatcgtgttagcttctctgatccatggaaggatcggagtttgtgtggatgtccgctacaatcgaagcaaattaactcgattttttacgaggcagacattgtaaacatgataggaccaaattttagttggaatttttggttctttttaataaactcactagagtatgaatttggattggttccggtcttgtggtacataactcgagtaccaacggttcagtattagcggcattctcctttctgtttctgatgctattgtggatggtgcagggatgcatatggattcgctgtgcggccacaacacttgcaacggtacagagagtatgcaaacatctacaaggtagaaaagctgcacctggtgatgcctccatttggtaccttct

SEQ ID NO: 37819 - DNA, 1501 bp, Oryza sativa
acatcgttgcgcatttgcacgcaggtaggcagacacttgtgcacttgtcttgcgtggagctcctcagctagtagtagagtagctcgcgagccaaaatgagctagctcgagctccttttacgaaccgagccaagttattgtttgggctcgattgcttagggcagtcccaaccctccatctagaatggtgtttatggtattaactacattattatgtaggacttttagcttatgtggcactatattaattaagagagagagtgaagagaggaaaaaattgggtctcatgtaagacacagcttcaacacgagaacctatgcactagacactatcaagttatgtattgggagagaatagtgtcttcataatagatgaagaataattatgattggtagagaagagagatgatatatttattaatggcccactttaagaaaccatgggttatagagtgtagtttctattgtgatgtcttattgacatggcactatagacactacttatgaacactatgggttgggactgcccttattgagccgagctagcttattatcttgatgagctgacacgagtcaatctgggctcgctatccacccatacgtacacacaggcctctagccaaaggagcgggtgggaattcagcattctgaatgctgaatgtttcctttgacttgaacgctgtcggcaagtcgcaaggccctgcgccgtgcagtagcggttcgtagaagttgacctccgatcgctatcaaagtgtgacagtcagtatcggttggtattttggtctggttgtcggggctactgactactactagcaatctccgagctcaagcagcaacctccgttgtagactagctggttaggatactcggctctcacccgagagacccgggttcgagtcccggcaacggaatttttttatattcctgttcctattacgatttacggcaatctgccgtcctccgcggtaggctggtggagtggtggccggccggcacggtggccttctagctagcgtgcgccgaccttgtcaggtgatacgaagacaagcacatgcatgctccggcgcacgccgcacccctcaatatcgtattcgcggtggttcgtgtgcgcgcggtgtgcctgtaccgctagctgtacgccatgtacggcggcggtgttgtcccttgtggtgggtgcgagcttgctaggtgctaaaccagtgtgcccatcgttcaaccactcgcgcgtgagccgcgccggttgcgcgaacatgccacgaggggccacggcgtactctatcccaccgacactgggcgatccatcgatcgacgggctcagccagccagccacctcacgatcgagatctggacggtacgtcgcctgaattactctgtgtgctagcattagctcgtccgtacgtcgtgagtacgtacgtagacaggcaggaaaaccccatagcctcccctgatcagcagcgcactgctgtacgcattaccggtgaaaatgccagtgggactaccggac

SEQ ID NO: 37820 - DNA, 1501 bp, Oryza sativa
ggtaacatgatctacgattaggatgtcaaagtttagcctgtgcctgtgcatcacatggcatgtacgtggattcgcccctgtagcctcgtacccttaacaaattttatgatttggccttgtttagagccctagcatagacaacatgttcatatatcagaaatgatgcattggatttaaagtgctgcctttctattatgggataacacgggttcctcaccttctttatgatggtagctaattacaaccgaaaacagagaagagaatgtcgttttaggatgttctcaaaagcatgtgggaacgctgcctgcctcaacttgaaaaaaaaaaggtttttacaatgctaacacaaatgacacctttttttttgtaacatctgaattagcttctaggtccaatgtgctgtgtccacaactggcatacttttgcatgcaaaatgaagaaattgatcttaggcttttttgtcgttggaagatttatttcatatgtggcaagcctgattggggaagggcataaaatcttggtgttttgcttgatttactttttttatcatatttttttttgcatcaaactgcttatttattttattgtaaaatgcagaaagaagaggcatcatccttgtttgttcaactctgagtctttgtgaatcagcctagttctctcaccaaattgtgtatgatgttattttgtgatcaaaactttcagatagctggttctggaacagatttgggaagctgagttctaattaattgaacttttatgagctagttttaaggaatatatttaggtactacttctatttgttttctaatcaatgttgtaatacagtttttttttggatttgagttgtacttacgtccgggagaaaaacagatacttgctgttgtaggtagaccctttctgaaacgcgtaaattagttttagttcaacttggatgtcccatttatttctgaaattagagctaatggaacaagccatgttatatttttaattggcctttgtttgttttaaaagttgatctttagattagcagtaaaccaccaaatggaacatgaccagttgatggtcgagttcagtctctagtgcagtgctgagattggcagcagataactggcaagggttagatgcagtgccaattttactggctcagacgtatcagaatttcagagcaccgcacttgttggaaaatttctttttttctgaacaggcatgcgtactccagcaatacctgccactgctatactgagacctgccatgtatcatggaaccatcacgtcacatgtgtgaactaccggtgcttctagcttcctagatgctcaccaatgctttttatgtttcttcatatgttacattagctttgaagtgcttggttcatgattacttgttctgtggactaagcttgcttatgatttcttagtttgggaatgtttcattgtttcttatatcctctctgtgccaggctgttatagctacatagaaggacaactgatacggtgttaggtca

SEQ ID NO: 37821 - DNA, 1501 bp, Oryza sativa
tccttcagtgggggggggggggggggaaagaacatggtaaaaagatggaatcagcaaaggggcataaatattactatttagaaatgctaagtgacaacacaaagttgaatttgtttagtggtaattggtaatgaaagtgttctaagtaattcccgcaaatggaagttgtaaactagctagctagtgattccttgccacttgttagctattaaacgcaattaggcgtagtagcttaagcattttggggtcatgcatgacagcagctgaaatgtgaacacaccaagattttgttgggtggtcaaagaacttcagcagacacagatttcccaagtgaaaggaacatgatcattttgttgttttcgtgtgaaagtctctatcacagttaccacccgcagtaaaaaaaagagaagacatgcatgatgtagcgtcaaaattcatggtatatacaaaggtgatgttactgatgtaagatcatggttaagataacgcggtaaaactattggatggcaatgagcaggtaaatgttaaaatcgtccaagagaatcattaacgtcatgaagacgtaagaaatgcattcctctctctatattttttttaaaagaactgcgctcctctgaaaaattgttacgcctttggactacgtttttaaaagatgctaatattaattttagaatggaaacggtaatacaaaacttaagtttaaaaaaaacattttcattcttcgcttcaattgtataatactaggtgtttttttttaaaaaaatgcataggtactatacaaatataccaaagtttattttatctctcttaaaaagggaaatggtagacttagggcatgttcagattcatgttatattaaaccataccattgtttattaatttttttttgcgatgaacattgtttattaaaattaacagatatatgacaacatttagtttattacttaatatttgccatgtctagataattgacaacatcatatgtagtatattctaccaaaacttggtgatattactaatttgctaaaattttggaaatattgaaaatatctataaagtaaacaatcccttaggatttcttaccgaacttgtacaaacacctaacctcatctaaattctttcttttttttagcataatctaacttctcgtttatgataacacgtgaaacttttgagcggttttttcccaataaaatttttgtacgtataccattgctaaagaaaagaacacattgaattgtacactgaaatagtgaaattattgcgttttgtttctaacaaaaaaagaaattactcagtttcagaaggcccattagataatcacttccatagccgagatggagccagcccaaaacactttatgggcctccagaaacagatccaaacctacatgggccgaaaggctgaagcccaatacctaccacctaaatccgctccccatcttccctgtgactctgttggctgtgctgtccagtcccccacttcgcagagggattgcctg

SEQ ID NO: 37822 - DNA, 1501 bp, Oryza sativa
ctgtcacatggatgttagcaattccgttttaaaattttactcttaaaatttgatctccgccgatgcaagccagctgagcgctcaccaaatggtgcaggtgctgcacgccacaaaggatccatggtgtacagattatatttcggacgaaatgatgggtacgtgcctcctgcatgaagcggtgcgatgcatcaggcgagatagtagtaggaccaggcgcttcagcacagccagtgcagcagccttctgcaacgcttcagcgaaatgggatcgattaccctgcccgcctgccggctctctccggccggctttgcgtttttcccctctttggtactagaagtagtgagtactcatcacctcaaacttttacccgggcggctccagttattactgtaacagcaaccggatccataaatgtgtgtacgcttcgtccatttatactccgggccgtgctgcttgtcctctctgaattgaaccctctgtctcctctccctttgcatcatttcccaaagtacagcctggatgtgagtatgtgatgtgcatcgctcgttccggttggcatcaaccgtatccgtcctgatgttactccgatttggcaaccggaacaaactctagctgtcgacccgtcctctcgcgctcagctactttcatcggatcggaccaagctatctcgcgattcaccgatgaagacaggtaggagcagagcaatagaaggaagtgaaaagaattgatgagatggtgatcgactggcctcccaacaaacaggagacagggtacctgcagacctgcagccgtcctgacaagaaagtgagcacctaggcacgccggtctcctccttccttggtttcatcataaactgcaacttgagtggcaccccggccgaagtactcctatagcatccggttcaggacttcaggtggagctaacgggttccttttacttcgtggtgaaaacggagcacctgaattaggccctgtttagttccaaaggatttttttttaaactttcaactttttatcacatcaaatcttttatacacatacaacttttctatcacatcgtatcaattttaaccaaacttccaaacttcagtgtgaactaaacacagccttactgaactaccagtagtactaaggctctgttcggtatccccttttcccaacccctctctctcgtttttagtgtgtacgtttttcaaacagctaaacggtgtttttttaaaaaaaaagtttctataggaatgttgcttaaaaaatcaaattaatccattttttttttaaaaaaaagctaatactccctccatatttataaaggaagtcgtttagggtaatgtttaagtcagatcttgggaatataaatcattaataactctcaagttgttgagtttaaaaatataaaaattatatgaatagatttgtcttgaaaaatactttcataaatatatactgtcagggttacggataaggtataccctctattcttggacatacgttgtatactgatg

SEQ ID NO: 37823 - DNA, 1501 bp, Oryza sativa
aaccggagaatcaagaccttcgttggtcatctctcttaaaaaggttcatagatcctaaagcaaaatatttttttagaggactaaagcaaattaaatttgatactgtaatatatttgaatattagataggggcaaatctttggccatttttctaactaaaacaattttggcctctatattaatcactttactttaatattcataaaaattttaacgatgtgtcggccaagaatggattttaatctattgaagggatgtcccctcatatatcttttttttctctcaaatataatgtaaatggtgttttttcgtttaaaaaaataatgtaaatgcggttatgattcttttttttttaaaaaaatacaatgcagagtatagtggcatcaatcactccataaaaattaagtttgaaatcgatctatacattgagaaaaaaaagagaaattcaggcaagaatagtgccaattctattcacacattggatttctgcatttcatttcatgaatgtacaagttaagtttagacacttgagaatctgtgaagtggtatatgtagattggatgagtgttgtaaacattttttttttgaatttctcacaaccatttaggtggtatttgagtgaacaagccgacattccctctagggattattgatttctctatttttttcatacgcttcgtgtatctctgtattaagattaagaaaatttacagcggttctctcgagcgacagagaaaaaaaaagagaagtagacaaaatgatttatctgtggtaccttaaatatgattttgcagaataaatgcctgttttagggtttaggtacaaaaacaaacaaacagagccggtccgaaagagaccggaccatgtgcctggtacatttaaagtatcagcctgtctactctaattccaaagtatcattttcattttttttttcactgaacctccacagagatgtcaaagcgtagagaatacaacaacaggaatgcatctgcatctcgtagactattagtttaataaagctccgtttccgtacttaaacaaatgaaaaaaaaaagttgattagaacgagagggctcactggagcagttgatcagagctagagtcgatgaactctggtctcctcccaacgtgcggcccattttcccggcaccaaattctgcgacgactcggctaaaatctgcgagacatgcgttgcaaacctccgatccatctcgtgatagatgcttagtactacatcatgccaaccgttcttctcccaccggccggcttgtggcatttgcagtaatcttggcgtataaacaattgcagcttggaacattctattccatgccatccaactcgttttctttagtggcaagcacaacgctgcatggctacgaattcgtcaagcctttccgcgtaatacacgtacaggagaatctctgataaccccttgtcaaagaataggagttagtgtgtgctagctagctgacctggaggaggacgatgctgtgtgatcatgt

SEQ ID NO: 37824 - DNA, 1501 bp, Oryza sativa
tttaccagggaccacacgatctggcagcttggctccaacgcaaactaaacccatacataaatggctgaaataaagaacaattggttatttcattgcacagaaggaaatgaagtacggatgctttttccgcataatcctttgtaaatataactccatcaaattgactaccatgttcttaacatcaagctttattttcagcctccatcgttgagtcgacctctcatctcatgcagagcctgctaaacatttttagatttacattaaacaacaaaacatccaagtcaaatttggcacacaaatattaatttgtttgaggatttaggaacagaggaatagacgagacatcaccttaacatgccccgttgagaacctcgttgctgctgcggcgacttggcgcttaaaggagatagggttggaagggaggggcatggtgggaggaactaagaaaccgaggtgacggattaaggaggaagacgccgcacgtctaccgctgctctatctcctggccgcggtccgggtggcgacgcggcgcgatggggtccgaacggcgacctgaacgcgggcaacggtggccagggtttagggggatcgaagtcaaggcggcgtttggcgaagggcggagagcaaagggcggcgggcggcgcgggatggggccatgggggtgcgagggcggcggttggcgatccctccggagggcgaaggaaaagggaaaggaaaccgagcgctggcgatttggcggagggcgaaggaaagtggaaaggaaacccagcggtgatcccgcgtgtgcgattttccgcctagtgaccccgcgtactacgtagttgattctgatgcgttggatttcacagaagatgatatcgaccattaagtgatgaatgaaagaatgaaagatgagtgaaattatttgttgaattatagggtagactaaggaatatattatttatcaacatgttacaaatgttgaagtacaatttatcagttcaaatacaacctttttctttgttctatcgacaaattgaaaacatatgcaagttcacgagaatgtgccactgtccttccccaagaataacgagacactagcaaaaggtaattgcccataggagtgtcactgtaggatcgaatcacaacaactaagccaaccagagggaggggtgaatggttggtatacccaaaaaccgaaaacttttagcggaaataaaagttaccctcgaattcgacgaagatcggtctgaccgaagttgtcctgccggtctgacagcgcctgtccccgtcggtctgaccggtgtagatcgatcggtctgactgccgagatcagctgccgcttgctatcgccgccgccggtctgaccgcccgtatgccgccggtctgaccgccggtatatcgccggttagaccgccgaaacccggtgaaacacaaattgaagaactcttaaagtggatgacgactttattgattctctctgtgtttacaaagggcacaaacatcactccttacaaaaatt

SEQ ID NO: 37825 - DNA, 1501 bp, Oryza sativa
atcacgtggtaccgcacgtgtttcttctggtatgctatacaaaatcaaatgacagtagtcagtaggattcgaatttgtaatttcttcttctaaacaatgaatgttaaaaatcatagtatttatgtaagatgacaatgttatacatgcccattcggagatgaacaagcaacataaattcttacagagtactaaatgattttatttacacactatcgctcatgccatgtaaaaagccaacaggatggtaagatcacccaaatccacatatcacatacacttttttcaatgatggttatgtagccattaggaatgaggccaaaataatttagagaaagttttgtgcgacttatcagggctaagctaaaaagaaagataacctgaaatgggcaaacagtaaatcaaggccaaactatacttaggaaaatgaatcatttggtttttttcgagaaaatacatactcagggaaataaatcatttataaataagagggacagaatcaatttataaataaatcatttcttaaagatgttcaaaacatcatgctgctagttggtgaattatgatagtaacatgcccgtgctaacggtattatggcattatttgttaatgcaaaacagtcaaaagatgatctatgttttgacaattaaacatataatgggatgtatatatgattcaaacaaaaaggaaacagtgattatgaacattccaaagtggttcgtccagtgaacaggcaaaggatcccattccaccctaacatgtgaactataaagctaacatatgcaagaggatgagtagtatatacctcaagaatgaaccactaaccactcctagtgggaggacatgcgttttttccttcaatctgaggagaacatgtcaagcacatgaaaccaagcagaaggtcatgacagattgcactaaaccatgttagaggccatagattagattggatcatgctaatgctatgcagttcatggtgcaatcaaattacagttgatttgaatatgcagttggtagcaaaaaaaatattagacaggaaaacatgaatttatgataaaaaaatggaccatgttaactctgctcaatctaggatagaaactgaattgatcttcactcctaatagaccatacaactctctcattaaaaagtatatagatctagggcataaaaattctgcaatttgatcatccaacacaaattcctgatgcatgaataaaggaaatccaatcattgaaccttcaaggataccataactctgactaaataacgtatttgctaatatttggcaatggaccaacggacctcagaaaactacaatacatgatttgcaattgattctttaagagaaatttcagggattgcaaaaggatcagatgcatatttatgatccatatggctatggaaaatatcttgattgttttggagattagcactaccagacatcgataagttgaatacaaacgtcaatgattaactgggctttttattcttatgctcctacaga

SEQ ID NO: 37826 - DNA, 1243 bp, Oryza sativa
ccctaaatactacttagatccgcttcattctctccggtggttggctagatcatcgacgacaacacaacgtcggtggcaggggcccgagccatgttgtgacggcggaggccgcggttgctgcagtggctgcagggtcagggctagggatccggctgttgtcatcgtcgccgcaaccactggcagactacggctaggcggggaatgaggtggcggcattcagtgatgtcgccgttgcgaaggaggagcggaaggagaagtgttgccatacggagagagagctggaggagaagcgcctcgcgtgaagagaaacggtgtagagagagaagggaaatggataagatcgagagagaaggagagaaaaggacgatgagacatggacgactggggtgcgagcacccgatattctctttcctattgggtgtccgaaccagagcattttcgccagatagatgctacttggaccaggaaaagagttcagatgttattggcatgtttgtaatccgatcaaataactgagatcaaacgcatcataataagggcttcggctcttatttttgtccaatgaaattgtagttgaaccaaacgacacaagtagtattttaacttttttaagagcgaagagactttctaaataaaagatatgggaaggatgaagctatctcttcctaatatctacttttagatgtataactcctaattaagatgacgtcgtggaagaacagaaaagcaagaaaacgtttttaacttactacctagaagctcatatatgaagctcatatatgataggatgatagaaaatccgtgaagagtacgacccgccaagcatcagccaacgcgctgcgccacacatgggactagtatggagcattttccccacatattggactcttgtataccactccctctatttcatcgtaagtgctattgtggttgacccttcgtcttattaaaaattttataaaaaaaattaaaaaataagttagtcataaaggactatttatgttttattatctaataacaacaaaaatactaatcatatttttttaaaaaaaacggacataactttttttaaaaaaaacggacggttaaacgttgaatacgaaaaactacaactgcacctatggtggaacagtgagtactttctttttagagtttttttttttgaacaactcttgtatactactagtatcgtcttttggagtagattgaggaagtctgaacatatccataacttgactagagg

SEQ ID NO: 37827 - DNA, 202 bp, Oryza sativa
ccctaaatactacttagatccgcttcattctctccggtggttggctagatcatcgacgacaacacaacgtcggtggcaggggcccgagccatgttgtgacggcggaggccgcggttgctgcagtggctgcagggtcagggctagggatccggctgttgtcatcgtcgccgcaaccactggcagactacggctaggcggggaa

SEQ ID NO: 37828 - DNA, 170 bp, Oryza sativa
cttacattcaggaaaaaggaataaaatacgatggtggaacttacatgtcagacaaaaaaaaaactacccttctcttccccctctcccactaacacgtcctgacagtgtgctcctgtccctctatctccttccgctgccccaccacttagccacctgtggcgacaaacaga

SEQ ID NO: 37829 - DNA, 1501 bp, Oryza sativa
accagaatcagcctatgtggcagatggatgacctgagtggtcaagaaacgaatctgtgtgattcgggatgtctacgggcatcatagactaggcttcccgagtggaagcggattgttgtgctgctgggcagttggactctgggagtccgagaaaatgaaaaggctctgggagccgcttaatcaagtgaaatggctctgggagccgagaagtaatgatctgacccaggaggtcggtacattaccaaatgagctattgaaaaacatctcttaaaagtcgaatcgagacacaagtctcttttcggcacaaacttagaaagaagtagaccacttagtgatttcaaaatgatttcaaaacaatagatttgcaaaacaaccttgcctctcttccaagcttgcattaaacacctaaattcccgtgacttgctgagtacgaaagtactcacccttgctctataaaaaaatatatatatagttcctccatcttgaagagaagattaagtgaagcgaagattagggtttcgtcctggtttccagccgtcgcctgtggtgttgggtgttagtccgttgtttccgctgctgctgccgttgttggtgttgcctcgtccgtgtcgtcggttgtaatctcgggctatcctgagctgcaaccctagttaaggtaaataagtcatttatttatttcaaggattgcaatgatttatatttgtcaccgtgggtaccagcgctatgtcctgggattggtactgagatcgcggtctcgtaggaagcggttctcaccgtttttccgacaacacgcccctgttaggtaccgttgtacggcggtgccggattgggggtgacagaatacttgtaagggtaaatttttatcactaaactacccatactagagtatcactggccttttatatcatcccaagatcccaactagtcgacaattcacccatccctaaggagacaaataaagtatttttatctctctccttgatactcggccgagggctaaaactggctatattgtgggacagaaggagtgtactactttaaatgctattccatccgtctcattttaagcgcaatcatgagtttctttttccaaatttgattgttcatcttatttatttattttatgattagtattagtattattattattattattatattattattattattattattattattattattattattattattattattattattattattatatgataaaacatgaataatactttatgtgtgacttatatattttattttgttaaaaaaaataaataagacggacgattaaagttggacacgaaaactcatgggttgtgcttaaaatgggacggagggagtaaaaattaggctcatatggttttactagcatatgtcattattgtaatattcatgagctatcttatgttccattatctccctcatgtcttggccctggttgaatcatcttcctcaatcgtaaaaccaggtataacgcttctcgcatattt

SEQ ID NO: 37830 - DNA, 1151 bp, Oryza sativa
aggggagtaccctgctgccctggtcacactagcagctcacagaaggagaaatagagagaaggagcaaggagagtagacaggcggctgccaccggtatgaataagatgatggtggcatactggcatgcaactaggatgcattgcagatagctagcattactgcactagccttgggcttgacattgaggaattgaaaacttcaatgtagagcaggtaaagcatgagagattgacaggctatgagaagagcataatccttatgcatgcattagagcttggctcaatgcggagcacgagccttaggcttgatctcagttcgttttaggcttgagccaagcccagaacaagctgagctcgagtagctcacaagccttaagcaaagactgttaagtgccctcgagttttttttacagccttagcagagtactaagcacacaagtacatactccatattaactaggaaaatgtggtatagagtgaataggatcggtatttctgtactcatctagcaagaaatgccacttagtttctacagaaacatgtgcccttgtattatggggtggccacagaagcagatggccagaatggtaataaatttcagcagtgtatgcttcagcaaaatcttacagcatggtatttgtcccgacaatgctaatgatagaaatctcacaaaaaagttgaacaaatagaacggcgatgaggttcaggacaataggtgatactgtaaagagcggttcaagaatcaattgtacgtcacacgctcaaactattggagaaagaagggaaaataaatgagaaacatgaaggtgttaaagctcaattcctagtttctgatttgttctgatgagactcagttatctcccttatttatcataattcctatgtacaaatatggaaataaaaaaaagcatattgctgttgacaaaatgcagagaaggatatacttttgtgctgaaaaatataatctgacaatactccgagtaaccaacacattacattagcatctgaaagctatatataagcacctcaatgtaaaattctagtcaaaacaagctttgcttcatttatgccaaacttgcagttttaaaagttaagctaaagaaatgcctggcatacatcaatgcagaaggtcatagaagccaaaagatgttac

SEQ ID NO: 37831 - DNA, 1501 bp, Oryza sativa
tcgggtaggttaattcgtctaagtacaatttctgagctgtaggagttaacaaaagagggagttttaattcaaggagaaagagctgggagaaggtaacccgtgggaaaagaagggggagcgtggccctcactgggattggtgatggcgtggagcacgccgagcacgaggagggagtcgccgccggcgcggaggatgtccccgcgcgtgaccaccgccctgagcgccatcctgatctcctcctcccggtggtccctcgtcgcgtcgagcgccagcaccaccatctgcggcggcggaagcagcggcggcagggccgcgggctggaccgctgccccgccgcccgcagcggcgctcccatcggcagcctccgcggccaccgacgacgccggcgtggggtggtcgtccccggccgcgatgaccgagtacatcgacatgggcgtgctgaccggggtgctggtggcgctgctccggtcgtccccacgcccccgccgccgccgccttcccccatcgtggccgcccgggagcgaggctattagtaggccgaggcggcggcgcgcggcggagtatattcgcgacagcgcggagtacatcccgccgccgccgccctgcttgctgcaggcgcggggggcatctcgaaggcgccggggcgggatatatggtggggcatctcgcgggcgatggcgacgcggggggttctaccgagggcgcccgcggcggcgacccgcagcaggttgcggttgtcgcgttcgcgcgcgcgcggacggcttcggcttcgccggcggaggcgacgagacgaggcggcggagaggagcggagacgaagaacttttcccgttgccgtcggccggacacggcccagcgactttagggcccattgcgcgaagactatccgatcgctcgcgctgagcatcgtaggccgatttagcaactaagcccatcccttcgagaaaagaaagcccatgcacgaaatataataggcaacattttggtgtcctctgttatcgattatcaacgtgggagtaaatccgacaattaagtgctctaatacctcttcatttgtagagtgtgcagcgctacccatcaaacatgggtcacccaaatcacattgagatatgctctatcgtaggtttaaccggaattaaaactttagatactggtctgcacaatctaaaaaattagtctgatgggtgagaattgtttttaccttttagtcgtgcttctccatcatcctataacggtataggactaaatccaacaatttaatggaaatggaagatccgaccaaccacgaaacaccaccgacggagaatcataccaaagcaaacgagtcagatcgtaaatcactataaattatagcagcagcacgtgtggataggtgagaaattgctgcaacacggacctgacgaccagcaatcgtggccagtttctagccatttatggcctgtgattaatacagtgtgtggccgaactgattaagaggtgcagccgcctataaattcagccta

SEQ ID NO: 37832 - DNA, 1501 bp, Oryza sativa
tctaaatttgaaacttgtacacaagggttcaaggagacgaggaaggaaacaaagcgggtgtttgatactttcgggaatgggaacaattatttggagaggattcaaaggaagggattgactttcggaatttgatttcggagactcgaatcggaattggaatcttgaggtggacgattttgatggcgacgagaaggacaaggagattaaattgagatccacggcacgacttagactcgcacacaaagaacgaaaaatttcgcatataagattttgccgaattagtttttttaacgcctcacgaaaagcggagcattacatattcgatagttatatttgaaacagcatctgaactctagaaattattatatttttgaggcagatacaatatatatctctttaagatgaccacttaacataaccagttataaatgcttcatttcttctgccactttaggcttgtttggtagagattcaacttctaaatttaactttaagagatgtatctagagtgaagttgtggagcagtctgaaaccacgctccatgtctttattttgtgagagtactccaacccactctaattccttttttggtggaacattggagctgaaaccgttgtttgtgctctagctgcaaaagaggtagagctagagttccgctaaaaggctctttatctgacttgttcagctatctgaaaagcatgtttgatttggcttaataatacgctttattttttttcgagagaatgcttcatttgttacgctaatatcacgtgaagataaaagtgccttcagcacttcagcttgcttgcgatccgtcttacaaatgtgagtaaactttcagtaaaaaattagtgaatttaccactggtctttaaatacgtgagcataatgttcgcatgatgttcatgagcatatttcctgtaattggtaaaaaagaagtcatccaaagcacacactggactactcgagtgtactagtaacacccgaaaatagcaggtaaagcacatccacaaaatccatctcactctgtccaaattttcacttccagcacacacgccgcacacgcgtacacccaagttgcctcgatgctaagcaagacgagtccggtgagccggtgaggtgaggcagccaaagtagtagtagcggccaagtccacaccgagacatcacacaaacatccccgtcgcgtggactcgcgaaccccaattcccctctcccctcccacccaacctcgccgtcgccgtcgccgtcgccgccgtctccgccgctcgatttctccccgccccccacgcagtccagagcggatcgaatgcgtggccctcgccgcccgtagcctaccccggcccggaacggcgagcgcagccagtccctcctcgccgcatccggatctccgcatgcgccacgtccgcggcgggatctagcggcgtcgcaccccccggaggttgtagaagggtttccgggatttgggggcgccggggggtatggcgactgaggcgtccactt

SEQ ID NO: 37833 - DNA, 1501 bp, Oryza sativa
tataaggattgcatatataagttgaaataacacaacccttaggtgccatatgaaaccagaaaatgcccaacatagtccgtgggctgttgtgacggcgatactgtctccgttttataaaaaactaacctattatatccggtagtaggttgattttttatgggatggagggagtacaaccgtaggagtattagtgatctatgacctatgtcagccatgtataaaaaataaaattaaaaacatctttcgtgggttccccagtgcactcattcgctttgtttatgcgtacgatttttttttccctctcggtaaggagggctgagcgaaggcgttttcgtaattttctctctcgatggaatcttcctcccttctatcttatctaccctgctgaaatgcaaaaccagaagtccaaaaccattcttttcaaaaaacagaattccaaaactgccatgcccgtatggccacagccggtgccgccgtggaccggcttctacggcggctagccgcagatgctggtcgtttgaagctgccctcgagcatagacgaggatatggcgcaggtacggcggaccctggcaaggttgcaagatgtgctgctaagcgtggaggggaaatacttcaagatgagcatggaggcgcaggaatggatgaggaagatcaatcagatttcctatgacatccaagatctactagatgaatttgaggactgcagtgaggccggatctcaaaggggcagttcctggattgcaaaggttcgtcacaatcctttgaaaaggggtaacccccatagtggaatttcgttttcagattacgtcctgatttaagagattttaagtccttttaccttttttcctttagaaaaataactgtgtcaaatgttcactattaattatttcatccttcaacaaattattgtttattttctgtacaactggctgtgcaaattacaaaagttctactgctgatgacctgaaaaatgcaatatgacattgtttcagtattatagctgttcccatcgttcaagtgactaatactttacctgtaaaagtattgatgtctggagtatttcttatgctattactcctacagttctgcttcatccttctatggccatgcattgtttacttcttagctacgcagtgtcagtgttatattgctgtatccttttagcaagggttctttctatgaccacgcattatttacttctagctacggcagtgttagtgctattgtatacttttagcaagggctctcccctactgttccccaaaatgaatcctttgaaatatgattatcaattgaaattaactcactaaaactacgacttcaatgtataatttgcaggaaatattgttgtgttcctcaagtccttgtttctttaatagtagtagattgcaaagaataaggataatcaaaagaaagttagatctgtcaacagaagattctgttgtattgagtttaatgcagcacagtccatccaaccttaagcattgcaatgagccagt

SEQ ID NO: 37834 - DNA, 1501 bp, Oryza sativa
aatcgattgaggggaaataatctcctcgatctcctcttccttttctcttatagaaactccgatcaattccctttggaaataggcggattcgagtttaattcggattcgtttttcccaacctttccatcccgccgccggtcgccgtgggcctccgccgccgcctccttgcccctttaaaagcacccccggtgtctccgctacccgccgcctctctcgccttcgcccgccgtcgtgtgtagcgccctagcctcgtgagcttttgcgccgccgtcgccgccgttcgttctgccgtgcgccgccgtcgctacggtcgtcgtcgtcactcgggaaggccaccgtcgggatcgccaagtcgccgccgtccccgtccactgtttcgcccccgccgaagaccgccggagcaccgtcgccgccgtcgacccgatctccgccgccgcttcttcctcgtcgccggcgccgtccgttgcttttccgccgccgttttggtcaccggtgagttcgccgcgttgcgctctacccgttggtgccttccgttcgcgccgccgtgccgtcgttcgccggcgagcatgcaagcccgagccgccgagccgccgccgccggtggtgacgtcatcgtcgccctctcccgtgagccggtcgtggaccggttgatctcggccgtctgttttggataggatcgatctcggccgtccgtacccgtgaaccgttgccgtgcgctcggtccaccgcaaaccctagccgctgacgcaataatctttcttttccttttcaaaaataattcattattgcgtcataattcaataaaaatccatataagtgttttaatccgatttaatctttaaaaattcataactaattcatttgaactcagtttaatgtggttcaagttgaaaaattatataaaataaagatctacatattaaaattgtccataaattgaattaaatttatttaattctttttaaatgggctttaattagatttaatcttgtaaaattcataataaattcatttgaagtcagaatgaggccgttcaagtctcataattcatctaaaatcatgacctacatgtttgtttactttatatgtattgtttatttggtttttattagtctttttcctcgttttgcgtgatagcttgtcgtttccgtcgttgcgaaggttcgcgagtgcgccggaagtattcgagaagattaattgaagaccgattattgcaaggtaagtcacacagatcctaaacacaatcctttgagcatgttgatcctatatttaaattctctatttatttcaactgtgcatttattttcgaatgtcattgggtggaattaacctattctttgttatggcccttttgatcttgattactttattccttgataccttgggtgattataattggactagttgagctttatatatattggttcaactagatactagatataattgcttagccatgcttagaaacattggcacactattgggataacttatgacttact

SEQ ID NO: 37835 - DNA, 786 bp, Oryza sativa
agaaatctacaaaaaagttgaacaaatagaacggcgatgaggttcaagacaataggtgatactgtaaagagcggttcaagaatcaattgttcgtcacacgctcaaactattggagaaagaagggaaaataaatgagaaacatgaaggtgttaaagctcaattcctagtttctgatttgttctgatgagactcaattatctcccttatttatcataattcctatgtacaaatatggaaataaaaaaaagcatattgatcactcagtattggatatgtctacagctatatttagctggtgttcagagcactattatgttgatgtacattttagctttctgctaacaatttttgtactatttctagtccaaagtagagatctttttaataagccaagtctatataactgtgtgagtggagctaaaatgatgagtatggtgtagtatgaagctttgattgggatgtgaaaatccatgggtggaatcaggtgcatggggtctatcaagaaattagataattattgttagtaaacattttttaagtgttcctctgctttgtccagtaccatggtatattgtcacattgctattaactctaagagcaagataagggctaaagatcaaataggttccagcaatgccaaatatttcaccatgttacaaacaccaagatcgattaaagtttctaagtattttggtttgttccatttgttttttggcagcttcagtatggtttttgtgaggtaactttttattgaatttttttctttacattgccagatgtctaatc

SEQ ID NO: 37836 - DNA, 1498 bp, Oryza sativa
aaaattacaaaaggggctgtagcatagcggttacagtgctatgtagcacctctagtcctgggtttggctcccaagggagcaaaattttggcttaatcgaagaaaaaaaaataccgtgggatctccctcactttttcctgtaaaaaacattttagaaaattagtgcatacaacaaatgtagagcgaaatttagaaatttacataagaatcttttaaattaaaataatttagagaaaacgactagcgcgatccactaggtgcgttagcggatagctatttatggcccagacctataggcatctgcataactgcattccctcttaagaggttaggaaggtgcacaagaaaagaaataacaaaattacttaggggtgtttaaatccagtggtgtaaaattttggcgtgtcacatcggatatacatacacacatttaaagtattaaagatagactaataacaaaacaaattatatattccgcatgtaaactacgagatgaatttattaagcctaattaatctattattagcagcgccacattgttaaattatggactaattaggtttaaaaaattcctctcgcaatttacacgcaaattatgtaattagtttttttatctatgtttaatactccatacatgtgtccaaacgttcaatgtgatagggtgtaaaatttttttatggaaactattttaccttggggttgcaatgaatttgtcgtaattattttttatctctcttctcgtgcctggatcgcagcacatatgcacggtccaatgcgcattagccaaatatatatttttaaagaaaaagtctctataccccatttatctgaaatacaaagaacatatttatatgcattttatgtactatttatttggttttccttatgcttttttctcgttttgtgtgttatgttttgaaaccattgaattggaggacctagagtccttcatcggtgattcacaaccgttcgttgatggcaagtcacaaaatgcacttccttgatactgtttgtaactttatttgcaaacaattttttattttaagggttaagtctgaaattatagttagctagttactccaacatagtcttttctttaacaaggtaagagtggcttggctttaaaaaagctaaataaaaatgttgcttatttgtttatgcttaaacttcttagcttataaatcagtttatataagcctaaacaaagaggtgttattataatatgaaatggagggagtactatttaggagaacatttgttgaaactcttcaaactttaatgacaaatatttttttcaaatgcttagttgaaaagaggcatgcgtagatttgctttggtgaacactatcagaatattataaacctatatatattagaatttacagatttattttaatgtaaaattgatggtcaaagttttgaaagtttcacttttctaaatatcaattattcattaagagaggaagtatcggtatcttaccgctgctatgctcacctagg

SEQ ID NO: 37837 - DNA, 1501 bp, Oryza sativa
gaacaaccatacccggctgaacagatctaactccaaatcaggagctaagcaaattattacccggtataacatccataattattgtgagaggtgtgagactaatcacgaaaaacattgctcaactcgcccataaccgcgggcacggctattcgaatagttttactctggccagaggtgtaccactgtacccacaagacacagcctcaacatcatgtctaccatgcgtcgcgatactggaaagtacccgaatagaggctgtgacaataccctctgcacaacacaactcaccacagtgcaccattcctggatcataatcaccccctcataaaacaaggcatggactccccagcgacccccgtgggcttatctccgccacttctcagtctggtgctccgaaatgaatcatgttatacaaaaggtaaagccgttgcccacgctggcttgtggttggcacggttaatgtttcacaatagtagctcgcgaaccggtccttaattgtcatgagcacgactctcaaaaccatgtgctcacaacccaccattatcaagttttagttggcaagtaattaattaaccaatcacgattgaccatcgtgaactatcattaagccatcattaaataatagtaagtcataagttatcccaatagtgtgccaatgtttctaagcatggctaagcaattatatctagtatctagttgaaccaatatatataaagctcaactagtccaattataatcacccaaggtatcaaggaataaagtaatcaagatcaaaagggccataacaaagaataggttaattccacccaatgacattcgaaaataaatgcacagttgaaataaatagagaatttaaatataggatcaacatgctcaaaggattgtgtttaggatctgtgtgacttaccttgcaataatcggtcttcaattaatcttctcgaatacttccggcgcactcgcgaaccttcgcaacgacggaaacgacaagctatcacgcaaaacgaggaaaaagactaataaaaaccaaataaacaatacatataaagtaaacaaacatgtaggtcatgattttagatgaattatgagacttgaacggcctcattctgacttcaaatgaatttattatgaattttacaagattaaatctaattaaagcccatttaaaaagaattaaataaatttaattcaatttatggacaattttaatatgtagatctttattttatataatttttcaacttgaaccacattaaactgagttcaaatgaattagttatgaatttttaaagattaaatcggattaaaacacttatatggatttttattgaattatgacgcaataatgaattatttttgaaaaggaaaagaaagattattgcgtcagcggctagggtttgcggtggaccgagcgcacggcaacggttcacgggtacggacggccgagatcgatcctatccaaaacagacggccgagatcaaccggtccacgaccggctcacggg

SEQ ID NO: 37838 - DNA, 1501 bp, Oryza sativa
tgctgtggatgatatcgtcgatgttgttgttggagctgactagctgatgagacaatcgtagggttgttcgttggatttctgcggtcttggtcaacaacacattgagttggcaatccttgggcacatggtttgtaccttcgcacagaaaacatgtcaccttgcgggtgggacactcccttggtggatggtcttcttcacaatgagggcagagtgtgagacacctgctagcactgtgtccaatttctccacaacgggtgcatgcctttgattccatctcttcctcgccgagatgtcggggagactcatcttcatcatccgaggagacttgatctgacccttcactatcagacactctgccaccatggcttaggaggtgctgggtcaaccgtcgtgcacctcggaaggtatttcctctttgacgtctaggaatagttatccctgctggaggccattcggtgctggtaatagtcatcttacgtacttcttcttcagttcgcatcggcgcttttctcttatgattcttactcttcttgcctttggcttgcttagtacgtgaccccacgtggtacgaaaggctaggaggaaagcatttcccgggattcaatggattctctccattgggctctctactttgtacactaggctgcaagcttgacttggtgcgaggaggctggtttagcgatgtctgccctgttaaaccaaaggaaggggcttctttggcatatacccatggacaattcagggcatagtgtccttgctctctacaatcatgacaaaaggggacatgctcttctggcattggaagctcattgacctgggtggcaaatgctcgatcaaacacatactgattttggtcttgacttccaaccaatggtagctgtgaactaagcagcatgcttggaatggaccaagggtgtgcccttgctaactctcttgaggccagtggtggattgagttgaaaacttgagtttcttgaggcatacccgctgacattctttcctttttctctgttaaacatctgtgacagggattgaggtgagagaggaaacaagccaggaaagaatagaccagaactagagacaggaccttaaaggaactaactcttcttgttgatgtgttgtttgttttacttattctgcaagttgattaagcaaacaacctagcatggttacatcacaccccactgatgcaaaccacgcgctacacacacaagcaaggaaacacgcgactaacgactctaccctagagggtggcttaggttctgcggcgggttctccaagatcttagcttcggcttcacagctggcttcactgcttcctccacttcgctagcgaatcctgcagccttctggagcttcggcagacaattgacgacatttgcttcttcacaaagctgaccaactagtactagttgaaatctgaagaaggaagaagggagtaaacctttttcaaatagcattaggggaaggagaaaaaaaaaggaactttcgcaaatagtttta

SEQ ID NO: 37839 - DNA, 1501 bp, Oryza sativa
ccccttcctccccttccttctcctcacttttcgcggcaacctcagtgaagtcagcgaggtgatagcgccagcaaaaccctgaacccctccaaccaccgcagccgcaattccgccgccgccgcagccacgttggccggcggcctactgggggtgctggaggcgcgattgatgagccctgcagccgacgccgcgggcagcgatgcacaggctcgtaccccgcgccgccgcctccttcctcggcgccccgccgctgctcaccacccaggcgggcccgcttctcgccgcgcgttcgggcccaccaaaccctagccgcctccgcctccgcctctccccgtggcggctgctgcgctcgaggagggggctctcctgctccgccgatgcggcgaagaggtgcggggatgatgatgccgaggaggatggcgagcagagcgtcgccgggggaggtgggagccgtccggtggtggataggaggcagagaagtcggggcgatgcggcgatggggagcggcgagctgctcgcgattcctggagtcgggccgcgcaacctgaggaagctcgtggacaagggattcgatggcgtggcacagctcaagcagctgtacagggataaggtgtgtgtgtgtgtgaactgtgaaatattagcttgtactccttcagatcgataatacttatcgttttcaacaagagcacggtctctaggaaacaatcataacctttattttctactataatatatatagtatcaacaaatatatactttgattagagtactttttaaaactaatctgtgcatatggtctgacaaatattttagaaatgattcatatccaaaatcataacatcattcttgttcaaaacaataaatattatcaacctggagggagtagtactatatctgttttgttgttgtttattaaacatgtgagaaatatatatgcttagttgtagtcacttaagtcaagtactttgcatgcctttgcctacactcacatacctgtatgtaagtgagtcgactgacacataaggatactgtaggtgttgtgttgcgcttgcaagcaactgtgtgtttcgtggtcattggtgaattattgatccatgctgatgtccaattctgcatcataggagatcttgcattcttgtgctcgctaggagagatgacagaagaattggtgaaattgatgcccgtgttcaacatatatgtcaaattttgtgttgaaactgttttgggtgaaagttaattttcttgttgtaacacaactaagatcctgaaaagaaaaaccttagtgtcaggaaaagaacagagtacaattgtgggttctcctccaggcctgatttgtgatatttatttcattgtggcgaccttactgcacgaatattagatgtctttttccctctttatttatcctaatttccgcatacctgacactgacacttcatgagtttttgcagttctttggcaagtccaatgagaaaatggttgagttcttgcaaagttctgttgg

SEQ ID NO: 37840 - DNA, 1501 bp, Oryza sativa
atgagacatgagctaaaaaaaaagagattatgctcgaaagagaatgatcaaaatgttctcgagcatgatgaaaaaaaaagtattgccatgttctctaaaataaagtgcgaggaggatcatatggaaaaaaatgagtcatcattctatttttttttattttcccaccatctcattttcacttataaacttaggtgcacaagcttggtcatggttatatgattagttatcttcttggatcttacattggactttacaatatatctgatgcaagtatgtcattcttattccctaccctaagctccacataagccttattagaaaggtaggataagaaaaggcaacatcaatgccttggtgagaaataaaacaatttgagtgattcaaaagaatcaaatgaggagtatagtaaaatttatgtttttaagagcatcaaagaaaatcccaaggtaattcatcatgaggagtaaagggaacttgattcgaggaccattacattcttcaatcgctcaagatggcatagtagacacatcaaggttcatagacttaggtatgttttgacatatttggtatgccatttcattaagtagaagtcattgctctagtggattcatgagctttactcaggaaccaataaaggataagtgtgggtatgttgttgatgatcgttaatggcaaactttaaccgtcaagttctgcataaaagatatcaaatgtactatcaaaatttagtggtaggagcttactactaatcacttccactagttttggtaaatatatgtatgcaggttatttaaggagaaaatacacccgacatgcgacgaaaatgaacctccggccaatcatgcgcgagtacaaggattggagggcccagaagtcagtcgagaccgacttaatatgagaccaaaccatcctcaatcaccataggggcccacctgtcagagactggagaaaggcggtggccaggggaggctgccctggttcggccgaaccaaccttggcaccctcggctcccaccttgcacgtggcaagtccccattggttctcaatgacgattaaggggtgttaccaacatttacagccgcctacaaacgttattgacacactataaaaggaggtcctcactcacttggaagaacacacaactttgagctcaagtagagaactcacttgtagtttaatatttagtatgttagcttggtagagagtgagcggaagctccggaagaagtgctccgaaatatcagagttcctccaaaaattatcattcgtgtaaacagtaccatttccctggatcaagtagtctagtacacacgagttcatagctgaaataccaaaagcacatacacgagagtctagtgctaattattacatcataagcccgtaggcattgtcttaaatcatcggaccgagcggtccggaatacatccaaaagcagaaatagataaggcagcggaattcaggcagcggcatgccattgccacaggcaacgaccgtactaagac

SEQ ID NO: 37841 - DNA, 1501 bp, Oryza sativa
agaaacaagaagtcaattgtgttttgaagaccgtgtcgctgtcctaaacgacctccttaatgagtatggagggagtatgatgttgctgcctactccatccgtcctataatataagagcaagtttaataatatagcctactactgcctccaattcatttatagccaattcatataatagttgcttactatactattaatatatagtcccccatgtcatacacacattgcgtcttggagtccgtgctgcaactggctatagatctgtagcccgctgctcttctcactcatcttttatctcattaaaatatgtttgcagctggctaatagtttacttttgtacctgctctaagaagttttagagttagacacggttattaagaaagtaggtagaagtgaatggtagagagttgtgattagttgggaagataatgttggtggagatattgttatattttaggataaatcttgagagctacaagttactccctccatctacttttgacagtcatatttcatcttggcacacagaccaaaaataagcaattctacttatcatctatttaaatatgttactagtcattctttgtaaataagcgattcattaatatttacatttctcgatgcccatgtagccaatcttgtgtggaagaatggagagtcacgcattaaatccaagaaaatcattaagatgataggttgttggattgaaatatgtcattcaaaaataaatttttcagatttagaaatatgactatcaaaaatagatggaggaagtattatattttgagacagagagagtattttttaaggcatgctattccaatagaaacaaaagtaaattttagttaccaccaccaatataggtttctaaggttggttggctaactaccactatatatcaccacgtttagaatctcatgtcgttgtcattgttaaacgaacagccaaaccttaacaccaaaatgtaacattgtcagtctcactttctccggtgcctaaccaccatgagtcattaatggattttatttgctatcggataacccaagcaggagtagtttgtacctacctaccgaaaacacaccacatgctgtattctcgcgatatgtcccaaatgacacaaacggcacttgggacgcccgaactggatgcgcaacccagcaatactttatattttctcacagtctcgctcattataatttccattttagttttgttttatgatctccaattactttttgtaagattctgctaaatcaaatcagaaaattgggaagaggaaaagaatcagatttttggttaatgataaacatcaagaatcaaactaatcaacatcagtcatctccattagaacttagaaaaaactctattgcccaccgtttttttttgtgttttttacaggttttttttccctaaagcctgctgtgctatatgtactggccctcctccagtggcctgagaaaccggaacgcgcgtgggccggccggcgatggcgcggccgcct

SEQ ID NO: 37842 - DNA, 1501 bp, Oryza sativa
tcagttaacaaaatggcactgtggcccggttaatcggcacgtccgcacatgccatagacagtgaccacattggcacggcaaggatagtgagaaacatggaaggagtagaaagggcatactagcctgaagtctgaaaaccatacggtctactcattagtttgtttgcattttgccaagacaaaagtattcacgtcttcaacaaaagaaaaaagaaaatgtattcacacggcacctagtttctgtagggtgtgtttatacatcctattctaaattcgtttttttgaaggaggtaacatgtaatagaagttttttttggccgtgtttagttcaccctaactaccccaaacttccaactttttatcacatctaaaacttttatgtacacataaacttctaaattttttttcaaactttcaacttttctcaaactttcaacgaactaaatacagtctaaactttcaacttttttcgctaactaaacacagccttttccataaactgaaaaggaataaatgggtgtcattctaccatggtgtaccagctcctatacataccggtccaactgacaccaaaggactggagtgcgtcaaaagagtactagcccactctttttggcagactctacctatgatgtcccagcttttcgagcatctgaccattttacctctacttccaaagtcccattttactcctactccctccgtctcaaaaataaaaaaaaagacaaacctggtttctgtgtttaacgtttgaccctccgttttatttgaaaaaattatgaaaaaaattaaaaagacaagtcacgcataaaatattaatcatgttttatcatctaacaacaatgaaaatacgaattataaaaaaaattcatataagacggacagtcaaagttggacacggaaacctagggtttgtcttttttttggatggagggagtacttcacatgaatgaaaattcggaggaataggaaaaacatatgattctcacaagaatacaagtgtaaaacagagaattacaaaacacaggaaaaacataagaatgaccgtttgattgagccgtaggaaaaatatatgaatttgaggagagataaagaatcaaaggattcttaacatgaggttctacctcatgctaaatttcctccaaaacttgcatggaaagaggcgtttcataggaatttcataggattctataggattcattcctttgattcaaatggctatataggaaaaattcctatagaaatgaaatactttaaaattcctatgaatttcctttgaatcaaagggggcctaagtgtttcttgtctgatgagaaccatactactcccttcgtcccataaaaaatcaatgtactggatgtgatacatcctagtactatgaatctgaacatatctattcagattgaaggcccctttgaatcgcagaaatgagaaaatataggaatagaaaaaacgcaggattttgataggaatgtaagtgtaaaacagatgattgcaaaata

SEQ ID NO: 37843 - DNA, 1501 bp, Oryza sativa
gcctttgaccgcgatgacaacggcttcatctttgccaccgagcttgcgcgctccatggctgacaccaacaccgacctccacgtgacatctcccactccggcggcgcggcgctcccattggccgcccttctctttgctgctcacggctagccgccggatgccatcggggaagaagcaagaaaaaacaaaaaggaaaagaaaactagaaatatagagagaagagggaagtagtgatgatgacatgtgtggccacatgggcccacttgtttttttgttttgtttgtgtaaccgatatgtgggccccacatattttattatttttccgcattgaattgccatgcaaacactatgttaatgccacgtggcaacgaaaaactagtcaaatgatccatgtatgcgccacgttagctaaaaccggagtcaatactgatgaggaaactcgtttgtacagttttataagttggaagatgctttgtatcctattttctagaccgaggacaaaaaaaaatcatattggacgataaattgagggacctagagagagaacttattcattttatctaaaagcttcatcttttcgcttatgcttatgcttatcatgcaaaatttgatttttttaaccttaaatttgtagttgattttagggttttctcattgaagtttatttttcagcctttacttttagattgctaagaacacatatataaaagatttattcacatattattttctgtttgtaaatacactgttggacttatttacataaattcactcatgtcttgatccctgctgtgccgtgatcttccttgtacacacatgcacatctctcactcaactcaacttactcagccttgtttatactactttctccgttccaaaatatagctacctattacatgatgggacattatctagtactacgaatctggactccagattcgtgatgggacattacctagtactacgataatgtctcatcatgtactaggtagttatattttgggacggaagaagtaggtatttaggaagcagtactgggccaaatacatcatggccttgagagcttattagcaaatgggcttttggcccataacttagatgaagtttagtaaaaagcccagcaatatttggatctctccttttttttatttttttatttcagccccctttatccacatccccatctccgcttcccaccaaaccgagcgccatcgcgatgccacctcccgccgtgagcacggcgccggtagctccggtcgtcgcgtcgtcgtcatcggcggcggcggcggcgccccgtagacctcgctcgctccgcctccgcgtgaccccgtacgcctccgtatcctcgtcgtcctccccttccaccttcgccgtctccatcccaccgccgcctccagcgaggcattcccgcaagcagctggtgggcagggacggcgcccccgcgaagcccgcgaaacctcgggtgttcttcctcgacgtcaaccctctctgcttccgcggat

SEQ ID NO: 37844 - DNA, 1501 bp, Oryza sativa
tgcagggcgcgctggactcgtccgccggggaggtcgaggccctccgcttggcgagcgaggtagggcctggcatgcttcgggatgccgtctcccgtctagaccgcgccgggcggcaggcgggcctctggggcgggcggtacgcgaagtacgccgccaaccaggggggcatcgcccagcgcctctcagagatggccgggaccctcaagcggctccccgaggagctcgaggagacgatcaagtcatcctcgagggacctcgcccggggggcggtggagctcgtactggcaagttaccaggccagggaccctgacttctccccgtgggcagcgctggaagagttccctcccggaaccgaggacggcgcgcgcgcgcaggtctgggacgccgttgaccacattgtccacagcttcgagggtacggcccctcggctcgcgttcgcccttgactccgacgaggagggcggtgatgacggtgcggacggcagcgatgacgaggccggtgacccaggcgcgttggagtgagcccccaggcccccgccaatattaataacttttccttcttcttccgaggccttcgggcccccttcttgtatagactgatttattctgcaatcaagtaaagaggaaatttctgcgtcagttctgtttgttgtgtgtatgagacgaggatggtctgtgccgcggtccttctgtgtcttggcttgaacaagggctcgtgcccaggccccagcctcaaacggcgcgggtcggggctagttgtcacgtcctgataaattcatcccgaaataaaaatcattttctaaaaggaataatagaattaattaaaattcgaaaagaaattgacaaacactaaaatacgtaccagaaaaattcgaatgtggcccggagaatttttgttaaattctccttggtctaaaaggagccctcaaattttacttgaattttcagagcaccggaaataattattaagcaacaaagacaattatcaaagtttaataaaaagaaaacctaaaaataaccctctccttccctttggaccaagtctggcccaaggttcctctctctctctcggcccgcggccaaagtctccctctcctccctctctttccctcctctcccgggcctctcctccttctcccggcccactctacctctcggcccactccctcctcctccctctccctcccgggccgcctctccctcctctcctcctgggccgcctcggcttcgcccggcccaagccgagccgcgcctccctcccgtgccgtgcacgtgtgcgtgcgtgcgcgccgttgccgcgcgctgacgacgcgcgcctgaccggtgggtcccacccgcccggtcgtctccttcctcccgcccggcctcctcctctctcctccgtgaaccctagccatttcctccctcaaatccgcttgattcatttggctaattccaaaattgattagggggttttaatccccattgattcctcttcaattccccccaatttcccccttgaa

SEQ ID NO: 37845 - DNA, 1501 bp, Oryza sativa
caatccttgtactcgcgcatgattggccggaggttcattttcgtcgcatgtcgggtgtattttctccttaaataacctgcatacatatatttaccaaaactagtggaagtgattagtagtaagctcctaccactaaattttgatagtacatttgatatcttttatgcagaacttgacggttaaagtttgccattaacgatcatcaacaacatacccacacttatcctttattggttcctgagtaaagctcatgaatccactagagcaatgacttctacttaatgaaatggcataccaaatatgtcaaaacatacctaagtctatgaaccttgatgtgtctactatgccatcttgagcgattgaagaatgtaatggtcctcgaatcaagttccctttactcctcatgatgaattaccttgggattttctttgatgctcttaaaaacataaattttactatactcctcatttgattcttttgaatcactcaaattgttttatttctcaccaaggcattgatgttgccttttcttatcctacctttctaataaggcttatgtggagcttagggtagggaataagaatgacatacttgcatcagatatattgtaaagtccaatgtaagatccaagaagataactaatcatataaccatgaccaagcttgtgcacctaagtttataagtgaaaatgagatggtgggaaaataaaaaaaaatagaatgatgactcatttttttccatatgatcctcctcgcactttattttagagaacatggcaatactttttttttcatcatgctcgagaacattttgatcattctctttcgagcataatctctttttttttagctcatgtctcatttggcatagatcattggagaagagaccacatatttttggagtctttatttggtggatgcatgacttttggtgtagaagcttagcatatggaaatgaatggaaaaattttggataatcctacagcgtatagaaagagcaatattttttgtggctaaatgcacatgactttgttcatgagaatatgaaaagaatctaacaagaatcacaaccacttggcaaaattcaaaatgatagcaaaccaacatatgtataaggtttcatcattgagatcgatatatggctttggtaggaagggaacatcatgaggagtatgtaaaattatttcattttgtttttataaaatttccaagggttcaacatcaagagcaaggttcatatcatcagactatctctcattaatcaataacttagataacatgtggtcctaagaatatgattcacaagcaacaggtgtgtgcaggaaataaaaggtatgtaagtcattttaccagaaaagtcagaaattctagttgatcatgtcaatacttattttaaatcttgagttaattatactggccattttattctaaaaggtttgtcactgtcacgaccggaaataacccaacgggagttccttacgtgcgtgcattattccttgtcc

SEQ ID NO: 37846 - DNA, 1501 bp, Oryza sativa
tcaaagaagaagaagctcctctacagatccaaggtcaagagcaccagtgagtccgtttgaggttgcagctgcctgatcaccagattcaccacaatggcagctgaactcattccctgatggaagagaaaccttttggttttggttctttaatttattggttttgctgttttggttcacattttgtatttgtttaattaaaaaccaaagtgagcttgtttttgtgatagttggaaggagagggttgatatgatataatgacatcgtgatggtttgttgagggcagaggacaaaaattgtggaaggactgaagaatatctgctgctttgtatatctgtctgtacattgcatctctggattctcatggacatgttaaatttagaagtacttgtcatcattcaccaatccatgttaccctttatatttctcctcttaatttccttgtctctcagaatctgagggaattatataatcttgatttccattctctaaccttttgcttgcccatttcctgcaagtaaggatcaattgcaaaatgatcatggtttcacttgcaaaatgagaactaccctccatccatttcttttctgtatctcctgttgactgaaaagaaaacatgttttttgacttctcccttttgtaaattacttactgcctgacttgccttaaacgaacaaacagcatgaggacaagatgtgcaggccaagcaggaaagcgattaggcatcttccaggtgtttgtgctgctaatgatggccataaactaagcgtgggtggagcaacatccagaaccttgttccaaggctgtcatcgtgtccctcaaaacaatccgccagcgccaatcagccacaggagaaacagctgttgcagataaacaaggcaaaagaacaatgcagcagtgcaagaaactctctcctctcctcctttgaccacgacagcaaaggaaagaataaaaaaaacatagggccaaaaggcctcatatccagtttggccatgtgcagtgcaagggagctttgaaaaaaattcccttggaggacgagcagaagagagctttcagctttgtgtgtgtgcgcccgggcattccggccagccatttcgacaggtttggttttgagtctcaagtgttgacaccctgtgtgttgccctcttgtctttgcttgaaccaatgagactggctagaggcaaaggtcccatacctgcatggctgcatatggctgtgtttttaatggcgagaggaagaagaagaagacgacctgatgattgatgattagtggtggcaaggcaatggcatcgacatgcaccatttgtcatgtttgacgtttgcgtgcccatttattcagcggccacaggacgtgtctccggttgtaagaaaggttgccagtatcaagatactactaggtagcatcgttttgcttaaatagtatcatatcgtagaatcatatcggaatattatgagattttctttttttacgtttaattaatacttaaattaattgcatatagcc

SEQ ID NO: 37847 - DNA, 230 bp, Oryza sativa
aaaatgaatgcccgtagcgatgattaaccagcgacaaaataaatgctcatcgtcagcattggttgatttggctccactgctaaatccaacaaaattccctcattccacacgacggttttttagatttacttggaataacatctagccatacaaatgtgcagagaatactatgtcaaaaaaaaaaaagatgaaaatgagacagctaacatttcctttattgccacggcagt

SEQ ID NO: 37848 - DNA, 166 bp, Oryza sativa
atgtccaccccttaaatccaagattccacaccaagtaggaaagaaggaaataattttaggaattgaagaataacaggggatcatacagcctttaacttgtcccaaaaaacaagcccaacgataagatcactctactgcctaacctcctaccgtaactgttcatagg

SEQ ID NO: 37849 - DNA, 1501 bp, Oryza sativa
aagaaaccaaaacaaagtgccgctacgtttaggtaattgcggcatcggcacatcgtgttggattggatgccacgtcttccgcgccccgcccgtgattccgcaccgcatcaaccaacaagtcgacccgtcgccgagtccgagactccgatcgccacctctcgccgtcgctgatttgacacgcaaccatgccagagtgggcgaataccatgctcctctctcttctcatgtgaggttgcaactcatgaactcagcaaagaggcggttgatctcttggcaccgatttctatctccgcggtgagcactaggtgcaaggccgaagcagtgctggcagcacctacaagtctccaaatctgcaggtacaagctcccgtgttctctctctctttctctttttcatatctcctttctacaatctgcattgttcttgcctgaaatccatgtgctctgctgtaatatatgcttctactgtgcaatagtaatacaacaccgaccagaactaatgccaaagagatcatagattcaaagttgatctcatgtcgctgctaggtaattcggttctgttttattaacgtgtgtgtactgattcggtgaaacaaccaccgagttgatctactgaaatgtagtgcttgttgatctgctgcagtgcagtgctaattgatctcacccttaaaatgaaattaattggtgtcgaaaaaaagaaattaattgtttatatgtacttctatacattttgtgagtcggaccacctataccctaaattttagatacatcactaatcacgttgcttcgatgacacctccttcttgttccgccgcctaacttccccctcttcctcctcccccaaccccccttcccccctaaccccaacctaagatgctaaccgatcggtttgccaccatcatgccgaaatccccattatctcatcggagctaaagccaaaatccccactattcatcttcctttgatctggtttagttcctaaaattttttttctcaaaaatatcacatcgaatctttggacacatgcatggagcattaaatatagataaaaacaaaaactaaattgcacagttcgcatggaaatcacaagacgaatattttgagcctaattagtccatgattaaccataagtgctacagtaacccacatgtgctaatgacggcttaattaagctcaaaagattcgtctcgcggtttccaagcgagttatgaaattatatttttcattctatccaaaaaccatttccaacatccagtcaaatatgcgatgtaacacacaaaaattttcttttcgcgaattaaatacacatttctttttttttttcaaaaaagaacatgaagaaaaggcacaatgatgacaacagacagtttcccacagaagatccaagacgcctgccactctaaactaggcaaaacacctccgaagtctcagctcagcttctcccctcctcaaccaagcagaaatggcggcttcttgcgcgctcaccctcccctccgccatct

SEQ ID NO: 37850 - DNA, 1501 bp, Oryza sativa
ggcctctttccggtatgtcgtggtggcatgccggcgcacggaaacgtgtcgtggggctgtgtcttgtgggtacagttgtacacctctgatcagagtaaaactattcgaatagccgcgcccgcggttatgggcggtcgaccagattcaccgtgattagtttcaccctagttagcttttggaactggttagttcaggtggtggtttgggcctgttgcaacgtggtgtaacgttggacagtgattggttaatatggattaattactacaactgttttactgctttcaactactgctttgaaatgccggctttatgcaaaagaacctttagcctcccttggatatatcttgcatcatacctcctcttccggtgtgacttgctgagtacagtgggtagtactcagtcttgctctcttttcccccacaccagagttgaagtccttcccagttgaagatgtctcgaagaggttggtttcgtcgctgccgtcaaggattgcctgtggaatggagtcgcccgctgcaggagtcaagtcttcaggcttagctcgcttttatctttttccgctgcatttgtaatcttttatatttttgtaagacgtggatctgtatgtcaacaattgtcgtttgtgtaccctggctggtcctggacaggggtttaatgcacattcagcttagaaattctggttcgtgaatttctgggcgtgacaagttggtatcagagccgaccttgaccgtaggacaagccaaatggaaaaacctaagagccctctgaatccttttcattgcatatgttctttgcaattggatttgttccgggaaaattgggatctgttcttgtggttcaagggaaaaatcttggtcgctcgtttaagtggggtttttcaaaacaagtcagtctagggttttagtaaaattattgggatttattcgtcagacagttggggtttgatgggtgaaatgcattaggtcctagctctataacatgggttgcaaggtgtttatgcttcgtttgttattattaatatgtatctaatttctcattattttgtcattatgtgagtctgtcttatttattcgctctcatgcaaaatgatctatgcataaaatttcgcttttattcgtttcccttatttgagtcttttattgctttatttaaatttggatttgagcatgcattgattcctatccctctgtactctttagatgtcagacctattctccgatcgcaagcgccgctccaagcttcagagtcgccacccttagctttatcgtcttcttagtctgtttgcgtgctagtttttgtgtttaggtttgttgcttgtgggttagtcggcagtcgatatcatgtgtgagtggtatgacagcctttattaggagttgtgtgcctctttttcagtgttttaatcaagattaagatgattgcacttaatcttataagaaagattagtttccgagccgtctgttttcttcctttctcttatttctacctatcctcctccagatgg

SEQ ID NO: 37851 - DNA, 1501 bp, Oryza sativa
aagtatccttctctctacctctccccttatgctatttatcccaactagtgtggagattatggataccccatatccaactgggtatggggtgccatgtatagatagaactagaaaatcagtgcgccaataggcgcaccgtgcacctactattttggatgtgtatgtgtatgtagatatggtgcattttaacactgttttagttcctttttttttccatttttttggtattaccaatagtagttgtggtatatttaattcccttattctttttttaagttaatgttcttttacttttgactgagaaatataatatgctcctgaaaagaggagcgagcctgctagttagcttctctgaatatgcgtcgcatttgacgatattttaattcctgattttggtgttcgataataaaatagtcacaataaataacacattatttttacaatatgatgtgtggttaaatattaaatcaaaattcaatggcgtcgtctgtttaaaatatagagggtgtgatatttatgtgaagatttacagtattgtaggttaaatatttttcattgcatgttcgataatacgagcttataaacaactggtttgacaagcctgcgttaaaccatacatgcacgtaaaacgttcagtagacccataaatcaaattacgttttagccatgtatgtataattttttaaaagcccatatagcgtcatgattacaattatttgttgaaaatattgaaaaaaaattcaaatcaagtaaataaaggccacatctatccctacctcactttgggcttttggcccacgttgttttttcccatgccagcaaagctcaaagagcacttctagaaatcaccgatgtggaattgtcaaaatataaaaataaaaaaatcttatcctcgatcccctaacggagtctgcaacgcatttccaattatgctcgctgcaccaccatcgttgatttccaatcaaacggctacaggtgggctgcaaatacgtggctgctctagagcccagaatccaggctgagttccgcttgtggtgccacgtggcccaatgaaaaggtaggattgtaaccctgaaatcgtatataagatatctttaagaggactcgggttaaattctaaacttgtatgtcaaggaaatacccaagatcctagtcggttatgattgttttttatctgtagctacatattccgttagggatatggattgttttttgtaatgcagaccccttcccctatataaggaggggtccgggtgtctttaggggcacgatttcttcctagatcatacgatcaataatacactcggcggatcaatccccggacaggagtagagtattacttcttgattaagaaggcctgaacctgtataaaattccttgtctctaaacccatccacttttccagcttgatagccacccccttttagtattgccgaaatcttgtttcgacagttggcgcgccaggtaggggtagcgtcaagttcttcgccgactagtgcga

SEQ ID NO: 37852 - DNA, 917 bp, Oryza sativa
ctccaccttgagacaaattcctccttgtagcgtgaatcaatcctttaccctgaacacaacaaagacaaaaacactttcggcgccaaatagcctcttgggctaaaccactataccaactagacttgagcaaagctcaaacttagcaataggaacatgctttgtcataatatcaacaggattatcatgagtgcttatcttgcatgcctttagcttaccttgcgcgactacatcgcgaacataatggtacttgatatcaatgtctttgtcctcccatgaaacatcttatatttagtgatgtatatgccactttgactgtcacaaaacaagttaatgcaataatcaactccacaaatctcagcaaacaatccttttagtcaaactgattccttacatgcttcagcaacagccatgtattctgcttcagtggtagactaggcaacaacaggctgcaatgttgccttcgaactcacagcacaactaccaatagtaaacagataacctgtcagtgaccttctcttatccaaatcagcagcaaaatctaaatccacatagccaacaagtcccttatcactcttgccaaacttcaatcaagcatcagctgtgcctctgaggtacctgaaaatccactgaatacctttccagtgttctttatcaggattagccatgtatctactaaccaaactcatagcatgagataaatccgtacgggagcaaaccatggcatacataaaagaaccaacagcactataatatggaactcttgacatctattctacatccttatcagtactagcacattgtaaagctgaaaatttaaaacgaggtgcaataagagtactaacaggctttgtattatgcatgttaaaacgatgaagaaccttcttaatgtaactttgctgactaagacgctctggccc

SEQ ID NO: 37853 - DNA, 955 bp, Oryza sativa
agaacgagcgaacgaacgtgaacgtgaaatgcaattataggcaggtgaataaatgtgaacgaacaaacgtaggtgaatgaaacgtgaccttaacgagaacgcgaacgtgaacgatatcgtgaacgaaacgtgaacgtcaaatgcaatatatgttacttcgcgtttatcctaatacatctttttgtatcttgcagaaaagacgttgtcggagttgtccctcaagccagagtggtagagctagccctcgaaggaattcgtgcaggcaagtgacgtaattatatatatgattgttatatttgtaatgcaattaagattattagatttgtaattagacttagcatataagattgtgtagtgttctaatatacgacagttacacttagaatacatgactatttgagttttagtataagattattggagttttaatataagattattatattggtaattagacttagtatataattattgactagctagggtcctataatatacgtcacctagacttagcatatatcactatttgagttttagtataagattattagatttgtaattagacttagcttctaagattgtgtagggttctaatatacgacagttacacttagcatacatgactattttagtcttagcatataagattatttgagttttaatataagattattatatttgtaattagacttagtatataattattgactagctagggtcctataatatacgtcacctagacttagcatatatcactatttgagttttagtataagattattagatttgtaattagacttagcttctaagattgtgtggggttctaatatacgacagttacacttagcatacatgactattttagtcttagcatataagattatttgagttttaatataagattgttaaaacataaatgtctcatgacttagcagatgtttcctgtatgaacaga

SEQ ID NO: 37854 - DNA, 592 bp, Oryza sativa
gtgtttgcttatgcaattactctatgtcataacgatgatattagagtagtatctggtagtttaggcgtggtgtctagactacgggatatcattatttggggttatatgctgtggatgagaggtgggccgctgatggtgacagctcagtacgggtattcctccgcacgtgtatatagtcctaagttaatttcctgtggagggtactactccgtatttagccccggttgtatggtcatgatgggctgtcgtaaggaactcggcagtcaggggtggcttctcgaagtactaggagggcatcggaaagagggtattagctagtaaatcatataactagaatgtatgtataatttgtatactagaagtataggaatagattctttttctattttctttccacttagcttagataatttagtttgagaatgagaagttctatgcttgtgtgtcatcctaccctttgaattatattaacccctgcttagactatgattattacaagtaacataaattattagtgcggttctctctattgtaatcttcccacgggattaaacaaatacgatacccatggaatactctcgggtgaaatgct

SEQ ID NO: 37855 - DNA, 1501 bp, Oryza sativa
ggctgcatatccattcatgagtgctgcagttaacccaaggagaaaggctctggccctgtatcccgtcttcctcatgtatatttcagttggtttcctcataattgccatagactaatggtgggctgaacttgtagtcaatacctaaaccgctgagattttcctcattgaaccaccagaatacatacaggtttgggcagagaatacgcccccttaagaattcttctctgattgcattgtcgattttgttttttaaaggaggcgtgcataaggctgtaagattagtggaaatctatgtgttgtaaagggcttctcgtactttggaccactcaattgactgtcattttcccctctactatacgatgttcaaagtctattgaagctagataataactcctgcagtagtatttctattgtggtctgtggaaccgaaacgcagaggatacggctcctctgtttctgcatgtttttctttttggagatgtgccattatggtttcattttaggttgtcatatctgatcttaatttttgttaggcaaactttaaaaaaacagattttgtgattctgtctgatacatcatttgatttatttgagtatatgttacatgatgattgtgccatcaaatttatattctagactacgaaagggcctgtagcctagtggttataaagagcctcagtaacaccggctctgtgcttttagtggtaggcgacatacccagggaggcgcctgtgatgactttgttaatcttgtcggcgcagtctttgaagatgcttataggggtaggctttgcatgcgtgcgtttataggggtgagtgtatgcgttgtactgtgtaattctaaaaaaaaattatattccagactgaaataaaatttgtaactgacagcctgtttgtcgaattatttaaggctcgtcgcggcgtgaagccgatggctcgatcaatacaggctttactgtagaagaacgccatgatatcattaacagcagcaaatcagcagaagcactgctgatcttctagcacgaaatcaattattaactgtgttccttcccttctttcctaactcacctatctccttttttcacacgcacgttttttaaactgttaaacggtatatttgttttaaagttttctaaaaaaagttactttaaaagttatattaatctattttttcaattttttagggtaatatttaattaatctcgctctaatcgcttgctatgtttttaatgttaaggaatctggcctcccgcagcccgattagtttattgtggtaaaaccagcccacccaaatttaagttatagacttcacataaatagtatttatggttaattttttagtggcaaatgatgtattcatcggtagtgatttcgtaaatcttaaaatatatctgtccggttttctagagatatttttataggataaaatgtgctctatattcatagatcgtacgtacgcgatgagcgcatacgtttatacgttttattttttttaaaaaaatc

SEQ ID NO: 37856 - DNA, 1483 bp, Oryza sativa
ctaaatgatctacatatttgtgttcatttattgagtctattcgttatttgtgcattggagtaaatggacattgatgcatgtatccatacacacaagtatttataacctacatgcaatatcttgatttgctattggttaggaaatattggggatggtgtatgcatctagtttattgctagagtaaatatagtatgagagagttattagcttttcttggtcttggtgtacctatgaaatatgtagataaatatggaatggagggagtatacagtagtgatcaaacttcttgatttatgaacagagaataagtaatgaagtagaaataaacttattttggcacaagttttaaccaaaaaaatcagttttattttggggtagaggaactacatactatggtgtgaataatttttgtttctattactatcgatctactcccaccatcctaaaatttaagcatttttagtatagtgacaagtcaaacatttttaacttatactattaataacaagaaaataaaaaaagatcaatcatgtaaaattgattagtagatttatcattaaacaaaactatcataatatgcatctctttctattaaaacatcttatttttatagatattgttggtcaaagtaacatctcagagaccgtgtcagagtccaaaaatacttatattttgggacggatggagtacatgatccaacacgatctgagagcttagattttaatttctttttcctccaaacgtagtaatttctataccttcagagtgaaggtgatttatcttttcaagctagctttactgtacagttaactatgtaaacaaacaaattaattaattaattacctataacattgtaaggtgtttaatttttttgtaagtaaaaagtttttttttaactttgatcaagtgtgaaaaaaataatcaacacaataacaagtaaatatactatcatgacatacctcattgtggattttagagaagattgactcagcacaaagctatctgaacggattgagtattgaaaatttgaaaaccggatgtgaacaagtattttaagaaacatagaaatttgtttgaaaaaatcacgacgttttatgagctttagaagcgtgcatgtaacaatctgttagctagtatagcactttcaaaggaagcctttttcaacaggttgagctgtcgctgagactaaatagctctgtgatttcgtcgtgaacataaatggaccacgtcacaatttaaatgtcaagcgacttgcaggtaacagatcatcaaattcgatctttcgatggttcagtcttggtgaaatttcatatgggtgtatccaggtatttttctcctattaaatcctttcacttgcagtataatctttttttctcctattaacacattctgactttgcatgcatgaccatcattatgtagaaagcgttgcgttgttgacctgtaaatatatgccacttcttgttgacttgttgggccttaga

SEQ ID NO: 37857 - DNA, 332 bp, Oryza sativa
ctggacaaaccagcttattagacgcgacgagtagtataggagccaacacaaatttgtgtgagggaagaggttgagacggatagggagcaagtggccgaatcgtgacagtgctacaaacagaatgatttcatagtagtagtgcaacttcctttttccgatgtatcttttttttttttttgcggggtttttccaatgtatcgatcattgttgactttagcgagcgccagcagttcagtacacgcaaaacgcacagctatatatgtgtacgctaatcatccatgaattgtcccaacctcatttccttaaacgcctacgcatagctctcaccatgt

SEQ ID NO: 37858 - DNA, 803 bp, Oryza sativa
atatatagtgctaaattttcgggaagggggaactttcaggtcgcacaaattttcaccagtttaagtattttgccacttccaaagcaaatgtatgatgatatttgtgatatatatagccattttagatggtttaagctttatgcatgtttgaattctgaatgccgatggggtgttcagggcaagttggtagtgtttagttgtttactatactttagtgttggtgtaaggatgttaggatgagatatagctaacttactgatttacaaggttgttgctccatttcaattttgttcttactataacatggagttttggcctgagtattcgtttcatcacattactaagattttgattttacagctcacgctagtcatgttctcactttcttacaacactggctagtcatgttctcactttattacaagactggaaggctgaataatttaatattatgtgcctcagagtttatcttggcatcttgcaatctactgttctcaattgcattagctcggagaattgtataagatatactcactattattgtttacctaaaaaaataataattattgttgtaaaacatctgggacctgcaggtgtttcactgagaaatattcatacagtagatatatactactgcattatatacgcctattttttgctaaaaatataattgttgccaacattgcaatctgttctgccacaggatttggacatagtaaatccacaactgccacttcggattgttctaaagggcaagagcatgtttttgtaagatcatactctgataggttgctcaagtgtga

SEQ ID NO: 37859 - DNA, 621 bp, Oryza sativa
ccccggttggtaacaccaaccgggcctaaagtcccacccctatatatatgtcttcttcctcctccagctgcccgagcaagcttcaaaatttctcaaaaaagagggaaggtcatgccaaaatttctagtgaatttattttggtgattacatacaaatcggaggtgcctaaaaggtttgcaacttcatcctccaatgttttttttgtcatattacatttgtagctatgttttacacacttttttgtctccaaaatttagttgtaagttgatgagagagaaaatttgtgtggggaagaaagaatatatagaaatttagttgatttgctaaagaaggttttataaaatagttgagaaggaaaactataatgaaagttaatcttgaatactagaaaacaaactaaatgaaaattaaaagaagtaaaacacattaaaattagtttaaaactttagaaatagtaaataagaattatttggtgtaatattttatgatttttgtatgaataaagatatgtcattattgtatgactgttgaaacagtttgtaattatcttataattattgtatgagtgttattattgtaagaataattatttgtgtatgattttttttcgactcatgtaga

SEQ ID NO: 37860 - DNA, 330 bp, Oryza sativa
  unsure (1)..(330): unsure at all n locations
tccaccgcgggccacctctctcccccattgccgcggtgccggcttgagagaacccagagagaagagaggagaaaaagaaaaaaaaanagaggaatgtgggacccacaccattttctctcacttacatgtggggccccgcatattaattttaattatttttgctgactaggatgccacgtcagcgaaaccaggcatctatactgtcttgggaccttttatgcacggttttacatagtttaggggtgcacatttctggttttgtggttaaggggcctcaaaaaatcttaagggacggccggtgaacttattcattctttcccctccctcagc

SEQ ID NO: 37861 - DNA, 1501 bp, Oryza sativa
gggagcgacgtgtccacgccctcaaaacgccaaaccttgctctctatctttcccagtcacatcgccacacctcactcaccattcctatgccaagagaaccgagggagagagctctagctgctctcctcgccttcgatctcaccgccggccgtgatgaagacgaatcttcgccaatcctatctcttccacgttccatactctcctcaccatgccgaatatttctccttttgatttcatcctctctcgtgcagccaatcgacgggaacgctgccgtgcccaccggagctctggagcgcgctctgcgcaccgccgcagcgacattgtcgccgttccggccattgtagaccgtcgtaggctgagccacagcaccaccaacaccttctccacatcctctccaaaaaccccccaagaattcccaagaatcgtgcactgaggagggagattgactccctcttccccaattccagccgtcaagctccaccttcgatttctccctctccggtgagtcacagttcaatttctcgggcatgaagctttcctgagacctattcaacaccgtgtgtgtagctaaacatctagatcaatgctctagctccacatgcaccgtcaccggagaaccaccgcgccgctcgcgccgccgtcgccattaattccggtgaccaatgcttgcaagaataccacctatagcctcgccttgaacccctttacattttctccttaggttgcacgccgagatctgccgccgtttgccgccggcgagctcgagaacgagctcggccatggctagctctgtgtcagctcaaaccaaggacctcacttgagaagaatcaaaactctaggtactagtttgtaaaacctatctcacacacaaaaaacctacctgatcagatccactacaaaagaaattgatggtaagactacactataaaatatcatctcaaagattatatatcatgtgtatatgaatttggtggtaatatataatactaacagataaaagaattgcatagaggtatagaaaagaggaaattgagggccatagacatccttattattcctatattgtgatagtaagttttcagacttccctatctaataatgtcgcatcccaatgtttgcctatatgaaaatatatactccctccgtttcacaatgtaagtcattttagcattttccacatttatattgatgttaatgaatctagacatatatttctatcttagattcattaacatcaatatgaatgtggaaaatcaatatgaatatggaaaatcaatatgaatgtggaaaatgctagaatgacttacattgtgaaacggaggaagtacatgtatattaagaaaaaaaagttcggctgcagcagaatatgcatgacagactgacagcactaaagaccatatgagaacatatactactaaggttgtgtttagttcagcgcaaagtttggattttggttgaaattgaagatgatgtgactgaaaagttatgtgtgtatgacagg

SEQ ID NO: 37862 - DNA, 1501 bp, Oryza sativa
aggattcgcgctgttcggttccccccatctcgcaggtcaatgccgccggctcctcctgctccgcctacctcgcctccggctgccgcgtctacaagattgaggtgaggaggtcaccctcgtactggctcctcgttcctttctgttcgtacaactgtatcgcggcaaggggtcacgatttcacgaatgctgtgggatcaggaattgtcgtgcgggctgtctagttcttagtcgctcttgcaggttggcgcaggatggcgagagaatttaaggacatagctctcctgttcgttttggttttgctggtggtggtagttggcgtgtaattacatttgggaagtaatttgatgcggttctcaagtttgattcccatttctctttcatcttggagctgaacagatagccatggagggtgagatgttgtccaagggcaaggagagcctcttgattcctatcaatgcagaggtacaaactctaggcttccatagggacttccattttacgattttggtccttgattgctctcttacattcagttgctaaatgaaaggtcataagctcgtcagtggtggatcgctgcccacatcgttcagagatccagagtgtagttcttgcagagggtgaaggtgcaatcttcagtatctcacaacaatatagaaccatctcttatttcgcagattaaaatgttgtagttcagtagttctgctgttcacttaacataacataggctgaaatagccatcaaaacctgttatgaatgtgttgatatatactcttctgtttgagttggcatattccgctttgcctgctgaaactatggcttacaaagagcataaacaacgaccgtacattatattgtactccctccattctataatataagacacaactactttttctagatgttccataatataaggcatacatgcatgtaggcaattaactattaccccttctccattaaattattacttttttaaatcctccactctcatgttctctaattctattggatgcatgcattgtatttattaggatgatccaaactacaagataataattattttcttggtctttgggttagggtggttatgccttatattttggaattgagggagtatttaattatattatatcttgaggaaattttatagtaactgctcttgcttcaatataattgcttggcaactagtactaattttcaccaagcactgtctcatgcgcctgtaacttcctagccatttcagttttagtgatctgtcattttaattttagcttgttggatttgctatacgagttgactatttggttggttctaacttaggtttgtaaatgcaattgccagtcacaggcactaggcaaagtactagaacgatatatacagttatacacaaagcaaggttgttaagtgctgaggataaaattatatgtttatattgtaatttaccgaataaatttatttatcaattccaattcggctttcagtttgttcttcttttagtctt

SEQ ID NO: 37863 - DNA, 1353 bp, Oryza sativa
tactttttgcacgaaattatttaaaactttaatgaattttgattgaatttgaataatttgtgtccaaattcacaaaaaaaactgaaaatttcatcaagataggtgcttgctgctgcagggaagggggggggggggggacgatattaccgacattttgaaaatttggaaccattagaattaggaaaaataacgcatttctagcatgaagtccaattgaataattatagctttttgaacaaatagattacattgagtattgttcttacttatctctgtaaacatagcatgtaaggtaaatttatagatgtaccatactaaaatcaattaccaattcaaccgcgatgcaactataactaccctatttaaagtccgatttactattgtgcttttcagcgaaatgatatataggttacatataatctaatattatctttttcttaatctttttgcgccgcatatatacattgcaggtgcgattgcaagcggtgattgccatcatcctgtccaccttcgcgggctttggcgtggccatctgcgccaacgccatcctcctccagatcatcagatggagggccaggcgggcatccatgtcagcagcacaggaagaagaggaagctcgccgtgctcccacacaggcggacctcgagaacgctctacctccaccctagtccagcttggcagagcccagtcacccccacctccctttggtttggtttgtacatatatggtaacatacaatttaatacacatagtagcatgcgtgtatattacttgttaccatatagtaccccctccagtcaagtgtatttgacattgggagtatatatatataatactcccaacgtcaaatgtgtacgtgaccggaagaagtaaaataggtagcttgtttgtctaaatatatgcctggccagttttgttaatattagaattgtttgtttttgtctttgcgaaatcaggagttatgttttattaatgagtagttggagtacagtcctttctaagcataatacacgaaaatccaagaccacaaattaagctagatacgccatttattattattagtaggctagtagcctctgctttgcacatagatgagcaacaacattgcacatttgcactctatgtgaggtgaaattcaaggaaactccgaatgagctccacaacatcaatggaaatcgctgaggctttgttacgaaggatatattctattccacgttgctataacaagcattgtgactccatgtacgacctaggtcgggtcgggcaggagagaggagcagtggcgtgcggcgcggcgatggggtagaggagcggtgcgacttccacctcctccctctccgagcactcgccaac

SEQ ID NO: 37864 - DNA, 1501 bp, Oryza sativa
gatcagatgtccatacttcggtcgcagagaaatcctagacctaaagatcattggtcaccttgagccatgtactaacacttccagaatctctctttttttaaaagaaaaaatctggggtgccagtttgcaacatctaataatttataagagcttcaaaactaatgtcattgttccaacgctgtgccatgtaatattgcatttgaatcagaaaattgtgttcttgctatcttgcaagttcaaagttgcggcagccgacaggatggtttcgtgaaagcatgtgcactagggacattctgttcggcgaaagtttgggactactggaaaatcggccgttttactttacaaatgcgtagccgcaagaaagcgtacgagtcatcgccttacatctctggtcgcaccaaaacccggcaaaccagaaaggggcaagtgtggtgtaacccaactttgttccacactagatcagcaaccggcgctccaggctctggcttcgattcgtgaacagcaacatatgaaagaacgtgtttcttccaagcactacaaagctttctggtttaaagaacctcctgcaaaaatcgcattacagataacacataagcgaagaaagagcaaaaacaaacaaaatccttgggaaactgtttggcacataagcgaagaaagaacaaaaacaaacaaaatccttgggaaactgtgacctattgactgtaccagtatccttttgcaagatggacgcagttcgggagacgtttccagcatctttatcatgagataactatctccggttagtgtttttgaatggggggagtttagtgtggttgtttttttgtttttttacaaggagttagtgtgattttgtgaagtggtgaaaccgtgtcggttagtgaggcggtcccacccaagacggaggagatagcggcggcgggaaaaagctgcggcggccggcggcgatgctggcgccgcggagcctccggaaggcggccgtgccgccgtccctgctctccgacccctcgcccggcagcctccagcccacccgcctcgccgtccacgtacgcgtccttcctctctctcgttggcgccgcgcctccaaaaccctaaacccagggctctgaggattcgcgctgttcggttccccccatctcgcaggtcaatgccgccggctcctcctgctccgcctacctcgcctccggctgccgcgtctacaagattgaggtgaggaggtcaccctcgtactggctcctcgttcctttctgttcgtacaactgtatcgcggcaaggggtcacgatttcacgaatgctgtgggatcaggaattgtcgtgcgggctgtctagttcttagtcgctcttgcaggttggcgcaggatggcgagagaatttaaggacatagctctcctgttcgttttggttttgctggtggtggtagttggcgtgtaattacatttgggaagtaatttgatgcggttctcaagtttgattcccatttctctttcatcttggagctgaacag

SEQ ID NO: 37865 - DNA, 471 bp, Oryza sativa
tactttttgcacgaaattatttaaaactttaatgaattttgattgaatttgaataatttgtgtccaaattcacaaaaaaaactgaaaatttcatcaagataggtgcttgctgctgcagggaagggggggggggggggacgatattaccgacattttgaaaatttggaaccattagaattaggaaaaataacgcatttctagcatgaagtccaattgaataattatagctttttgaacaaatagattacattgagtattgttcttacttatctctgtaaacatagcatgtaaggtaaatttatagatgtaccatactaaaatcaattaccaattcaaccgcgatgcaactataactaccctatttaaagtccgatttactattgtgcttttcagcgaaatgatatataggttacatataatctaatattatctttttcttaatctttttgcgccgcatatatacattgcagg

SEQ ID NO: 37866 - DNA, 1501 bp, Oryza sativa
gttgactggcatgctaagtctaaacaatatctcatttgcttattattcggctttgtggattttatatcgaatggtgtcagtttgtgattatgggcacattgaggtatggctggctatttatgtatgtatggatctcactcatccaaaattatgtggtaatcacaaattgcattggacggtataattttcgggtgcccacagacatcaccccagtggccaacattctagccatcagcgatgccacaccgggctcacagctccaaagatgcaatcactgcacaacttcaatccgtcaccacccttgttgaagcttgccgtcggtcgtggaccatgtcgccactactacttcgctggcttaatttctagggtttgaggaaaggagttggagattcggaggcgtgagagaggaccgggtcttggttcgaaccagacccaattagttgtaggccaaacaaaggcaggagcataatcgtactctcgcatctgtttctctctcatattcctccggaaataataaaataataccgtgaatttctagcagctaattaccaatttttttacagtgtcttatggtgttctccagcgaattacacgtcttttttatatcctatagcaaattttgtaaaagaaattatgggggtgatattttacactaatattggacctgatattttgttattgttttggacctaaaacgagtcttccaaacatgccctcaacgaaaaaaagaattgtacagaacagacacagaaaagagtgtcgaagcctatttaaagttggcttatagtcacgtgaatgcagttcgtcttttactaaggtcgtaccaaaacatggtgcgtagaaataacgtagtttccatgttgagacttagtcaacctttgttccatcaaggggtccttttcctttccattgattgttttttgtttaatttccttaaagcatacatcaaatcgaagctatcccaagtatccgcaatgactgatgagtgggattagcaagtcaaatgggtacacgggaagcaacagcaacacatgagcagtactagcctcgtttgtacttgccggccaggaaatgaagcaagcaagcttaattccagcgcacacagacttgggaaaacagcaacatatattaattaatattgttggattttttgaaccgcttaatgattaattagctactttagcatgattaaaacagaaaacagttaataactagtcattcctagcttcgacttaactaatcagagagagcgcatatatgtgtagatgcaggttttggtagtactccagatttgtattgtttagttgggttttggtactattatatatatcttcgtaattttggttccataatcgttgcatccgtacaattcctgtttattgcttgcctttatgctcccgtttactgtaggatggtaaagggccttccgacggcatcgtcatggttagaccggcggggatacggcggtgatagacgactttggggcattgggcggttaaac

SEQ ID NO: 37867 - DNA, 1501 bp, Oryza sativa
catacaatagatcttcaattaaatccagattgatccacggtggtaacttctattataatctgagtatcttgttggtaccagatacagaagtacaaaattaaaagaaatacaaattactccaggatagcaaggacatgcaactattcatcggatctttcaaactaaaagaagcaagcaacccaacctgcgaggatcatagatggttacagtacgatctgttccaccaacagcaattggtccagaaggagaactacagagagagtatatgatgcctccaatagggccagaaatgcggtgtatgcatccaccattattgctcgttctcaagtcccatatgctcagctgcaaactaaccgccataagaagagagtacagagaagaaagtttatacagggacggtggattgattttgagtctaacctgagaaccttcagcgattgctagcattgaaccactttcattcacttgtggcatgcactgggcaaagctaaatgaagatggataccataacctgcagtttcaattttttacatgctaagtcagaaatattttgacattacaaataaatttcagcatgcatatactagaagatattatacagtaattataatatggtcatatggatgctgatagatgggggttatctgtttcattcacaaggcttactttgaatatagcaaggcaaaggtcagatataacccatatggatgttaatttttcgtttcatgtaaaatcgcaagtggtcgatacattgtgctttagcaactttcaaaaacaacaaagtcagtcagacaataatctgtcatgaaggcaatatcctggtaagaggaaacttacgtacgtaaactgcgaacatgaatgtcctggtcgtagatatcaatgcacttacacaattcacgagcaacagctacctggaaagaatataagttgtacctggttatgtggtaatgcaagtgctctacatattgatgcttatgctaaaagtataaaagccaataggaaatgcactgtccctgtgtataaagtttttgctaacaaagataacatgtggattttgtttgtaggcaataataccgtggattggtgcattggactaaaacataacccagcccaacttccttctccgacaccacaatcacgaggtggtactgaataggaggccctgtcaatgtctgagcaagtttagtagcgatatgttcatacatcgctaatgagaaagatgcaaatatgggatttctttcatgttttcaattatccatgccatgttgaagacaagacagaaagttaccatcagccaccgtatctaaccgagatacaataagatgaccataagagtcaactgttccaagaatcaaacagccatcacctggtaaagtggtaatgccacaaagaagggtgtgaaataaactgtggaatatgtgccgttttaattttaccaagactaaaagaagaacaaactgaaagccgaattggaattgataaataaatttattcggtaaat

SEQ ID NO: 37868 - DNA, 523 bp, Oryza sativa
aactccagcatggaggacgcggccgcaggcgagctccggcgtggggcatggtcgcatggacggcggaggatctgcgtggtgacagagacggcgccggcgacgagctcaggcgtggggcgtgaacggcggaggatcctgcgtggtgatggcggcggcgccggcaattgagctccagcgtggaggacgtagccgccggctgaggcgtggacgacggacgtggctgccggtgacgagctcccgacggaggacgcggtcgttggcaacgagctccgatgtggaccgtggacgggggaggatgcggctgccggcgacgaggttcgggttcagtgtggagcgtgaacgggggagaacatggccgcaggcgacgatgcctcgacacctcgacgcccagctcctggtatctagtaggtatcatattgatacctcacaaatatcaccctgatacgtcgtagaaatcgcacgatacctgatagatatcatatgatacctcacgagtatcgcctgatacgtgataggaatcgtc

SEQ ID NO: 37869 - DNA, 411 bp, Oryza sativa
caagtttcaaagatgttttccaggcagctgctcacgtatcagtgttcctgcagtcatttatggtagatgtgcttggcaaaaggaattttggtggatacgccatactggctggccctatccaagttgtctgcaccatctgattattggcatcaccgttggcctaccacggtgcctttttcttctgaatcctcaatttgaatcaggccaaaatgcacgagtgttaggaatattcaatattgtactccaagattggcatgactctgtactagaacattcagcgtgtaaacgaccttattaatttggattgggatcctatgctgtttgaatagggaatttggaaggctatatgcatccagaccagcagggaccctctgcaaattaaatatggtgaaggttgtggtttataaggca

SEQ ID NO: 37870 - DNA, 1501 bp, Oryza sativa
tttcaaatttcaaattgtttaaatagagtcatatggagaaatgaccaaaataaaaccttttcatctcgatgatttctacagctttggttttggtgacttttccatttgaaatcatttattaaccctaatttttattcgaagttgtcaaattttgaaaattcaaaatttaaattgttcaaatgaacttatttgtaaaaagaaccaatacaatagtcgcagatctcgattagttctacaatttttttgtttatgatttttttcatttgaaacaaaaaatcagcctaaaattacatttaaagttctcataaattgaaactaaaaaataccacaagatcattcctgtttcggcccaaatggcccaactatttctgaccgtcctatctacgatctaatggttctgatcgccgtccctaaccctagccccatataaaaccctgctctccacccctcctctctctctctatctctccaccctcagccgccacacttctcccatccattcccctctcctctcctctcctctcctctccggcggtgggtatcggcgatgacagcgtgcggcggcgtcctcctcctccatcgccgctcgcggtgccggcttactcccccctcaccgcttactgcgccgcctccgtctccgccggcgccaggctcgggagcggtggatctgccgccgacagcgctcccgggcctagggcggctagatcgcgcggcggcagtccccgggcggctcaacgacggcgtgcggctacggcgctgggcctgattagcacgcagcagctcgccagagctcgctgccgcgccgtttgtgccggcgggctcctgcttcggggtttctggaggcgcgtgggggtccgtccgcgggtgcagtctgcatactggctcaagttctggcggaacatgatgcgcgtcactctcacctacgaggcgcatgccgcgcggatgctggaccgcgggaccccatcaacgccaacctctactgcgcaagaagcttcgggaactcaggcaccgttgccaggagggttcgctcagggacatcgtcttctgcatgcgagccgacctgcttaggaatctcggcaacacgtgcaactccaagatccgcaggttctgcactaatcttaatctgtattatgccagcatgtttttgtttcagaatgcaggcagatttaatacccagatttttgaaagaaggcctaaacttgctaaacagagtctttataccagcaattttgatgcgataagatgttgttaggatttagggcaacttattcttagaactttagcaatatttcctaccaaattgatgagcggtgagactaaacaccctttcatggtttctattgttccctcgctgggcttatgtttcttttgttgatttgactaggatttaacagatgatcagctgcttgtaggaattaagcttcgaattgacaagtccattgaaaaaaggaaaattaacacatggtctgagtaggatgttatgattgttttttttttcctt

SEQ ID NO: 37871 - DNA, 1501 bp, Oryza sativa
atccagcagcagcgactgcaggtagctgcctgcctagctagcttagttaggttgggtggtgtgaaagggaaattagctaccttgatggagactggtataattttgcaagcaccacacgggccagagctactggtagctagtttagatgtctttggcttgagctaattacatccttaatggttccatgcacgacacctcacccgacaaacaacgatctctgggtgacagttcttgaatttatatggtttgctgctctgtacagacatttacatataagcttgctcgccttagcaacgtttagataattaatttcattacttaatgtaaagcatttccattaccttaaagtgcattgcttaatgaaatatctcaagagaacatatccgtaggctagcttatttcagaacttaaaaaattaagcagtattccgttatcactcttcaaggaaaaaattgaatgtaggatcgaatagctagaactaagccaactagaggagattgaatagttgtagtatccaaaaaccgaaattcgatgacgatcgtccgatcggattagatgcaccggtctgatcgctggatgatctcaggtctgaccagtatagtagctccggtttaaccgcccaatgccccaaagtcgtctatcaccgccgtatccccgccggtctaaccatgacgatgccgtcggaaggccctttaccatcctacagtaaacgggagcataaaggcaagcaataaacaggaattgtacggatgcaacgattatggaaccaaaattacgaagatatatataatagtaccaaaacccaactaaacaatacaaatctggagtactaccaaaacctgcatctacacatatatgcgctctctctgattagttaagtcgaagctaggaatgactagttattaactgttttctgttttaatcatgctaaagtagctaattaatcattaagcggttcaaaaaatccaacaatattaattaatatatgttgctgttttcccaagtctgtgtgcgctggaattaagcttgcttgcttcatttcctggccggcaagtacaaacgaggctagtactgctcatgtgttgctgttgcttcccgtgtacccatttgacttgctaatcccactcatcagtcattgcggatacttgggatagcttcgatttgatgtatgctttaaggaaattaaacaaaaaacaatcaatggaaaggaaaaggaccccttgatggaacaaaggttgactaagtctcaacatggaaactacgttatttctacgcaccatgttttggtacgaccttagtaaaagacgaactgcattcacgtgactataagccaactttaaataggcttcgacactcttttctgtgtctgttctgtacaattctttttttcgttgagggcatgtttggaagactcgttttaggtccaaaacaataacaaaatatcaggtccaatattagtgtaaaatatcacccccataatttcttttacaaaatttgctat

SEQ ID NO: 37872 - DNA, 1501 bp, Oryza sativa
acagatactaaatttatgatgggatttaatatacaactattttattttcttctgtttttattgtactttatttacaactattgttatcaactatacttgttataatttggtcctacaaaaagtcttggaaaaatatcaatctttatatgtagcatccttagacaatatcgaaatttgtatattatgtatatctcaaaagaaatttccatgtttttaaagaacttttttatgtagctgaaagacaaattacttaattaaaagatagacgcgacaaaaaaaattcttttatcacatgaaagatgattttcataaaagaaaatcaatcacagaaatattctattatcaaataaaacaaattatattttaaaaaaattaatacatgaaaaaatcttgaatctacacaaaaagttctgcattatataaggatgctgcgcacatttttttaaaaaaatttaacttaagcgaatcaatcaattatcaatcagtatatgtcttgaaagacagttttagaaaaatatctgctccaacggcatattttgaaaataattgataaagtcattttttcactgctagtagcacattggttacacttttttagttgtaacatagaaatataagttttgaatcatagatattctatactcagttgtcttaaaatataacaacttactatgataaatctaaacaagcttcttatctatattctatattagattgctaactatgtagatagtatttcccatgccattacaaatttacctatttagaaaaatatcattacaattcgtctatacgtagccgtgacactgaaattttacaaaattgaatctatgccatcgctgtcacgttcttcgtcactgtcgtttctttcttccttcctctctcctcttttcttctcttggctgccgtgggcgtcaagatccagcgtcggtcgtcggcaccggcagagaagttgatgctgccgccaggcacgattccttcccgcggctccaccctctgtgtcacctcctcccttccttcccttttcttctcccagctactgcgggcgtcaagatccaacgccaatcatcggtgcctctgtgtcacctcgtccctcccttcccttttcttctcccgactgtcgcgggcgtcaagataccgcgtcgatcgtcggcgctattggagaagctgatgccgccatcgagcacaactccctccagcagctccaccctccgtgtcacctcagcctgcggcagcggggaagcccatcaccatggccacaccatccttcctcaccatggggttgaagtcagagccgcagctggtggtggtggtggcggaggagcgtgagtgtgcggcttggactcgagcaatgcggatgccacgacgaggtagggttggtacggctgctgccggcgacggcggccggggtgtcatcgtccttgctattggctaccaccgctaccgctgccgctgccattgggaaacgagagacaagggtttagggttagtttggttcgtg

SEQ ID NO: 37873 - DNA, 323 bp, Oryza sativa
acaccagttaacgtgacgctgaggtgtctaagttcagcaccatacgatttggcgctaaacaaaagggtcatttctgaaataagttgtggcacgattcatttgtaaaattagtttttgcaaagggtcaaattgtcaaaaatttgtgttatccaaccggtccatccatcatgtgcacggccgcatcctttgctgcgctagcttgagcctgtgtcaccaaccggctaattgatcctaactactacggctacctatcaggcagaaaggcagcccaggctagctagccagcttgacatgattagccactcacggttcatccgttcagg

SEQ ID NO: 37874 - DNA, 273 bp, Oryza sativa
tgaaaacttttgtgcatcatccatccaccctgcgactggcaaggcgaagtgagttcgctaccaatatgcagcgagccacacacgacttgcaatgaagcaggaggcaaagacatggcctccgatcttgcatggaaccatgaaagagcaacgtggacagggtacagggtcaagctcccctctcggggttgcgttaaacatggccggaaaaacattcgcttgaagcacgaaatgcctttgcagttttacatgcttcgtgctacaagacccggtcgt

SEQ ID NO: 37875 - DNA, 342 bp, Oryza sativa
  unsure (1)..(342): unsure at all n locations
ttctcaatcttctctttttctctcctctcaaactcacaaaaactgatgaaaacttgtgattggcaaatggttgattatcttgtcatccaatcgtttgcgagagcaaatagaaaaataccgtcctttgaccatgtattgtatgttgatgcattgatgagtccgactgctattcacagtatatgagataagtgtgatctcgatnatctcatgaactaggcaagagcttaagatagaccctccaatccgacgggatacaattggacacctgtcacgcctttaactatcccgagcggaactagtccgcgatgactcacataacctgtataccgatcgtttactaga

SEQ ID NO: 37876 - DNA, 730 bp, Oryza sativa
tagtcgcataacgtaaaggaccttggagattggagttcttgattggttcctattggaaatttgatcataattcggtatattttaatctaaaataacaagataataagcatgatattcgcaatgggaattgatccagtgatagtggtaaatgtaatcaacatgagcatacttaatatagaataagcatcaatatagacaatacaacgcaataatattgtgactgacagttgtaggaaacaaagaacgaatagtaacagtgaaacgttatacccccgagaatagttctccgctggagtttgaggcagtattgcctccgttgatgttgacgggaggctccttctctttgtatctagtgttgctgttgtcaccagttgtcgacatgttggtgaagatgatgcagagctacccaaaaacttgatcgtccgcctacccgtgtaggttctcaagcggacagagtttcggaggcacttgcttgttccgatcacccgtgcacacgagatgaacagaaccggagaaacagagagacaacgcaaaaacagaaggagagtatcgccaaggaacaacaacaggaggaagactcgatctttgagagcctctgccttgcgttatatatatagagagagatctccattaccacacaaaaaaaatctcatttgttgtgaaggttaccactgtcagggttatgaatgaggtataccctctacccttggacgtatgttgtatactgata

SEQ ID NO: 37877 - DNA, 971 bp, Oryza sativa
ccccccccccccccaatttagaccactttagttatggcaaatcttgctggctgctgctatttagggcgctgctcacctgttcatcccgaaggtgcaatggaagcttcactacttgtctacttggaagttggaagccgagtccttgcgggtcatattaggctgataacccgtagcgaccctatcattcaaagggcctctgttgtggccgtaccaggcttccagcccaattcagggcctaatgtgatgggccgtttctggaagttctgacccagttccagcctctccaagagtttggctgtttgacgtgtgtgcacgaatacgaccggagcggcacaggcgaacagcggccagcgggtagctgccggcgaggaacctgcttcggtgccaaaagcccaattccacgagacagccgaacgacagcggagagcctgagaagtgagaacttggacgagtgaaatgtgaccacgaatgcaaaaatgatataatcatcgttgaaaaagaaaaaactactactccgttcgttttacgtaataagacgttttaacttattttaggtttaactaagttaaattattttaggtttaactaagtttatagataaatatagtactccctccatccacaaaagttacacatattacttttgacatcaagactaaggaagaattaaatcatcttgaatgttataaaatcaaagagtgaatgcaaacatgtaaccaataactatttagatgactccttggattctaataaaatatttaatttatctcttaatttaagtcttgaatgcgtaaagattacaaataggaacaacttatttggaaaaactcaaatgtgaaataggtgtcacttttgtggatggagggagtaatatttataatactacattagtttcatcaaataaataattgaatatattttcataataaatttgtgttagattgaaaatattactacttcctcaatatgaa

SEQ ID NO: 37878 - DNA, 360 bp, Oryza sativa
gaagataaagtaaatagaaattatattggatttgataaacatgagggtattttagtctttttattttatgttggtggtataaagtgggtgaaaaataattattttgaaacggaggaatatttttcaatcttaagacatgttcagattactatcaaaatgatcctgttcaggtcactcatgggattgtcggatggacggtagtccgggctctactgccagcgtgcatcactgttgaccgccgaaaaaccataaaatagtctttacccgtaacccaaaaaaagctctttattgtttgggctcggtaggatcgatcgctggctctgtcgcgagggcccaactgagcagccaggattgggatga

SEQ ID NO: 37879 - DNA, 1335 bp, Oryza sativa
gcccaccaaaccttagggagagcaaactagacttttacagagggatttgaattgggaggaatttgagatttggaatttgaatttgacgatggataggggattcaagatggagattggcacgcacagagacatcaagcaaagaaacgacttccgcaaatagggtttttaagatttagttttcccgctaggcgccacgacggaacggacgctacaacgccctccccccacacgtgcctccacgaaaaaaagggcgccctccccctacgcgcgtctcagcctgcctcccacgtgtcctcaccactcacactctgttgcaacaaatcccccacatattacggaaacgctctattagggaatccgtttcaattttgttataccaacaatgtttcagcaaatatactcgtaatatttcatatgtatagatcaaatgctgcagtgaattgaaacattctttcgctatttgctaaaacattttcttatataaggtgaaacaatacccgattttttgagaaaccgttgtttcatacgttgtagcaaaatgtttcatgaggtgatttggttgtgtttcagctttttaaacgattgaaacattttcaatctacttagtgaaacaattccgatctatttggtggaacaacgtgcaacatttaaaaataattcaaaaataagctaaatattttttttcatcggattatatccatgtgtggtcttgttttaaagatttaattacaacggatttaatggtacaatcggatcatgatttggataaataatttaagagaaaaaaatagcttcgcttagaaagttttgcttgcatgtatgcatgcatgatgacgtgaacgcccgattttagatgcgtcgcatattctaatactataaatctggacagacatgcgacatggtacaaacacgcataacaattaattaatttgatctatacatagtgaaacatcacaagtacacttgctgaaacattattggtggaacaaaaattgaaacggattatcttaacagagcgtttgcataatatgtgggtttcaattcactgcaacatttgatctatacatagtgaaacatcacgattacacttgctgaaatattgttagtggaacaaaaattgaaatggatttccttagtagagcatttccataatatgtgggtaatttgttgaatggcgcatgtggtgggcgcgtggtggggacggtgcggaggcccgggaggcctgcgcccgatttttctaggggtgatctggcgccgatcccagcattttccatctattgaataaataatagcaaatatctaattctaccccctttcatcatgtatcgtgtaagc

SEQ ID NO: 37880 - DNA, 1501 bp, Oryza sativa
ggcttcatgcatgggtgcaaagatgttcagattggatccctggggggatcatgtcagaggggagagttgcagatgtaagccctgtaagcatagcatgcatgcatatatggctggtgtgactgcacgaggtggttaatttttgtgcagtaaattctgagctggagtgtacaccgtaggggagagggagaagatgactgatgatatattgagatggtgtggtgtgtggatggagtatattttttttctttgccacggttcgtaataggacgggagtcccctgttggggttgactaactgttcatgtgaggacaagctggccatgctgctggctcagctcatgctagctttctctgttgaagcaaatcttttggttgttttctatcttaccacttggcttaaaaaacgttcctttaaaataagcctatggttctaatggtgtttaatctatgtaaaataatctttagccgcatttggctgttatataggagtattcatcgattccttctttgcactcactgaataaaaactactagtaaatgtaatggtgctgctacaggacaaaaccagaattacagtagtagttcttttgcaaaaattaagtaggataatcaggaaggagagagagagagagagagagagagagagagagagactggtaaaaactctaagggcccctttgaatcaaaagatctatgtaggaatttcataggattcaaatcctataggaaaatattcctatttggcccttttattcaaaggattgaagctttccaaatcctatgaaattcctatggaatggcacattgaatgtggattttagaggaaatttagcaagagctccaacctcttggaaaatttcctttgagtctatctctctcattcgattcctgcgtttttcctgtgctccaatcaaacgaccattcctgtgttttttctgtgttttgtaatcctctgttttacacttcaatttctgtcggaatcctgtgttttttctattcctctatttttctaccctgcgatttaaggggtcctaagcaagagcaggtgcaactgtgcaagactgcaagaacaaatgaacgatggcgaaaatcgcgtccaagatcctctaatagatatgacataactgtatcatacccactgctatacatcatgtgttcactgttcagcaaaatgaagaaacagcacgtagatggactgcaccaaaaccattagtactctgtagtacagatgcttgtactgtgtacagcagcacagcatataaatctactctgcttcgtatggatttacatctgtatggggtacatttcccttcatgcctgtccacttctctgggatagatttcctccctttccattcatgtgaacttatcttcagagttcagagaaagcttgatgagctagcggtgcctcatcatgtcaggcacttgcagaactcgtttttgatgtgtatatcaacggcgatttgctggagtgttcatgtccagcagcacttgcatgcatct

SEQ ID NO: 37881 - DNA, 1501 bp, Oryza sativa
ggaaattcctcttccagttccagtgtggcccagcgaggggactgctgtcgctgatctatctgctgtagccctcgcccttcgccgcgtaggtgagttaaatgcccgtcattgtgcagattgaggaggccatgattggtgggggcaagccaatgacgatggtcttgccagttgacagcaaaggtttatttcttcttcttcttgcggggttggaaacggggtgagaatgggggagagtgagagtggaggaagaagccaggaagaacacaaagagaggaaagagtgagagaggattgaaaaattgaagaataaatggtgtccgtacttttgtggaagtttgaagatgaaaattgagttttttttttccttatcctatatatactccatagtacagcaaatagttcaaagaaactgtgaagctaaagaagaaagcgtccaattgaataagttcccattttcctcaaccatgattggcttggataggcaggatttcaaaagaaattgacttcaatttcttttctgtcagctgaagataatgaatctaaccccaccctatcataataagcccaaatatgtattgcaaattgaggatgtattgatattttcttctttgccccctttaatggaagcatagtttctttggtaaatttactttcccatccttaataatatttagatatatgattgcctaattctgcaaactgtgatataattgtcaactaaagtacagtgctgtgtattttgcctatcataaagtaccttcttttattttattcctgtactgttcttttgcatctcagacttgcatatcatatacaattcaatatgctgcgtacaatttggtggaacagtgaattccaatggccaagaccatctcattaccaattttcttatacaggaaaacagtgccgtcctctacggtgaccagaatttctaaggctgctatatatggatcaaaagtcttatctttgttttcgcgtacaatttggtggaaaagttaattccaatggccaagatcatctcattaccaactttcttatacaggaaaacagtgacgtcctctctggtgaccagaatttctaaggctgctatgtatgggatcaaaagtcttatctttattttcttctgttgacattaggaacagcctcccctgcaagaatgagagagtacagtgacgaagtccagattatccggctctaagagttgtcacttgtcatgctacttaacaagacggcatggatcgctagctcaagttgccattgtataaaatccctgagctgtggtagtatatagttaagtatgcgattcttataggtttctttcatcacgactggaccaggtatgtattttctatatactcaaacatttgtgatgatccagctttccttttgtcaattcttgttctggatatccacatgtctgcaacctgcgatcttcttatgtgtgcagacccgaatcaagatgtgggcaaccttgctgtgtaagcatctccaaatcaagataa

SEQ ID NO: 37882 - DNA, 1501 bp, Oryza sativa
aaactttccagttcttctacgagacagactttactgaacttgaggcattcatatcattgccaatattagaagctacgttcaagatcaagacaatctttccactagttcgtctgcatcaaacggctcaatgcatgatgtgatccacagttgtcttgcatgtgcagtagatgtacagtataagagcatctccaacagcctctctaaatcgaactctccaaacacccatatagctaacttcccatcttatttagctagtcaaactagatactcacttcaactgactctctattaatcatcttcaaaataataacggacccacatgtcagcctatactcatattcttcttctctctctctccccttcttccttcccgttgccgacggcggccgcatgtggtggtgctgcgacacggggaggcgggcggctgcgcacggtggtgcggcgacacgaggaggcgggcggccgtgcgcggttgtgtggcgacgctgggaggcaagaggcgagacgccggcggctcgcgacaacgacccggggcgacactcgaggcatagctcggcgcggcggctcgtgacaacctcgacagcggatctagaggggggcggtgacggagctcggcggtggcggtggccggccgcgaagacgatggggtggcggtggccggccgcggcgacgacgggacggcggcgccctcgtcactccacatctgactccgacgatggaggccacaggtgcgtgccgcgtggagaaagagaggaaacaggcatgggtcccacatatggctagccggctttggctggccaactttggctagtctggtggggaatttatccagccggatggcttggagaggcatttggctagtttgttggagtagatttttttttgtgcaagttagccaaattttgacttggagagctatttgactaggctgttggagatgctctaacagacggtatgtgcctctttgatgccgtgcgttggggaaaaaaaaaagaagacgtcaacagttgtgaaacaggtgggcctgatatgcgcacatctttggtgggctagtgatgacatagaaccaggttactagtatcattttgttagcgctggaaacaaagaccggctcgtcaaaccttaactgtcgaagtgtcaaccgtcaacgtacgctgccggccgcctattcctctctgccgccctattccatgcatcgagcgttaaaccgttgcccctttcaatcaccagttcaccacccgcagatcgttcgatccccagcctccttagtccaacaacgcgcgccagtatcccctgaaaacaatagccgtgcaccccctgttccgcactaaaatcccacgcacaagtcgtcgcgggcgttctatacttctatccatatctcggtcgctacacgcgttacatccgtacgcttcatacatatactgctcctacctaagatcgatcgatcaatgcgcttctcaacaggtaatgggtgatcacgcaatggccaataatcacgagc

SEQ ID NO: 37883 - DNA, 1501 bp, Oryza sativa
cccccatatcgtctaaaccaacttcaagtctgagagatttttatccagcgttaactccaacacaacacctacaataagcaagtcgacaaacaaacaccaacattatcggatcgagataggccaaattaaaatacgagtattagggctttcaccatatagagatcttgccaacagtaacaattgctccaatgccaccacgcccgcaaaaagagaaaagcaaccagaatagaactggtcatgactgattgtggccgttgaatcgttcttcccaaagacactagaggagaccacccacgttttcatttccgaattattgccatcaacctcagcaaattgaacaaccgtctaacgaaatgttgcctccaatgggacacctccgtcgagtggatggaaagggcttgatatcgaagacctaagacttcagtggactaatcatcactcatcacagattgctaattgttgaggaggtgtacagagaggaccaacgttgtctggcattggctagatccaatttctcatcgatttgccaagaggaggaaagaaagaaaaggataaaatcctcttggaaaccttggacgccttgcctcatcagagcaccattgcagtcctcagaagatttcctttgtttatggttgttacctctatacaaacaacaccactaaccggtcacctagccaatcacaattcgagggattgtagtcaccggataaagtacatctactcgcggtggatgtagttgaggtgccaaagagatctcggggccgccacaaccctgatggcggctccatgggatgatatgtatggaaaggcccaggggttcttaaaaaatgatatcatgttgctatgtaatattagagcttgtattctttgttagccgtgtttgtatcctttgacgcgaactatattttgatcgagttggatccttttttttcctaaggggtggatggaagtttgtgacccattgatggttaataatactagtaatcgaattagtacttctagaataggctgggcagtcaacttttgatgaatcctggcaatagaagaataaaattgggaagaatgaatacatgccaattttttgttgtttatggttgttacctgttccaacaactagatttagcatttacattatattgccccttatgagattaagaacatgtttgacatagctccagattccagatccacactagatgtggactttataagttaaattaaagtggttgaaaattgtatgtttcaaaatgattcattcaaatgttatcaatacaatcatagatctagatccatcgatttatgaagctagaaatacctagctacaagaaatcctggatttggagttatgccaaaccgggcctaagtgtgcaggatgatactaagtagtaaatagtacgatgatacgctgtgctcaatcctcagtgagattgtgtcactctatttgtactgaggaaacatctgcgacatgaaactggaaaaaaaataatacttcacaaactaa

SEQ ID NO: 37884 - DNA, 1501 bp, Oryza sativa
aactacacccttcctagtgtagggtgtacagctaattaaaaacctgatccctatgacgagacgatctgagtattgaattctctccctgcttggtcagtgcattgggatcgattagacaggtcttaaaacctcaacagctagcagatggatgcatgggctaaaccaatttgctagccagaccagctaagctagcccatgcaatgtgtgtgtagttacagcaccctgttccccgctgtttcgtttgaaacacacccgtcatcgagctccgcgagcgacctagccgacagctccttaaattaaccacacgctcgagatcaccgtgcgattccgatgcagtactgacaaatgaatggagccttctattctattctccctctgaacttccaattcatgcagcatcggctgacgatttagagcttcgggaagatgcatatgcagtgatatggatttgactgctcgcaaatgccgtgtttatgccatgacccgatttgtggaagtactactagtacatatcagtacattggttgagttaaactaatccctaattcagatttgcacagttagctggcaaattcttctggatccaggaatgattagcgattcccttgcagcagcagcagctggccagggcggtaccgaatcttagcgcatgcatgtggccatgattaggttattggtgcccaaggtttttacctctcagcatcaaaaggaagttagaaatgcacatggaaaaaaaggcgatcggagtgaacaatccaaggtagctacactggtgaaacttatgttctgtccaaggttgctgctgcgtgcagctagctttttcttcctttcggccatggaaaggaggacacaaaatggtgagctcactgtgctgcactgcagtggacgccgcgaggcgcgtgcacatgtacgtttccggcaagtctagctatgtataggcgactatgtatgcggcagagatgagagtagctaggccgcactccatgcatgatctaagagcgtgcagttctattggacataatttccctcgaagtgcccagctgtgcctgtgagatgtgcacctcatcaatgttgtagattgtgttcgagatctatctccctttctctcatttatatgcagagatgcatgcaagtgctgctggacatgaacactccagcaaatcgccgttgatatacacatcaaaaacgagttctgcaagtgcctgacatgatgaggcaccgctagctcatcaagctttctctgaactctgaagataagttcacatgaatggaaagggaggaaatctatcccagagaagtggacaggcatgaagggaaatgtaccccatacagatgtaaatccatacgaagcagagtagatttatatgctgtgctgctgtacacagtacaagcatctgtactacagagtactaatggttttggtgcagtccatctacgtgctgtttcttcattttgctgaacagtgaacacatgatgtatagcagtgggtatgatacagtta

SEQ ID NO: 37885 - DNA, 1501 bp, Oryza sativa
ccaagggggccgaatgcaaaatttaagccaacgtggagcatcacatcggcaatcgtacacggttaaaaggggttcggaccttgtatgatacccaatattattatctaaatatgcattttataagatcgtggatctaagtgacaccatcatgcaaccttaaggacatgccatgtattttactatattattttagtatattttcagctttatgttaattattgtcaaaatacgaatctaattatacaacttcatatgaaaaataaattatttttaaaaaatatatatcaaatcttagtattaaagctaaaactaaccattaattttgaatccattgtaatttttatggaactttagcatacctcctccgttttatattataaaatgtttcaatggttcttttaagttaaacttttataagtctaataaagtttatataaaaaatgtaataataatttcaatccaaagcaaacatgctatcaaaatatttaatgttggatttaattaaactaatttgatattgtaaatgttactaaacttttctataaatttgattaaactttaagaagtttgattaagaaaaaagtcagaacgaatgttgctaaagtgagttttgaaatatgaatgacttttgtcaatattttggcagtgtgatcagttattcaaattagaacttttgtttttgagatgtcatattggaactaagttaccagttaccacttatcagcaattgaccgagatattgtgtttgtttgcatcctccggactgataatacttgttgtttgagataagagtgaggtcaaactttatgatctttgattatgagccatttttaaaatatctgtctttcagatatggtgatacctgtataggttagtcttaaaaaatattttaataaaatatatatctattacttcctccgtttcacagtgtaagtcattctagcattttctatattcatatagatgttaatgaatctagatagatatatacgtctatattcattaacatcaatatgaatgtggaaaatgttggaacgatttacattatgaaacggaaggagtaatacttttatatatattataatagaaaataatggttaaagttattttttttataagaccgcatccttattaaaaagaccagtattatcaaatccagaggaagtagattaatgcgccgcttgcccccagaattaacgaattgggctttgaatctaggaggaaagggcctgcccgtctccgtcgaccaccacgcgcacctggttaatttggttcgccggcgccggcgtgccgcgaccccggccgcaacgccccgggcgccaattccgcccaccagatcacaggctgcgcaactggtgactccgccatcgcgcgcggacggggacggctgcggcaagaacgcaaaaggagaagcacggcgacagagaggagcaccgtcacacaatcggagtcggaggcaaagccaaacgaatccggatcggcgggcctttcttatacaatc

SEQ ID NO: 37886 - DNA, 739 bp, Oryza sativa
cccgatgtagcactttccctacggagtattccagggatatcgaatccaagggaacatgtgtggtcaaatcttccaccagttcatccaaggacaccaagcaaaagataggccaggatagagaggatttaatagtgagaaacagtgtctagggaaagcttaactttaatcctaatgcaatacttcaggcactggcaacctgctatttctagatgtcgctctactacatacccggacagggaggacttaagtgatctcgagggctgtcaccacctctacacctacctcaaacgtactgtgggatacgcagcaattactggtaacaattacctaaacactacgtctaagcaattaatatctattttagtgtttataactcaccaaagcaatcactatattttagttgattatagtgaacaataatcatgtatgctatttaggaactaaccaagagataattctcacaagataaatctaaattactcaagaagaatattatattaaattcagagtaataaacataataaaagaaataggagaagattaccgacaactccggaattctcccgactccttctactctactctcttcctattctagtatacaatatagtacaatagagccttttataattcagcttaagcttggaagtgtgtgtgaagtgagggagtgatgtctttatataggagtaggtatgacggttggtgaaggggaaatgtccgaagtgccctccaaccgcca

SEQ ID NO: 37887 - DNA, 1501 bp, Oryza sativa
gtatgtataacatattcatatattattattattatttgatgtgcatagaaactatttaagatgagatgccagagggaaatggtgacatgcaaacctagtggagagtgtggtctacttagtctttagaggcatccagaggtcatacttgcatgctaagtatagggtatcgtcctggtaataataagttcgtcagtgaatcaaccgatgtaatatgcaatgtatctggtgaaaaaaaaagtaataataataaatggaaccactgttgtaggtgtccaagctccagttttgatggttagacactgcatcttgctttgtatatatgcgtataaggatacgacagactgtcacggaaaaaaaatatttgggtcgtgacaacccctatatgtatgcttatttattttcttccataatgacccaaggaggtcatccgaaacacatgcatcgttaataaagttcaaatctaaagctccacgttcttctcttctcttcttcatgcttctcttctcttcttccgaaacacatgcccctagacattgttcttcttcctgcttctcttctcttctcttttcttacttctctcttttcttctcttctcttcttcagcggtgtcactctcgcgctgcctgccgcgagcgctgctccaccctgccatgcttgctccggcccgtgctcctaggcctcctcgtcgtgctccctcgctgtcaatcgtggcggtcctcggaagcggcgatgaaggacaacgccgacgggacgccgttgctgctctgccgactgccgtcccacccgccgcctaccccctctaccgcccgctgccgcgcttgtccaggaggctcaccaagttattggaagggatcgtcgaggcttggacaacagcagcttcggttggaacggctcgactgcgaagaagaactctaggttcacgacaacggcttgatctactcgaagagctgccaagtatgcacacggatggtgttatggacatcctagggagcttctatgcgcgatggattgaatggtggctcaccggagcgggtggaatcaaagatgagctcgctggccggagttggagaagacgatgccgatcgataagctcgccacgccattggctaggtttctttggggcttccgaagaggaggtcgtcgtgatgaagatggtgcggtggcttggccttagcttcacccgatcgacgggaacggcaatgatgtcgcggcgcgatgctcaaagtgcgctccagggcagcgagggcgtggtccgcgttcaccgttgcatggaatggcacgaaattagatggaacgaagatggcatcaagtgaagattgaggaatgcagaaaggagagggcgatcatggctcatcggcgccgacggcggtcgttgtcttcaccgaggggcatgagcggcggcaagagagcaagacatgaggaagaagacgaaaatagaaagaaatgatatgtaagattgacaagtgggctcatgggcaaacttgtctttaaccaatgtttc

SEQ ID NO: 37888 - DNA, 151 bp, Oryza sativa
actcaataaagcaaaattgaatgaaaattacaaggctcaaaactaatgtttggtaaaggaaaaagtggtgcggctgtatagtggatgatgggaaaaaattacaaaactaaaatcctcaccaggcaactgaagctctgataccaactgatga

SEQ ID NO: 37889 - DNA, 1501 bp, Oryza sativa
attacgatcggaggtggctcaacatcatttgagtttggccccgattgtcggctcatataaaatagggccaccgacacctggagtgttatccatcgctcccaggtttcgctacgcccctaacatcccctacagccacttgatactaagtgtgtgctgcagcgatcagaaggctaactcctgtgccatgatgatggtcaaccggtgtcgtggagactagatgggtgatgctaccccaaccgccagtgaccacaagcttggaatctccaccggtgtctctattgctcctagcgatatcaatacatatacggatgacttcttcgtgaccaccatcggcatatatactctcaagctcgacgccaccaccgatgtcattcatgctttcgctgatgacctcttcatggctaccatgaacatactcgagctcggcaccactaccagcaccgtgatcttattctcaccccagccaatgccatgctagttcccactacaagcaccatcttcacctccaccgacgaggctaaatggcagggcgggcagagtcgacatcaagacgacatcaccaacaccggcgtgcggactgacgaggccgcgaacactgccggcacccactcacacacatctataccatcatcaccatcatgcatgggaggacgtgaagcgaagacggacgacgatgaccagcgtaccttaatcggaggtatctcacgggtttcacccacgagagtaattaaccgggtgtcttccgagaccccgggaaccaggagatcacaatcgccaagtcagatccaccttgcctatgggccgtggagcgtatttgtccaaggattttgtattttttaattcttcgagaattataataaaatgcatttttcttcgtccattttatttttgtgtacttagtacactggcatgcccgcacatcttatttccctgggtggggagattctagttaaaattctctccaaacactgataaaatcatcaatccattattcggtgttcataatactttctgttagattattagtatcaccatttcaataataatggtaaacaaatttagtcaaagttaaatagttgatgggcgcaatcttgccttgtcttctgttgttcttcctctacatctacatctctcgggattttagttatcccgtgaatgctaggagcaacggaatcccgtggggtagcagccctctaaacccacaattactttttttccccttctttcgttttatttagtttactaattctatttgcgggccaaacaagccgcctctggaccatgggccgattcgtgctcgggccggcctgtgtacgtgaggctggcacggcacagcccgccaccgggccgtgtcgggtcgggccgggcggcccattttgccagctctccccaaaccccaccatggtgagcagcaaacgatctctcctccttccctagtccagactcccgacgcgaccaagcgccgccgtcgccgacgcttccccgccgtcggagatggact

SEQ ID NO: 37890 - DNA, 539 bp, Oryza sativa
tactgacacctctctctccatcacggcatttgcatcgccagatggctatacaacagatcaaacaggtcatgcggatctgtaaccctggccacagcaacaaccgcaattcatgagcacttaatcgttttctctaggcactatgtggcattcatcgtcactttaattgccgtgaggttaccagctgatcttttaggaggagggatttaaggagttgttggagcttcactgcatgaacttggcttgcgactactaggatgccaggtttgcatcttcgattctgcatgccaggcgaactgtgcttgtgctgccttgcgctgccgacgcccacgctttgaatgcaacccgtagcatctctgcctcctctgtttttagccttagcccaatgcttctctagtaggcgtactatttgatcagtgatcttcagaattcagatgcgtgcggagagtgaggaggaagaagatggcgcgataatctgaagtgacgtagtaatcaatgtatttactcactgtttgtcagaacacgattactctgtctgtaga

SEQ ID NO: 37891 - DNA, 321 bp, Oryza sativa
  unsure (1)..(321): unsure at all n locations
atgtattgctanaatcctccattttttagcggcttcaactccttgggtttatgtttggatttcatttatatttttgtctgtgttatcttctaatcattagttttagttgtccattagattttttctttggttcctcaaattaaaataggccaatttgcctggtaccatcgcaaaaatcatggaactggaaaatactaatgtatctgtcattgatgtgggtccaggacccacatgccattctcagatacgctcgtattttgcaactcacatatctcaactatagtattttccgattttttttattgaaataggtctcgtgtc

SEQ ID NO: 37892 - DNA, 796 bp, Oryza sativa
tcttaaaacctgcttaacaactaaaaggtgttaatggttggcctgtgttggcttggggacgagctgggacccagggtcgggttgccagttcggtatgaatcatcgtaggccttgggttaaggcaggttcgtgtgggttcacggccttgataaataatattgtatagttctagaatcgtgtttactaaatagttttgagcaactaaatatctttaaatgctatttactgcaaccctaaccctttatagtataactcctttgtactcccttgcatttattctgcacttgtgggtgtatcttgttgagtacggtggttgtacttagtcttgctcaatttttcccaaacccagaagaggagcccctggaagatgaaggctttggtgtctagctcgtgcctgccgtcaagcgcctgtggtcatcgccctagtcttccgctgtttctcgtttgtctttgtgtgtgctgggcctttgctgcccatgtaataaattaactatttacgcttccgcttgttaaactctgaattgtatcaacttttggtgtaccttgcctcctgggacaaggattaatgcacgcacgtaaggaacacccgttgggttatttccggtcgtgacaagttggtatcagagcccccttgaccctaggacgagccttagatcccaagccttagcaatattttcaaaataaaaatcccttcttatttgtgaaaatcctctagtctctctctgtcctgctgcttcatttatcgccaaaatatgacctttaaaatgttgcttttctttttgtttttgtttgtaga

SEQ ID NO: 37893 - DNA, 636 bp, Oryza sativa
tattgtgtgcctcggctgattcctggacgagggttcacacacatgtaagcgtttggaattttggatagaaattccgggcgtgacaccattccatagtgtccaggtgatatgaacatcccaaagtctagagttgtaaaatcacctaatgttacctaattaaacagcgaagcatctacctaaaatcatactagtggtaccatgagtagagtgtccactagttggggttttgtttaatctagggtgaacaaggtaataataacaataacaataataataaggtcataacaaaggtaaataggcatggctagataaaacagtgataacgcgggaatttaaataaagcgataatgcaataatttaaagcaacataattttataaactgggattcaatatgttcaaggatgatgtgacttgccttgctcgctttcccaaacgtcggcttcaacttccacgaagagcggatcttccgaagctgcagcgtctacacgaccaacggaaaagaaaaggcttttactctaataactccatataacaagtagaaacaaagcacaaaaatgggttcttgacttcttaaggaaaaattagagacttgaacggtccaattccgagttcaaatggccaagttatggccattt

SEQ ID NO: 37894 - DNA, 1501 bp, Oryza sativa
taatagtagcatgaaaacaccaaaacattatatgtctaatctgaacaatcattttgagtagcctaattgattgcaagctcttgtgatgattttgctgtgtgcatgatttatgttctgcattcatgtgaatgtctgaattgaaggactcgtctggaacttccacgttgctacgtgccgctgaacaactgaaaaaattggttgttgctaacttgaaaaaattgactgttgctaactgttctacatcgacgggaaaaaaaccatacatagcattggttgtgcatatgaaaggctcagctaaacattctcttctgaaaacaaggctcatgtatgtctggttgacctctttaatttatgtataaaaacttcatgtatgtctggttgacctcttttattttatgatggtactgttagttcgaattcataagctgacttatcttatgaaattaaaattgtattcaggattgagttggttgataacctagaatcgacattgattggagattgcttgacgtcctagaggaagagccttgcgattaatattttcttgtgtgcttctattatttctatagcctgattgaaaggtggcttgatgtcctagaggaagagccttgtgatatatgttttcttgtctgcttctattatttatacttctacattatattgcctgtaatgtaatgtaatattaaattggagtaggaatcggtgtgggggatactgaacctgtgcgcgcaaactggattagaatcggtgttgtttttttttaaacttgggcttgcgggcttaatctggtagactggagtaggaatcggtatgggattttttttttgcgtgatttgctctagagtaggaatcggtggtgttcttatttttttgatggggtgggaaaagtagtgtcatattagattagatccgatcacaaatcggataacagaaatcgcagttgtgggggctgcggtggaaaaaacggaaaacacggacaaaaaaaagggttacggacgaaaaaaggggtttcggactaaaaaccgcgtggggtgaagatgtgacgaaaggaaaaatccaaatcttttaattattattaagatagggtactcttttttgttccaaaaaattaaacttgtgatataatgtgatctaacctaatacaacgaatctattcatattcaaattcgttatactaggttatatcatattgtatcataggttgagttattttagaatagtgaagtaatttatccgacctgtatatgcattgactggaaaagatgtcagttgttgtaacaaaggctgccaaatatgtctgttatatagttattacaatgtaatttaaaatgttattataattatattatatattttttaaggaaaagttacgataactatactttagatagtactctcccaaagtaaagctgtcgtcattcgtgggcaaagcatcgacccactgcatttgagcccgatacaggcattagcccatggaccgtatatacggcctgaatagctt

SEQ ID NO: 37895 - DNA, 819 bp, Oryza sativa
gatggtaacatttgcagctaaaatctccacaactttcaggcattgttgtctccgaagatcataagatcgttccaagggggctgtgcaagtgtaccatgatagaaccatggcacgtcagtcctcacgtataccgtgagatatattctatatggtcgcaattatgtaaagtcttggacatagacaccgtcttctaaggactccttcggaacaaaggggaaatggaggacttttcaaggattgaattcttaggggaaataattcttatgtgactgttttgaagaaaagaataactctgaaaagtctctttagaatttctatggaatgggccatttgatgggatttttggagaaatcctaaggctgtgtttagatccaggggtgtaaagttttggcatgtcacatcagatatacggatacatatttgaagtattaaatgtaatctaataacaaaacaaattacagaattcgcctgtaaaccgcgagacgaatttattaaacctaattaatccgtcattagtaaatgtgtattgtagcaccacattgtcaaatcatagcgcaattaggcttaaaagattcgtctcgcaaattagtcgcaaactgtgcaattagttatttttttaagtctataattaatttttatataggtgtttaaatgttcgatgtgacggggtgtaaaattttggagtgggatctaaacaccccctaacatgaagtcttacctcatagtttctctttcttgtgtctagagttcgtctgttttttctattgggttactaatcaaggtgtttcgttaattcttgtgaatttttttccttgtagg

SEQ ID NO: 37896 - DNA, 685 bp, Oryza sativa
attttttgaataagacgaacggtcaaatatgttttaaaaagtcaacggcgtcaaatatttagggatggagggaatatttattttactgcatgaaacaacactttacagtgttttcacttttttaccattgcatatttacatctaatagtacactgttatgtcacttatgaagcttagcatagcatctcatggcaaacaatagttatgttattcacaatagtttatgtcttactctagaaaatggtatatggatgtcaggagatcaaattgttatggaaaccataactttgatgcaccagagaagcttgttacataaaatgctatgctcaatttgtatagaataaatttatgaaaaaagtaacttcaagcatagccacacaggacattttgttatgctgtgatctttttggccattctgcaactgcaattccaatatttgaccttgggggagaggtcaatgttgtacaaacagttgtgtacacttaggaaacaaggatgaacttccttgttagttttgcttatgataatgagttgttggtgccttggtggtgttgatctgtgcggcatgcatagtagctgcttgcaaatagtgattccatggttcagtttttttcttaatgaattttaggatactatgattgttgtgttttgaaaattcactcctttcatttgttcgtatactagc

SEQ ID NO: 37897 - DNA, 1501 bp, Oryza sativa
aaactaagcactcgagaagttaatgttggtcaaagctttaaaagtttaaccaaatattgttataaacatcaaataattaatgattgaacgaagtaactattataatctgtgaaatgttgccttgaaattttttgattttctgctatgagactaggcaatctacattttcagtcatttaaaccaagcaaaatcccctgatagattactttctgtatggtgcatacctagcattaatcaacaacttcatctccagggaattttggtgataggcatccatagctaaaataaatcttatagttgaagctagtataaagtatgatgttgtgtgggcccacattccatacttaaaagagacaaatgcttgaaccaatttgtttgtttacaaactccatgttatacatctacaggaaccgaacagcccacctctctaacaagcttgtagttacatagtagataagaccatagcttatgtatgtctcatagagtcatagagcgcaaggctaaccttaaaaggtctatagtttagtgatgatcaacatggaacatagccccctgttaaccttaaaaggtctatagataaaatgatagaaaaactaaacactaacgtcttcaaaaggagaattggcacttttgttttttatgaaagccaccctgttttcaaagtgatggcccctcctagttccctacttgagcctactacttattatgctggaataaaattgtatggtagctttgggtacttataattttataatcccatatttgatattgtaagccgttctagctatgtcccaagttaaagttagtttaacttaaacaaaacttatagaaaagtaattgatacacacaataccaaataaaatacaccagattacatgtttcaaggtggattttagagatactaatttaatgttgtagatgctagtatattatttctataatcttggtcaaagctagagatgttcgattcagcacaaaactaaaaacacctcataatagtatggaacagaaggtgtaatcttagcaactggtgaatgtattctgccaatgaattccttttcatatatttttttatgttgtcataggataaaactagaaaagtatattttcatcattccacaggaaaaagagaaaaaaaaagaagaaataaaactgaaagaggccgccaagcccattatctgctggacgacaaccaactcgacagataaaaatcaggcccagtaacctgacgcaacccggcccggcccatgaacccaccaaggtcggctccaatcctcgcgcgtcgccgccatagcctgcagccgagccccacctataaaaatcgcccgagccacccgatcccatcggcttcctccctctcccccttctttttttttcccctcccatttttttttttaatctcgacacctctaaaaccctcgcggcagcagcggccgacgggcctgcccgctttccccgtcgccgccgacgatgtggagcggcgggccgccgccgccgacga

SEQ ID NO: 37898 - DNA, 1501 bp, Oryza sativa
aggaccgagccatgaagttaagcctgaaacgactcccgtacaaccgtacttctcgaatgggtatagacctagcggattagatagccgagcggaggcagtatccatgcatagtggtttctcattgagtgaggcaggtgcgctacggtgggacagccgttgaggtagggccgcgaggcgtgccctacatcggtgtcgccattggtaggactgccatgagtgtgcgagaaaaaacttaactttaaaccataacttaatatgtgtgtgagacttcttcccccgggagcgccagaactcctcacactgctagaaacatggacgcctagagtgtatgaggatgtaaagttcatggcgcgggtactgccaatgcgaggttatcgaaaggctttgccgtgatgcgtctcatgtgttgggacgaggctcatgtgttgggcagtcgcggagtgcgggtaaagtgtacatccactgcagtgtgagtaaaccaattctattcgaatagccgtgctcgcggttattgagcaccgggacatgtattacacttggctagactctaaattcttaacttgtgtgggatgggatactgcatgaagatttttttatgctgatggagccacttcctgagaggagggaaggtggacgtcctcagaaaaccatgacgactcaatgaggggaagctatccttgtgatcacaatggatggtggacagaaccgtcgttgtctaatgtgaacactggtattaaaacttgatcagtctatgctaggtcttaggcttgtgaaaagaattacaaaacttgctttgtgcaaaagaaccatagccattctttgaataccctctatcatgtgcattgttgctgtggtggtttgctgagtacggttggtactcacccttgtaatatacaaacttaatcagaggtcggagatgaagcttcggaggatccctacgcttactaccaggagggtgatgaagacgatggcgctcagtaggtcttagttacggtcgttgcctatggcgatggcgtgccgctgccttaactccgctgccttatctacttttgcttttggaatgtattccggaccgttcggtcctatgttctaagactatgcctgggggcctatgatgtaataattcgcactagactctcgtgtatgtgcacttggtatttcagctatgaactcgtgagtaccagactacttgatccagggaaatgatactgtttacacgattgattcctgttataaaaacgggggtccacagagctggtatcagagccatacgactgtaggaaagaccaaatggcaccccacccctttctagttggccaagggagaaattcccatttagtaatactttcaaaaaaaaataaaaatgctatgtttacaaaactctatacgattttcatcttactcttaactattttcttcacaaaacaagttttacttttagctgactttggtttttcttaaaaatagatgacagatcaggattcacccactacctgggaga

SEQ ID NO: 37899 - DNA, 1447 bp, Oryza sativa
gatcttattttagtgcattaggtaatttagcatttcatacccacaaggttaactatatgtgtatgatgaaacatttgtcattaaagcttttgacttaaaagataacacactgatgaatttcatacctttttttaccaaatacactctcacaaacacaacacggtatattgccatattcaattgaaattgacacaaccacttactataaatccattgcacgcctcgtgcttacactattgtcacctctatatagtttgggcatttttatccgtggaaaacaagttgcaattatgttcatgatatacaaaatacaaagtataagtactatatatctaatgtcacctaaggaagttcatataccactaaggattccattgaaacgcaagactgacaaacatagagaattagaagtacgtgatgttgataggaatataagtataaaacatatgtttgcaaaatcgaggagaaaaatatataaatggttgcttgagtagaccgcgggaattggataagaaatataggaatgcaagtgtatgaaaaatatgactgcaaaacacatggaaacaatacatgaatgattgctaatttgaagcatatgattagaaaaaacgaaggaataaaaaaatgaatggaagtgtaaaaaaaaattacggaacactggaaagacacataaatggtattttgattaggctgaaaaaaaacgtaggaatcgaatgagagatgcacaagggaaattttctaaggagttggaccacttgctaacttttcttcaaattttttataggatttcttgttccataggaatttcaaaacaacacgagtagataggattcaatcctttcaaaggctttgaatttttcggtaggattaaaattccctaattttcctatgatttcatataaaatcgaagggtactaaaatcttatgctacagtccctagaaagaatgctaaagatgaaaagtgaaccacgttgattatcccgagttcccgacaccgttggaaacttggaattacccatgtcagtgagccagtgaggtcagcgtggtggggatcagatcccaaatcaccccaactaatcctcaaaaaaacgaaccccaacgcgagcgagaggggcctcttcgcaaatcgcaattcccaccaccaccaccaccaccaccatcgccaccgcctactcctcctcctcccagatccacccggccgccgccgccgccgccgccgccccccacgccccgcggcggcgagatccctcccccgtcgccccaccctggattccgtcgagaagatcgtcgaggacttcgccatggacctcgccatcaaccccttctcctccggcacccgcctccggttagccctctccccctcgcctcggatggatcaccacccgcgtctcctctcgtatcccctcctattcctcagatccgcgcgcgtggttgtggtgcagggaca

SEQ ID NO: 37900 - DNA, 263 bp, Oryza sativa
taaaccgagttacaatgaattagttatgaatttttaaagattaaaccggattaaagcatttatatggattttaattgaattatgacgcaataataaattatttttgaaaaggaaaaaaggattattgcgtcagcggctcgggttcacggtggaccgggtgcacggcggcggtctatggaaaccaacggtctagatcaaccctatccaaaacggacggccgagatcaatctaatccattgcgggtctacggctagcgtcagcgc

SEQ ID NO: 37901 - DNA, 1501 bp, Oryza sativa
agtgttacaagggttccaaaactccggagagcactctcgctcttctttccctagagttcaggcctactgagtggcgttccccttcccggtggacaaggtcctccttttatagttcaaggggataccacatgcaccgcttctacctactctttctacgggagggggacccactctaccttgaccggaccgcgattcgtgccttcgcccggaagctaaaaagcggtccgcccttcagtgtcacccggtgccgccccccacctgacacgggggacagccctgtcactcactcttaaatgggcggagacttgtggctgccctccttacggggagagaactccggatgatgctccgatgtgacaggacatacctacctccactccgccggatacagaggcgacgtgggggcacggccgcctgtccagtcagatgtgaccgacgacaggccggtcacagactggtcagacccgactgacgtgcatcagtcgggcggcaccgcatgtctgcccttaccgcattaaatgcggtgaggggcagttggggcgccgcgcgcattgatagcggcttggcttgggtctcctccccgctcgctccccccgccacatggcagttgggcgagggcctcagggcgagtcagcgcgggggcccgaggggcgtgatgtggcaccccgaggccccctggctgcccctgcgtctcccgaggcgcggggggagggccaaactgtagagtcacgtggctggatgggaaggtaacttcccctcactttgcatacccccgggcccatatctccgacagtagcccccggcaccacgtcggacattggtcccctgagggcagtctgacgtggcgcctcacgacttaccgtgccgaggttgtgggcccgacgaggactccagacggttgccggcggcaaccaggatggcacattagccaaaatggcgatttgaccgccactgaccacgctgatgatgggggcacttagggcgcgaaaatcgggggtttggtcagaccatgcccagaatcgctatttacgccgcctcgactcccccgcctgtcaagcatgcgatgggaccaatggcgggcccgcctaaccgtgcctgtgagcatcgcacgccccacgccgagtgtgccgctgacaagcgcactaaacgcgggacgcgggctccgcggggcaacgtgatgagtgggcgcgagatttgaggaggcaaccgcaggcgcaggaatcgagggggcaaccgtaggggtgtgaaacgaggaggcgagtgcgggcgaggggtggataaaaggaaggggaggcggagagttcgtcccctttctctcgccaactgcatactcgcatactcgctcctaaagccctagcgctcctctcgctccaccctgctccatacaccaagctcctcgccgttttcccgccggccatcatggcccaagacgctggtgacgccgtccttccggcattgcgcatcacggcggagaggcaccttagcctcatccgcaagatca

SEQ ID NO: 37902 - DNA, 452 bp, Oryza sativa
gtggtccatcactgttgtgtatgggcctcaattggaagccgataaaattgcctttctctctgaactcgaaagcttacaaccctccatgaaacgggcttggttgattattggtgattttaacctcatctataaagcttcagataaaaacaaatgaccgcctcaatagaagaatgatgcagcatttccgtggcctcttagacaaaatccgggtgaaggaattgaatcttcctggccgccgtttctcctgggcaggacaaggcgcaaatccaacacaaactaagattgaccatgctttcgttaccactgactgggatttaatgtttgatgggtccaacttatatccactgtcttctgcgtgctctgaccatgcacctctccttttagttggaaatgagaaaagaacgaaatttccaaatttcagatttgaatcctgatggcttaaaattcctagg

SEQ ID NO: 37903 - DNA, 1139 bp, Oryza sativa
tttggagaagatgtcttaggtggagtcctggcttatacccccagttgagcgcctgtgaagatggagccgtaggcccgctagtccgctgctgtttatttttgattgtcaggcctgaagcgcctttgtaataatgtaaatattatcgatgtaataaagatgtgtcttctatatcatgtttgtgtggtgtaccccggcctttcctgggacggggattaatacactagcgttcgggaaaaggcaattttcccggtcgcgacaagctggtatcagagccatctcgactgtaggataagccaaatggataaaacctaaggacatattttataaataaaattatttgcgaaagttcctctttttctccttcccctaatgctatttgcaaaaggtttactcttttcttccttcttcaaatttcaattagtactagatggtcagctttgcgaagaagaagatgtcgtcagttgtttgccgaagctccggaagactgcaggatccgcttgagaaagtgcaggaagcagtgaagccagctgtgaaggagtgaagatcttgggaacccgtcgcagaacctaagccaccctatagggtagtgttgttagtcgtgtgttccttgcttgtgtgtgtagcgcgtggtttgcatcagtgggttgtgatgtaaccatgctaggttgtttgcttaatcaacctgcagaataagcaaaacaaacaacacatcaacaaaaagagttagttcctgtaaggtcttgtccctagttctggtctattctttccttgtatgctttccctctcaacctctaccttgtgacagatggataatactggtaacaaaggctatgggaatgatggatccgatgactcaagaacccaagccaatgggaatgagagaagcatcaacgaaacctcaccagagctaatccaagttgtggttaaccaaaccaacatgttggcaacagcctttcaactattacagaattggaacaacccagcaggggcaaccaacgttcaagtgcctacagtccagcaacagtgcaagttatcagaatttctcaaaactgagcctccaacctttgccattgccgtcgatcctatggaagccagtgattggttgcgcacaatcgagaagaagctagggttgattcagt

SEQ ID NO: 37904 - DNA, 249 bp, Oryza sativa
tcaagattatgccacatcatatctatgtggcatgtcatatcaacgccatgtaggatttattttgggctaaacttgaatttacatggcgaagttttgtactgcataataggcttttcagtgccttgggccgtggctcagttggcccgatgcctgggtccacctcgcaacgttcaggtttcgcttatgagcgccaagagaccgaccgctgtctaattagttccccactcatccgtcatggtcgcgcatagc

SEQ ID NO: 37905 - DNA, 837 bp, Oryza sativa
tttggagaagatgtcttaggtggagtcctggcttatacccccagttgagcgcctgtgaagatggagccgtaggcccgctagtccgctgctgtttatttttgattgtcaggcctgaagcgcctttgtaataatgtaaatattatcgatgtaataaagatgtgtcttctatatcatgtttgtgtggtgtaccccggcctttcctgggacggggattaatacactagcgttcgggaaaaggcaattttcccggtcgcgacaagctggtatcagagccatctcgactgtaggataagccaaatggataaaacctaaggacatattttataaataaaattatttgcgaaagttcctctttttctccttcccctaatgctatttgcaaaaggtttactcttttcttccttcttcaaatttcaattagtactagatggtcagctttgcgaagaagaagatgtcgtcagttgtttgccgaagctccggaagactgcaggatccgcttgagaaagtgcaggaagcagtgaagccagctgtgaaggagtgaagatcttgggaacccgtcgcagaacctaagccaccctatagggtagtgttgttagtcgtgtgttccttgcttgtgtgtgtagcgcgtggtttgcatcagtgggttgtgatgtaaccatgctaggttgtttgcttaatcaacctgcagaataagcaaaacaaacaacacatcaacaaaaagagttagttcctgtaaggtcttgtccctagttctggtctattctttccttgtatgctttccctctcaacctctaccttgtgacagatggataatactggtaacaaaggctatgggaa

SEQ ID NO: 37906 - DNA, 520 bp, Oryza sativa
cggggagtaattccccccacttcaatgcgcgcggggacggcgggatgcggcggatttggcggcgacggcggcgctagggcacgggcgggcggcggctgcggcgcgaggagggagatgacaggtgggtcccacccgtcagcgagagtggcgggcgggcccacctgtcagcggcgcgcgcgcgcgagggaggccgatgggccgcgggggaagagagagagagagggagggactgggccgagccggcccaagaaggaaaaaggagagggggggaaagaacttcttttaggatttttctttttataaaccttttcaactttgtttatttcttttcaattattatttgtgctctgaaaattccactaaaatttgagggctccttttaggccaaggagaatttaacaaaaattctccgggccacatttgaatttttcttgtacgtattttagggtttgccaatttcttttcgaattttaattaattctattattccttttagagaatgatttttatttcgggatga

SEQ ID NO: 37907 - DNA, 1501 bp, Oryza sativa
cgcgttcaaacgggcggatttgctcccgcaaatctcgccggcgccattgatggagcccgagagcgccgcgccggtttccttctcctccggccgccctctctcactcccaaccctatataaacactccccgtgcctccctccaccgtttccgccactcgccgctctctctccccgtcggaatcgagcccgcgccgtcgctctctctctccgccgtcgccgccgagctccggtccgccgccgtcgtcgctccggaccttctcccgcttcggcatcgcctccttcgggttcgccgcgacctcgccgacctcgtccacccctccgtttcgcccgccgaccaccggaacgccgccgtccccgtcaacccgagccgcgccgccgccttcctccgctccggtcgccattcccgtcgtcgccgtcgacccggggtgagccgtggaccgccgtttcgcttcccccttccctcccctctctcggccgccgctccgccatgcctatggccgccgccggcgaccagaggggcgcgggcgctccgcctcccgtcggctgtgccggcgtggccgccttcgggcgcgtcccgcggctgccatgtggggcccggccgtcagccgcccgcgccctcgggtgcggctgacgcgtgggacccacggcgccggccggcgtaagccgcgtgcacccggtccaccgtggaccgtgaggctgctgcgtgggccccactcccgtggacccggtccgcgcgcccctcccctcggctgacgcaataaatccgattttaaattaaaatttaaatgaagaaattcgcaaatatccatttaaagagcatataaacttcaaatggccataacttggccatttgaactcggaattggaccgttcaagtctctaatttttccttaagaagtcaagaacccatttttgtgctttgtttctgcttgttatatggggtttattagagtaaaagccttttcttttccgttggtcgtgtagacgctgcagcttcggaagatccgctcttcgtggaagttgaagccgacgtttgggaaagcgagcaaggcaagtcacatcatctttgaacatattgaatcccagtttacaaaattaggttgatttaaattattgcattatcgctttatttaaattcccgcgttatcactgttttatttagccatgcctatttacctttgttatgaccttattattattgttattgttattattaccttattcaccctagaataaacaaaaccccaactagtggacactctactcatagtaccactagtataattttaggtagatgcttcgcaatttaattaggtaacattaggcggtttacaactctagactttgggaatattcatatcacctggacactttggaatggtttggttgttgtggaattggcttcacaccgccccctctattcaaaatccccaaaatggttttaggctgggctcggggtgcatggttttgatagtagcacctcggccatataaggaccggt

SEQ ID NO: 37908 - DNA, 1501 bp, Oryza sativa
attttggccacttaaccataaaaccaaattaagaaggctttctcaactatcgaaaccatgtacatttatatctctctggatggtttaaacgacgattttatatatcctatggtgtgttgagttcacgctaaaattagaagtttgattgaaattgaaacgatgtgatggaaaagttgaaagtttgcgtgtaaaaaagttttaatgtgatgaaaaagttgaaagtttgaagaaaaagtttcgaactaaactcggccctagtgaaacgtccccaagaattcatccggtgtgacgtctacatagtgctttcgttcaattacaataacttggtaaggaaaacataaaaacttaatgagacgcaacaattctacctgaaatgtcaagagataatgaatctctctaatgcccacgtcggttatataaagaaaataaattaaaaatattttagaaccacgttccacttaccttccttttcgataaacgggagggtaaactgatttgctattgttttcttgtttaatatgtattctcttcgtccctaaatataaggggttttgataagatgtgacacatcctagtataaagaatctggatatgcttccgtccagattcgctatacttggatgtgtcgcatccaaccaaaatcccttatatttagagaatagagaccgatggagtttgattcaattgtgctgctgacaagtaagtatagatggtcaaataggccattgggcccgagcacgaccaaacacggcctaatcaacacgccgagccgtgtcgtgcctgtccatgggctataccaacagtctaggaacagcctaataggttcgtgtcgtacactcgtgccaggccgagccaaaggcatgacaagtatatcgtattctttcttggaataaatgtaatttgccctgaaatttttatattttggtccttggcgccccgctctgccgagtcagcaagccctcgtaggctctggtgccacggtggcacggccgcggcgccattgtggctggtggcgccatgttggaggacggcgtcaaccactctggcgccccaaaaaggacattcccggtttaagtttttccagggacctatttgtaaaataagttttcaataaggaccaaaatataaaaattccaggtaatttgccgccctcggtcatttggattgctgtctgtatgatggagtatgatatatgactgatcatccatacatttggagaagtgaaatgtttacgttttgatttcggtcttttctaaagcaaaaggcagcccatatcttgtggagatcaatagtttcagacttcggagcagaaactgaacaaaaatcagttcagcacttgagctgatctgatctggagttgtgtccccgtcgacgccgataccttcctcaccggcggtgccactccaatcgtcgccacgtagccgtcgacagcacatggcggatgccaccgccggccgtcgcggcgttggacacacacagagcaacagcaactgacgccgcc

SEQ ID NO: 37909 - DNA, 800 bp, Oryza sativa
ggccccacttcccgtggacccggtccgcgcgccgctccctcggctgacgcaataaatgggatttttaattaaaaattaaatgaagaaattcgcaaatatccatttaaagagcatataaacttcaaatggccatatcttggccatttgaactcggaattggaccgttcaagtctctaatttttccttaagaagtcaagaacccatttttgtgctttgtttctgctgttatgtggagtttattagagtaaaagcctttttcttttccgttggtcgtgtagacgctgcagcttcggaagatccgctcttcgtggaagtcgaagccgtcgtttgggaaagcgagcaaggcaagtcacatcatccttgagcatattgaatcccagtttataaaattaatttgatttaaattaatgcattatcgctttatttaaattcccgcgttatcactgttttatttagccatgcctatttacctttgttaggaccatactattattgttattgttattattaccttgttcaccctagaataaacaaaaccccaactagtggacactctatttatggttccactagtatgaatttaggtagatgcttcgccgattaataggacaacattaggtggttttataattttagactttgggaatattcatatcacctggacactatgaattgttggtttatggtggaattggacatacacctctcttcctctttcaaaacccctaaaacctattttcggtggggtttgggtgcatgccagttgtgggaagtagcaccccggccactataaggattaa

SEQ ID NO: 37910 - DNA, 1501 bp, Oryza sativa
attccatattttagttgttgagcaaattttaagaattaaaacactgacttgggtacattgctcggcttgcccatatccgagggctcggctattcgaatagatttactctgatcagaggtgtacatctttacccacaagacacatctttactccgcattccatggccttggaacccgtcgtaaagatgtgacataacccttcacccatcctagccgtgaacaaaagtaccgacccaaccctgcctacggccggtatcccgggacaggcaggccagggttgagcccctagcaacaagatctagaccgggtgcgccacacacataggggtgagaccacccgcgtactagtccagtgccatggcatctcgactaacgggcaccgacccgtgtagtcttcatttgcctagacatctcgattaccgagccgcagctcgcgtagccttcatttgcctcagagatatccatcgtcgcaacgacttcatccatctctatccgtgtccttttgttcaggactagactgagcaccgagttaagccttacccattagacatgtggttagtacggtagtgctttgcaacagaggcccgagcttaatccttatagtggccggggtgctacttcccataactggcatgcacccaaaccccaccgaaaacaggttttaggggttttgaaagagaaagagaggtgtatgtccaattccaccataatccaacaattccatagtgtccaaatgatatgagaattcccaaagtctaaagttataaaaccacctaaggttgcctaattattcagcgaagcatctacctaaatttatactagtggaaccacgaatagagtacccactagttggagttttgtttattctagggtgaacaaggtaataataacaataacaataataataaggtcataacaaaggtaaataggcatggctaaataaaacagtgataacgcgggaatttaaacaaagcgataatgcaataatttaaatcaaaataattttataaactgggattcaatatgctcaagggtgacgtgacttgccttgctcgctttcccaaacgccggcttcaacttccacgaagagcggatcttccgaagctgcagcgtctacacggccaacggaaaagaaaaggcttttactctaataaactccaaacaacaagcaggaacaaagcacaaaaatgggttctttacttcttaaggaaaaattagagacttgaacggtccaattccgagttcaaatggccaagatatggccatttgaagtttatatgctctttaaatggatatttgcgaatttcttcatttaaattttaattaaaaatcccatttattgcgtcagccgagggaggggacgcgcggaccgggtccacgggggtgggggcccacgcgtcagccgctcggtccacggtggaccgggcgcacccggctggcggcggtcggcgccgtgggtcccgcgcgtcagccgcacccgcgggcgcgggcggctgacggccg

SEQ ID NO: 37911 - DNA, 1501 bp, Oryza sativa
aagtcttttgctgttatgatgtatgttaggcttattctgcaagttgattaagcaaacaacctagcatggttacatcacaccccactgatgcaaaccacgcgctacacacacaaacaaggaaacacacgactaacgactctaccctagagggtggcttaggttctgcgacgggttctccaagatcttcactcctgcttcacagctggcttcactgcttcctccacttcactagcggatcctgcagtcttccggagcttcggcaaacaattgacgacatcttcttcttcgcaaagctgaccatctagtactagttgaaaatccgaagaaggaagaacggagtaaaccttttgcaaatagcattaggggaaggagaaaaaggaactttcgcaaatagttttattcataaaatatgtccttaggttttatccacttggcttatcctacagtcgagatggctctgataccagcttgtcgcgaccgggaaaattgccttttcccgaacgctagtgtattaatccccgtcccaggaaaagccggggtacaccacacaaacatgatataaaagacacatctttattatatcgataatatttacattattacaaaggcgcttcaggcctgacaatcaaaaataaacagcagcggactagcgggcctacggctccatcttcacaggcgctcaactggggtataagccaggactccacctaagacatcttctccaaagcttctcttactgaaggggggagggattgagcaagaatgagtacaaccacagtactcagcaagccacaccggcggatgcataattaatgcaagggaggtacaagggaataataatagggattaagttttgcagtaaacagcatttaaaagtcacttagttgcccaaagccatttataaagacgatcctagagctacacagtattattaaacaaggccgtgaaccctcacgaacctgccttaacccaaggcctacgatgattcggaccgaactggcaacccgacctgggttccagctcgtcccaagccaacccaggccaaccattccatattttagttgttgagcaaattttaagaattaaaacactgacttgggtacattgctcggcttgcccatatccgagggctcggctattcgaatagatttactctgatcagaggtgtacatctttacccacaagacacatctttactccgcattccatggccttggaacccgtcgtaaagatgtgacataacccttcacccatcctagccgtgaacaaaagtaccgacccaaccctgcctacggccggtatcccgggacaggcaggccagggttgagcccctagcaacaagatctagaccgggtgcgccacacacataggggtgagaccacccgcgtactagtccagtgccatggcatctcgactaacgggcaccgacccgtgtagtcttcatttgcctagacatctcgattaccgagccgcagctcgcgtagccttcatttgcctcaga

SEQ ID NO: 37912 - DNA, 1501 bp, Oryza sativa
ggtggtggaggaggaggaggaggagagcgccgggaatggggaggccaccggcgcggcggccattgcggcgcggctcggagtagccggaggcgagggcgagctcgcctcgctgcagttttgcgccggagagcggcgcgatttttcgtccgcgcggggaagaagaggatgaggctgtgcttagtgacgtggcaacgagagtagtcaagcgtaacaggacagggaggggcaccaagtgaccgttggatgagatagcgacgctccagatctctcctcttatggaagacaggcaaccagccagatttaacaccacaggtttagcagatttcacggacaattttgggtagatttggatttgatttatactaagggcccatttgaattgtaggattgaaaaaacggaggaataggaaaaacacgagattttggtaggattgcaagtgtaaaacagaggattacaaaacataggaaaaatataggaatgaccgtttgattagaccgcaggaaaaatgcaggaatcacatgagagatagactcaaggaaagttttccgaggttagagtggatgttaactttcctacgtttttgctctagaattgtaggaataggaaagtttcctacgtttttccttttctcgttcctacgaatcaaagacatgaatagtgtaggatttcaattcctttgtttttcctccatttttcctccaattcaaaggaggcctaactctttgtttttcgtcgagaagtaagagcccctttgaatcaaaggaattatgaaagaatttcatagaattgaaatcctacaggaaatttttctatgtaaccctttgatttaaaggattgaagttttccaaatcctacaaaattccgatggaatggcttgttgcatattgcatataggttttgaaggaaacttagcaagaggtccaacctcttggtaaaaatcctttgagtctatctctctcatccgattcctgtgttttcctgtggtccaatcaaacgatcattcctgtgtttttcctatgttttgcaattctctgttttacaaacacattcctgtcagaatcctatgtttttcctattcctcctttttcattcctacgattcaaagtagccctaaaattatactagtagttaacactctttgttttttgtcaagaagtaaaattatactagtagttaataacattattgatccatatttttcagacacaaaatactcttattcttctcagtcctctcttctcccctcttctcaaacacacttttaacacaattaaacagcgtacaacctttttttctctcccagcagttagcatgaaaaactataatccagatgatagaacttaaccgtaattaagtaataaaatagatttaggatttactacacttattatctcaactctcaagttgtcaaaagaacagtgcaattatcacgcatcagctcgaaattttcagcatctttggcgctcagttgggtagaacactagaaccaacaaccgaaga

SEQ ID NO: 37913 - DNA, 990 bp, Oryza sativa
ttatttccgccacttctcagtctgttgccccgcaatgaaccttgctttacaaaagataaagccgttgcccacgctggcttgtggttggcacggttaatgtttcacaaccgaaactcgtgaaccggttcttaattgtcatgagcatgaccatcaaaaccatgtgctcacaacccaccattaccaggttttagttggcacattaattaattaaccaatcatgattgaccatcgtgaactatcattaagccatcattaaattatagtgattcataagttatcccaatagtgtgctaatgtttctaagcagggctaagcaattatatctaatatctagttgaaccaatataaataaagctcaactagtcaaattgtaataacccaaggtatcaaggaataaggtaatcaagaacaaaagggctataacaaacaataggttaattccacccaatgacattcgaaaataaatgcaatagttgaatagaaacagtagctttaaacgggatcaatatgctcaaaagggttgtttgggatctatgtgacttgccttgctggccttggaactcttcaaactcttctccggcgaaaacggactctccgaaaacgacggaatctaaacagaaaagagcaaaaacaccaaaacaacacataaacaagcttgaacagtacatgtggatatttttaacatgtagatctcaattttagaaaaatttagagacttgaaccaactaaatcggagctaagatgaattagttatgaatttttgaagattaaatcggattaaaacagttaaattgattttaattgaattatgacgcaataatgaattatttttgaaaaggaaaaagaaggattattgcgtcagcgggctagggtttcggtggaccgggcgcacggcggcggttcacgagaacggacggccaagatcaatccatccaaaacagacggccgagatcgatcggtccacgaccggttcacgggggacggggacga

SEQ ID NO: 37914 - DNA, 405 bp, Oryza sativa
  unsure (1)..(405): unsure at all n locations
ttctcttttatttaaccaaactaatggcacatgcacttcataatctcttttaatggttctcattcaanatttattccagtgttattagtactgtacatctattactgtactaatggctcatttatcagcaaaagttttacaatattgttttatttaatcttgctgcaataaaataaatttagcatgttgattttataactttcttttatctcttttgaaacctgttattcaaaagttcaaaactggtgaccttgtttccaactgtttcaacttatcttgcaagcttggtttactttatttacttacctttttactttgattttctaactctattcaaattaatccaaaaacttatgctattaattggataaatgtcttaactccctcctttcacttgtctttaga

SEQ ID NO: 37915 - DNA, 1501 bp, Oryza sativa
cataatagggttccatttgcaaaagcagcatttagcaaacatttgagaatttaataaaacagttaagtaataattaaacaatattaatccaacactatacaacgtaccctgttgtataggcccaaccattctgaacaaccatcccggctgtacagatctatctccaaaccaggaatgtaccattccaaaccaggagctaatcaaattattaccaattatagcatcttctattagggtgagaagtgtgggactaatcacaaaagacattgttagactcgcccataaccgcgggcacggctattcgaatagttttactctgatcagaggtgtaccactgtacccacaagacacaaccccacatcatgtcaccatgtgcctcaataccaccacggtacctcggaaaggagttgtgacaataccccttgcataacacaatccaccgcagcgcaccttcctggatcataatcacccccttataaacaaggcatggactccccagcgacccccgtgggcttatctccgccacttctcagtctggtgccccgcaatgaactatgctatacaaacgataaagccgttgcccatgctggcttgtggttggcacggttaatgtttcacaaccgaaactcgtgaaccggtccttaattgtcatgagcacgaccatcaaaaccatgtgctcacaacccaccattaccaggttttagttggcacattaattaattaaccaatcacgattgaccatcgtgaactatcattaagccatcatgaaataaaagtgaattatagttatcccaatagtgtgctaatgtttctaagcagggctaagcaattatatctaatatctagttgaaccaatataaataaagttcaaccagtcaaattattataacccaaggtatcaaggaataaagtaatcaagaacaaaagggctataacaaagaataggttaattccacccaatgacattcgaaaataaatgcaatagttgaatagaaataatagctttaaataggatcaacatgctcaaagggttgtttgggatctgtgtgacttgccttgctggccttggaactcttcaaactcttctccggcgaaaacggactctccggaaacgacggaatctaagcagaaaagagcaaaatcaccaaaacagcacataaacaagtatgaacagtacatgtggatatttttaatgtgtagatctcaattttagaaaaatttagagacttgaaccaactaaatcggagctaagatgaattagttatgaatttttgaagattaaatcggattaaaacacttaaatcggttaaaattgaattatgacgcaataatgaattatttttgaaaaggaaaagaaggtttattgcatcagcgggctagggttttggtggaccgggcgcacggcgacggttcacgcgaacggacggccgagatcgatccaatccaaaacggacggccgagatcgaacggtccacgaccggctcacggcggacgaccccga

SEQ ID NO: 37916 - DNA, 361 bp, Oryza sativa
acctttgagcatgttgatcctatatttaaattctctatttatttcaactatgaatttattttcgaatgtcaccgggtgagtgtgaacctgttcctttgttatggccaatttgcattgattatcctatttcttgattacctcgggttataatttgactagttggatttatatattggttcaactagatatattagataaattgcttagccatgcttagaaacattagtacacgattgggataactaatgtttcactactacttaatgatggacatgataatggtagctcacgatgtctaatcatgattggttaattaattaatgtgccaactaaaacttgataatggtgggttgtgagcaca

SEQ ID NO: 37917 - DNA, 1501 bp, Oryza sativa
tccagaagaggagttcctggaggatgaaggctttggtgtctagctcgtgcctaccgtgaagtgcctgtggtcgtcgccctagtcttccattgtttttcgtttctcttcatgtgtgctaggccttcgtcgcccatgtaataaattaactatttacgcttccgcttgttaaactctgaattgtatcaacttttggtgtaccttgcctcctgggacaaggataatacccgcatgtatggaatgcctgttgggttaattctgatcgtgcaagttggtatcagagcctccttgaccctaggacgagccttagaccccaagccttattcgtattttgaaataaaaaaccaccccttatttgcgaaaatcctttagtctttctctgtcttgctgctttatttctcatcaaaagctgatctctaaaatttttcttttgcctttgtttatagatggccaacaacctcaaccggtgtggtcttgatctgactggcttcgctttggagctgcggggcatgtgcgttgtccagggatatccgcatggagtggactaccagggcaagaagctttcacagcaggatggtgacgatgcacagccccgtgccgcttgggaggtcactactgtgatcctcaccagctcccccgagagcaattcgctggcagtcaccgcgggtggagactccttccccgccgcttggcagaacgccgtgctcctcgccatcggcactcttcaccagtctatccggacgagttgcagcactcgccctaccactaccaccctcgtcatggaggaacccgcgactacgccgccttcagggatgctagcgcggaggatgacgctaccatcatgcatttggcgtgcatagtggaggcgtatgacacggcccgtatcgatttccatcgatatggtgcgccgtggtttggtcgagaacaacatgaagatcctggagctgcgtcaggagaatttctagctgaagaaggagttggacgccgtggaagcgcagctgtgtcagcttaagattgcttaaggacaggtctgccaccccaagcaccgccgtgtctgttgcagtcagaagatcaccgcccgcaagagtacctccaggcctgagcttgttcgtcagtccttggcgtggacctgcttcgtggagactccttgcgccgagcccgcacccttggttcctcaggaggagggagcctttggcgttggcagcacagaggatgtgctgttgctcaccttccgccccggcccgtcgcagaagtagacgagcagctagtaggcccgcgcgtgtgttcttttcgtttgtcttcttgcagagtcgtgtggggcatggttataccggtgtgtggtataactgtgtcggagcctgtctttatttatttcgcataagcgacttgaaccttaatgaaccaatttaatagcagaaataaattcaagaattatggtagtcgtgggtggttagttttaatcgtcaactctttctgttttctggttctatgtggaatctttaga

SEQ ID NO: 37918 - DNA, 1501 bp, Oryza sativa
ttaattttaatctgctattgttcttgttctagttgttttttttttgggttcaatttcgatgaagctttcgttttccgttgtggtcgctggattcatctgctgggtgtttccgtggaaatctaggttttcaggtttggggggcgcactgggaattgggcatatgaatagttggggatgtaggagaattgtagtaatgctgatcgtttggtggaattttagccgattatccaaagttaaattcctttgctgatgataggctgattcttgattttgaaaaaccttttttttatgccgcagcttttttggctggagtcgggagtttaactagtatcttgttagggttagtccttgctgttacttttgttgtgtttttgtcaccttgttggtaaaaacgagcatcctcttggaaacgatggaggcttaaggaaaaccttttttagtgcatagattttataattcactctgtaactacccacatagtcgcgctttgcatgacttttgattgtttaataaattttgtgtatgatctattagtttaggtaagcttttaagaaggttttgacataataagttaatttgtttacaaagtattgatttccctagccaactatagatttagctaagttgtactatatgtttataagagaagtcactataagcctcatgtttcttctcttatcccctctcttttttatcatgtgtctaggaggtggtaccaaaacctccggaaattttcatatgtttagcctatttgtggttttttttaatacatgtacccttttgaaccaatggccattgtttatccaaacccttcatctcattgtgtaatgtatcgacacctctatggattagtatatttgttgaaatttgtatactgcgaattcagtgtattaactcatgattttaggggtagtacttagtacttgctatcgattattcaacagaatgaagctgtgcattgcctttttttttaaaaaaaaagaaagaaattcaggttgtcaatgtatagtatatgttatgtcctgtggtggtaggtgtttctctttttttttctatcatggagtttatcatggtgctttttactgttcaacggtacgatgatatgattgtgtctcacataatttacaaaaattttgactgtctttaagagattctgcctattaatagggtcaaggaatgaattatggcccacttactgatttaatatattgggtaagagaaattgatgtgggatgcctgatggctgctaaaggcattcaggcctgaagaggttggcaggtttccctattacaatgattaaagaaactgagataactgactgaacagttgctctctggttcatcattaatttgtacttatttgcatgtaaaatgatcctttatttcaagtggatgcttttcttctgttaatatatatatgttagtgttgtttatattgtcaaaaagacacattctttttaatacttcattctataagcttttctctcttgtttcacagaaga

SEQ ID NO: 37919 - DNA, 1501 bp, Oryza sativa
acatgctcaatggattaatagcaaccaaaactcctaaagtactagcacgtgggtgtctccggttaagactaattggagaggcctctccaattaaaattaaatttaccgtatgtcatttttttatttttcataggacactgaaaataattcattctgaacagaaaaggagctagttgcggtactctgaagataagttcagcccaaagaacagagcatgacagtaaaatgatgaaactgattccagaatagcaggagacgctattgtttatctattgtccctttatgccgaagacatttgcaaaataaaatcccatgcaaattatttttctcaatcatatgtcattcacatgaagaacgaagtagttaccagaagattccaatttttctaataattccatgtgaactagacagctcttggttaagttcatctgttcatatgctgacttgtcaaaaaagggtgacaactgaatgacaatcctgctgcttaacaaaattaagtaagcaaacatgcttgtagagtatcttgttaaactttgtagattagtactgctagttgaaacaactagatgatgttcatggagaagcagaagtggaaagcttgcaaagcagttgagatgggttaacgtttctcaggtccgttgaggatgaatgtatctttttctctctcacactctcctctacaacccttctcgctgatggtgcctgagaggccaccgtgtttcttagttgtttggacagtttgctgggcagctactttgtaggtctagcggtgtctggtcacacgcacagtggtgttgtcagcatgtggtggtgtgtttgtttttcttttcattcctaattacagattcacagtattataggcttatattttttttctactatattaatatgagataggagtatcacactgtccgataccgtttgtttcgaaaaagaagagcttgcaaagagaggaggtaaacaacatgttgcaaagctaatgtgataggatgctaattaaggtgagagaacggaaaccggtggacagaccacctgatgatcttttttctatatgcttgtgtatttagtctgctcctagttttccaagggtttatggctctttagtaggaaaaggttggtttttttcttctatgttaatgcctaaatataaaagtaggcctttttatgttgcaaaaatcgtgtttttgtaagatggaaatcctagcggatcggtgtggtatatgaatgtgggtactctttttgtttggctttcttccaaaagctaggtcattatgcaatataatgatcttacttttaaaaaagttgaaacaactaaggatggaagtatcccagatagaccgagtatcttctctagcatagttagtactaatgtattatgaaaaccaattataccaaattgccaaccaaggttctcttttgagaacaaccagagacctgcattattgtcattatcttccttcctagaacatggcattgtgctacatggttagtagattgcaca

SEQ ID NO: 37920 - DNA, 1501 bp, Oryza sativa
accctcaacatcatcccaaatgggtgagagtttgctcaatcttgcacgcgttgggacgtggacaagacgagttctttgacttgcagtgaccaggcccggacgttgcactgatggtagcgccgcaggctttgttggtaacgggtagcccgaaggctgcacgttgccttcgctctttatggtagttgaggtcgtcgtgtcgaagctgatcttgatcattttcgttatacagtgatgcccagggtgaccccagggtcagcttggatgggaggaccgcctcagccccgtgcacgaggaaacatggagtttctcctattgcgcggctcggcctagagcactgccggcagctccaagatcgatgagtccccgagcttcttgaggacgttgtaagttttcgtcttgaggccattgaggatttccgtgttggcacgctccgcttgaacgttgctcttggggtgggcgggtgaggtgaagcagagcttgatacccatgtcgtcacagtagtcactgttcagcaatggcgcagaaattgtcctggtatatttatggttacggaagttatccgcaagcacacggatatactattgtagcatttcacccggaagtattccaaggtatcgtatttttaattccaagggaagataatatgagtagactatgctaatactctttatacatacattatttgtatttatcaaaatctaagcagaggttaattttaatataggggtagagtgacacgaagcaaagctatttaactcctcataataaaataattctaactaagtggaagaaaaaatagaaagcactcaattactatacttctaacatacactcaattcctagtttacatctgctaatatacaatcatatggccaatacccccccacagtgtcctcctggtaacatcgagagaccaccccgggttggccagttcttacgacaacctatcatggccgtccagccggggcctaaaatacggaggagtccctccccaggaatttgtcttaggaatatatactaacgtggaggaataccagtactgagctatcaccatcagcggcccacctctactgtcccgcacatatatgcccaattaatgatatttaataatctaagtaccacacttacattactaaatactactctatacccgcgcacacgacatagagcaactggtaaaccaaacattaaacccgcaccattacacctctctggtaggctacccacataattaatataacacagatataatgtaagaccagtactcagactgaacaaaataccgaagatgtataaaaatgagtatttcattaattcggaaagtattcagaagagaatacaagagctgctagagccataccaaaactctttcggagacctcgaggactccgaatactaatctactctactccgcttagcactatactactaatactaaagtatgaagaagaatttgagcttgcttgagtgtgttgagagagtgaatgagctcctcctttta

SEQ ID NO: 37921 - DNA, 1501 bp, Oryza sativa
gccactctagtaaaaaaaactccaacagcctctccaactggatggccaagccatctggccggccaaaatactccctcccctagcaaaatttggccagccaaagtcactggctaatggtgggccccacgaaaacacgcactgcgaggggagatggatcgcggcgacggcgagggaggggcgaaaaaggccggagaggagcgaggcggctcgatggcgaggacgcgaaggctcacggtgagggcgcgacggcttgacggtgaggtggatctacgatgagggcgtgacggcgagggaggagagaggaaggccggcgaggagtagatcctgtcattgcccgtcgtcgtctggcgggatggtggcggcagtgatggccccgagctccgccgctgtccccccccccaagccgttgacgccttctgccttcctgcgctgcctccgctgattacggactccattgcgtcgccttcctgcctccccgcacccgcctgcgcccaatgtcgacgggaaggaaggaaaggggaagaaggaaagagaaggaagagggggaaagagaggaagaagaggagaggagaggctgacatgttggtctgttgttattttggagaggattaatagagagtttgttggagtgagtatctcgtttggctaggcaaatcagataaagagttagctatatggatatttagagagtacaatttagagagactattaaagatgctctaagggaatgacatgtagggcaatatgctacaaagtacgattgcctcaatcttctcatctcaacaggataacatcattttttacactgccacgtcactacccacccgacacttaattttttatcccaaccagctcaacaatatatccatcccacggttaaaaacttttttctgtgctaatcccatggctaaaattggctaattatccacacattatccacaaatccagtgcaacaaaaaccccaaaaaccgcacgcacaagacccgggggtgcgtgtagctcctcaaccatataaaactccacgcatccaacgacctcgatcccctgattactctctcctctgttctgctctgctgttcgtcgcccagcctagattagggatgatcagggattagattagtgacagaggcccgattaaacaagtgatcaaactcactgttaatttgtttaatcactgctgattgatgctgctgctgctgctgtgatttttttagggctaaagagtccaagacgagaggtatctttcttgaacaattggttctgttgactcgcactgcactctctctctctctgtactcttcttatagctgttgctttctttctctcttttttcagagattcagagttgtcgtgtgtgtataaacagatttggagttgttgcgaaatttcttggggaggagaggaggaagagtgtgactctgaatctctgtctctgaaactcagagagggagagagagagagagagagagagagagagagagagagagagagagagagaaga

SEQ ID NO: 37922 - DNA, 1081 bp, Oryza sativa
acaaaggggaaatggaggaattatcaaagattgaattcttaggggaaataattcttatgtgattgttttgaataaaagaatgactctgaaaagcatcttcagaattcctacggaatgggccatttgatggaattttttttttgaggaaaactaacatgaagtcttacctcgtggtttctcttacaaaaacgccacacttaggtttttagcctttggattagaatacaagagctgatagtggtcgagtgcatgagtacaccaagataggtgtgtgcataggataagttgcctagatctcaccccaaaattttaaactctgtcatatcgaacgtttaaacacatgcgtggagtattaaatataggctaaagaaatagctaatagcacatattgcgactaatttgcgagacggatcttttaagcctaattgctccatgatttgacaatatggtgttacaataaacatgtgctaatgacagattaattatgcttataataaattcgtctcgtggtttactaacggatactgtaattagttcttttattagtgcctgaacaccccatgcgacaccctatataatacctgatgtgacacgccaaaactttacacccctgtatctaaacacctcctagtatgcaaacttcatcacataataagtggcaacctattcacattttttctgtttcaaccacttttgatttaaattaattccttcccattttatcattcatcatttaaattacatgccatcccactctcaatcccatccgggcatttaggtaattcgtttgtcctactaatttggtttttaattaaattctacaactgcacttaatataagatggagagtactcttgtacttttttttcctgtctagatttacatagtagtgtaagttacatttagttatagactgctatattctaggatgagagagtatataaaaaataagcaaaataaactaaatttatacaaagtcacatcgaagtttgcctctcagccgctaccaaaattaaaaattgtgaagcagaattttagtttctttattggctaagaataaaacgaccaccgcgccgcgcgga

SEQ ID NO: 37923 - DNA, 1501 bp, Oryza sativa
gactgcgcggcccgatccaaccgtaggagcactgaattcggccatagcggtgtcggaccccaaccgtcgctcatcagcaagcgcccatgaggctaccagctcaccgtactgttggaaatatggccataaatcggcatattttaatccaaaatgttaagacaataaacatgacatgcacaatgtgaagcgatctagtgataaaactaaatataactatcagcatgcttaaggtaaaataagcatcaacattgaggcaacgcaataatattgcgactgacagttttaacaaaatgaaaggtaacagaaggatgttataccctgtgaaagtccctccgctggaatgtgaggcagaattgcctccgttggtgttgtcgatcggcgcaccacctcctgctcctagcgcaccacctcctgccgcacctgctgctccaggtgtgccaccaccagtagacattgcgcaatgcagatagaaccgaacgacgacgaagaagcgagcagtcgtgcggaagcactccccaaaaacctgatcacccgcctacccgtgcagatctcaggagagggtgtggttctggaggccctgctcgtcccaatcacttgtacatgcaagcgatcagaacaaacaatggagaattcgtggagaggctgatcgtcggtctctgtctcgtcctaatagcgcacgaggaggattcgcttctgtaacgacacgatcaatcagtattgaatcgctcgcccgttacagaagtaatctcgtggagtgaatttttaaccgttgcaaaaggatcgagagagagccgggccacagcctcggctcggctcggcgcgcgcgcgtgtggctatccgacccccactttaaccggtcaacggggagcctccgataactgccttttaagttgagatactacgcttttaattcccaaggtggtattattatctttaacatttattatgggcccttgagattttaatagaaataaattgggcctagcccatttattctaacacgtactctgccctcctccctcgcaccagagactgcgtgtcgctgtgttttagccccgctgccaccatcctggctccctgcacggttgtctggcggcggcgagacagagagagccggaaagggtgggcagcggaagtggatagggttttccgccgagctgcccgcccgaggacaacccagggagaggctgcttcctgtttccatctacgacaaactcatgcttcatacatttgtcacggcccaaatgttctaatcctatttaaatgtttcctggtgcggtgctgaatccatttgagaacatgtgcagaaatccttctaaaaggtaaacaaaaatatacaaattgcagacagatacaaagtgctctctcattgcagttatgatcatgtggtgaacaattacttgatccacaaattgatttaaatagccagagcaaaagttcacgttaatataaggaagtatggaaagagcccagacttagatatggtcaatatagcctactc

SEQ ID NO: 37924 - DNA, 1501 bp, Oryza sativa
caatccgtatcttggaaacaaatgagagaagaaccaggaatcgagttatccgtttttgcaaagtccagtggagtaatcactcggaagaagaatcaacttgggaacgagaagatgaattgaagtcagctcatccgcatctgttcgccagttcttccgaatctcgaggacaagattctgtttaaggggggtaggtttgtcacaccctgaaaattcaaaatatataaattgttgtttaaatggaatttttagaattaattttaaaagcctagaagagaagatctaattttaattaataaattccaatataaaatggggctagataaaatttcattaaatactttgcttaattctataattcctagatttttctgggatttatttgagctaagaaagtatttttaataaatggaattgcatttaagaaataatttaaattgaaaaaggttttaaaaagtctcttttggctttgggccgaaagtcggcccaaaatctctcttctctctctcctcggcccagccggcccagtccgccgagcgcgcgcgcgcgtccgcccgctgacaggtggggcccacctgtcagggccatcgtctacctccggccgccgccgccgaaaccctagtttcgcgccgtcgccgtttccttccaaatccggccgctcctttccttctccggccgaattgtttgaggggaaacaatctccgggatcttctctaccttttctcctttagaatctttggctaaatcgttttggaaagagttggattcgagttcgtctcggattcgttcttcccaatctttccttcctcgtcgccggccgccgtgggcctttgccgccgcctccgagcccctttaaatggacccccggtgtctcctctacccgccgccacccttgccttcgcctctcgtcgtcggaagagctctagcgccgtgtgccctagcttcgccgtcgccgccgccgctccagccgtgcgccgccgtcgtttcagccgtcgccgtcgctcgggaagaccgtcgtcgtggtcgccaagtcgtcgccgtcctcgtccgccccttcgccgtcgccggagatcgccggagcctcgtcgccgtcgtcaacccgaaagtttccgccgtttcctcctcgtcgccgtcgccgtccgttgatcttccgccgccgttttggtcaccggtgagttcgccgcgtcgtcctctacgtcttggtgccctccgtttgcgtcctagcgccgccgttcgccggcgagcgtgcgccgcccgagccgtccgctccgccgagccgccgccgctgtcggtgacgtcaccgctgacgtcatcggggtcgtccgccgtgagccggtcgtggaccgttcgatctcggccgtccgttttggattggatcgatctcggccgtccgttcgcgtgaaccgtcgccgtgcgcccggtccaccaaaaccctagcccgctgatgcaataaaccttcttttccttttcaaaaataattcattattgcgtcataattcaattt

SEQ ID NO: 37925 - DNA, 612 bp, Oryza sativa
  unsure (1)..(612): unsure at all n locations
aataaggtagtattggtaatttccagcctaatggtgtcctcgtaaggaaatatccaaaaagcatattgtgacgccgaaagataattcgaacccgggtggggttgtgattgaaggttagacaaacaacatgcctgaaatatgtaaatctaactagtgaaatagcttttatactattatatagatatagacttccgaaggcctgatggctttgtcttcaatcaccaaaaaggggtatatagaaagtacaggtcataatactttggttttgatgatgcctgataaattcaattatgtgagcctattttggatatgaaagtcctaggcaaagccctgtcagttttcaaggtcaaaaaaatgtgnatatgaaagtggagtgtgtagatctacttcagaaacttcaagaagttaagttaagatagaaacgttcattggtaacgcacataacttccaaggatgaaatccttggagataaatcttacaacaatctctctctctccaggtacatattgatatgtccaaagagaagattacgatgtgcacatcattattcacatgaccctaatgtgttgtaggagcattttcggcacgtttagtctcttcaccctgaaaaca

SEQ ID NO: 37926 - DNA, 1501 bp, Oryza sativa
ttgaatgcagggtttcttttgaacggcgtggatcactccccaatgacagttggagggcaattccgaccattccaactgccacaaccgtcattggcagcctatttaaggagctcctcttctctcttcacacacacacctcgagcaagagctctctcatattctctcaagttagtttagtagtcttaagctagtggagtaggaatagagtagaaatcggagtccggaagccttcggaagagttcgggtatggctctagtagctcttctcttctcttttgtaagctttgtacttttattaaaacactcttctttatacatttatggtattgaaatactttccgagtacatgaatgctaactttatattatgttcatgttatactgattatattgttagcttatctgggagatgcatcggtacgggtatagtgtttggttatgcaattactctatgtcatgacgatgatactagagtagtttctggtagtttaggcgtggtgtctagatttggggatatcattattttgggttatatgctgcagatgagacgtgggccgctgatggtgacggctcagtatgggtattcctccgcgcgtgtatatagtcctaagttaatttcctggggagggtactccttcatatttagccccggttgtatggtcatgatgggctgtcgtaaggaacttggcagttaggggtggcttctcgaagtactaggagggcatcggttcgagggtattagctagtatgtcagataactagaatgtatgtatactatgtatactagaagtataggaatagatttcctttctcttttttttcacttagcttaggtaatttagtatgagaatgagtagcttcctgcttgtgtgtcattctacccttcgattatcttaacccctgcttagactatagttattacaactaacatataaattattagtcaggttctctctattatgatcttcccatgggattaaataaatacaatacccttcgaatactttggggtgaaatgctacaatggtatatccgtgcgcttgcggatgaactctgtaaccataatataccaggagtatttatgcaccattgctgggaattatatttctagtaatgtcgtttagaaataccaacaagcatttctggcaccgttgctggggaagatttgtaatagagattaccataactagtactttatattttcctctgtataatcactgtcctttgcaggctaaccttggttgttttcacttttattatggaaacagggtagtgcacgactggttttaagttgccagaaaacttcaaagaaaatccagaagctttcttctggagcgtcaggccgcgagtcgctgctcgacagaaaactctaccaacagagaaaccagccgtaccagcgtcaccgaccttcaagactatgactaacaagactctccgtgaattcgctgctccctctgctgacaatgtgaccattgggccacaaattaacctgggagacgtgga

SEQ ID NO: 37927 - DNA, 558 bp, Oryza sativa
  unsure (1)..(558): unsure at all n locations
cgtcaaagcaaaggaaaagagataccattactaaacgttagagaaagagagggtaggatagaaaagcgagggtgccaaatatagaggaagtagcactaggagaaccaaagattgcgtaagcatacgcatcaaagatgtaacttccaaacgagagacttgaattatagatactccctatggtaagaatcgtttaagtaccagagaggagctatcctgatgtttaaaatattcaggtaagccagtagaacgctagagataccgacgtatgtcaagcaagaccgaaaaaaagtccaggtgataaaatgatccatagcacggtagcataggagggattcgttccaggaacattcgttacgttagaagtgattggttaaaacaggaaagtaaaaagggtattaaaaaggggaagagatgggaagagaaggaaaggaaggtgaagagngggngnnnnggccgaaccaccagctggcctaatccagcccattttccacctgcagttatctacaggtatcctatgacggttaggagcaattctaccggtagaaaccgtcataagca

SEQ ID NO: 37928 - DNA, 1501 bp, Oryza sativa
gacgaggctcgacgttgccacgtcgaggccacgcatcgaacgcacctgagagttgttggcgccgatctttcctctctcacgttctctcttgcctgctggtcggttggaggattgcacagggtgaggacgagccacagccactgataagtgggcccaaatcgatgacaccaaggttagggagaaagggaagggtagaaacaaaggtagacttgattttggacgattttccaggatttatttctcttccccttttttgttaattcatatattaatttgtgttgcagatgtgttcatgtggattttattgcaggtggatgaatgtacctagtttccattttctttggttgcacttaaaaattatggataggttgctcacagaaaattgaggaatatgggctatttggaaactagtttgaatttttaggaggtctaaaaagaggataaaaattctagaaaaattatatttagttatgataaataatctagtatttaaataaattatttaaagtatacacttttatgcattttaattcactttttgggtgaggtatggttttagccaataaaggattataattagtctactatgtgactgttttgactaatttatttgaggcaccaaacttagttattaagttgtaccaaaattacagtaagttgtatgtgttaaatagagactacataaattttcccatgattttaccttgcatattttattttaaataattagcaggatctttctatatatatgtcccactttataaatgcatctaaagatttttatgtaaagtacattaaacttctttcacttgtgatggcattattttgacttccttatcttatcttttaaaattatacctcatgaataacttttgttttgcttagtgaaattatttcccttaattatgttcatgagtcctaatatgcaatgccaaccaaaatccaaatgcactaagaagactcaagtcaaaacatgtcttatgcgagtatgcatgcttgctcttacgtttgcatctatgccctaggttagagatgaaaaaggttttaatttgttctcaaattttaatcatgcaatggtttaggtcggttattacctaagttaaaacgaaaatttttggctgtcaaaattggaaaagttaatttcaaactattttgacgagaaatttttaagtccgagaatttcaggtatgtgacagattcttttggtaaccgcgcgcaattaaggcgggcgtggctcgccccgtcttgaccgcaacgaccgcacgcctaccacgcgtgtgtcagaagcaggcgcgggaaatgagagggtggagttagtggccgtgagaaacaaggagccaggcgtgggtgaggggagtacaacagggcgccgcggaaggatttccttcccttcctttcgccacttcaatcttccacgcttaccgtgccctagccttctcggttcttcgcctttctctcgccgcgcacactcgctcgctttgtccctgctccgccagtgcga

SEQ ID NO: 37929 - DNA, 404 bp, Oryza sativa
aattgtcggtactgcacatgggagaattgagctggagcattgaaggatgcattcccaggatttgacacaaaggcaccagatgttgataaaatggaatatggggaagttgttatggatagtgcaagcctgggaactgcacatgaagaggtagaatgtgagcagcagcgcgaagatggcgatcgccgtcgttgatgtagccaggacagacggaccataggtgctgatgatggccgctggcggccatgggcgaggccagacagtgaacatgacggatgcacgcggcggatggcgccgcggttgaccacgatgatgcaccatataggctgtgtttggatggatccaaagtttggattttggttgaaattggagatgatgtgactgaaaagttatgtgtgtatgatagg

SEQ ID NO: 37930 - DNA, 518 bp, Oryza sativa
attgggatttaatccccaagaggatcctatgcaaggagggattgagagtggatcccaaccatatcaccctaaccctctggggatgaatttcttcctaccctctaaacctcattccgatacatgtgttctgtatagtctgatcctcttcaaaatgattgtaaagggttagctctataatctttcgacacaagcaaatccctggttttttttttctgacagaaccaatgcgcaataagcatgttatctcatacatatgtcatagaagtcattcttgaacctaaataaaatgtgaatgtatcaagacattcatatagtatatatctgaacgagagaaagtacgtgaagtttggccttgattgcttgctggtgtgtgctgcaggtaagggtatatagcaagaccattatagtcttttcacgtttattgtgcacatttatatgctcatttaagcctatctcaatgcatataatttttattcccaaatttcccttctgctataccggcaaggtttgttctcaga

SEQ ID NO: 37931 - DNA, 848 bp, Oryza sativa
atcgaacgaagacaagcgagaacgagggaacgaacgtgaacgagaacaagcgaacgaacatgaacgagaacgagcgaacgaacgaggacgaacgttaacgtgaaatgcaatatatatatatatatatatatgttacttcgcatttatcctaatacatctttttgtatcttgtagaaaagacgtgttgtcggagtcgtccgtcaagcctgagtggaagagctagccctagaaggaattggagcaggcaagtgacgtaataatataaatgattgttatatttgtaatgcaattaattaagattattagacctgtaattagacttatcatataagattgtgtagtgttctaatattatttgagttttaatataaaattattttattgcaaattagacttagtatgacattattgactacggaattggtgcgactcctagcaattgactattgtagtcttaattagacttagcatatacgcacgaaacacttagcatacatgactattttagtcttagcatgtaatattatttgagttttaatataagattactttatttgtaattagacttagtatgtaattattgactacggaagtggtgcgacaagtagcaattgactattgtagtcttaattagacttagcatatacgcacgaaacacttagcatacatgactattttagtcttagcatgtaatattatttgatttttaatataagattactttatttgtaattagacttagtatgtaattattgactacggaattggtgcgacaagtagcaattgactattgtagtcttaaaacataaatgtctcgtgacttagcagatgtttgttgtatcaacaga

SEQ ID NO: 37932 - DNA, 393 bp, Oryza sativa
gtctgacttggattgcatcacttcacttttgccagacagcacaatgcaacgattacatatacattttatgaataaatgttatatggatattccccatttaactaacttgatgacttaatctaatgtatcaccatgcaaatacagctccaaattctcttcatatcttagtactttctctcttggttactgttacgttttacaaatatactgatctttatattaacctagagaaatttgacttcgattccccttcaattccagcggcaacgcgcggggtatcatccagttaccataaaaattgcaaccgccgagagaaccggggatgaagagacccccggtcacccccacgacgtaatgaaggcaataatcaccgggatcccgatcccagcgatc

SEQ ID NO: 37933 - DNA, 1501 bp, Oryza sativa
taatatacatagtatacatacattctagttgtcacgcccggaatttctatccaaaattccaaacgcttacatgtgtgtgaaccctcgtccaggaatcagccgaggcacacaataacaaattgataatagagtacaattattactctaattaataagcgaataaaatgtcattacagaggtagatagttcctctcaatcaataaaatctaagcagcggaaaataaaattaaacggcgcagacggctcgactccacaggcagcttgaccaaggctacacctaatcctccacaccatcagcatcactgtagatctcttcctctgatgaatgattgcaaggtgagtatatgacatactcagcaagccacgcagcaaatatgcaagtgcacaggataacaaaggatggcatagtagggtttcatttgcaaaagcagcatttagcaaacatttgagaattataaaacagttaagtgataattaaacaatattaatccaacactatacaacataccctgttgcataggcccaaccattctgaacaaccaccccggctgcacagttctatctccaaaccaggaatgtaccattccaaaccaggagctaatcaaattattaccaatttaagcatcttttactatggtgagaagggtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtacctcggaaaggagttgtgacaataccccttatacaacacaatccactgcagcgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacggttaatgtttcacaaccgaaactcgtgaaccggtccttaattgtcatgagcacgaccatcaaaaccatgtgctcacaacccaccattatcaggttttagttggcacattaattaattaactaatcacgattgaccatcgtgaactatcaataagccatcatgaaataatagtgaatcataagttatccaatagtgaatcataagttatcccaatagagacttgaaccaactaaatcggagctaagatgaattagttatgaatttttaaagattaaatcggattaaaacacttatatcggtttaaattgaattatgacgcaataatgaattatttttgaaaaggaaaagaaggtttattgcgtcagcgggctagggtttcggtggaccgggcgcacgggcggcggttcacgcgaacggacggccgagatcgatccaatccaaaacggacggccgagatcgaacggtccacgaccggctcacggcggacgaccccga

SEQ ID NO: 37934 - DNA, 245 bp, Oryza sativa
gggttttttttttaataaaccatttttaccttggttaatttcttcttaataattatttgtgctctgaaaattccactaaaattaatttacgcattttaggcttttaggaaatatacaaaaatcctccaagccttattcgacttttaacttcgcacattttaattgttggaggctttcacaaggattttacttattctaagcataattttgaggatgtgttttagagtcgttttgggacgcgacac

SEQ ID NO: 37935 - DNA, 1501 bp, Oryza sativa
tatattgctttcagatttaagtaaatttcaaaaaacaccgggtttttggtcaaagttgaggaaaaaattgatattataacgtgtggcacataaccacatattttatggtctcagtgtttcataaaaccccaccttaattgaaatcttgataaatttcagcatatctcaaacaaaatttttaaggtagtaatggattacactatcaatcttagtgatttaacaattaaaatatttcaaaatttaagtaatttcatgctcaaattgcataagggtggggttttgtgaagctttaagcatgtggttttctgcaattctgaccataaaacttgggcttttctaaaatttactctttagattttgatccaacgatcagattgaagttttttgcagttctacaggttagtttattttttaaaaaaattaagtgcatgtcacattgaaatttcgttagattccaacaatttcatccgttacttttcgtgtttcttggaaaaaaaatcggggctacatctagaacctctgtttcaaggtgcacatcacagggatttgaaattgggaagttgtcagtgaacctgaagggatgacgaagccaagcattgtcgatgacggtaaatagttcactgaagaaggaggagatgctgatacaagagtgggccgggtctattcaagacgcgcaagaaagaagaacccattgtatattgggccagattgggccatgtaatagttgcgtgtagctgttgtgttgctgtcacagctggcaagagaggagtgggtgagagagagagagacttaactgtatataactgaagaaactcaagaacagagtcgatcttggcaattggtggcgatggcggcggtggctcaatcctgttggatttgagaatatatgggagaggagattgccaattcttgtgtgtgttcttgtgttcttgttgagtgcgctaacaattctggtatcagagcgctctcgctcctggaatctctgatctgattgcaaaatccagagaaggattggggttagttcttcggaatcgaccccgcgaaaaagcaacttgccttcttcgggttaatcggatcagagtggagtgtgaggagtaagctaatctggagcgccctgctatctggagcggccgcgctacatcaccaaacaagcggcgcagctgatggcgcaagacggcaagctcgacctcttgctcaagacgattgaggagaatgagaagcggagggtggaagccgaggagcgctcgcgtgcagatctgatggaactcaagaagaacctagaggtacgcatcccactggtggagaagaaggtggatgaattggggggtacgttccaagatctcaacaagaaggttgatctgttggagagcagtatcacgaagaagtatgaagaaattccatcaggaattccgctccaggggtcaccaagtcaagacacctcctggttggttggtaagagggatccatcttttactcatccatctcatctcgatttgaattc

SEQ ID NO: 37936 - DNA, 160 bp, Oryza sativa
ttgatagttgtgtagctgtgatgccaaagctaactagacactaataaatgagggaattttgtttcacaatacatggtgggagtatcttttgttaaattgtttaatgaaaggttaaatgtaaaatggtgctgattttgcacacatatatttctattgtaga

SEQ ID NO: 37937 - DNA, 1501 bp, Oryza sativa
agactcctaggccacctttttcctttggtctacacaccaaatcccaagaagcaagagatcttctagttgagtttgggttgtttcccctccagagacagtttttccttgcagtatcaatagctttaaccactgaaacaggcaactacaaagaacacatataatatgttgggattgaggaaatcacagagttgatcaaagtgagtttgcctccatgtggcaaaaattgtgggctagctgtcaatcttctctcaaccctgtctaccaatggtgcaaagtccactacccatggtctagttgtccccataggcaaacccaggtaagtaaaaggcattgtacctatgatacactcaagtataccagcaaaaagctcagcattctcatgagacagattgattgggtagaaataggacttatggtaattaattttgaggccagtagaatgtgcaaaagagttcaacaaagccttaaaacaaaaaacctctctctgtgatgctttgaggagaataaagtgtcatctgcatactagattacttggaaacccctttcatcaagttcattaattggcttgaacaacaaacctagggagcaagctttgttaactattctctgtagtaattcagcacaagaacaaagagcaagggtgaaagtgtatctccttgcctaacccctctcatgcatttaaaagaatttctaggtaccccattgagcagaactgaagaatgtgccgaagaaaaaatcatctgtacccactgcagccacttatcatgaaaacccatacttttcataatggatatcaaggcagagtgctctatagaatcaaaagccttttcaaagtcaagctttaacaagattatttctctctttgactgttgacattgatgcatatactcaaaagaccatgctaaacaatcttgaattggtttgcccttaatgaagccatattgattctcatgaaccagcttaggcattacactctgcaacctatctgccatcaatttggttaatacctttaaactgatacctatcagtgagattggcctataatcattaactgtttctggagaggacttttttggcactaaggttatgaaggatttgtttatcagctatagatcagtataacaagcatggaagtgtgctgctaacctgtaaaagtcatgtgatatgatgggctaaccttagtgtgcctcctcttctccttgatggccagatctagcaggtgtggctggagggtgacgacagtggagaggacgatcgagaatgttgttgatgttgagcctggtttgtttgtgctggtcataccttgaaagtgcaataaatggctgaaggattgtgatctttgatgtggttctggtgttgttgatgagttgttgaataagtgtaaatagcctattcttgatttgtgatgtagttgttctcatctttgacatattgatatgaatattattgtgttcttgttcctggtctataaatgtggatggggaattggggcgggagcaaa

SEQ ID NO: 37938 - DNA, 1501 bp, Oryza sativa
cttacaaacattataaaagtcttacatgaatgcaacggaaaattaaagataacaggagctaagccttgacttggattgtcgccggaacaccaccccacaggcatcctcgatggcacggacgaagcccactcctcagagaaaccaccatcggacgcacacacgaactttgagggttgggagatagagcaagactgagtactatccactgtactcaacaagtcataccagaacggaggatatgatgcaatatataaccaaaggaaggctaaaggggatcatttgcataaagctagcatttataaacagtagttgaaaatagtaaaacagttgtagtaattaatcaatattaaccatccactgtccaacactacaccacgttgcaacaggcccaaccaaccacctgaactattcaattccattagactaagctaggctgagactaatcacggtgaatcaggttgaccgcccataagacacagaggtgaatctgatcagaggtgtacaactgtacccacaagacacagccccatgacacgtttccgtgcgccgacatgccaccacgacataccggaaagaggccatgacaggacccttcgcataaccccctctagccaagcacaccacacctcaggtttcacccttgtccccagcgggcaacgggcagtcccctctcgtgcctaggtgaatccggaagcgacagaagccgtcgcagggcccaccccgctccatcatgcccacccttgcctgggagcgtcggctagaggaaagctacactacaagcccagccgttgcccacgttggcttgtggtaagtacgataagttcttccagggcgtcccgcgaaccagcaaaaccatgcacccacaacccaccattggtatattttaattagccaacaccatagtggtagtacatgtccaacattaagctaaaccaatgtctaacatttaatgtgaatcccccattgtatgcgagttcaactaagcatggctaagcaatccctaactcaacatctaatcatgttatatccccaagctaacaaaggaacaaggtaacaaatagtatggctgagacagtaggtaatcatctcatggtagcattgtaaaataatgcagtatttaaaggaaaacaatagggcatttgcaatatacgatcaacatgtccaagtgacaagcatgacttgccttgctccgctgttgaagggacctcggctacaacttcgaagtacaccggagcgtcgggagagccggattctacacgacatacaaggcaaacaatgcagacaggctataaggctactgaaacagagaacaaaaccatttttaacggattctttgtatttttcttgatttactgagccttgaatgggcttaaacggagctcggatgaattttctatgaattttagaagattcactgtgtttttactataaacagaaaaatccttaattgatttattgtgcaattattaaaccctggagggagagacgggtggtgccgaca

SEQ ID NO: 37939 - DNA, 293 bp, Oryza sativa
  unsure (1)..(293): unsure at all n locations
tcggagttcattaatcgcaaataaagaataactatcgaggaataaacctttaaattaatttggctaaataaataattgaaatcatttanaataaagattaggagtggatagaaataaataaatattatcgtagccatattggtaacaattaaatttatttgtgagggaataacaattagccctaattaaaaattcaaataaattatataacaataaaatgtgggtaacattaatctcgggtgaatcttttggttaaaataacacaaatattaagtaaacttcatcggtgcaaa

SEQ ID NO: 37940 - DNA, 1501 bp, Oryza sativa
ctaaggttatgaaggatttgtttatcagctatagatcagtataacaagcatggaagtgtgctgctaacctgtaaaagtcatgtgatatgatgggctaaccttagtgtgcctcctcttctccttgatggccagatctagcaggtgtggctggagggtgacgacagtggagaggacgatcgagaatgttgttgatgttgagcctggtttgtttgtgctggtcataccttgaaagtgcaataaatggctgaaggattgtgatctttgatgtggttctggtgttgttgatgagttgttgaataagtgtaaatagcctattcttgatttgtgatgtagttgttctcatctttgacatattgatatgaatattattgtgttcttgttcctggtctataaatgtggatggggaattggggcgggagcaaatatggatgaggaatttggtgccgtgggtgtgaatattgcgggcagcttgacgcatttgttcgatgaaattgagctggcctttttttatttttggttcgtaggaacactttttttttttatgattggggattaatcaagaggacctatattgagcacactaaaaggctggtggcacattagcatcctcgcatgaaccggtatataagcattatgaattgtaattcgaagattaggcatcaattaaacaaaagtttttttttcaggcgtgttcagaatctcgttgctggatggtgaggagccctcttccatatgcttgagggcagcggcgattgcatctgccatcccctaagcaaccatccctttttcccacttgctgctgaagcaccaccaacacctggctggtgacaatgtacatagaggaaattatctgttacgtgatttttttttaacgattcacaccaaacagcgcgaagatttattgaatagagaaggagaaaaattacaaggttagagccttgggaggcaatagctaggaaagaagaaaaaaatatccatcacccacgcactgacagcacctaaacacagccttagagaaggctagcaccggaccaaccgccgctagtctaacaaaggaactacaaccgagatgacccaaaaaccaaccctaacattggaaaccctaggggtgaaaacggatcggataatatcccatccgatccgatctactctgaatccttccgaaacaaggatatggtatgggcttatccgatacggatacggatgcggatgcggattatctgacagttttgtcggattatccgataagaagtttgtcggataatccgaaattatcaacatatataaccactctatctattgcatataacataagttggtacatccaatgccctaattcatcaactatcatagaatttttagtctaaggcttttattgtctcatgtcacactcaagtagctatattttttatattatgggcatcaatcatgtattcatattctttagcacttaatcatataattattacgattggtcatttattgagtattgtattattgt

SEQ ID NO: 37941 - DNA, 1501 bp, Oryza sativa
cccctagaagatgaaggctttggtgtctagctcgtgcctgccgtcaagtgcctgtggtcgtcgccctagtcttccgctgtttctcgtttgtctctgtgtgtgctgggccttcgctgcccatgtaataaattaactatttacgcttccgcttgttaaactttgaattgtatcaacttttggtgtaccttgcctcctgggacaaggattaatgcacgcacgtaaggaacgcccgttgggttatttccggtcgtgacaagttggtatcagagccacccttgaccctaggacgagccgtagatcccaagccatagcagtattttcgaaataaaaatcctttgtatttgtgaaaaccctctagtctctctctgtcttgctgcttcatttatcgccaaaatctgacctttttaaatgttgcttttctttttgtttttgtttgtagatggccggcagcgtcagccgtcgtggcttggacatgactggtttcgtcttggagctgcggggcatgtgcgttgtcctggggtatccgcatggagtggactaccaggccaggccgcttccggatcaggagggtgacgatgcagagccccacgctgcgtgggaggttactgcagtgatcctcactggctctcccgagcggacttcgctggcagtcaccgcgggtggagattctttccccgccgcttaccagaacgccgctctcctcgccatcggcactcttcaccagcgctacccggacgagttgtagcactcgccctaccgctaccaccctcgccgtggaggagcccgcgactacgccaccttccgggatgctagctcggaggatgacgctaccatcgtgcacctggcgcgcatggtggaggcgtacgacgcggctcgtatcgacttccatcagatggtgcgccgtgggatggtcgagaacaacttgaagatcctggagctgcatcaggagaacctgcagctcaagaaggacctagacgcagtggaggcgcagctgcatcagctcaagatcgcccagggagaggtctgccgccccaagcgccaccgcgtctaccgcagccagaagatcaccgcccgcaaaagcacctccaggcccgagcttgttcgtcagtccctggcgtggacctgcttcgtggagacccctcgtgccgagcccgcgcccgtggttccccaggagggggaagcctccggcgttggtagcacggaggatgcgctgttgctcaccttccgtcctggcccgtcgcagcggtagacgagcagttagtaggcttgcgcgtgtgttctttctcgtttgtcttcttgttggagtcgtgtggggcatggttatgccggtgtgtggtataactgtgtcggagcctgtctttattttattcgtctaagcaacttgaactttaatgaaccaatttaatagcagtaataaattcaagaattatggtagtcgtgggtggttagctttaattgtcagctctctctctgtttgctggttctgtgtggggttttcaga

SEQ ID NO: 37942 - DNA, 221 bp, Oryza sativa
tttcaaatggtccattagcaacatataaaagcagatttcctggttttcagttagcagccaaacagaatgcctagcaattgaaggatcaagacattcatcaaaggaaacaaagcaatggaggaccaatcaatagtccgtatgtctacactgataaccattacaaaagttactagaaaaatataaagtgatataatagattaaagacaattctatcaatcaga

SEQ ID NO: 37943 - DNA, 1501 bp, Oryza sativa
ccccatttctccctctctctcccgcgttcaaacgggcggatttgcccccgcaaatctcgccggcgccattgatggcggccgacctcccgcgccggtttcctcccttccccggccaccctctctcgccccggctctatttaaaccctccccgcacctcctccgtccggttccgcctctcgccgcccttcctcctcgccggatttgagctcgcgatgtcgctctctctctcgccgtcgccgccgagctccggtccgccgccgtcgtcaccccggaccgcctcccacctcggggccggctccttcggcttcgccgcatcctcgccgacctcgtccacctctccgtttcggtcgccgaccgccggagcgccgccgcccccgtctacccgagccgcgccgccaccttcctccgctccggtcgccgttcccgtcgtcgccgtcgacccggggtgagccgtggaccgccgtttcacttcccccttccctcccctctctcgggcgccgctccgccgcgccggtggtcgccggcggcgaccatcagggcgcgggtgcgccgcctcccgtcggctgtgccggcgtggccgccttcgggcgcgccccgcggctgccatgtggggcccggccgtcagccgcccgcgccctcgggtgcggctgacgcgtgggacccacggcgccggccggcgcaagccgcgtgcacccggtccaccgtggaccgtgaggctgccgcgtgggccccactcccgtggacccggtccgcgcgcccctccctcggctgacgcaataaatccgattttttaattaaaatttaaatgaagaaattcgcaaatattcaattaaagagcatataaacttcaaatggccataactttgccatttgaactcggaattggaccgttcaagtctctaatttttccttaagaagtcaagaacccatttttgtgctttgtttctgcttgttatatggagtttattagagtaaaagccttttcttttccgttggtcgtgtagacgctgcagcttcggaagatccgctcttcgtggaagttgaagccgacgtttgggaaagcgagcaaggcaagtcacatgatctttgaacatattgaatcccagtttgtaaaattatattgatttaaattattgcattatcgctttatttaaattcccgcgttatcactgttttatttagccatgcctatttacctttgttatgaccttattattattgttattgttattatttccttgttcaccctagaataaacaaaaccccaactagtgggcactctactcatggtaccactagtatgattttaggtagatgcttcgctatttaattaggtaacattaggcggttttacaactatagactttgggaatattcatatcacctggacactatggaatggtttggttattgtggaattggcttcacaccgccccttctattcaaaatccccaaaatggttttaggctgggctcggggtgcatggttttgatagtagcac

SEQ ID NO: 37944 - DNA, 854 bp, Oryza sativa
tctcctaaagcaagcaccgattaggggggaggttttcaactcgaaatttttgcttgaactctatacgaaaggtgaagaactctctatcctccttcatttggctccatttttgttatatttcgttggtggaaagtggagtttttttaatattttgacaaggtttgttctaactaatttttgcaaaatctagcttcaaaatatatgttttgatgggcaaattttgcatgtaatcaattgtacatactagttacatgtattgttgtatttttttttggagacaaatgcatttaaacttttgtatgaaatacctgcggtctatttttttatttgtaacttttttgcctttatataattagatggatcagtcgtcatggatgtatgagatgtggagaacgcagccgatatttattaaggaagcatctaatttattgatcaggctaaggcgcatgctttgagggagaatatgacaaagatcttttgtccgtgccgtcattgcaagaatcagaaattgttggtagatcctggtgaaatattgggtcacataatggagtacggattcaccgccaactacaaggtttgaacctatcacagggaattcgccaatccgaaagatgacgatgaagagttatgtttcgagatgaatgaggcagagaattttataatcgaagacatgtcgcgtgaaagaatggttgtcgatgtttccaccgatagtgatgatttcgatggtagttttgatttagaggatatgctacgccatgttaaaccagaggtgctagcgggcaggtcacgaggattggagaattggcaggcattagagaaggcatcgaaggatcttctttacgatgaaccgaagg

SEQ ID NO: 37945 - DNA, 409 bp, Oryza sativa
ccccccccccccccccccctctgagcacagccggtctgcgagctccttcccctttgccccctggccagagggctcctcagtgcacgtgcatgaagccgcccgacaagctcctcccagcgcgtgtcatggacggggattcctcctcttgagcgtagccgatcagcaatctcctccattctcgcgttgtggccagccaggtcctccccgcgtgcgtgcggacaaccactgagctcctcatccacacaacacgaccagcaaggccctctctgtatgcgcagccggccaacgagctcctgccctgtgcgcccaattgaccaggtcttccctgggtgcacagttggccagctccaacgagctcctctaccgtagactgtagtaggcaaggtcctctatgcgtgcgcggtcggca

SEQ ID NO: 37946 - DNA, 653 bp, Oryza sativa
taacagtgggacctgcatataagtagctgacatttgtaatatctctttgtagctataaaaagaggaccaagaccacatggaaaaggggttggattctttgaaggcggactacaacatcaagaagcaccgttgctgactaaaacattcagaagcacccttattgacaacaacatcgagaaagagtccatattgttagtctctcctggaaatcatgagagtagtaaccagaaccaagagagaacacatccacaccttgtaatcctcgataatctcagatatagtcaagaacaaaacagcagggtgttatgcttcctcatggcccgaacgtatttacatcatttggctttttgcatttatcgtattttctgaaaacggacctcgaacacccgcaccctagccaaatctctaggggaaggggctccttatttccccgcttaaggacctcgggctctgacacatggtgagagagaagattttcttgacttcaattccaccacatctcacatatccaagcataaactttggtttgtttggatgaggattcattttttttaacgaaagataagaatttgtgtgttcgtcaaaagaaatgtaggatgtaataaggaaatgatttgtcacttgccaaacaaaatgttgtactcctgattttc

SEQ ID NO: 37947 - DNA, 1501 bp, Oryza sativa
aaaatcaccaaaacagcacataaacaagcatgaacagtacatgtggatatttttaatgtgtagatctcaattttagaaaaaattagagaattgaaccaactaaatcggagctaagatgaattagttatgaatttttaaagattaaatcggattaaaacacttaaatcggtttaaattgaattatgacgcaataatgaattatttttgaaaaggaaaaggggatttattgcgtcagcgggctagggtttggtggaccgggcgcatgggcggcggttcacgcgaacggacggccgagattgatccgatccaaatcggacggccaagatcgatcggtccatgaccggctcacgggagaggatcccgatgacgtcaacgatgacatcaccgacgacggcggcggctcggcgaagaaaacggctcgggcggcggacactcgccggcgaacggcggcaccacggcaccaacggagggcaccagcacgtagaggacaacgcggcgaacacaccggtgaccaaaacggcggcggaaaaggaacggacgacgacggcgacgagaaggaagcggcggctaccttcgggttgacgacggcgacgatgctccggcggtctccgacggcagcgaaggggcggacgaggacggcggcgacttggcaagcacgacggcggtcttcccgagcgacggcgacggctgaaacgacggcggcgcacggctggagcggcggcggcgacggcaaagctagggcacacggcgctacagctcttccggcgacgagaggcgaaggcgagggctgcgacgggtagaggagacaccgggggtccttttaaaggggctcggaggcggcggcgaaggcccacggcgacggcaacggcgaaggaaaccttcggcttggagagagggaaaaccgatccgaaacgaactcgtctccgacgctttccaaagcgatttaaccaaagattccaaaggagaaaaggtagaggagatcccggagattgtttcccctctaacaaatcggccggagaaggaaaggaacggccggatttggaaagcggcggcgacggcagctcggcggcgcgaaactagggtttcggcccgaggaagacgacgactgacgggtgggccccacctgtcagcgacagcgcgctcgcgcgggcggctgcggactgggccggactgggctgaggagagagaagggattttgggccgactttcggcccaaagccaaaagagactttttaaaacctttttcaatttaaattatttcttaaatgcaattccatttattaaaaatactttcttagctcaaataaatcccagaaaaatctaggaattatagaattaagcaaagtatatatattttgaattttcagggtgtgacaaatggtttggttattgtggaattggcttcacaccgctccttctattcaaaatccccaaaatggttttaggctgggctcggggtgcatggttttgatagtagcacctcggccatataaggaccggt

SEQ ID NO: 37948 - DNA, 520 bp, Oryza sativa
cgggaggacaggttggtagaatttaaccaaaattaattacaacggacaatcaatgcaattaagcaattcgtgcggggggggagtggggtcaccaaagggaaacagcaaaaaaaaaacaaaaatgtaaccttttttccacaaaaaagccaaaagggccttcatttttcttgaacacgccatccttataagtagaccgaactccaatttaacaattctttccaatataaccaccatttttaaagaatattcataattcaatcaaattccaataggaatatatcaaaaaattttctcacgttccaaaaaagccccaaagaggataagaatccccaatgaatgacataatatgttcatccaaaagtgtccgacatatttaataattgggtttctccaaaaattaaaatggtaatattggtagtttctatgtccaaattagttgttgaccgaaacccaaaattttttttatccccattattaccaatgcatacgtaaagtttctttgttttattaattcccccta

SEQ ID NO: 37949 - DNA, 1501 bp, Oryza sativa
ccgagaggaacaggacagagcaagaagttgagatggacaccgctacgtctgcacctgaacgtacggagacatctacaagtgcaggcgggagtgggaaaaaaagatgtggtgagagaagcaagaataaattacccaaggaaacttacaacgtgattgctctcgatcaggatgggaagcccgtcgagccaccgatagtgcggtccaagttcagcaacgcatgtggcactctagtcaggacacgttgtcccattaatgtcaagttgtgggaaacagtggacgacaacatcaagacacttctctggaatgagttgcagaagtattttgtgttccctcctggatcagaggtcagggggagagattacgcacttaaaaagatgggagatcgatggcgacagtggaagtccgatctaaatcgggattatgttcagaagaatctcccaccgtttacggattatggacatatatcgcaggctgactgggacacgtttgttgcggatcatacaacagctgaagcattggctttgaggaaaaaaatgtcatacgctggtcacgtcgatcaatggcgggagatcgagcaaagatttgccgcggccggtaagcccctgctggtagaccccatggttgaacgtagcaagaactgggtttgggcgcgtagcacaggtcaagtctcggatgagggagacatactattcgagactccagacatagaagaagtgactactaatttgcagcagatagtcgagaaagaaagatcaggacagttcgtcccacggtggggagcgagatcagcttactgcggcgttggggacggctgaacactctggacgtgtaaggggtttgtcctcaaagacaagttggaaggtcgggtttccacaagacgcaccaagttataagaagagagacaaatacaaagaacaactatcggacaagatctatgcgcaagtgaaggaacacttctactcgttggcagctgaaaacccgacagcctttccaaggttattccctgatagccaacaacccacacaatccgcacagcaaacaactaatgtacccagcagtgtaggctcagtgcagacaactaccttccctgtggatagtataactggaccacctccgtgcagtctcatcgtaccaatcggtcgcgctggaaagactaaggaggttgcaatgggttttgcaatacccggacgtcaattccacaacacggcaatccctgaggattacgcaaggatacaggtcgccaaggtccatagcaaccacgtttccttggaactagacatacctacacttgaggggattgaacttctcggtgatgcagtgaatcagtttatcttgtggcaccgcagagacataatcctgagcgcggcctttcctgcagcaggatcttcaaccccatcctcatcacaggcaatgactgctgccgctcctgcaccaccgtcgccttgtcacgaccggaaataacccaacgggcgttccttacgtgcgtgcattaatccttgtc

SEQ ID NO: 37950 - DNA, 187 bp, Oryza sativa
ccgagccgagaggagcgagcacgagccgcgcgtaatgcatcgagatcagccgagccgagcggagacgcggctgtgcgcgcaaggtacaggccggccgccagatgcacgcctcatccacgcgtcgcacatctgactcgggtacgcacggattgaggtttgcatccggtatgcaccaaatttttttccg

SEQ ID NO: 37951 - DNA, 1501 bp, Oryza sativa
ttcggttgtgaaacatttatcgtgccaaccacaagccagcatgggcaacggctttatcttttgtatagcatggttcattgcggggcaccagactgagaagtggcggagataagcccacgggggtcgctggggagtccatgccttgtttataagggggtgattatgatccaggaaggtgcgctgcagtggattgtgttatgcgaggggtattgtcacaactcctttccgagataccgtggtggtattgaggcacatggtgacatgatgtggggttgtgtcttgtgggtacagtggtacacctctggccagagtaaaactattcgaatagccgtgcccgcggttatgggcgggtctaacaatgtctttcgtgattagtctcacacctctcatcattgtaaaagatgcttaaactggtaataatttgattagctcctggtttggaatggtacattcctggtttggagatagaactgtgcagccggggtggttgttcagaatggttgggcctatacaacagggtatgttgtatagcgttggattaatattgtttaattacttaactgttttatcaaattctcaaatgtttgctaaatgctgcttttgcaaatacaaccatattatgccatcctttgttatcctgtgcacttgcatatttgctgcgtggcttgttgagtatgtcatatactcaccttgcaatcattcatcagaagaagagttctacaatgaggctgatggtgtggaggattaggtgtagccttggtcaagctgcctgtggagtggagccgtctgcgccgtttatttaatttccgctgcttagaactttattgattgagaagaactatctacctctgtaatgacattttattcgcttattaattagagtattatttgtactctattatcaatttgttattgtgtgcctcggctgattcctggacgagggttcacacacatgtaagcgtttggaattttggatagaaattccgggcgtgacaagttggtatcagagcccctttgaccctaggttataccaaatggttacccaaagaagccctctgaaaaatattggaaaagtagaactgttctcctccctttctcttttaattaaccaaactaatggcacatgcacttcataattttttttttaatggttttcattaaaaatttattccagtgttattagtactgtacatctattactgtactaatggctcatttatcagcaaaagttttacaatactgttttatttaatcttgctgcaataaaataaatttagtatgttgattttataatttcctttcatctcttttgaaaccagttattcaaaattacaaaatttgtgacctcgtttccaaatgttttaatttatttcgcaaagcttggtttactttatttacttccctttttactttgattttctaactttattcaaattaatccaaaaacttgtgctattaattggataaaggtcttaactccctcctttcacttgtctttaga

SEQ ID NO: 37952 - DNA, 513 bp, Oryza sativa
  unsure (1)..(513): unsure at all n locations
gagcattgaacgggaggaaggggcaaaattagtcatgagacaaaattcatgggggataaatattagcagacgggggaactagctgaaaaccagtgtcttgcaataatcaagaaaagtagggttctaagctttaaagtgggataaatttcctggaaaaaaaaaacatagacatttggcaatccaacatcagccagaaattggagttggctagccagaagatcctaccaactaaaatgggaggtgatgggatgacagactcaccagtcgccatcaaccaccagtaagttttgggtggattacccaatctacagctatttttatgtaaattgttttggtggattacccaatcaacagctatttttatgtaaattgcgcataaaatacataacgcaaagtgtataatgaaagaaaagatgtggaaaggacataaagcaaaaagaagatactaggtgggctgtcanccagacagcccacttatatctccaaccctgccaatactattccttctccaga

SEQ ID NO: 37953 - DNA, 1501 bp, Oryza sativa
agattactgtaagctggattataataagccgacgtagaataagctattagttgtttgtttctctggattattagctggttgtttggtgttagccacctaataatctaaaaaaacacctttagagtggattactatattatattatattaatctggcttataaattataataatctattataataaggtatatgtttgtttcggcttactcctaataatccagattataataatcctaagctgaaacaaacagggccttagtcggcccaattacactctttatttcaatttattaattcgactccaatcacactctagagttctttctctcttttctttatcatcactcgacttatttatatttctctgtcttttgactcgaattacactcgaatttttttatttctatgtgcttcaccaaccgaaactttttttaaaagtgtggtttgagaaaagtatgaagtcttattatcttctttataatccattgtctcctccagccgggagattaccattcacccgacgcagcgacctcaacagttgcctatgtcctcaaattatctaacgtttgatcttgtatttctcttcttttatctcatgtgtgttttcctttcctctcaaattttgagacatttggaaacaataataaaaaaagaaaatatgaaaataaaaaaattcaccgtcgtcacaactcaagagcaatcactaacaaacttcggttgagtccatcataatcttgtttgttatgggtgaattgccgatagcttcaagcaccttcatattcatcagttttgccaatcaggccaatgtgtgtgcttcaaacatttgcaccgcaagatagaaagaccaacttgtattaggaccgtcctcttgtagcatgcaagtgtgccagcatgataggcatagaaaaaattaactttcacctctggatttggtgaactccactgtctcgattcgtagcaaaaacgactgtcggttatatagaagagtggctaaattgcaaaacaaaacgccatgtctagttgcttcctctcctgccaatgcctaccagcacatatatattcatgctctgcactgctatgcaatgctttagcatatattagatgtgaaatttgtcattccattactgtgatgatgaacaaacaaaatgacttgttggaggaaacaactgaaactcatacatgtgtgtgtccgggtgagggcttcgatcgatcatctaaggaattcatgacagacaatgcatatgatgtaaaggagcagcaaatatgtagaaatgctaataaataaatacattgacgtatgtgttgctttctttttgacattaaacatataaaaaaaattgaggtcagaatagggatatatacaaaatctttcttttttcagaataactttctgatctcagctctaattaatttgtagaggagaatgctcgcccaaaagaatggtagcaaagtccggtttgatgtagcttttcattctcgtttgagcaactcgtccagaat

SEQ ID NO: 37954 - DNA, 670 bp, Oryza sativa
aataggaagatgtaaatgactagaaaagagtcatataatcattagtttattaaggttggaagtgtaaacattaatggaggtaaaagcttaaaacatacaggtaaatagattgccataacagttatagtattaataaccttttaaatctgtcaaggtagcttgctcgtgtgattaagtaataaaaatatatggaaattttaattgtatagatggatggaaaagttatttatgaagggtcggcagtatttcaatatagggtcgggtcgaatttaaccgaaagtataggaggtagttgtatgggtaataaaaattcgatattagaacagggtagataaaaatgtttatggttagtcatgatataaattggggaaaaagaataagtagtaccgggaaagtgtaaaataaggaaatgggtcaaacaattttaaaaaagtaaggggcgtgcaatctgtagataaagatcaataatgtaccagcggggactaaaattaaacacatagtatataatccatatcccttatcctctcctccacagttacaacttaacagatcgaatctcaccccctctcctcatatctatcctctaactctccaacttctccccttcctcctctcctcccccttctctccccttcctcctccccttcccggccggcctccccttcccagg

SEQ ID NO: 37955 - DNA, 1073 bp, Oryza sativa
tgccgcgacaacgtgaacgagaacgagaacgatcgaacgaacgagagtgagaacgagaacgatcgaacgaagacaagcgagaacgagggaacgaacgtgaatgagaacaagcgaacgaacgtgaatgagaatgagcgaacgaacgtgaacgagctagggaacgtgaacgagcgaacgaacgaggatgatcgttaacgtgaaatgcaatatatatatatatatgtatatatatatatatatgtatatatatatatatatatatatatgttacttcgcatttatcctaatacatttttttgtatcttgcagaaaagacgtgttgtcggagtcgtccgtcaagcctgagtggaagagctagccctagaacgaattggagcaggcaagtgacgtaataatataaatgattgttatatttgtaatgcaattaattaagattattagacctgtaattagacttatcatataagattgtgtagtgttctaatattatttgagttttaatataagattattttattgcaaattagacttagtatgacattattgactacggaattggtgcgactcctagcaattgactattgtagtcttaattagacttagcatatacgcacgaaacacttagcatacattactattttagtcttagcatgtaatattatttgagttttaatataatattactttatttgtaattagacttggtatgtaattattgactacggaattggtgcgacaagtagcaattgactattgtagtcttaattagacttagcatatacgcacgaaacacttagcatatacatgactattttagtcttagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacaga

SEQ ID NO: 37956 - DNA, 389 bp, Oryza sativa
caggtattattcacatcatattctttttcgtgtgttcatactcgtcagtgtttaacatgtttttcctttttttttaccgtgctgatatgaggtttgcattttattctgtaatttctctcttttttttttttagggttcatcgtgcttatcccagccccttacacaccaacagtagtactatcaagcacaagtggtcttctttaatttccatttattcaagaactacagacaaagcacgtacgccggtagaggaactactagttacacagaagccggatgctttcattttcttaatatatgtcattgtgttcgactgtccatgcaaagaagctattatggttctagataattaatggacatgaagataggatacacggctaccatgcatc

SEQ ID NO: 37957 - DNA, 396 bp, Oryza sativa
ctgtagctctcttgagcaaaagccggaatgtttcattctattatctttacagcgcagaaagaagaaagtcacgcgagttggtctttttaaagaacaaagtgacaacttttcttagggtgggaggaaatctacgtggaattgtactagaattgaccctagatggcttgcggggtcaattatcactgataggagtatttgattgggtcgcatgtgattttttttttgtattttgaaaattatatttttgctatgtcacatggcaagttattttcgacattacataaatatttacagtcaatagcttaccatgttaccttcagtgaatggctagattgtttgttttaacaattggttactgaacgatttttcagttaaattataaaagatttaaaaaaa

SEQ ID NO: 37958 - DNA, 435 bp, Oryza sativa
ttgaatatgccacgaattgtcaacgatccttgttccccaattcatcttactatgcacaccgctaaaaatgttgggcggagtctcgatgtataggtatttaatgaaatatacaaaggggcctaatggtggttagagtttcttccaacattaggaagaattcatttccacgaacgcatatatgtgaaattcggctcacattttgtagtttgtactatttgaaaaagaaacccattttcgcctgcacattgattcttcccatcaagttgtttggatgccgcagaattgtccatcctttgttccccaattccatagggaggcatcaaattgggcaccctttttaaccactagtgttaccagggagaacctacacgttggacacaactgaaacctaacgaatcacacagcaacaagcagtcaagcacacagaatctctta

SEQ ID NO: 37959 - DNA, 1501 bp, Oryza sativa
  unsure (1)..(1501): unsure at all n locations
gggtacaagtcttagacttaaaaaattctttcaatggtaggcgacgtaccagtcgacagcgaggtgtgtggcgacttcatcaatgtcaaaataggtcagcctaatctctcagaagtacttataggggtatatgcatgtatgcattaatagggggtgagtgtgtgcgtgctgtgagttttttgcgtttgtacttagtttctaaaaaatatcaaacattatttattgtttctcttttaatttaagagataaaacaatagggagtggacgacagtattgtgtacatgggagggtgaggaggtggtgaagattttatttttctatttttctaaatgatttaagtgaaagccgatgacggggtgttttattttttctaagaatttctatggtttttcctgtttttttatagaaggtgacacatggcaacttaagatttttttaaaaaatagatctaatagttaaaaataatagatacgtcaatttaattactatttattacaattttacaacatattatacggtgatttatgagctctatagagcgtgtttaattgatttttgttacgtgcaatgaatgatttagtataacataatacatatgtacaattaattttccattgttatttagttgccatgttaacttctatgtagtaaaatatagttaatgtgatcttgatttatttatttatttatttataaataaaactataaatatttataaaaaacatactttattttatacccggaaggtatggaataaaagtacanagctaccggcaagtatatctatgtacccatatactaaaagatcattaaatactgtctaataaagtcatttaaatagtaccatagaatatattctagagcacttacgtagtagaagatcgtttggcactcttggattggattgtttcctctaactggcagaactgccttttttgatcaatcacaaataaagatataaaattataattgttgtggtagctagagtcaaaagccaaccttaaccaaatatgtcattttggatatgtattggagtgaaaacatacagtaaacatcgattgtgccaatatagagcccgaggggcattgtatgtatgtacatacgtataccagcgcccaacatccaccccctccgcctcattcatcccttctcccaatgtactgtctctcatgttttcatcatatattagtcaggaaccctaatttattataatcttttaaaataaatagttattttttatcgacttatgtcgttggaccattattaactatatttgaaattcttaaataaatatgttattttttgttacattctgactattttcatatcatttaaataattattagaaaatataaaaaaaccaatgatatatacttcacctgttgaaaatattattggtgaattttctttacatctatgtataatgtaggatttattactatttgtcagggttacgggttcggcataccctttacccttcgatatacgttacatatcgatg

SEQ ID NO: 37960 - DNA, 532 bp, Oryza sativa
atttcggaaaatggtcaaaaaggtgggttcagtttggttgcctcccaatgttcggtacctaaaaaaaaggtcatgcgaaaattttgccagctggccaaattttgggcacctaagcatgcaagaaccccgtcaaggccaagacttgttaccgttcttttgcccaccaaagtgtacagtccttttatgtctttgccctcccacctgaagctaaggtttataagttcgtagcataggaatatagtacgttttggtattttttgcaaaaaccgggcctacccaatgtgaactcaagcctcgccgaagttgctgatgtccctaatgttgtgcagtcgctgcaatagcggtagggattatgaggctgcctgatacgatttacagcaggccggcagcagcttccgatatatcgtcgcacatgactcattaatgaagtcttgtcttctagtagggagtttatgtgaggggttaatcaccgcatgtggagagtaggctagcagacacatgcatcggatctggcgaggtgtgtttttatagg

SEQ ID NO: 37961 - DNA, 259 bp, Oryza sativa
tgttaaattgctccggatttacactaaaataagcaatcattgctcttctacaccgcttcttttactgcgtggatgaaatcacaaaaggtggggcattcttcggccaaccgcgaggactggacgacttgacccatgtccaaacgcgcttgttccgagtataccgccctataaaaacacacctcgccagatccgatgcatgtgtctgctagcctactctccacatgcggtgattaacccctcacataaactccctactaga

SEQ ID NO: 37962 - DNA, 1501 bp, Oryza sativa
cggtgcgaagtatccgcagttattttatcagtgcgaagtatgaagaatgcgtttatatggacagaaataatctattttatctagcttgcagctactactgctggggctttcaaaattcaaatggtactatatgataaccaaaggatattagtcgcatatgatgcactctctaattaattaccactttcattatgtactatttttacagtgtaataatgaagaaataagagtctattcagattggtgccaaaataaaccttactaaatttttgcaaattggtaactacgttgtcaaaattttgataggattgatttaatatgggctatttagattgtagccaaaataaacttttggcaagttaacaatattgtcaaaattttgctaagatttttatgtatttaccaaagtttggtaatgaaataaatgtagatacttttttttggactttgccaaaaaaaaaagtgctatgattgaaaatagcatcaatctgaatagcccataatatattaccaaaatttcatatacattgtcaatatttaataacaaactaaatatagctatacaattgttaattttaccaaataatggtatggttgaaaatatcatcgatctgagcgggccctaaatgtgcatgctttggtagcccaagggacgacatataggagatgcatctgacatgaaaggcaatatataggatttccagaagcacagaagagaaatgcaaataaaagttttcttgagatctcttcactagcatcgcccgactattgttgggatgggaggcaactaggaactaagcaggcaggaacctaaatcattttgaaccagacagggatctccagcacatactgctgccagctacaccttcaatctcctgaatggttcattagcataggagggtctgagatcaagcattgtcgcagtagcaactgcacaatataatgactgtacattgtcatggtcttcgaccggcctgtacatttagatccgatggtttggaatccgagaacaaaaaagcgccacgatgttatatagatctgtactcttgatttctcattatgtggtgctagtgcaaccgcacaaggtgtaggactagcagcagcagataggctcgggtccaattttggatgctttgacatatgtcctaatggttcgggtccagttgtgggtaacctaggtggcgaataggctccatatccttttgatatatctacagtggggctaagagatggattgttgtctcgtttgcatacggcggaggcaagccccattgttcggccagcctctagtagcaagtcgatgagagatccaaactatattttggatgacaagtcacgcgttgaacttacattttgcaggggcccaggttctccaaattaagacgttgaagttggtacctatagtttccagacattgcgctcttgttcatatctatctatctattatatactaaaagttcataaaacattctacaaacgctcctacgctgccatgtggcac

SEQ ID NO: 37963 - DNA, 230 bp, Oryza sativa
caacaaagattaactgtttaatctaatcttgtggatttcatgacatcggacctccagccgatgtgtgctttaactttcggatcgatgcttatttatcatgtcattgctagccgattggtttatactggattatattgttattttattacatcatcatcagccgattgcctttatatcatcatctacattggacatatagccgattgtttaaaccctatcgctatcggctg

SEQ ID NO: 37964 - DNA, 317 bp, Oryza sativa
caaaacgaggaaaaactctaataaaaaccaagtaaacagtacataaaaagtaacaaaacatgtagatctcaattttagatgaattttgcaagttgaatggcccaatttggagttcgaatgaattagatatgaattttagaagttttgagccattttaatgaatttttagaattattaataatttattgtgcaattattaaataatttctcaaaggaaaggcctgctgctgacatcatcaaaggggccggctccgacaggcgggtcccacgagtcagcgacacacaaggggttggcgcacggtggacacggtccacca

SEQ ID NO: 37965 - DNA, 1501 bp, Oryza sativa
gggggcttttgcgaatttaaaaagtacaatccgtactatacggggattgaaatgtatatgtatatcgcagtatacggccaaattatcacgaaatactgcctgttgtgcgcgcgaatcttggcgacatgatcaacggcagatagtgtacgtggacatccacctatgcgatcagaatccgccctcaatggcacatacctaatacaatatattgaataccagttaatagaacaactcaaaaaaaatgtaaacaacatattttcaacaaaagagtaaaatatttttataagtgtcaacaacataacttctagatctatatttggtaactagtgtatgttacacactttttacataaaacagttaaaagaaatcaccacaaaatatcaaacaagaagaaaatagaaaagagatttgtcctaaataaagctatggttaaatctagtgtgtcaaactccaaaaacgcacatctattttttttgttgcactaaatgtcttaacacaatcagaaatggtgctcacgcatgtgtagaaatgtgggattggttacgctatatttctattattttgcacctatacctcaattgaatttgtccagcattagagagtaaatgttgcacgcatgcctagctttctaataacatagccactccatcctatccctctgtccattctaccatctcgcacaatgccaccattcacctcacaaccttcttcttccccaccctaggtgcacacacacaatggctaaaaaccaatatgcagactcaattcgacacgatgttataacaatttatttgcatgggcttgaagataaggcattagtcattttgcattccctaccccttccatagccaccatagtgaaaatctagtaagaggaagagtcgaaggcaccttagtgtgcgcaagggacgttgatactttcagttgttttctgtaaggtaaccgagttactttgatgacacctcccctagtgacaatggacagatctggttgcaaaaagagagaaggccaaccaaatctattcaatattataaatggtagatttcaatgcttatatttggaaatacaagatatctatcgtcatcatgtgcttatgtagatcacatacatgcatcttgcccactggaatgaaatgattcccacagaccggtttactcatattggtaaagccacttggactgttggacataccatgaccttgcacattacaatttgttgaatatatgaatacacatatacatatgtcaatatatttttccaagaaaagataaatcatacagatatccaataaaaatgtgcttgttatatcaaagccattgtgtcatatatggacacctacgacaaaattgtatttcctgaaaatcactcactcttcactaatatgacaattaatctgatactaacactctaatcatttttccaatttcaagtagtactaaacctgggccaaaccatatgcattaatataaattaaaatcatccattttgtcccccagatactg

SEQ ID NO: 37966 - DNA, 348 bp, Oryza sativa
tctttcgtgtgatagatcgattttttgatttagacaaaatttgacaaaattttgtctaaaatcaaaaatagtttgtgactaaaaatagtgcatacaagaggtgtaaagccaagcaaaggtggtaagaaagaagtacgtcatatattcagttttatgtattattttattttatgttatgcgaataaatattctgaaatttgtttatgttgttttaaattttcagaatggacgaatcaaacattccatcgttcacgttaggtgatttcgaccctaactacgtgtcgaggtcattcccaactagtgagtatgatgccaccggatcagctccaacaccaccagttatggagc

SEQ ID NO: 37967 - DNA, 166 bp, Oryza sativa
tggagaaaatttagatcattggtataggatagatgaatacatcattggtaagatgtaaaagtgtacggatgagagatgagtaaattgaaacggtgaattattatagggcagatgggcggataatcactcagttcaagtcctcctcaattccggatcgatcgggaga

SEQ ID NO: 37968 - DNA, 1501 bp, Oryza sativa
tcttcactatatttgtaataaagttgtctatatgttcatctattatgtagaccgcatctcgttgtaacatggcaatgataaaggggttttcataatacactttcttatcggtctttgattgcgcctcctttattcagtgtatgtacgcactgatgacctatagattcaatttaaaatatttaggaacttgacaattaaataaatattaacgttgtatactcatgtgcagttgtacttacgtcgtcgttcacccattcatctttagtgagaaggcacgataggtgatgttttttgacagaaaaacctcccatgttcaccagcgtctcattttcagatgataccagaataatgtcttgagcagtaacatcctggttggttaatacataatctgtaaaataaaaagggagaaagggattactgatgacaaaaagttatagatagatgatactaaacacatgtcatacaataacgtaccttgagggaggtagtcgtaagtctggccaattatagatcgtatcaagttcgatggtacgccattattgggcatgctgactttggatcctacatgctcccctgactccttatcctataataatggtgtattatactaaacaatattatgctaaacaaatgaaatgaaatattgactaagagggtcaatcaatttgtgcaacacgctcatagagttttaaatgaagtggaataacctgcaatggttcttctggttctgttccttctacacaattaaacaatgaaagtatttataagtggccattgagaggagcgtatgataataatgacaatagtagtgaaagagggaatacttgttctaaatggttatcagaacacactggaaattttttatgggcttactgttccacactgcattccttcacaattgaagtttgccatctcttatggcactcttttagcttgataatctgaaaaaatatatgactaaatctatagtttccttttatccaggaggagatttggcttttcagtatgcttcagtaaggatttagcagatggcaatctttgctggtatgtagagtatttcattaggctaatcgcctatttgttgatgatcataattggcacataaattgataaatttgtattgatgattctactcattttaaatgttatatggtagcatcctttgtttgataaggaaaaatcagtgttctttgcatattcaattagagaagagcatgaatactgttgttactctaggaagaatgcttatattatgaaaggagcgctaacattgcgttgagaaaacaacaggtgatgttatctttttctgacttccttatattgcagtccgttagcaaggagcatcaagagttcctcggccttgtcgacaaagaggtataatgtgaacttgtaaattgatattagagtgacaattattcatgcagttatcttccatttttattgcaaatacttgggagggctcaataactcttggtctttgttgaatgcagattgaattata

SEQ ID NO: 37969 - DNA, 418 bp, Oryza sativa
tttttttggcttttatagcttctttgtactgtacttgttaatgcagttttatattcccatgaagaaaacattagcttaaactggaaatatacaaagatggaatgtgtttaatttagtagaacacaagttaaattcaatatagagcatatgcaaatacaaatttacctccaaattttcaagagctttctcaaatttaagtgccaattcaggtatgcagcgcatatgcatactagttactaggttttgtactggcagtacaacctttacaaatcctggatgcgacgtggccttcgtcttcttgggccatattctttatagtatagcattatatatttatgctcccttttggatttccaacctgtacttttttcaggctgtgcaaattaccatacaaatcctttttttttatgatttcagg

SEQ ID NO: 37970 - DNA, 1501 bp, Oryza sativa
acaggattagtggtactagagaaaataggcggcctcacacgaagaaattctgctaacttgttctggggaggtgcatggttatttccttggttttgctgattctggagttgctgcatcatcatgttcattaactgagtctgttgaacaagaacttgggtaagtgtgggattctctccattgttgttgttattggggttgttggggccattcccgttgctgcgagtgttcaccatctggcatggacagggcacaagaagagaaaccgggggaaactacttaggacagagaattactttaacttttattgatcttaagtgagtttcattattacaaaactgaagactcttacaccactaaactcaccaacttcctaacactcaaaagcaaacaaacacatgcacttacatcccaccactgatgtaaatcacatgcgaggcacacacaaccaaacttaaaacaagcaaactaacacaacgatctaagacaacgacttaacaagtcactctagttcttccgagcatcggaggtcgattgaaggttcgttcggctcgtcttcatcatcttgggtagctacccactcaatcttggaatggttgcgcttggattcttcttcttcatcatcacttatgatgatgaccggaggatctgctaaggctggggtaacttctttctccaccacacgaacctttggcgccaattgatagcgagggacaaatagagctctcttccttgcggtaagacgaatcctggccttctgcggtggtgcttctcccttcaatgtggctagttccttctccaaacgatccaccttgtcttctaacttgcaaatcttaccacgattccggtcttcacgatcttgagccgctaacacagtctccgcacgactttcatccatagcccacagcatctcaaccaaatgccttgtggtagcatcattctcaattccttcagtctcaaggtaactgccacggtcacttccctggggttgacgaggatggtagcgatactcagtgtcggccaactgatcactataatgatcgcggagctctcctatggcgatccttgccacctcctgacatgcatggatgtagtttcttcctccagcttcgaacattactgaggggatatcttcactattactgttcaaggtgactttgactcggcacttctcttcgtgacgatcatgaggaatctgggcataaaaaggggcagtcccaaatccaatgacaaaggacatcgtacacaactcctggacaaaacactcaacaccaaacaagtactcaggcttgtagcgcggcatctaaagacaagtgaaaggagggagttaagacatttatccaattaatagcacaagtttttggattaatttgaataaagttaggaaatcaaagtaaaaggtaagtaaataaagtaaaccaaacttgcaagataagttgaaacagttggaaacaaagttacaatttttgtacttttgaacaacaggtttcaaaagaaataaaag

SEQ ID NO: 37971 - DNA, 1501 bp, Oryza sativa
agcatcaaaaagagagaaaaaaaaaagaggaaagtaacctaggagcgcgcgtggtggcggcgccgccgcctccgcatctcgccggcgctccgccgtcctgagcacggccgtctctcaactcgcgtcgatctggcgtcggaagatcgattcaccgtggaattctggttcagaatcgaaagcttgggaggagcgtgaaagataatagttattccaaaagggaagggctcacgtagaaatacgcgtgggccgccctcctccttctcgatccaggccgcccatgtaaaatccaacggttaaacgggacgagtggtagcgatccagaatacgggcgtgaaaataataatacggggtaaacgaagggttgctgtgcaaaattactttacagtttacacactgtgtaaacagggaaatattttctacgtctaactgttatcgcctgcacgcgatataagatataagatattgtataaatatacaagtctaaattcgatctatacataaaaaattaaaaataataaattttatttacgttgtataggtattgttcaatgtctgatcttattacttttatttctttatttgtagatcaaatttattggtgtatatttgtctgtatcatcctaattgatattaccaatttctttttattattattttagtcacatgcaaatactactaccattgttttttaataaaggacactttgacttttaagcacacgtttgattattcgtcttattaaaaaaatatttgttgtgagatattttatcactaaaaatactttaagcataattgatatcatatgtatttgcacaaaaattttaaattagaccgaatgataaacggcatcgtctattttaaaaaaaaaggagggaggactaacatgcatgagtcactcaccgctcagcaggtcttcgtcactgtgtcaaatcctggagattgacttttttaaaaaaaaaaattacacagtacaacatcttctaaggcaaattatggagattaaccataggctacaggccctttctctgatttcacatcaagatgcatattgtatctgatcagaactgtaaatgttgtagtaggcgcggattaaggtggaggagtaatatatgcagccgatcggaggagaaaggcatatggaacaaggctttgaaagcggccaaagcttgcctcttccccccgtggtctcaccgtggcgcctcccgtcctgctcgacgtgtgtctatggcggcatgcctgcgcagctgccatccatgcacgcctgcacccgtccgtcctctcctgtccttatctgctcatcgtcctcaccaaattggcaaactcattgagagactcgatctttgatccctcttcttcctcctcctcggttcttcacctcccaagaaccccagaaaccagaggcgggctggttgatccattctttcaattggattggattgagctgtggatcggaagaggaactgtatagtgtgggagagatcgattgattgatcgatcgaga

SEQ ID NO: 37972 - DNA, 1457 bp, Oryza sativa
atatacctggtcttataaaacatatgtgagatataatgtgatgttcagaaaatgttaatttctcataagtgtcaatgtgtgacagaatgccttcgatatagtaagaacattttctattcaatatataatgactatatagagactatctatatggatttatctattctttttgagggaaaaaatatattgacataagtatatgtgtattcatacgaagatatcttctgattgcaatatgcaaggccacggtacatatgaagtcagcttttgctcttttgtgtgcatgaatcttatttgtgttattaagttttcaagtcacatgctactatttgtactcaaatatatttaacaaccttatagttgaaacaagctacactagccacaaagaattcgattttcactaatgtggaataaactagacctttaaccataactttaatgctagaagagtacaatagttctttttaattttttatgtagtttagtaacttaatggtacttaagctagtgtggaatttgtacttattaactcacacttttgttgttttcgataacaacaataatattatgtgatcttactctcatgtacacaagcaccagtaggtccgtgaaaggatacaaaacggatccaactccaggtaattcaagtaaagtggaactggtttatgaaaagaaattttgtaatatgtcaatactctcttatagtactttcagctcaatcagtctaaaacatataggtactactcaataccagaggggaaggaatccaactagcggcaatattcaacatggttttgtgtgactgttatgtgaggatttgattttgtgatagttggtttctccattgttcttttggaatattatgtaattgttgttggaggatgtgacttcttaagaattggtctgtgctgaagttttagaatatgctacctcaatagcatccaaatgttagcatttccttttaaagttgtattttaattgccacaaatgttttatttaccaaatcaagtacttttgaaaggaagtcatcattattggtatcacaaactagtttatcaaatcacatacttaagggatacattatcatagaattgtggatttatgtgagaaaaaaccaccaaaatgtagtatgcattataataaaataagagataatatattctgtgccattgagtttgtcatggttctatgatttaccaccgaatttgtacacttccattatatgccatcaggttttgaaattctctcctacaatttgccattgctgtcagttactttgtccttttgaaaagacaaaatcacacataatcaaatgcacaagatttattgttgtcgcatttctcaggtagccgacctgattggttgctagtttatctccaatgaaaataacagaacaagatttcttctctacctctttgagtgtcaaggataaggcatacctcctacacaaggattca

SEQ ID NO: 37973 - DNA, 263 bp, Oryza sativa
ctctctctctctctctctcttccccaataaaaatcgatcaggtcgccatcagcctccgcgtcttcccgtccaaagccaagaaaccaaagctgcaagtagccagccagaggaagaagaagaagaagctagctagcttctcgggaaggaggagggaacggagatcggaggcggaggctccaagaaagcagcaagaaagtgcgaaaatctgaggaggaaggagaagggaggttgaatcgatcgatcgatggctcggcggccggcgc

SEQ ID NO: 37974 - DNA, 1501 bp, Oryza sativa
ttgttcttttggaatattatgtaattgttgttggaggatgtgacttcttaagaattggtctgtgctgaagttttagaatatgctacctcaatagcatccaaatgttagcatttccttttaaagttgtattttaattgccacaaatgttttatttaccaaatcaagtacttttgaaaggaagtcatcattattggtatcacaaactagtttatcaaatcacatacttaagggatacattatcatagaattgtggatttatgtgagaaaaaaccaccaaaatgtagtatgcattataataaaataagagataatatattctgtgccattgagtttgtcatggttctatgatttaccaccgaatttgtacacttccattatatgccatcaggttttgaaattctctcctacaatttgccattgctgtcagttactttgtccttttgaaaagacaaaatcacacataatcaaatgcacaagatttattgttgtcgcatttctcaggtagccgacctgattggttgctagtttatctccaatgaaaataacagaacaagatttcttctctacctctttgagtgtcaaggataaggcatacctcctacacaaggattcatggaatacggcaataccatatacttgattgtatacgagcaggtatcctttaattaaggaaatatggtagataatataaaaaagaaaattatcttcccggaatagaaggtgttagagacctattcagggaagataaggtctccttgggttattttgttttatctctgtgagtcctacttggagaagaagatgatctatgttatatatacaaggccttctcactcagggaggggcatcaagttacaaagccatagccaaagccatacccagaagtaatccaaaggaagccaacgccctattcgccaatagatcttgtcgggttgttctcgacaactacaagtcggcggattagtctagtcatcctattcctcattgtaaagtgactttcccacccataatacatataaactagagtagggttattactcatcttgagggcctagaccagtataaatctatgccccttgtcttcttcatccaatatcgcatatacgcttgttccaacgatccccatactctacagataccatcattttaattgttgatttgcgatagcatttatctctttgtacggcatacaatggattctcccatgataaactgaatggcatagaataaattctcgcaaacaaacatatgtaataagaaaaaagaacaagcttagatgcaagaacttgtttacgattgaaatttaggtatgcgatatatagtacttccaatcatatataagttcccatgtgagctcttgtttattagtgaaatttagacatgaggtatgcaatactttttatgattggaaatataggcataaaacaatcggcatgtgtcttgttttatcctaaatttaggcatgcgtctcatgcctaaatgagtcttgtttgtttttcat

SEQ ID NO: 37975 - DNA, 955 bp, Oryza sativa
atgtcactagaacagtggattatgtcactagaacagtggattaagggctcatttggtttggtgccctaccaaatcattggtagtgtcaaatcatgggcaagatttgatactaccaatattttggtatagttggtttataggagttgtattaactttgttaaattttgacatcaatccaaacatctataaggtactattcaaagtgctaattatttggtagggcaaattttggcatcaaaccaaaacagccctaagtactactccttccattccaaaatgatcaaatttgaactaaaagagtgtacttatttcaagacggagggagtagatcagtaaccaaataaattttaaatcgtaaggtttattagcgataaaaaaatactttgtaagtaaaacttttatatatgtattattagcgtcttaaaagctaatgttaaaaaataaattatgatgataaaaacatcaaaatcaatttaaagttaagttttaaaatataaatgttagttgcggctagcaagccgaagagcaaacgctggtgttattgtgtgaatcaaaatgatcaaaatacagtggcggagccagaatttttccaaacctagggcccaattagttgagtgtatatgattttgcctttatcttctagtttttgaagttttaaaatggaatttcaatgaatatttagaatcaggagtagggagtagggctgcagccctagctgccctactcctgtctccgccccctgtcaatatagcaattaaaatgactagagatatgaaaaaaactatatataggtactgtcataatggccatatgttgaaaatatttatctcgggtgcatgtaacattttttttctagaaaaagatgtagttactatataacaatttacacctatggtataatgtgttttcagagtagtttcgcaactttctaattcaattttaactcccaaatagc

SEQ ID NO: 37976 - DNA, 1501 bp, Oryza sativa
ctggatccatatgcatgtatcatttgactgaactaattgttgctgatgatgtgaacttggacaagtttctcagttcgatgcacgtgctaacgctacgacaatatttgataatgcaaaattaaaaaaaaatcaaaatattttatatatcttgaaagtataaaatgagataaattttaaagtcatgaaaaaaagttcagtttaaataacaaattttaaatcatgcagaaaaaaaatcaggtccagagatggatagcaccagtagctataccgtgttactctaaaatacaaaataaaataattttatctcctggatgtaaatctatatttttgtttcataacaccacatttttcacaattacaaagagggtcgcctcaagcaatcgaaacatcaatggtcactacatgcatcgctagaaagaacatcatcttgatgtaaactgctggacctgaatagattggcctctctaacagcaccaggatcagctccaacatcatcttaagctagaaataacttcgatttctgaaagctcaggaagacattagcatgaggcatgtttgcatggttccaactcctaaactcctgagaaaccaaatgccttaaaaaattttctcgtttagccacatcaaaaatctttcaagcaaattacatccaaataaaaagaagtaacagaaccggccatagaatttatgcattgcatcattattagtaattacaaagtcatcagcacacttcaatattcaacatgccagagaaaacacatctttattggattcatccaatagcactttttcatggatatgatgaagctatcgtttcattgtctggagctccaaaattggttggtgcatacaaaggagatactccacttaatatcaagcaattgacaaaattaacatattttcaaagttatggcacctcacaaaatggaaaattgaccttctgctgcagcctacataacacatatcagcagcacaacaattgcagttcaaagagtctacactgatgaataaaaattgatttggttgatagaaagaaccacccaagtactcaatacaaatagaaaattgcaataattgttcagtatttacagtgaaatctaaatctacaggaaataacagcctcgatctgccatggagaaacttttccaatatatttccactaagttaggcactcaggctagcaaaatgaatacaagattccaactaatcaatttctgaaataacatggtgtctagaaatgctaatcctaattttagtgctgttctacttactctggagagatcttggtcgatgtcaacgattatcatggccatgttggtggatggggacaaggctctttgaggcggtcttcctcctctcattggcaatgcaaacacagttctgcaccctccaactcctactctgagtgggcctcacaccgccggcagaattccattagtatataatataattcaatctgcattcaacaaagaccaagagttattgagccctcccaagtatt

SEQ ID NO: 37977 - DNA, 879 bp, Oryza sativa
caagagaagccacgttggttttgatatatttaccggacttttatataaacttaagcatatttatttacattatttttaacccatcttattttaaataatattttgtaatatcgtaaggatcgtagaatctggataccaccaaagattttgtaggatcgtatagtaatgaatagtagaattgagatactatgaaaattaggatactaggtgggatcggtaccatttcgacatggtagaatcgtagtattctaagatgctaggatacaaatcgtgatactgtcaacctataaacatactgtcatttacgggaggatatatgataaatatggctagagaatattcaggtggataccataaatatgattagctagagaagagagaagtgtttcaaagtacaacaaatgtaaagtgagctagaggtagttcaaagtgtaatttatccagttattatcttcatcaagcatagactgttttgtgttaattccatatttctatggatatgttcattgattcatatctgtataagccacagtaaaagtacactacaccaattttagatttactattattaacaacatagattctcctgcaggaactctctacagcatcagcaatttacagccacaaaaatggagctaaacaaactgagtttaatatattctcgaggataccaagttctgaacctttttgacatgtcattgatttctcctctcttctcgccctccgaccactcatcccctccacgttgcagcaaaccgccatggccaaagcagcctgacgaggcgggcgggccgcggggggcaagaagagccagcggcgcggcgaccgcgccattgccggcgcgcgcagtggggcgcggatgcagaggaggcagacgcc

SEQ ID NO: 37978 - DNA, 1501 bp, Oryza sativa
gaggattaggtgtagccttggtcaagctgcccgtggagtggagccgtctgcgccgtttatcttattttccgctgcttagatctttattgaatgagaggaactatctacctctgtaatgacatttgattcgcttattaattagagtaataattgtactctattatcaatttgttattgtgtgcctcggctgattcctggacgagggttcacacacatgtaagcgtttggaattttggatagaaattccgggcgtgacaagttggtatcagagctcccttgaccctaggttatgccaaatggttacccatagaagccctctaaaaagattggaaaagtagaactgttctcctccctttctcttctaattaaaccaaactaatggcacatgcctttcataatctcttttaatggttctcactcaaaatttattccagtgttattagtactgtacatctattactgtactaatggctcatttaccagcaaaagttttacaatgttgttttatttaatcttgctgcaataaaataaatttagcatgatgattttataactttcttttatttcttttgaaacctgttgttcaaaagtacaaaaattgtaactttgtttccaactgtttcaacttatcttgcaagtttggtttactttatttacttaccttttactttgatttcctaactttattcaaattaatccaaaaacttgtgctattaattggataaatgtcttaactccctcctttcacttgtctttagatgccgcgctacaagcctgagtacttgtttggtgttgagtgttttgtccaggagttgtgtacgatgtcctttgtcattggatttgggactgcccctttttatgcccagattcctcatgatcgtcacgaagagaagtgccgagtcaaagtcaccttgaacagtaatagtgaagatatcccctcagtaatgttcgaagctggaggaagaaactacatccatgcatgtcaggaggtggcaaggatcgccataggagagctccgcgatcattatagtgatcagttggccgacactgagtatcgctaccatcctcgtcaaccccagggaagtgaccgtggcagttaccttgagactgaaggaattgagaatgatgctaccacaaggcatttggttgagatgctgtgggctatggatgaaagtcgtgcggagactgtgttagcggctcaagatcgtgaagaccggaatcgtggtaagatttgcaagttagaagacaaggtggatcgtttggagaaggaactagccacattgaagggagaagcaccaccgcagaaggccaggattcgtcttaccgcaaggaagagagctctatttgtccctcgctatcaattggcgccaaaggttcgtgtggtggagaaagaagttaccccagccttagcagatcctccggtcatcatcataagtgatgatgaagaagaagaatccaagcgcaaccattccaagattgagtgggtagctacccaagatga

SEQ ID NO: 37979 - DNA, 1501 bp, Oryza sativa
atcatttcccctctatcaattcgaccggagaaggaaagacgcggccgaattggaaagcggcggcggagtggctcggctagtgtttcgggcggcagcggcgcgacgaagacgacgaccctgacaagtggggcccacctgtcagcggctgagagagagaggagagcagcggctcggcggactgggccgactgggccgactgggccggggagggagagagaaagagaggttttgggccggctttcggcccaaagccaaaagaagacttttaaaacctttttcaatttaaattattcatgaaatgcaattccatttattaaaaatacttccttagctcaaataaatcccagaaaaatctaagaattatagaattaagcaaagtatttaacaaaattttatctagcccaattttatattgagatttagcaaattaaaattagatcttctcttccaggcttttaaaatcatttctaattattccttttaaacaacaatttataatttaaggattttaaacaagaaaagcacttaacaaaaataattagatcattaatgatcaaataattactgaactgttctttgtatcatttaggaattgagctctgaaaaatccgagaaaatttcagagagtataattaaccatggagaatttaacaaaaattaaatccatccatgctttatatttaggatattttatttcccacatttaacttcacttgtaaattaaagaacacttaatataaattctactattaatttattaaataatttataaatcctgaaacgaaaatcaggatgtgacaaactaccccccttacaaagaatctcgtcccgagattcggaacagctagaaagaaaaagggaataggcaaactgcagtctatcttattccataactccgataatcattctaaggctttaaagaaaactactgctgctttgaaactggtggctgagttgtaacacttgaagacacaactcttgaagacgcaactggcactgcattggctcctgtgacgacaatgttgttagcaatcttgtccgcgtggtagacatggttagcaatcatcttgattgatatgaaacatggttatctctggtcgcaggaatctcagcacacgacatgttgttgacctgaccttgcggccgctgatgcttcggcttcggacactctcttgcaaagtggcctggcttgtaacagttgaaacatacctgctgctcccgtccactactgttattctcttgagactgatcctgctgaactggcaccagctgattagcttgctcgatgttaacttcattgctttcattagtctctgttttgatctcaccaccgatattcaactgttgcgactgtccttgaccagcagaagaagattcaccaatttggagttgcttgatacgctgcctctggctactaccttgtgcctcctggaaaacagtcattttccttttacggttatccatcctgttcttcttgtcttcaagtcgaattgctttgtca

SEQ ID NO: 37980 - DNA, 1501 bp, Oryza sativa
tgttgaccttatggtagtaattatgatcgatgctgggttttgttccgtacattgtttggtatgatagtcttgactatgtagttactttttattgtgtaccttccaggaagaagttaatccaaatgagctatcttttgatagccgttatggggtgcagtctagccacccacaccattatggcaatcagctgcatccaagcaacactatgcaggttttttttttcttttcaacaagaagcttgcatttccatttatgatttttctcccacatgtgcaactgacaaaaagaagtaaataatttcttaaaattggatagtttggccaaactacatcaacagcagagcactctagagtccagtggatgtaccagaatatatttcaggtggatgcttactttgcatttctagtacttttgtagagtttgccagaatcaacattttactgtagtaatgtgatttgtatatgcacttatgtgttataataaatgtaggacgatcaagtgccttatggcagacggacatgacagcaatcaaatactgggttcagatggtgccatttcaggtttctttctcattttagttactgtaccattttagggttctgacttctgagctctaactccgaagcagtcccaccatcagctcatcagtcatcacgattgaatgttgcaaattttgatgagcagagcatggaaacaaacagatacactcaaaattgtacgatatgtaggcaagtcttctacactgtaaattcaggaaccctgtattttgtagttagatacccccaaactcaatggtaatgatacttcacagttcacattcacactcttgggcacacaaacattgatggataaaattgagatgttgtaggggcagaaatatttcataaacccaggaaattctgaatttaattagtccctgtgactacggcatcatgttctctactaatatatgattcaccataacttggcactgaccataacatatatcaagtgttaatagatctgcgtcatgtgcagtcatctgttgaatggctgtacatctttttttttttatatgttgtgtccattcctaccttttctatttatcagcataataattacttacggagttcacttatatgcatgtataggaaaattacttaaggcacctgcaactgcaccgtctgaatcaatgtgaattttggagttcctgtatttgatagtgtgtaacatatattgaaattatagccttttgttttgcaattcaacacattaactgttgcctcgctagagaagatacagagaaacaccttccaactagtttggctatctggaaatttcagcatttcaaatactaagctcattgcatatactggataaggaagctatgttgtttctaatcaggagatagcattccttctgggacatttccaaattctgagactaatttctaatgattatctttcacgccgcaggttttcatcagacatacagaaggaaagaactctttctcaagaaaaca

SEQ ID NO: 37981 - DNA, 1477 bp, Oryza sativa
gtatgagaataagttcaccatatcggatttatgatgtgattcaattctttttttcttgttgtttctttttgagagaatctattttataccactgagcttgctcaagttcaacaatttgccatcaacattgtcgttttctataatataccgacgactttattaattgttctacaatacgccattgggctaagtattcttttcaaaaatacctaaaatacccctatggatatatgaggttaacaattgatttatctaatttgaagtttcaaaaaaaaatgaaaactttcatgtggccttcttatacaacatggaaatttgtatagaagttttaagttttttacatttctattttttaaaaaatatataacttatttgttatatgctatataaaaatacttttttactattgtttttaatataaatcatctttcatacactacataagatatttttattctattatgtcttatataagcaaattctctttcacataccacataaaaatattttttctaaaaactaaatataccagaaaaaaacttgaaacttgtatacaaacttccatgttgtgtaaggatgccatttaaaaattttcattttttttgaaacttctaatgagataaatcaattgttaatcttgtatatttctaagggtattttgggtatttttgaaaagaaggcccagcccaatgacacattgtagaacaattgataaagtcgtcggtatattgtagaaaaagataatatcgatggaaaatcattaaacttgaataaactcagtggtatagagtagattctctctttccttttttgtttgaaacttagatccttttcatttgaaggtatacacgttatgtgatgtgaatggtagatacgtgattccatgagatttgtgattcagatatgtcttttgtcttttaatttgtcatggtagatattcttttgtcttgaagcatttccgttttgtgagtagtcccacactcccacatgaagcacataaagactgcatgtaatttacagagtttatagtttctataatcctctaactcaaatccggctcagcctgttttttttttcgagagctcagcctttttttactcgttcgtcacagatgagcccttttcagtgccgagaacatagagccacggtgccagatccaaatctagcactgttggcccttttggaaccgacactgaattagtgtcgtgtggtagtgaaaggaaaacacatacctgaacaatgcatcctcccagccctatcccttcgaagaactgatgaaatgttaacgcggccacgagcggtctgatcgtgcttgggctctcggatgcacctagtgatatcccgatgataatcgaatgcactatgatacccagctcaaacaccttcatccacacatgcaaattcatatcaaaccaagaaacgtatgaacattagcaaatttaaattaattaacgcgcatccatgttcatctcccagc

SEQ ID NO: 37982 - DNA, 1501 bp, Oryza sativa
gatggcataatataggctcatttgcaaaagcagcgtttagcaaaatatttaagagaaataaaacagtagagtagttaatcagaaattttaatcaacactgaacagcacacccatgctgcacaggcccgaccatcctgaacaaccatacccggctgtacagatctaatctccaaaccaggaattttccattccaaaccaggagctaagcaaattattaccagttataacatccataattattgtgagaggtgtgagactaatcacgaaaaacattgctcaactcgcccataaccgcgggcacggctattcgaatagttttactctggccagaggtgtaccactgtacccacaagacacggcctcaacatcatgtctaccatgtgtcgcgatactggaaagtacccgaatagaggctgtgacaataccctttgcacaacacaactcaccacagtgcaccattcctggatcataatcacccccttataaaacaaggcatggactccccagcgacccccgtgggcttatctccgccacttctcagtctggtgctccgcaatgaatcatgttatacaaaagataaagccgttgcccacgctggcttgtggttggcacggttaatgtttcacaatagtagctcgtgaaccggtccttaattgtcatgagcacgactctcaaaaccatgtgctcacaacccaccattatcaagttttagttggcaagtaattaattaaccaatcacgattgaccatcgtgagctaccattaaatataaccataagtgatagtgaaacattagttatcccaattgtgtgctaatgtttctaagcatgggtaagcaatcatatctaatatctagctgatccaatatatatagctcaactagtcaagttataataacccaaggtatcaaggaataaaataatcaatgcaaattggccataacaaaggaataagttcacaccacccagtgacattcgaaaataaatacacagttgaaataaatatagaatttaaatataggatcaacatgctcaaaggattgtgtttaggatctgtgtgacttgccttgcaataatcggtcttcaattaatcttcttgaacacttccgacgcactcgcgaaccttcacaacgacggaaacgataagctaacacgcaaaacaaggaaaagactaataaaaaccaaataaacaatacataaaaagtaaacaaacatgtagatcataattttagatgaattatgagacttgaacggcctcattctgacttcatatgaatttattatgaattttacaagattaaatctatttaaagcccatttaaaaagaattaaataaatttaattcaatttatggacaattttaatatgtagatctttattttatataacttttgcaacttgaaccacaaaaaactgagttcaaatgaattagctatgaatttttaaagattaaatcggattaaaacacttatatggattttaattgaattatgacgcaataat

SEQ ID NO: 37983 - DNA, 152 bp, Oryza sativa
tggacacggaaaccagggtttgtcttttttttttgggacggagggagtacaccttaggaatatggcggtacagtgtgcacccaagaagaaaatatctcccctttatgtcagatcggttttctagtagttgtctctcttttatctcttctagg

SEQ ID NO: 37984 - DNA, 641 bp, Oryza sativa
gatccatgaaaatgtttagataggcccacgtgtgaaattctaagcctccgcgtatcctattttgaactatttccttctttgtttcgaacatctatttgaaaggcaagctcatgtgttgacttaaaaagtttatatatagaatttttctataaaatgaaataagtgtttgtttgttagttatagccccggctcttttggctctacccaaaagggactatagtggctagagtgggagcggagtttagcttgctccaaaacttcactgcgtacttatttttttagttaaatttatgagttcgagctctatcaaacataccataagaataaaaaaacaatttatcaaaagattgaagtgtgtggtcaatccctaaactcgttgatttatatcatctagatcctaaactctcaaatacatttgtcattccggtcctaaaatgccataacccttccaagatcctacgtgacatatcacacgggtgtttgctcttttttttttcttcttctcccttttctcttctcttcttccttcctatctgtgtggcaaaaaagaggaaaaacaaggaggaaaaaagagaaaaaaaagtagaggagaaggaacaaaaataaaaagaaaatttgggttccgaatgtttatggagtga

SEQ ID NO: 37985 - DNA, 467 bp, Oryza sativa
aatcgatccaggcactacactaaatgttgttttcttctctctattttcttttttttttaaaaaaaaatctattttcctagcttttttatctcgttttctatgtgcacgcttctaaaactggtaaacgatatattttcacgaaaaaattatataagaaagttattttatatactttttttttaaaaaaaaacctaataattaattaatgatgcacgagggattatccaactacaagagccaaacacagcttcagatgttgtatcaaatcatagtgctagaccatttggagaaggagaattaatttcacaagcacaagaaacccatacgcaagttctgttgattttttgtaaaaacgaaatcgttgaaagaggacaggaggcaagtagtgtcagcgacagatgggtcccactaaacggtaggtataagcgtcatccaaaacccctcttcccttttcttatcccctcccc

SEQ ID NO: 37986 - DNA, 264 bp, Oryza sativa
ttcctggtttggagattagatctgtacagccgggtatggttgttcaggatggtcgggcctgtgcagcatgggtgtgtgttcagtgttgattaaaatttctgataaactactctactgttttatttctcttaaatattttgctaaacgctgcttttgcaaatgagcctatattatgccatcctttggtatccttgtgcacttgcatatttgctgtgtggcttgctgagtatgtcatatgctcaccttgcaataatcaatcaacct

SEQ ID NO: 37987 - DNA, 1084 bp, Oryza sativa
ttcctggtttggagattagatctgtacagccgggtatggttgttcaggatggtcgggcctgtgcagcatgggtgtgtgttcagtgttgattaaaatttctgataaactactctactgttttatttctcttaaatattttgctaaacgctgcttttgcaaatgagcctatattatgccatcctttggtatccttgtgcacttgcatatttgctgtgtggcttgctgagtatgtcatatgctcaccttgcaataatcaatcaaccttagttgaagaaaaaggatccagaaggagaagacgtttggcttataccccagttgagctgcctgtgggagtggagccggagcttcgctagattttattttccgctgcagttttcttcatggtgaggactaagtgcctcttaagtaagtatttatcgttgtaattaatttgatgaatctgtatattaaattgtcagtttgtgtacctcggctgattcctggacgaggattttatgcacaaataagttcggaaattactagtgaaatttcgggcgtgacaagttggtatcagagccatctcgactgtaggataagccaaatggtcaaaccttaaggactatttttccgacaaaaaggatttgtgaaaatttctcctttcttccttatctagaattctttgcaaattgtttcattgtctactctcctctctcgttcaacttgagtagttctaaaactagttgtggaaactagaagacattgatgtggtcaacttatggaggtcagtcaagtggatcgaggaaggaccgaagtgccaagtggtcaagatggaatgaagtttgcatcctaccttagaacctatgccgccaaactatccttgaagaatagtcagtaggatagaacgtttgttgcttgcttgtgtgtaggtatggttgcattcccgtcattggtgtggttcaatgatgagtgtgtaactatactaggttgcttgcttaatcaacttaaacaatataatggtctacacacatcagatcagtgttaacctagttaaggtcttgtctttagtgtaacccctctccttctatcttctctaatttgcaataga

SEQ ID NO: 37988 - DNA, 222 bp, Oryza sativa
tagtattttatctacttctgtggttctttttagcctggcacggcataattcttaagaaactagcctatcttcttgttctacatgcgcaataattcactcttaaatatttcctgcatgtacataatgcttactataattacctggctgtttgagtattgcatatagtctactacatgcacagccttcctatttactaatttaatgtgtccctttaaatactaa

SEQ ID NO: 37989 - DNA, 1217 bp, Oryza sativa
ccccagtggttgtattgaccctgatgcaaaaagttaattgtagctagagtgagctcaatgtaatgtacatacagggagacacaaaataagtgcaatggacagccattggtgtgtgcatgattgcaacattggttacttacccatcagcaattttgcagaggtattcacgctgatcgtctcgcagtggaacatctgtaaaatctggaaggccaaaaaaaaagagagagagaaacttagatgtttgatgatcccatcaaacaatagtcaattcagtctaatgcaattttggtcagcctctgacaaaatcaaaactctgttgaagcattttgtagatgagtaagaggttggttagagattgaaaaaataataattgatcatattaatatgtcaacaatccgatagtttgcagataaaaggagtcatttagtttggcatggccatcagagagacaggaccagtaacttgcctgctccatatatgttggaacctttgaacgtcgtgtttcctgtggcaagtgccccttccaagttggcatttgtcagatttacctgtgaaatgattcaagagacacaccatcactcgattgtcagtttgtcactaggttatgcaagctagtaacaaactatttgtgctgcaaacctgtgaaatccatgcttgacaaactggtagtaacttaatcagaaagtggtcaatgactttctgaagaaagtgaggacttatgtaatgaccaattatattatgtaacgcaagcttgttcaatattgctatgatgccaatgccaaattgctatcaatttattactggtctaatcagtaaaaaggaaaaaacaatccaggctttctgaacaatgcaatggtcaatgtggaatgtagtagcatttcaattagcttgctatcgctaatgcttttctttgagcaatatgcagtactaccttcgatacatttgccagtgagaaatctgcacctctaagatcagcatcagagagatcagcacctgaatttatcaccagaaaactctgaataatcaatgcaactagaaccaaaacatcagttttgccatttcagaacttcacattggggaagaatcactacaactactgtgataaatggaacatctaacaaattcacaagcacagcatcagaacctgtcagatctgcatcaaagaagctcgcgccgagcagcttcgcgcctttgaagttcgcctgcctcagtataga

SEQ ID NO: 37990 - DNA, 728 bp, Oryza sativa
atttacgcattttaggctttttaggaaatatacaaaattccgccaagcgtgttttgacttttaaatttgcactttttaattgttgaggctttcacaaggattttaattattctatgcacaatttcgaggatgtattttaaagtcgttttgggacgcgacaaaagtaatcaagatcaaaaagggctataacaaacaataggttaattccacccaatgacatttcaaaaataaatgcaatagttgaatagaaacaatagctttaaataggatcaacatgctcaaagggttgtttgagatctgtgtgacttgccttgctggccttggaactcttcaaactcttctccggcgaaaacggactctccggaaacgacggaatctaagcagaaaagagcaaaatcaccaaaacagcacataaacaagtatgaacagtacatgtggatatttttaatatgtagatctcaattttagaaaaatttagagacttgaaccaactaaatcggagctaagatgaattagttatgaatttttgaagatttaatcggattaaaacacttattttgattttaattgaattatgacgcaataatgaattatttttgaaaaggaaaaggaggattattgcgtcagcgggctagggtttgtggtggaccgggcgcacggcggcggttcacacgaacggacggccgagatcgatcggtcaacgactggctcacgggagacggggacga

SEQ ID NO: 37991 - DNA, 279 bp, Oryza sativa
aattaactagcacaatgtacctggtcagcatttccttcttcagctaaaaccacaattgcacgcgctttagaaactgagaccttgtacatgaaggcagattcagttcaacaaagagttgcatatagatttagtaaagtaatagtgagtcattaaattaacataacaaccatccaattgtctattgattactgccaagtgccaacagatcataatgcgggttagcagaatcactacatcacaatgtttacctttttcaagtcagctagaatcagagggctt

SEQ ID NO: 37992 - DNA, 569 bp, Oryza sativa
taaaacgtgttcaatagtttaggaaatctggtactcgtagttcttatgatggtagcacacactttttcaccgactcccttcgtctaaaaaaaattatacgttacatccagtgctaaattggtattttatgggacagagggagtaactctgaacatacaaacactaagatatatcaaataaaacatatttctccgcaaaataattatattgaaacttgtagtagcaagaaagtgaaccatttccattttttaataaaaaaataaaacctgaatcatatcagaatggctggaaaaattccttttattttctcctcctttatactaggaaagaacagccgacgtggcgatcaacgattggtcgactgagcaagcaacccacgaacagataagacggataaacacaccgtcgctaaagaagaaacacaaagaaaccaactccgacgaccaccggagtcggagagcatcaagaatcgacgacgatcgatcatggccatccccaccatcctgggcagtctgaagctcacgccatccccaccctccgccacgccggtgcgctcctccgcctcctcc

SEQ ID NO: 37993 - DNA, 291 bp, Oryza sativa
cctttcaattgaactggaaatgcatgtatcaagaggagcgtacctgcaaaagataaattgtatacatgtcaccaaacagaaaatacactatagatcattaacggtatctaaaacatatttaagcaggataggttagtaactatcttttcactgttgtctgacaatgaaccaataagtaatcatcagaaataggccactggtgactacaagatcagatgcaatctgactttatgagaacagggaagaaagagaaggatatgagctataaattaccaaggaaaacggggccca

SEQ ID NO: 37994 - DNA, 567 bp, Oryza sativa
tccaccttcccagcctctcaggaagtggctccaacaacataaaaatcatcatgcaataacccatcccatacaagttaagaattcagagtctagccaagtgtaatacacgtcctggtgctcaataaccgcgagcacggctattcgaatagatttagtttactcacactgcagtggatgtataatttacccgcactccgtgactgcccaacacatgagcctcgtcccaacacatgagacgcgtcacggcaaagcttttcgataacctcgcattggcagtacccgctccatgaactttagccctcatgcactctaggcgtcatacatttctagcagtgagaggagttctggcgctcccgggaaaaagaagtctcacacatattaaattatgattcaggttaagttctctctctcacgcactcatggcagtcctacccatggcgacaccgatgtagggcacgcctctcggccctacctcaacggctgtcccacggtagcgcacctgcgtcactcaggggtgaaccatctatgtagggatactgcctccgctcggttatttaatccgctagg

SEQ ID NO: 37995 - DNA, 185 bp, Oryza sativa
ttatctgccaagcattcagcttagaatatcacccaagaaaacttttgcttagtactttcctaatgaaaatagcctagtacttttgcttcttcccaaaacaatgtttacttagcaagttaacatttgtcgtttatttggtgggttatatctgtgttcactgaaatatccatttcacatgtggcagc

SEQ ID NO: 37996 - DNA, 627 bp, Oryza sativa
cggatccaagcgagggtcaagacccgcaggacttcgaccaacgcaagtcatcaccattctttgaacatgttgatccaattgcgaaattattttatttccaaataagattgcatgcaatgatgaacatcctacttgtgattatgccatgtcttgattattgtttacctttaaatccttgtaaccataattacgtatgagtccttagtcaattatgacacatacttagaaatgctacactagattcatgcacgctcatattttatcaaatgctatatgcttgggcaattacctttgggaaggtaattgagatgcggcatgtggagacatgagcgccacattgccatgatgatgatgacatgatttgtgaaagtaggaatgaaattaaacacttgttttagactggggcggacgatggatttgggtggtatatgggaaaggctagtaccgtccccggtcaattaagaaccgagccatgaagttaagcatgaaacgacccccgtacaaccgcacttctcgtatgggtatagacctagcggattaaataaccgagcggaggcagtatccctacatagatggttcacccctgagtgacgcaggtgcgctaccgtgggacagccgttgaggtag

SEQ ID NO: 37997 - DNA, 854 bp, Oryza sativa
tgccgttgcaacgcacgggcacccaactagttaattataaaaaatgtaattaaaagaaggggaagaacacatttttttttaaaaaaaaagcgaagatgaaagaaataaacgaaataagaggatacgaggcgacggacgtcgattgcctaacgccgacgcgagggtgacgtcaggggaaggatgacgcagagtagacgtaagcacgtcgttggcacgttccagctccatccattccaacctcgcccgcgccgcgccgcgattccggaagcagccgctcccgcgaaggaagaaaccaataaaacaaagcgtttttcatccacacgtgacgcgaggcagaggcactacacacactgctctctctgtttttttttggtcaaccccaacccaagcaaagcagccgcatatctctccattaatcacctaccaaaaaaaaacaaattattttgtttttaaagatcatttccaacaagaacaccataccaatccttggtcaaattctgctagtatttatcctcctagagagggacatggggagaggaggagtggatccacgatgatgacgaggagcatgatgaagtttttctctcccttctcctccgctatttataccaccctctcctctcgtctcgccaggatcaacgccactcgccacacaccgccaccaccaccaaagagcagcagagcagcaagatcactaacctgtactactgcctctaaccccagatccaaatccaaatccaaggccaagcatctcctgctgcttctcctgattgtctcgctcatcttgcttgcagctttcttgctgattcgagcaaccatgtcttcttcgtcttcgtcgtcggatgctgtcgccg

SEQ ID NO: 37998 - DNA, 160 bp, Oryza sativa
gagacgtacacatgacgtctagctagctactgcatctcctccgccttattagttgagtgagcaagcaagcaaccgatcaatcgatcaagatcgaaactgcagattattgatccatcgatcgtctagtggctaatcagtccggccctcctgctgctgcagg

SEQ ID NO: 37999 - DNA, 291 bp, Oryza sativa
tagggactgccggactgggaagtggaaagggagaggagagagagatgggggaattattttggtactttagtctgaggtagaagacgactgttgtctgcctcaagattcgtgcgaacacgtgtcattcacaaaatgaagtctttccagatgagcgaaggactgaggtcctgtgtaattttcttccgccgcccgcaacacaacaaggtcagggggcatgtgggccccacttgtatggcccacccttccccacttgtatcacccaaaaaaaccgaaaaaaaagagaggaaagga

SEQ ID NO: 38000 - DNA, 164 bp, Oryza sativa
ccctcaggtagccaatgttcccggggggtcttctatccctcctgggggctccactcatggggatcaagggtcttcgcagcagcctttggcttcctctggcgagggctcttctcgccaagctcacaccactgcgcctcctccggcggggctcatcggccccctca

SEQ ID NO: 38001 - DNA, 426 bp, Oryza sativa
tgatctcaattaaaaatggctaagcaatcctttttagatttttaacaaataccaaatctaccctttcatatactgcaagtatatactttaagtagaatgtactgtaaaagtcctctttttttcgccccccatgtagttaagctggcaattaatcgtttttttgttcatacttcatttgaaatgtgtaggatcaacaaaacacacacacttgtgaatcgacaaacgcaacctgcaggtgctaggcatgcaccgtgaattattgtatattaatctgtcaaagactcaaagagcagcaaaggaaatgtctcatagccttgttaaacataactttgccaggagatctgtatgttttgatgcacacaagctgttatgagggttgctagttgctactcacttgctcttacatgcacttctgctggcataaga

SEQ ID NO: 38002 - DNA, 821 bp, Oryza sativa
tgagcgtggtggtggcgccgacgccgacacccaccgcgttttctttggttgacggtctccatcaacaggaggttcttcattttcttgctctaagcagtgtcagacgatacatcgatcgaatcaaatgatatgaacttatccatgtccactccatgtacatatatttgatctggaagttgacggaagcaaaaatcatttccccatatatgaacaaatgaagtgtattacatgggtgtagactttttgtggagtaaataccagccatgataccgaggaggatcatggcacctcccaagtatcacatgatcgtacttagttataatctgtgaaacccacagaaaccatgataccagtcatgatattgagcagaatcatgatacatctcatgtatcacatgatccttctaaggtatcatctataaaacctgatgataccagacatgatatctgagaagaatcatgatacctcccatgtatcatatgatccttctaaggtatcatctatgaaacttgatgataccagacatgatatctgagcagaatcatgatacctcccatgtatcatatgatcctcctaaggtatcatcggtgaaacctgataataccatccatgatactgaggaggatcatgatacctcctaggtatcacataatcatcctcaagtatcatacgtgaaacccgcaggaaccatgataccatgcatgatatctaagtaggatcatgtgatacatcataagtatcacacataatgatacttttgatgtatcatgtatgaaaccttcaggtatcacacaagatgatatatacctagcgagggatca

SEQ ID NO: 38003 - DNA, 407 bp, Oryza sativa
ggtcacgtattgttttgtttttttggttgaatcagcttcgactgcatgtcttgcactcactccaattgatcagagcagatacgattcaggtcgtgtgttgtgaattgtgtagccaattgcaaagtagaatgggttgtcaaatcgaatcttcttcttcttttacggatgtatccgcacgagactgaagcctaatcttttcgcttacgttcatacttatcaattaaaatttaaattttcaatcttaaatttaaagttgattttggggttttttcatcgaagtttctttttcagcttttaattttcgatcgctaagagcacctatatataagttttattcacaaattatttttcgtctacaaatatgccgcttcgaccatgaaactgaatttcctgtactggccgttagg

SEQ ID NO: 38004 - DNA, 339 bp, Oryza sativa
ccactccttgttattcttatactcattgttattcttgtcttgattgaaggatgcctcctcgcaagaaaacttctcgcaagtccaagcgctctagggatcggtctcccactccttccccatcctatcatgaggactcggaccgtgattggtccgggggaggagaagaggagaccggccctcaggtggccaatgttccccggggctcctctctcccacctcggcgctcaactcatggggatcaagggtcctcgaggcagctttgtgctttctctggcgagggctctcctcgctaagctcacaccactgcacctcctccggcggggctcatcggccctctca

SEQ ID NO: 38005 - DNA, 1501 bp, Oryza sativa
actaaaacagcattcatctttagagccctgttatgctcacagttaggattgactaaaacagtgatcatttatagagtcctggtgtatttttcatttttttttattaatggcttacactgctcatttggaaacttaccttgaaattgtatagagttttagttctgttatgcgtcttccctgaatcttgttacatagaaattgtttttcattgtttatttcttgttatgttatgagtggagaaatattgtagggctaattccgcatgctcaggcatgagtctcccataactatttgtttgactatgccaaaaatgctgtggagtttggaaacctaacagtgtgagagttgacccaacacacagggtatacttgcattttatttcaatagagcccctgtcttacatctcaaatctgcttttaagtgcaggattttgtttctggttctttgtaatcagttaatcactccctgctattatgaggattcacaatttagcacatcaaattttgtttaattgtgcaatatttcataattaccagtgcatccttttttttcctgcggggaattgttaatgcaaattatattgaagcagcagaaacatgatatacgcatattggttgatggattttatctaatagtgcttatgctacttctaggttgctgagagagcattgtttttgtggaacaatgatcatatcgagaatctgatcaaacaaaatagtagggtgatcttacctatcatcttccctgcactcgagagaaatgctaatgggcactggaaccaagctgtgcaaagcctcacacttaatgttcggaaattgttctccgatcatgatgttggtgtatatgatgagtgtcagcggaaatacgaggatgaaaaagccaaagagaaggagacaaaattgaagcaagaagtcgcatggaagcgcctggaagagatggcatcagcaaaagcaacgagtggagcagctgtgcttgtctctcgaaccttacctcgccaatcttcagctgtctagcgcattgttcaagtggtaaggaagtttactaatttttggttgcattgcaagtttgaggtagtggcttctaatgtatgaatccacctcatttgttaggtccttggagattcaaaaagcactgtacaggattgaactgtacagacaaggtatatcaaggcgggcatattgatggaagatctgagaagccagttgggttacgcagagtaccagcaatcacctctcaatcctgagtcttggcttttgatatgctgagatctgcagttaattgctttactatcctttaaccttgtccgaagttggttgcgaacttgcaatttgttttcagctggtgctgcaatcttcccatgggtgtttgttttggaagcaaatggttgttggtggtcagtagatagaagttagttagtccttcaaaatgagtcatcgttgttctccagttggcatgggccttcatggttgtaaatggaaacagaaatttttttcttgagtac

SEQ ID NO: 38006 - DNA, 568 bp, Oryza sativa
tgattttgctctgagcgccgccggtggctcggaggtctctgtgtattccagctcctgccatccgccgccgccgcatgaggaggtccccgtcaagtgcacagctcccgtcgccgagctgccaggtctccgcggagcaccaccgccagcgagccaactaggtgagctccctcccgccgaatcgatgagccggcgaagccccccattactacctcctcaacaaaatttggagtggcgatggagaggtagagcgcgttttactcagccccgtcctctgatcaactgtcatgtgatcctgtggatagctaggcgttgtttttcttcagcgatcttagggtgatttgttgtttttccttgtcaatttgattcaagcaggtcagagtggctccatttggtgcactagctctgcaaaaagcttcatcgtttggatgagagatccccgttatatggaaatggacttagggtttacttttcagtaataccaattgccacattggagtcgggagaaaagttgtttcagaagcacccgagagctactgctggttggttttgactaagctgggtgatagca

SEQ ID NO: 38007 - DNA, 1501 bp, Oryza sativa
ccgaacggaccctaagagcaagtacaatagcagattataagctagctatacccacatatcgagaagaaaagagaagagagaagaaagcgggctataaatttgtagccagttgcaacacggactcaaagatattatttatgtagatattaatgttgtagtatgaatgggctattagagtaggtacaatagcagactattagccagctataaacatattttaataagataaacgatgagagagaagggaagcgggctacagatctatagtcagctgcagcacggactccaagacacactgtgtgtatgacatgtgggatcatatattaatagtatagtaagcaattattgtatgtattggctattagattggctatagataaattggagctagtagtgggctgtactattaaacttactcttagattagctatagataatttgaagccagtagttagctatgctattaaacttgctctaagttcatttatcgggctctcaaaggacagcaaagtgcgatgtgctatgctattaaacttgctccaagttcattaatcgggctctaaaagtacagcagagtgcgatgtgcaatgtcgcggtgctacggcctcgatccgtggcagttcaccatcgagctcatggtttggacgtttggtcaccaccaaaccaaagccaacgaatcatccatgtggacggagaacgaaccatccaccaacccaacctggtgagctggcttttccacacttctaatttcctaaactcacaagtcacaagtcaacaactactggcctaataagaactcttacaagtaaaagctgggcgtaaagtctcttgtaaaaaattaaaaaaaaactacggggcgtacaccgggtcactgcctacggcctacggctattccgcaacgcgtgtgaggcgtgtgacccgtatttttctccatactgcaaaacgcaccgtggacgcgacgcgcgccacatcgtccgccacgccgacggtcagcctccacaccccggcttctctcccgcgtcaaacccaccgatcgtctggtcccaccgctccactgacactagttcccggggccccacctcgtcagaaaagcggtttcttctgtcacgcgcgtcctccgatccgcctttcgcttcccccgaggccacgcatccgaccgtccgtgccgccgcatccgacggccgcctcgaaccaaccccgacgcggcggccacaacttgcgcgccgctgtgcggtaaagcgtccggtccacgcgctgtcgccctcgcccagacgccaccgccgcaacgcgttgctgcgtggaaggaagccctcctcctcctcatccccttgtccgccgcgcccaaccaccaccccgaagcgaagccgcgtggaggtgaaggcgtcgtgcagatcggggctgtgccgctcgccgtgggatgccgttccagccccggaggtgaggtagctcgacgtctgcttgtgttttttttttctttccccggcgcggattactgaggcga

SEQ ID NO: 38008 - DNA, 1501 bp, Oryza sativa
catctgtcagtctcatgttggattgaatccccacacggcacacggcgtgcactaatgacactgcctgcgattgtaccatcagtctacaattactggtaggtacttctacttattcctgatccagagccttccactgtcagagataaaaaggagaataaaaatggtgaaaaaactgaagaaaaaaatattatcaggaaggccgagatcgttgacacaactaaagagtcgtccaatcctatatattccagtcgtatgtatgtactgctatcactaaataggattcgtatcacgcacatagtaattaggcgttaaggacgatgatgtattatttggagtagtacaatatacgatgggtaataccaattgggtaagtagtcgtagcagaactagtgtacggtgctattacttgtttgggaattattcaacgtccaactaattatctgcgcgggtaataaatgcagtgaagtttcttgccacacttgccctttacatgattttcatagatttttaatgagaaaattccctatatacccctgaaaatttactcaatcccttcaatacccctgaatttgacatcaccccttatatacccctgaattttcattttgatctcatctatacccatctccgttagttgacgattagttgaccgttaaatattttaaaatgactatattacccatcctatatacatatgtggtacctacccaataaattttcatatgaaaaaaaataacttatacaaaatacaagcaatataatcatttaattcccaacttaaaaaataaaacttattattttttatttttaaaaaattatgattaaatccatacattagtttcaccagaaaattaagagcaaaaactaaatgttatttaggtttaattttttgggaagatatacgaaattcatcaaatttgatctgaaatttattttctaatttgtgataaactaattacatctcctttgttttttcacaacgaatcttttttcactaaatatttgttgaaaagtaattttcaaattttgtgcagaacttttttgacaataaatattttttattttaatgaaataatgttttatttttaaaaattcataacaaatatttagtaatttattccttattggttttcacaactcaaataatttacacataaaaaaatttctagcttttaacaatataccaaggacaagaaagtaatttctacaataactaacggtcaaactaatggtcaactaacggaatgggtatgtaagggatccaaataaaaactcagaggtatataagagatcaaacaaatttcaggggcgtagaagggattgggtgaaattacatgggcatgtagagaattggcccatttttaatccatttacatggtcaggagtaatctagaaattaaattacctacggttaattcgaaggtggatcacttcactctctataagaagcagtggaagcggaaacacactgaagcacacagacgagtgtgactgacatagc

SEQ ID NO: 38009 - DNA, 1244 bp, Oryza sativa
aaaaaacttgaatttatataggattttacagtatgcatctaccaaccttgaaggaagaacgaatttttttcatgtatgaatattatgatccatgttacatgattgcagaaccttctttgatatattacctgaaactgtgtttcactacctctatttctttcttccttgtaagtattaattttaacctcaatggtactgcaaattgttctatgatcactggaatttgatgcttgaaactagtgggactcatatgttgctcagagccaataataaatttgatttgtttgcagttatgcaaacaggaccaacaaccgctgcatcaggatctgcttatgcagaatttgggaagacaaaggtcattgtgtcagtgtaagtatagttgcatttttatacaatcacgttatgtatgtaagtacgttatggtttagtttccaagtgttaaagaacatatctttcattagatcccaatgtgaaaggtgtctcataaactcaacttgctactaaaacataattaacagtttccattatgatattcccaatctatcctcctacacatcattccaaatttgaatttttaaagattttggcatttgtgggaccaaatattagcaagttaaggtcaactgaaatatgtttacacttcaaacttctttctttgaacttgaaatacacttaaaagttactaagctcttgagaacagttcataatcagcttggattcatgtatcagtatgttttatacatctatcagtttagcatgctaacatttatcagcattttataaatttgtgctcttatgacttttgagggttttgtctctatggcttaccctttctcaaggggcaacccaaaaaaaaaaaggcaatcgcaatgatagtttgaaggccttgaggctgacctttaacatgtacttcctagcttcatattacatcagtttcatgtatcttgtcagtcaaaacttatcagattgtatattcctgttgaaattgtcttattgctccgattgcttggtcatgtttatttgattattactttctcaggtttggaccgagagaaagcaagaaagcaatgttgtacagtgatactggtagactcaattgcaatgtgagctacacaacatttgccactcctatacgtgggcaggtctgctgctttattagctctccattgtctctttggagaaatttgttactggaccatttatgcttgaaaataagtgttgaaagtttgcatctttgttccagg

SEQ ID NO: 38010 - DNA, 1501 bp, Oryza sativa
tttgaagaagtgcgctaaatatttaggatgcatgggtcgaatcggaccgcaggatcggatatgaactattaacctcgcggctagggcgctgatgctgaccgagcgagacgcagcggaggccttccttgccgagcagcgttgaggacaacgacccgaccaagaaccgggaaacgttttatatcgcgcgtccgagcgaatcggaaatatcggatgcctgggcagatggattagacgaaacctattactgtaacatgtatgtccagttttttctttttttctttccttttccctttaaatattttttcttctaaactacttatccgacctatgaaccgatcacaccgttgtatttgttgcaattaaatctttacgacaagatatcatatgattatattatatcaaaataaaaacatgtgtttcaaaccgttaaaactaaatgttttatacatgatagtgatatgtttcaatgtgcgtctttattgtgtttcacaaaattcctaatactacctgctactactctcactcctctctctctctctacctcatccatgtacatgtgcatttattttagcaagtttcaaaatgatttttctcttaaattacttatccaatatatgatccgatcacaccattgtattcgttttaattaaatctttacaacaagatatcgcatgactatattttgataaaggaaaaatatatgtttcaatccgttaatacttgttgtttcatatgtgacagcgacatgtttcaacgtgtatcttcaccatgtttcataaaatatttaattgtttcagttgctgattttttttcaccatatataacttaatattttacttgttggtcaactgcaacatttgaccatccgattttctgaggagcatcgggcgtccgatagttagctttctccccaagaaccagccagatgcgagtggaggcttccctaccataggttgggttcggctccaacgggatggaagctgttacaaacagtgtcctgatctggacgttccggggaacaacgtccatatctggatgctgttgtacatttacatagcatccttcttatttttataaattaaatctttgatttactatttatttaatttttgggttattaattactatgtaaagaaattcggcatggattctcatgttgtatatccaaaatcactaaaaaaaattaattaattaattcagacatcacaataatgcgcagtagctgaaatttaagcggacgtcataggtcgcctgtgatacagcctgtgtatccttcagaccgaacttatcccatagagatttgcttcggtccgatgaaaagtacctcgaggtaccggtacttcatggtaccaaatcatttccgatcgttggatctaacaatatccatcctacttagctagatcgaacgataggaaacgatttgataccatgaggtactggtactttgagatacttttaatttgttagaacagagcaaatctatatcacacatatgggcgtt

SEQ ID NO: 38011 - DNA, 288 bp, Oryza sativa
aaaggtcttcctcaataccctgctcaaatagagagcgcaatgtcgttctattttccttcgattacgtcagtgcctaagagtctaaggcgtggtatattcacagtaggacgatgacttgaacagtaaaagaaaacatttgacagtgggaatgtttcgccccacaacaccatcatcagcatccttgctctgccactgaggacatggaactaccgttgtatgtaagacatgtgtgtactactcaggcataacgtcgagcacctaaagcgcagaccaggcgatggcagaaaa

SEQ ID NO: 38012 - DNA, 1501 bp, Oryza sativa
gcaataccatatagaatagcttatatatgcctaaattgattaccacttattagtaacccaatagaaccagtgcttaaacttgtcgcatcacatatacaatatcactcatagaaactagctaatgtataattaaactacaatatatttaggaatcacttggagcattgggtagtacactttctaaataagctcatgtacagtaggtgaccagaaccttatacgttgttgcacacatatattgtacatcccattatagttacacaattaatttatctttttcatatattaaaccggggagaatataacaaagatgaatagcagataagtactaattataaatcttgacctcatatgttcatagttcaattgtaactccggattgttcattaagagataatctgtaactataatattataaacttcccgaatttaacatatagagcatggataattattagcccttttataatttataatggcaagtaaaatatgttcataattaaagtaaagcttccatcaatagaataaataatacaaatgattcactgtaattatttgattgatcctaaatccatctaacaacagaacctctagtatataaccgtcctatttagatagatgcatgcttagccataatccttccataagccatttgatagactaaaccaccgattagccaaatatatatgtatcccataaatgctatgttggttaactcctaaataggccacgttgacaatagaaagattaagaaaccttagcccctagcgtgattggaatctattagcagacgcgaatagtacattttgttgcgcatatttgattgttgtttgaatattggtttttctcgcgtattatagaccttgtgtatcggttagtcgtgaggcaacgtctgcaacttccaggaggtgaaggttgatcaagattatatcaatactaaggattatcctgagcaaggcaagtcatcactattccttgaacatgttgatcccaattgcgaaattattttgtttataaataaaattgcatgcaatgatgaacatcctacttgggattatgccatgccttgattattgtctacccttaaatctttgtaaccatgtctacgtatgagtccctagtcaattatgacaattgcttagaaatgctattctagaatcatgcatactcatatttatcaaacgctatatgcttgggcaattacctttgggaaggtaattgaaatgcggcatgtggagacatgagcgccacattgccatgatgttgatgacatgatttgtgaaaggagaaataaaattaaacaactgttttcgacaggggcggacggaggatttgggtggtatctggaaaaggctagtaccgtccccggtcaattaaggaccgagccatgaagttaagcatgaaacaacctcagtacagccgtacttctcgaatgggtatagacctagcggagtagatagccgagcggaggcagtatccctgcatagtggtttcacttagg

SEQ ID NO: 38013 - DNA, 491 bp, Oryza sativa
ttttaacccaaaacaaatatattatcaaaatatattttatgttaattttaatgaaattaatttcgtattgtagatgttaataatttttcggaattgctagaaaacttccgcaagtttttttttgcccccaaaaaactttcagatttgtggccatcagatcgcattgagatttgtgcatgaaggaaaataattggtagaaagaaattttcacccatctcacgcgtaagaacttgatgctaaccaaaacatagtagaatataagttttatataagttatattacagttacagcgcagttgcagtgtggttacgatgtaatttcacttcaattatattatagttatatctgaaaatttttcactcaaaaaacttactgcggttttcttaatactccttaatctttctataaatttaggtaaacttaaataagtttgattaagaaaaaagttaaaataacttataatataacctgttctttcttgtttctgcagg

SEQ ID NO: 38014 - DNA, 1501 bp, Oryza sativa
ataagtatctccagtaagcataccatgaaattagagcccctttcaatcaaacaatttatttagaaatttcataagattgaaatcccataatatcttttttctatttggtctttttaacaaagtattggagcttttaaatcatatgaattattttaatggctcattgcatatagtttttgaaggaaatttagtaagagctctaactggccttaggagaattttatttgtcaatctctcatccgatatctatgtttctcttgcagtacaactaaaaggttacgggtatttagattcagtggtgtaaagttttggcgtgtcacatcgggtattatataggatgttgcatggggtgttcggacactaataaaaaactaattataatatccatcattaaatcgcgagacgaatttattaagcctatttaatccgtcattagcacatgtttactatagcaccatattaacaaatcatggagcaattaggcttaaaagattcgtctcgcaaagtagttgtaatatgtgcaattagttatgtttttagcctatatttaatgcttcatgcatgtgttcaaacgttcgatatgacagggcagtgtaaaattttggggtgggatctaaacatgcctttattcatatgttttttcttttcccttatttcataatctaccgttttgcacttactttcctatcaaaatcctatgtttttctaactctttctgtttttccatccctatcattctaagggctgaaattaattgtcggcaatccataggatgagattcctcgaagctgatcatgctgagcccatgttgtcccacaacgaacagagggaggaaagagaaacgatagactatatgattcatttgttcaaaaattcgttccaatcacatcttctcgttatagcaccatgtaaggttgcgttcgctggttctggttatagcaccatgtaaaatttttttttaataagatgagtggtcaaacagtacaaatagaaactcaaaatcccttatattatgggacgagggagtacaaaatagttttcgcagacgaccctcatacaggattgcacggaacacgagaacgcccatatgtgtgatatagatttgctctgttctaacaaattaaaagtatctcaaagtaccagtacctcatggtatcaaatcgtttcctatcgttcgatctagctaagtaggatggatattgttagatccaacgatcggaaatgatttggtaccatgaagtaccggtacctcgaggtacttttcatcggaccgaagcaaatctctatgggataagttcggtctgaaggatacacaggctgtatcacaggcgacctatgacgtccgcttaaatttcagctactgcgcattattgtgatgtctgaattaattaattaattttttttagtgattttggatatacaacatgagaatccatgccgaatttctttacatagtaattaataacccaaaaattaaataaatagtaaatcaaagatttaa

SEQ ID NO: 38015 - DNA, 810 bp, Oryza sativa
cccccccccccccgccgctttcacgactcgcgtgacgcgcgagtggggccaacctgcagagtcatgtggccggagggaaagtaattcccctctacttcacgtacccctgggcccatatctctgacagtagcccctgacgctatatcagatatcgatttcctgggatcgttctaacatggcgcctcacgactcctcgagctggggttgtgggcccggcagggaatccaaaaggatatcaccgcgtggcctggttggcgtactaaccacaacagcggtttgaccgcctctgactacgctcatgataaagacgcttgaggcacgataaccagggggtcagttagaccacgcctagattctctcgcccgctactcctgcggcggtagcggtgacggtttgcccaacttgtgctcatggccgttgcaccctccacctcgagtgtgccactaacgggcgcactaaaggcggaagcggatacaatgggcgacgtgatgattgggcgcgggatgcgaagagacaaatgcgggcgtgaggatcgtgagggcagttattggctcgcgaaatgaggaggtgagcgcggatgaggcgaggataaaagggggcagagaaggagactctgtcttcttcctttcgccaaccgcccactcgtcctttcgcttctcgaaccctaatattctcgccacctcacactgtctcgtgctccacgctctccatcacctcttcgccggttgccatggcccaagacaccggcgacgcagtgctcccttcctcttgcatcacggcagacaggcaccttagccttccttgcaagat

SEQ ID NO: 38016 - DNA, 389 bp, Oryza sativa
atttcccccagggggggtcggttgcgcttgccccggccccgagggccggggcaccccgaccccttaaagaagtctgcgccacatatatgggataagtgagcacagctgtgctcacctaacagcatttattgcagtctggtcaagcgtgtcacgctgcgtgcaacgcagtacagcacgctcttttatccggtctgtgaccagtcacagaccggtcagatcaagggttaggtggcgactggcggtctgacgcacgcctcgccccatcccgtcaagacgaaagcctcaaggcaactcgtctcaagccggagctagcgtgttatctcttagagatggcacgttagccctggtcagatttataccaggcttcatcctaaccattacaggcaagg

SEQ ID NO: 38017 - DNA, 283 bp, Oryza sativa
gtctggggagccttcatgtttaactacccggtgatctcctacaccatcggcctgatgcagtagtcgtccatccagaacgagctgttcgtcgtctgggcctgcttcctcctcctcctcggcagcgccgacaccatgacggcgttcagcttcaacgacagcagccagcagacgaggtccatgatgaaccaggccctctatgtcgtctacctcctcttcctcatcctctactacaaaggccagctccgtggcaccttcctcgtcagcctcttcctcctctggagct

SEQ ID NO: 38018 - DNA, 306 bp, Oryza sativa
tcatgtctgtttgctctgggacttactctaactaaccctggtggatcaccaatcgtccgtcagcaagcacacaccccgactgtgtcgatcaccaaatcccaaaaatccacgcattcgctcgccacgcacgacgtcacgcgcgcggccggttggtggccagccagactgctgaacacacatatataaatgcaacttgctcactgaccagctagtgtgaccagaccagcccagcatatctcgttcgaccggcggcagtgttcgccgacatgggcgacgtactgccgaggtcttatgcccgccccgccg

SEQ ID NO: 38019 - DNA, 248 bp, Oryza sativa
ggggaaatcacgaggagggcggacacctcaccctcgggcccgacgtccccgaaggtgccaggccacgtgggcgattgcgtctgcctcaagcctctggtcatgatactcccggtcccatatcaccgacaatgatgaatgcatatacttagataatgaggaggctgttgctggtcaagctgatgaaactagaggtgaaggggctgccaatgaagaatccgaggatgaatcttgggctacatctgaggata

SEQ ID NO: 38020 - DNA, 158 bp, Oryza sativa
taattaatatagtaccacataagctaaaagtattacatggtaatgaagttaatgccatagacaccattctagatggagggttgagactgcccttatatccatataactgtacggatactatctccacattggttgttcgatcatcaccaatctttggc

SEQ ID NO: 38021 - DNA, 1501 bp, Oryza sativa
ccagcgccagcgccgcctccgcggccgacatcccaagcccaccgcctcctatccctagcccagcaccgaaccccgaggacgaaccctcctcatcccccacctcgtcgttctcgccaccggccgcagccgccgccccgccgtagaaccccgcggcgtatccggccgacaccacgcgcgccacccgagccgccgccctgcgcggcgcgacgcgcaggcgcgagcgcgagggcgggagagtcgggaggagagcggtcgccgcggcggtggaggagatggagagcgccattggtggcggcattggagagcgagcgcgagagagtggaggtaggcgaggtgtgttgccttcgtgtccagtggatagataaggataggatttttagatggaggcccattaaaccggtttttgttgggccggggttagtgggccaaatggaccggcttttgattggcccaggtaaaggttccagccacttcgctttgcctaagttttttcatttttaaatttttattttttaatatttacagaaatattgtacggcgaaaacatttacagaagtagatcccgagggcggcaaggtgatgtgaggacggacaagataaaaaaaactagaaaactgtattttttacaaggtgaaaattgcattatatctcggtgcaaaatacgcacaccttgccaccctccacttagggagcgttcggcaggaggagtttgtgagttagtttgtttcatttttcgcacgcacgcttctcgaactactaacggtgtgttttttgcaaaaattttctatatgaaagttgctttaaaaaatcatattaatctatttttaaagtttaaaatagtttatactcaattaatcatgtactaatagctcacctcgttttacgtatcttcccaatcttctcttttcccctcctctcaaactcacccttaggtgtcaggggtaatttatgtaaatattttggatggtataatattttttaaatattaaaaaataaaaatttaaaaatgaaaaaaattctcgctttgcctctgacttcgtgtccagccgacagtatagctgagctggcagtccgttcgtgtcactgcaagtgggccccacgccgtacttgctccacgataagctcgtgctctgctctgctcatctctccgcgtgcttcttcttcttctctctctaaatttctccattccgctcgcgatctccactcgcttcgtccagatctccgcatcaacccacaggtaaagtaagaaaaaatcaatctatgtttctttctacttgctctcgcttcgttttggaggatatttgtgcctcagatcttgttgccgtgtgtagcctagccgtgtagaataggaaagagaaaagaaagcaatctttcttgtgatcaagtctttggtgattcttgtggagttagcaatggcgtgcgatctgtttgcttgatttgatcttgctgtgagatcttgattcgatcgcttgttgttgttgctacctgaagttagcgagca

SEQ ID NO: 38022 - DNA, 173 bp, Oryza sativa
taattgagatgcggcatgtagagacatgagcgccacattgccatgatgttgatgacatgatttgtgaaaggagaaataaaattaaacaaccgttttcgactggggcggacggaggatttgggtggtatctggaaaaggttagtaccgtccccggtcaattaaggaccgagcca

SEQ ID NO: 38023 - DNA, 1501 bp, Oryza sativa
aattggtaacatgataaattggaaattgctaggtagtgaactatgaaagaaatggtttaagttgaagtatacagcagagaaggatagctgtagagctgctccttgtgatttggtttcagctggactgttgatagatgggagcagctttatatattaatatttttaaccagttggatcaacttggtcgagagcagcttcaatattttgacatcaaaatgttctctgttttcatggcatttgtagagaagagggtgtgtactgctaagcaagaaatgttgtgcttttgagcactcttaggaatatttgctcagctatacatgaagttttgagttgcattgaacttattgacattcttctcaactttagattcagaaatgcaatatggaccgaacttcactgcctatcagtgcagtattttatttattgaaatttaactcttttatatttggctaaaacaacattaatgggaggagggatgtgcaatattttgttatctgaccgtagagccacaatttcatgtttatgccaacatatctgtaaataatgaagcctttgtgttaatgctgatgttgaagttacctattaggtgaatacacaagctgctgcagatgttgttgactgcagcaatccaaagaattcaaaatattatgtcgttgttgttcaggtaaactgtaagtttgatctcaacacactatcttcaaatttaattagtacattttatcttcacacggatatatttgcagtatatggcacggcttaatgcagacagcatcaagaacttcatctattccctaaacgagaagcagatacccaagaagagatttaacagtaagatttataataatatattgaaacaaatctaatctctacaaatgccaccgataaccttttattggtcatcagcattcaaagcttccatgaaatccctcgaaggttttctcccatccttagtgaggtatatacctccctactatttatgaggtaaaaaaataaacctgttgaactgatcagaagacaagttcataattggcagtggcaagacttttagtgttagtagagaggaataggtatgtatctcttgactagcacaaatacctacacctctaaaaaaacgtaagagaaggtcaagaacatatataaagatgagttcacaatcctattctaacctataagattagttctggtacctctccatggaatgctatatctgaagtatgaggaggaatatacctctcacaggatgggagaaaaccttaattcctgaacaacatggtatgctgtgaattggttttaatatcaacaactaaggcaagcatcttgtctgatggtttttacatacaacaatatttttcatacggtggtatttttttcactttaaggaaaaatgtgtgaccatgatcaaagataaaggaatgcagtatatcgtgtgtagatttcagcatcctgcagtaatgttgcctctattatattttaggcatttcaagatttgtaggtgtgtctg

SEQ ID NO: 38024 - DNA, 1501 bp, Oryza sativa
gagaagtaaaacagtggagtaattaatcagaaattttaatcaacactgaacaacacacccatgctgcacaggcccaaccatcctgaacaaccatacccggctgtacagatctaactccaaaccaggagctaagcaaattattactaggtataacatccataattattgtgagaggtgtgagactaatcacgaaaaacattgctcaacccgcccataaccgcgggcatggttattcgaatagttttactctggccagaggtgtaccactgtacccacaagacacagcctcaacatcatgtctaccatgcgtcgcgatactggaaagtacccgaatagaggctgtgacaataccctctgcacaacacaactcaccacagtgcaccattcctggatcataatcacccctttataaaacaaggcatggactccccagtgacccccgtgggcttatctccgccacttctcagtctggtgctccgcaatgaaccatgctatacaaaaggtaaagccgttgcccacgctggcttgtggttggcacggttaatgtttcacaacagtagttcacgaaccggtccttaattgccatgagcacgaccttcaaaaccatgtgctcacaacccaccattaatcatattttaattaccaattaattatcataacacgattaaccatcgtgagctaccattaaatataaccataaataataatgtagtatatatgattcatcccattagtgagctaatgtttctaagcatggctaagcaattatatctaacatctagttgaaccaatatatataaagctcaactagtcaaattataatatcccaaggtatcaaggaatagaatccaaacaggccataacaaaggaatagattcacaccacccagtgacattcgaaaataaatgcacagttgaaataaatagagaatttaaatataggatcaacatgctcaaaggattgtgtttaggatctgtgtgacttgccttgcaataatcggtcttcaattaatcttctgaacactcccgacgcactcacgaaccttcgcaacgacggaaacgacaagctaacacgcaaaacgaagaaaaagactaataaaaaccaaataaacagtacaaaaacaagcataaacagtacatataaagtaaacaaacatgtagatcatgattttagatgaatttagcaacttgaaccactcaaaaccgagttacgatgttttagttatgaatttccgaagatttaatctattagaaaaacaggtgtggagattatgggtaccccatacccacacggcatggttatccgactagttataggggataacttatatctatgtaatatgtaacagatcatgacttgggtgttacgtttccttgtatattacggaacggcctaaagtcctgatttaggaaacagataccgtattggttaaggtttctatcttgtaatcctgccccccatcctatataaggtgggcaggaggccctctagggggcatata

SEQ ID NO: 38025 - DNA, 1501 bp, Oryza sativa
tccttacaatactttagcggtgatcaaatatactaatcttataaaaatcatgggctatgaagactatgggtcgctaagagggacaaagagtgtgtatcaacaacaaggatagggtgcgctctttttccgtaaaggaattgaacataaatatgcatgctcttcgaacttataaatggtgtgtgtgtgttttttaaatgctacatccgagtttcttttcattaaataccatttttaaatgctacatccaagtttcttttcattaaataccattgtgtatttttcattcatgtgttcctcgaatcattaagctattcaacattccattccatttcgttcagcctaaaaggacacgtctaaacctaaacaaaacatgtttacttttgaacttccctattatgagaaaatttgaccaaggatggctactcatggccgtgtaaatcacttagcataattatcagaaactttatattatcatgttagtctattatcgaattgttataaatttaagagtaaatttcataaaactacagatattttgaccaaattatcacaaaactacagatttaaggagttgtatcacaaaactacacatttagcaccaaaattatcataaaactgcagattttaggttaagtatcacaaaaatgcatatttaatattgaacttatcacaaaactacaacttttgaagtttaaatccctagcaccattgttatggtggagctataaacattattactttgtgattaaattggttctaaacctatagttttataataatttagttactaaacatgtagttttgtgacacttcatcttaaatgtatagttttgagatatatttggtgttaaatgtgtagttttatgataatttggtcatagtatctgtagttttgtgaaatttactctaaatttaaactaattagcacaactcaacatgtaaatatatttaataaagagggtggttatagttacgtgaaaaatacgatttaataggctatatatgaatatgagctttgtgagtgtccaatagcgacctttaaattacaaatccatgtgatatgtcatgagtgtcaaaaatacgattaaccttgattgaccataacttatctttagcaaaattggcaatcatctgctactcgttcaaagaaaagttcagattgacctcaatatctcattagtcacaacattacgtgcattaactagattgccaacaacatttgttgttcgatgactgtatcattagaaagatttattatcttattgcctatatcttgttcaccgtcactctcgaaggttaaactgaaagtgctccctttccttaaaaaagtacactttgttttttttaaaaaaattaaaagatgcaaatggttgattaagcttagtcctacaatttgactttttaattttgcaagtgagttgatttggcatcaaacaggggattagctgagcctttggacctcgaagtccccaaaaccatcaaattagtcccctaggaagga

SEQ ID NO: 38026 - DNA, 1501 bp, Oryza sativa
ccaagtcatgatctgttacatattacatagatataagttatcccctataactagtcggataaccatgccgtgtgggtatggggtacccataatctccacacctgtttttctaatagattaaatcttcggaaattcataactaaaacatcgtaactcggttttgagtggttcaagttgctaaattcatctaaaatcatgatctacatgtttgtttactttatatgtactgtttatgcttgtttttgtactgtttatttggtttttattagtctttttcttcgttttgcgtgttagcttgtcgtttccgtcgttgcgaaggttcgtgagtgcgtcgggagtgttcagaagattaattgaagaccgattattgcaaggcaagtcacacagatcctaaacacaatcctttgagcatgttgatcctatatttaaattctctatttatttcaactgtgcatttattttcgaatgtcactgggtggtgtgaatctattcctttgttatggcctgtttggattctattccttgataccttgggatattataatttgactagttgagctttatatatattggttcaactagatgttagatataattgcttagccatgcttagaaacattagctcactaatgggatgaatcatatatactacattattatttatggttatatttaatggtagctcacgatggttaatcgtgttatgataattaattggtaattaaaatatgattaatggtgggttgtgagcacatggttttgaaggtcgtgctcatggcaattaaggaccggttcgtgaactactgttgtgaaacattaaccgtgccaaccacaagccagcgtgggcaacggctttaccttttgtatagcatggttcattgcggagcaccagactgagaagtggcggagataagcccacgggggtcactggggagtccatgccttgttttataaaggggtgattatgatccaggaatggtgcactgtggtgagttgtgttgtgcagagggtattgtcacagcctctattcgggtactttccagtatcgcgacgcatggtagacatgatgttgaggctgtgtcttgtgggtacagtggtacacctctggccagagtaaaactattcgaataaccatgcccgcggttatgggcgggttgagcaatgtttttcgtgattagtctcacacctctcacaataattatggatgttatacctagtaataatttgcttagctcctggtttggagttagatctgtacagccgggtatggttgttcaggatggttgggcctgtgcagcatgggtgtgttgttcagtgttgattaaaatttctgattaattactccactgttttacttctcttaaatgttttgctaaatgctgcttttgcaaatgagcctatattatgccatcctttggtatccttgtgcacttgcatatttgctgtgtggcttgttgagtatgtcatatgctcattcttgcaataatcaatcaacctcagt

SEQ ID NO: 38027 - DNA, 1501 bp, Oryza sativa
tggcttgttgagtatgtcatatgctcattcttgcaataatcaatcaacctcagttgaagaaaaaggatccagaaggagaagacgtttggcttataccccagttgagctgcctgtgggagtggagctgaagccatcgctagaccgttatttcgctgctgttttcttttcttttgtaagtgtgtaacgttattattatgatggatttgtatattaaattgtcagtttgtgtacctcggctgattcctggacgaggattttatgcacaaataagttcggaaattactagtgaatttccgggcgtgacagtacgcttgatgctgttcttgcatttggcaaagcatgtcttggagtcgtgtcatgttctgtcgcatggcttccatgtcggctttggtttgtgtctgggggtcagagttgacttgggcttgcacagcggcgagcgcagttggggccgctgccagctgtgacggagcggcttggggcaccagcagttggcttgtcggaaggatctccgccctggtctggagtgccctcgccgccgcagccgccttcgccatgtcaaccgtgttcggcacctgcacagaggtagcaggggccgaaggcggtagtgatggcgcaggtgcggaagcagatgtgtcacaccctgaaaatcctaaatttataaattgttgtttaaatggaattattagaaatgattttaaaagcctagaagaaaagatctaattttaaataataaattccaatataaaagtgggccagataaaattttattaaatacttcactttctttgaattgtgttatgcgaagggtattgtcacaatctcttttcgggtacttgttaagtatcgcgacgcatggttgacttgatgctgaggttgtgtcttgtgggtacagtggtacacctctttcacttgtctttcgtgattagtctcatatttcacaccataataaatgatgatgaaaataatttgtttagctcctggtttggaatggtatattcctagtttggagatagaactgtgcagccgggattggttgttcagaatggttgggcctatgcaatgggtgtgttgtatagcgttggattaatattgtttaattaaatactttactgttttattaaattctgaagtatttattaaatgccatttatgcaaatgagactatattatgccatcctttgttatcccttgcatttgcatatttgctgcgtggcttgttgagtatgtcatatactcaccttgcaatcattcatcagaggaggagttctacagtcatgccgaaggtgtggaggattaggcgtagccctggtcaaactgcttgtgggatggagtcgcctgcgctgtttattttatattccgctacttagaactttattgtttgagaggaactatctacctctgtaatgactttatattcgcttattaattagaatattaattgcactctattatcgatttgttggataaatgtcttaactccctcctttcacttgtctttaga

SEQ ID NO: 38028 - DNA, 1501 bp, Oryza sativa
catatattcaagcctagctttcattaaaatacaaaagtactttcctctagaaaaacacgaaagtccttggatataacaatacacgtgcggtgtgtgtgaattaacatggtagatgtcatatcaattaactcatgtgtaatgttttgcgatttaaaaaagccacttctgcatggttgaagcttttgtgatcttatatgcaaagagaaaggtaaaatgaaaatatcaaccttgctcacattattcatgtttgtgttgatcctttttctaagtgtattttaatttgatctttgtgtcaggttataggaaacaccgtacctcttatgaacagttatgctacagaagtcctttttgggaatttgggttcaatcacacttggaattaatatgaaaatttattttgctataaaatatgaacattgcggccacaaagagtgttaattttcttccaattgattaaaggaaattctccatgaacccaagtttaaccactttgttcctttgctatagggtacagttatttaatttactaggtgaaaccccacgcattgttgcgagaatttagtatgataacaataaaaaaataacgtgtaagatagctaaataacatcagattaagtaaattaatgtgctttatgataatttaaatttaaatagtatgcagaatggtgattcaaacgtaaaaagtaaggtggtatgactttatggaagaagaaaagtagggagatagtttggaccgtagattaatcatctaaattctaaaaacaattgatatgatatgacttaattagaggaaaaactgaaaaatataattcgaaccatagattaatcatttaagcactaactaagtgaggatgagctatataagtttataggatatcataaaacataataaagatatacattggaacattatgtgaattatgttggataataatttaacatgtttgtatttgaaaagctcttaaattataaaaactataaagatatagcatgtttgcttgatgtttaaatgtgatgattgttagtggatgatgatgtaccatcttgttagtggatgataatgtggcatctttgcatgttaagcttaaggagttagtgggggataactttatagtaagatagaattagtgtacagtgaatgatactgtgtaaatgtttcatctttacatgagctaatttgtgtgtgtttttaaatgcatgcagtgtcttgtctcttcttgtacaatggtgaccacaaggttatatgttagtataggtccccacatgttcaatgtgaaaactcagcgaaattttatagacccaactgcaattaatcaatgaaccgaggtcaatacgagtcatatcatgctgatattagcggtgttaacgggacggaaaatacgatcgaagatgattatgtccgtcagcctgatgaaattgtcattggttatgcagacattgaagattcagtgaacgcactgattgaatatgtgaatatgtgttcccctcactcaatgatgaga

SEQ ID NO: 38029 - DNA, 275 bp, Oryza sativa
attatctcgaatacgaataagaatcgaatatgatcggacacaaatacggaaacaaatttttctcggaacacgaaaaccaactcaacttctaatggaaacaaatatcaacatatataattagctcattttatataaaatgaggtataatttataaatattttttaaaatttaaataatattaatagtatggactagtgttaagagataaactactattaaaatctataaaggtatattgaaggttatagaattagaaagaaatggggtatgtctca

SEQ ID NO: 38030 - DNA, 166 bp, Oryza sativa
ttttgacaacttgccaaaattttggtaggatttcttatatagttacaaaaatttggcagcaaactaaatgtagccactttttgacaactttaccaaaatttggtaaggttgaaaatgacatcaaagtgaacaggccaaagaaatcctgccaaaattttggcaacta

SEQ ID NO: 38031 - DNA, 1237 bp, Oryza sativa
gcccccgcaaatctgcgccggcgccattgatggcgaccagacctcccgcgcccgtttccttcctccccggccactctctcccccttccaaccctatttaaaccctccccgcacctcctccgttcgtttccgcctctcgccgcccttcctcctcgccggattcgagctcgcgacgtcgctctctctctccgtcatcgccgccgagctccggtccgccgccgtcgtcgccccggaccgcctcccacctcggcgccgcctccttcggcttcgccgcatcctcgccgacctcgtccacctctccgtttcggtcaccgaccgccggagcaccgccgtccccgtcgacccgagctgcgccaccgcctccctccgctccggccacctcctccgtcgccgccgtcgccccggggtgagccgtggaccgtcgcatcctttcccccttccctcccctctctcagccgccgctccgccacgccgatggtcgctggcagcgaccatcggggcgtgggcgcgccgcctcccgccgaccgcgtgtcacgtcctgataaattcatcccgaaataaaaatcattttctaaaaggaataatagaattaattaaaattcgaaaagaaattgacaaacactaaaatacgtgccagaaaaattcgaatgtggtccgaagaattttttgttaaattctacttggtctaaaaggagccctcaaattttacttgaattttcagagcaccgaaaatatttattaaacaacaacaacaattatcagagtttactcaaaagaaaaactaaaaataaatcctccttcctcctttgggctaagcccagcccaaagtctccctctcctcccctctctttccctcctctcccgggccttctcctcctcctcctggcccacctcttccctccccctccggcccaactccctcccctcccctctctctcccgggccttccctccctccactcctcctgggccggccgccggcccaagccgcgcccaagccaggccgagccgagccagccgtgcacatgcgcgccgcgcgtgcgctgaccgcgcgcccgacctcgtggggcccacgcgccgatcgtctccttcctcccgcctggctcctctctctcccgtgaaaccctagctcgctccctcctccaaatccgcctcattcaaaccggggattccaaaattaagtggggggttttaatccccattgattcctcttcaattccccccaatttcccccttgaa

SEQ ID NO: 38032 - DNA, 1501 bp, Oryza sativa
gttctatgttaagtaccaggactactatgcaagaatggaatgatgtattaactaaaagcaacatttgcaatgaaggggaggataaaatttttcctatacttcggctgagctatgatgatctgccatcacacatgaagcagtgctttgctttcgtgtgctatattccccaaagagatctatgagcattgaatgtgggagaacattggatgccaatgtatggtatggacacatgagcttcagtaccactggcaggcaggcaagagccatcgtggcaagacaggtaggcccgaggaatcatttgtcacaggacacatagtttgagaaggtacattcttttacacagatagtgcaatacaaagtttcgtgcagcggggaaggaggagatggtgtataggagagtcgagcgtccggtgagcagaagcaagcgtgcagagagtacaatgatgcttatagcatgcacatgttcgtcaattctagttatggggtaaagacatagtctcagtataattggttcgtctaatttgaaaaatctgatgcgagaacatcctttatatcacgttctcataccatacaccagcattgctcttccagatgactttatgggaaatgaagctccagctctccgaactttattgtttcgagggtattatggtaatgtctcaacatcacatttatttaagtacaattctctacagctaagagcattagagctcccaagaagggaagaattaccaatcaggccaagacacctacaacatctaagatatctaaatctctcagacaacagtaatatccatgaacttcctgcagacataagcacaatgtacaatctacagacatcaaaccttcctgattgctataatcttgttagactcccaaaggatatgaagtatatgacaagtctacgtcacctctatacaaatggatgcttaagattgaagtgcatgcctccagagcttgggcaattaacttccatccggacactaacatattttgtggttggtgctagctctggttgcagcacccttagagaactgcacagcttaaacctctgtggtgaactagagttacgtggcttagaaaatgtatctcaagaagatgcaaaagcagccaatcttagaaacaaagagaaacttgcacgcctatctcttgtgtggaatagtgaatgctgtgttgaagaaccaaattgcaatgggaaggttcttgatgctcttaaaccacatcatgggctgctgatgctcaacgtaatttcctataaaagcactcatttttccagcatggatgacagatctaagtatactgcaaaacttggtggagctcaaattagagggttgtacaatgtgcgaagaatttcctcaattcattcaatttaagtctcttcaagttctctgtttgatcagacttgataaattgcaaaccctatgttgcaaggaagttagacaaggaaaagaacaaacatttcatcttcttcagaacgttgttatcaagagctgtccaaagt

SEQ ID NO: 38033 - DNA, 1501 bp, Oryza sativa
cgagttggtgaattataggatagcagcaacaataagaacaacatcaataacaacagcaagaatttgtacacactccgagacggttacatgggtgggggtacaaagaatgcaataacttggctaaaccgagcggactcctaagggaagggtgaaagaaactaagcaaagctatgtgtcgtgtaaatgttgaatatttgtttgcaaatagttggattagttcttttgccagttcacgcagatatcatcagcttataagagcagatgcgtaagaaactgctgcggaacaagtcatcacagattatcacagtacaacaagagtgtgtccaccaacgcagagcggaaattggagaacctctggatttctcaacccactcccagcatgctttggtaccaatattgtttactactcctgcatatgttctagctgttgacatggtaaaaagacagctacatggtgtgacagagtttggaaccgtcagggaactggccccaaatatcatttgtctccctggtaatgtctctccccaagcataatcaaggtaagcctggaaataatctcagggtaatttacattgtatcatcacttctccagtcagctgcactactgctgctgataagatattagatttaaattttagtcatggctaaccagctgcagataacaattaatagagccgaatatccttaatgaaatcggcagagctcctacctttaccccttggaaaaaaaaataaacagggcctggagaatcagagaaacaatggccttggtgtcttttgctatgagaaagtgagagattagaaggtgcggatgccatcctttttgacttggtcggctgcaaatgcaaactgccagcgttacagtgtagtgcagtgtgcagcaccgatgaatttggcgcctttagccaccaactcaacacacattattttgcgtccatcggcatgtgatgcaaggggcccctggctggcacgtctatatcttctgaaattctgatcctttactgtgctatccatgtccacgacgatactcctactattgtttgtgtttatctgagcgagagcgaacatatgctactactaacaccatcttcatattttttttaagataatggaatgaaatatttcgaactttgctcatcataactacagtcaattattataaacgaagagtatagttcaaaataaaattaaacacacccaacaaaataaaagaccaaaccgagataagaagtacacatttattcaagtctatttgtgaatctccatccatagtttgtaaaaagttgcataactgttgtcacaccccaatctgataccgccgtacaacggcacctgataggagcgtgttgtagggaaaacggcgtgaaccgcttcctacgaaaccgcgatctcggtaccagtcccaggacatagtgctggtacccacggtgacaaatatgaatcatagcaatccttaaaataaatagaggacttatttaccttaacttaggttgcagctcaga

SEQ ID NO: 38034 - DNA, 819 bp, Oryza sativa
attatattatatggtctgtttggcacagctcagctctatccctggagcttagccaaacaattccagctccattaaaactgggagtggagatatgtgaagttttttcacataatgaactagtgttgtggagctagatttaggcagttccacgacttcactccagacccaactcctacagctaaatttaggagtcggagctgtaccaaacaggccctgtgaattgcaatactacttagaacttttgaattggattcagaatcgtgattgtgtgaagtactaagaatagatcggcagacggcatcaaaattcagttgttccatgctggcgtgcttcgagtagcagcagtacaatagctacgatgtcaaagatgaggaggggcctagagcaagataagatagatggaatctactcctaccaactaaaacgctggccccacctgtaagtgagcattggatagatagattatctgacagacttcctcaacgaacgtagcgatgaataccccaacagaatgttgcgcgggcgcttgctaaatgctaatccatcatcattttatgcgctaatccactccagatcacgccgctaatccttatccaaacgaattaacaacaaatcagtcgcgcgtttgaaacgagtccactccacctccatccagatcagtgtatataaaccgccgcgccgtttgttcgtgctgattctctctctctctctaatcagtagtaccccagatcagtttgttgctttgctgcttcttccggttccaatctgagaggggggattcgcgcgggaggcgaggcgaggcggcagccatggtggggc

SEQ ID NO: 38035 - DNA, 1501 bp, Oryza sativa
atatacaaattggtactacaaaatatgcaaatcatgtactgcatcatacaatagcaactccgacactccaagatgtcaatgtcagcattccatgccaaaaccaatgtatgtgacatatctataatactaatttttcttattaattaattcgtcttacatttctataaacaaatctaatatactcaaacaaactttcaggtacaaacttcctttaacaattaaagatgaattaggaactttggacgcagtagcattctacaatgtggctgaggatttggttgaggtaaatgctactcaagctacccagaacttgaaaattgatgcaaccgaacatgccatagctcttgatacagccattgggaaaacaagactgtttcacattgccatgaatacaaagtactcttcacacttcactatcaattatgtcctcaagaagagttatcccgttgaaaatgaaaatacaagtttgatgctacctactctggaaaatacaaaggtagcaaaggtatacaaatgtttgtccttaccatatcttctaccaaccatctataatctaaaaataacttttttcaggaatcagccaccaaacaacttgcaacagatgaagggctaaccaccatggaacattacaggttaaccaacatatgccttttttacttattatattctgcttaacatttctatatttatgactacaactaatagcagcaaagaagaccaacatcccactacgccaccgtccctacaacctccagaaacaactctagacaacaatacagtaaaccaaattataccttcagcaaagagagctcttcaatttgaaaaggagttacacattgatcaaccaaggtactgcactgatacaagttctttttgcagaatatacaaactattcttcaactaaattcctttcatatatgcatcagcccagcaattgcaaacactattcaggttgcaacaaatcaactttatcattcccaacaagtagatctcagcaaggaaaaacaaccgtcaacagaattttctccaggacaaaattctaagcgccataaaaaagtgtacgtgcacaccttaagtttcagcctataaacatatatatgtgtgtcacgcgcgcgcatatatatatgtatgtatgttttgctactaatttgactgctaaattcagaatggaagcctccaccaatggagaggaaaaccagctgcagcagccaaagatagctgatcaacagccatcgggtcacaaggaacaggtacaactcttcaaatccttcacaattctcctacaacatggccttttatcagcaacatatatagtttttcttaaaaaaattagacctgcaccaaatctgtcaccatcactgctaacaatttccttaagaaatttaaacctgcaccaaatctatcaccatcattgctaacttatctttgcaaccattacttgcaagtttactggcaaaaccaaccaaatctgaaatatggcatttatatctattccatattt

SEQ ID NO: 38036 - DNA, 1501 bp, Oryza sativa
atgagccacacgtacaattaaaatatctctccaacaagatcaaaaaaagaatatctctccaacagttagtcattcataaccctgtgtcgtatgccatgttgttttcttgtgttagacccgttctgcaataatgcaactgtcacgagcccttgtttgttcttggcaacttggaaaaaaggaaatgacgatgatgcatgctctgccgatctggagcgtcgttgcttactcctattcccgccgttggtttcaggtaaaaggaaactcatactgcatgtaccaaaaggcagaagaagagtcacatatgcaagcaccctcaaagcaacgcacgtacacaaaatctcatggatttgtgagtgccaaacacatctccccgtcgatcgctggtcgtgctcctcctctgggccactgagtttctgttgcgccacttcgttgttcaggctatccgggccatctgccggccggcaaatgtgacgttgatgagttgtgcttcggccagtgatcacagagcgcgcagaaaggcggccagggggtctagaaaaaagcagagagaacggatggtccagtccatgtactccatggggcaacacagcattgactgcgccctgtccacagccacgagctggacaagacccttgtcgctggctcactgccagttttatctttgccagctcaagatacacacacctttcgtatcactgtccacggtcatgcatctgatctggcctccatgcatgtgatttgggttcccttttatttccaaaaattcattcgtaatgacattttttttcttaatgtgaatcgaacatcatttttgataacaatccggctcaggtagggtcggccgagacccaataacttaagattgctcggaccccaacagttcttagtcacacccactcgggaaaatacccaatctcccaaaaagactagtccaatagggaaatggtggctctctcttttaaggtggctttctccttccaagctaagtaaggtgggattattcagaggctcacacggtcgccacccgacttttgcgtctttgccagcgggtaatagtggaggatgtcctcatcaatttttttgtgataatagaactctttttgccagtgtcactgacccatattttcttaccaaatgaggagtaatcaacactgataaaccgtaaagtgagcacaactcagcttattaggttcattgtgacgaaatcagtatacccgagctcaattactagattttacacgggtgcttgtatttatgattaattattcttttggtgatagacgacgtatatgtcaacaacaaggcgtccatggtgactcctcaaatattaagatatactgatctagacttttagagtgttgtgtgcgcacgtgtttcataggggtgaatgtagggatactgtgagcattatgtttgtacagtgtttcttacaaaatttaacacacgtagcctcggttgtctaggactatctccgttttaagttataagactttctagcatt

SEQ ID NO: 38037 - DNA, 494 bp, Oryza sativa
acaagttggtatcagagctccctgaccctaggttatgccaaatggttacccatagaagccctctaaaaatattggaaaagtagaactgttctcctccccttctcttttaattaaaccaaactaatggcacatgcatttcctaatattttttttagtggttctcgttcaaaatttattctagcgttattagtactgtacatctattactgtactaatggctcattttaccaacaaaagttttacaatattgtttagtttaatcttgctgcaatgaaataaatttagcatgttgattttataactttcttttatttcttttgaaaccggttgttcaaaagtacaaaatttgtgaccttgtttccaactgtttcaacttatcctgcaagtttggcttaccttttactttgattttctaactttattcaaattaatccaaaaacttgtgctattaattggataaatgtcttaactccctcctttcacttgtctttaga

SEQ ID NO: 38038 - DNA, 1501 bp, Oryza sativa
ttactaaaactagttttgtattgtagatgcttctatgttttctagacttagttaaacttaaaacaaaaataatataaaacaaacatcaatgtcttataatatgtaatagagagagcccatacattcgtccaggttatgaaataacacgttcaattgttaataatgactatcgaacaactttaaaattttctatatgctttgtagttggtttcaaaatgggatatatatatactcacatgcaaatttatttactatcacaaacaattccgaactctagaataaataaaatacaccatgataccacaattaatttgtgtggtgtgtgcaatttagttactcatctcgaaattaattacttaaatgagctactcatcttattttgaggatgtaaatctcattgacacatgttacatgggctgttcgatcgttgccaaaatgccaagttgaacgccatggcggtcactacaccatgtccaaattaacattcccatccgactttagatggaaaaaaatatctatactgacatccagtcggtcggtaaaaatttttcgacaaacatacagaccggtctcttttaacgtagaaacacataatgtaatacttctttttttctaaaaaaaagccctcataaagaacaaagcgcgcaaaacatatatataagggggataatttgctttttattccttttcttaagtgcctaccttgcccgtgttactttcgagcacatcgtattaggtaaatatgacatccaacttggcatcaaacaaccacacgtcttgtatttaatgatatatgcaccctagagacaagataactactaactcacaagataagtgaggtaagttataccacctcacaagttagggaactgtcggtgtatcttactattcatattaatatttcaaaaacccaaaataaacgtttactaatatgcacttgtcttgtattatatatagaccattcaaatatgtttattatttctttactttttttcttcatttaataactccaaaacaatgtcctcgcaaaaaaaaaacctccaaaacaatgaatttacatagacatagttggtgtaagatgctacatttattacttattacttgaaattttacttggtggagccttagtttttctttttcgtaatcaaataattttatgacttgaaattaataaatatatagctttacctagtttggagtcttaatttcaattactatgattattagggaattcggtaaaacatatcaagtaataatcattgagtcatatatttacatcctagtttaattattcttaaatttgcaattaaggattagttatagttgtatacccatgtccctaaaaccattatcgttatgtccggtctgaccttatcctcaaaccaaatacatcccataatggtagaatgtgatacaaataatagaggctagacacatcaaacatttctagtccggacgattgctcctattggctcaccaacaaggcatgcagttgttaaga

SEQ ID NO: 38039 - DNA, 256 bp, Oryza sativa
tgctcagtagccacgtgtagccagtggctactgtattggaagctcaggttatgacgcatttccatatcatagatggttctgcaggacagtgctgtcatacagggtgtcagggacgtccttgataatagcatgacatgtgagcagagacctcaagtaagcaaagaaggaagacaggcaagttccaggcagagggaacttcaagtgcaaatcccacggaagggagtgtgctctgtgtctttgaggggcttccaggcaa

SEQ ID NO: 38040 - DNA, 152 bp, Oryza sativa
tccatcttttgaacccatctcgtcgaaatcctggagcaccaaaacacccctacctggcgcgccactgtcgacgttagatgtcccccttctggtgtttgcatagtatggagatcgtcggtgctaggatatacgcgagactgaggtaaaacaga

SEQ ID NO: 38041 - DNA, 1501 bp, Oryza sativa
ggaagctaactagtcacggcgaatacatgacgacatcggcctacaacgcacaacttcttggcataaaagcttcaatttcaatgcccctatctggaagccctaggcgccgcgcaaatgtaaaacattcgcttcgcttggcttgttatccaaaatagagtatggacctccgacagattggcaacccgtgggtaatcgaaaatggctccatctgcccctttgtcgaaggaatcaggaaacggccctcacctcctggcggagtgtagatatgtgaaagaatctaggcgacacttgcagactggacaacatgtgaacaaataagaccaacgttatggcaacaagcctcgacgctactcaagtggtgggaggccaccgcatgttccaacgaagcgccaaagaaagccttgcagactctaatgctattagtcgcctaggatatttggaatgaaaggaaccgcagagtttttcagcaccaagagcttccggtggctagtctgatagcccaaattaaggaggatgcccaaacatgggtcttggcgggcgcgaaacaccttgataggtgggctacctttaacatgttcggcccaaggccttgagacggtaaagtttctaatttgcgcttgcgcatgtacaattttattcttctattcaatgaaattggtggctcactggttcattaaaaaaaattgaatctagcctgttcgggaagaagaggatgtttgttcgtgagagagagagagagagagagagagagagagagagagaaggaggaggaggattttcaggcttcgcattgcccaacctctgcttctgttggcccaagaagaatcccaggcgcccatgggctggcagtttaccacggacctacctagcctaccttagctatctaagcgggccgacctagtagccacgtgcctagtgtagattaaagttgccgggccagcaggaagccacgctgcaatggcatcttcccctgtccttcgcgtacgtgaaaacaaacccaggtaagcttagaatcttcttgcccgttggactgggacacccaccaatcccaccatgccccgatattcctccggtctcggttcatgtgatgtcctctcttgtgtgatcacggagcaagcattcttaaacggcaaaagaaaatcaccaacttgctcacgcagtcacgctgcaccgcgcgaagcgacgcccgataggccaagatcgcgagataaaataacaaccaatgatcataaggaaacaagcccgcgatgtgtcgtgtgcagcaatcttggtcatttgcgggatcgagtgcttcacagctaaccaaatattcggccgatgatttaacacattatcagcgtagatgtacgtacgatttgttaattaatctacgagccttgctagggcaggtgttctgccagccaatccagatcgccctcgtatgcacgctcacatgatggcagggcagggttcacatgagctctaacggtcgattaattaatcccggggctcgactataaat

SEQ ID NO: 38042 - DNA, 528 bp, Oryza sativa
aaagttgattttgacgttttcatcatagttcacaacatatgtatactaggggttgttcagaatgatgttatttttaaccataacttctttttaacaagattgccaaaaaaaagtgtctacatttagtttgttaccaaactttggtaaatatataagaaatcctatcaaaattttaataatattatcaacttgccaaaattgtaaggtttattttggctataatatgaacaacctctaattttatctatgtattacttttgtttgctagtaaatgttatggcttataactagttataggcgaaatgatggattaatagtttaagggagtttgagtatgaatagttttggatggttaactgagttttaggtccgcgtcacttatttgtataaacaaatttgttttcaagacaagggaaatataaaatattcttgttggaccgggtatatgttgcaaatcgactcaaatgattgatttccattgtttttttccccattcgatattaatgcatcggcacttgttgctttaga

SEQ ID NO: 38043 - DNA, 511 bp, Oryza sativa
agcgaatgttttacatttgcgcggcgcctagggcttccagataggggcattgaaattgaagcttttatgccaagaagttgtgcgttgtaggccgatgtcgtcatgtattcgccgtgactagttagcttccatgtgatcttgtccttttcgtactctgtcaactgcaggctatgaacagcaccctagacattgacaagttggctaattagttctgtcgtccagcctgaggttaccggcaaaccgaggtcaaccaaccattggtcgggaaagcgatacttgttgcaggcttgcattcttcttttttgcaatcgcgtagactagtggtgctatgtcctttagccgtcgcccctgaacaggctagattctcacttaagtttaagaatcagtacttaatttagaaaagctaaaagaaactttcccatattcagtatatgttggttgattgcttgtcagttgtttcttataattttcaactccaccaaataagatcgtactgcttctaatagaatgg

SEQ ID NO: 38044 - DNA, 485 bp, Oryza sativa
actatttttttaaggctataaaaaatacctacatttagtggccaacttgccaaaataagatttattttggctccaatatacaaaccccctagatttaacatgagtgcttgtatttactagtaattttccttttaatggtaagcgacttacccatcgacagtaagacgcttcatgataactcttaaagggaggtcgtacatgtattgtggacgcttgcgtttgaatcgtattttaagaaaaaaaactaatccagccctcaaaggtactactagttgtaataaacaaattaacaggagttagcacccagctgcaagcaagaatgcaaatggattacgtatgccactagctgctgcgtgagggtatcacgtcatgtgccgtctatgccttgcttgctgaatgcggccatactccaatgtctcacacacagtcatcatgcatgtgtgtttctgtctaggtgctctgtctttttttgcctcacctacagc

SEQ ID NO: 38045 - DNA, 167 bp, Oryza sativa
ctgtacaaaatatttgcagttttatgaaatttactctcttttttttatattaaagtaaatgacaaggataaaagaaaatatcttgcacgtagtaacgttatttttttataggaaaaagtacgaattaccccctaaactatcgtggttgatcgaattaccccctaaac

SEQ ID NO: 38046 - DNA, 265 bp, Oryza sativa
tttgtgtaaccagcttctcagcacaagatgtacagccagtgctgtaagataaataaaagtatcatggctttgccgttgcacttgctactacatgctttgcctgcttagcattatggttgagtttactctttcttcatagaaatcgaaatgtgctgcctgcctgtcaagctcaccagccgttcaatggaccactgaacaaacatgtttacaaaaatcattatcttaagctgaaacaggtaatagtactgtactaatcttctgcaga

SEQ ID NO: 38047 - DNA, 460 bp, Oryza sativa
caatctactgtatcttttggagctttgagcccagcccagcacaaaatattcgaagagctcgctgctgggcccacgcggcactcttttgtgccgctgagcaccgggacccaccttgatctggccggatgggaccacccatacaaaattctctcccgtactttgaactcgattttgggacaggataggtggccgtgcatacggtccccgtcctttgggcatctgtaccgtacggctctcacgctgctcctgatgttcattaaggcactgatctactgcaatttctgcagaagattagtacagtactattacctgtttcagcttaagataatgatttttgtaaacatgtttgttcagtggtccattgaacggctggtgagcttgacaggcaggcagcacatttcgatttctatgaagaaagagtaaactcaaccataatgctaagcaggcaaagcatgtagta

SEQ ID NO: 38048 - DNA, 669 bp, Oryza sativa
ttgttatatttgtaatgcaattaattaagattattagacctgtaattagacttatcatataagattgtgtagtgttctaatattatttgagttttaatataagattattttattgcaaattagacttagtatgacattattgactacggaattggtgcgactcctaacaattgactattgtagtcttaattagacttagcatatacgcacgaaacacttagcatacattactattttagtcttagcatgtaatattatttgagttttaatataatattactttatttgtaaatagacttggtatgtaattattgactacggaattggtgcgacaagtagcaattgactattgtagtcttaattagacttagcatatacgcacgaaacacttagcatatacatgactattttagtcttagcatgtaatattatttgagttttaatataagattattttatttgtaattagatttagtatataattatttactagctagggttgtataatatacgtcacctagacttagcttatatcacgatttgtaattagacttagcacgtaaggttgtgtagggttctaatgtacgacaattacacttagcatacatgacttagattgttaaaacataaatgtctcgtgacttagcagatgtttcttgtatcaacaga

SEQ ID NO: 38049 - DNA, 304 bp, Oryza sativa
actcttcttttaatacttcttttattattccaaattccatatatttataacttatacttttatatggactcttgatattttatattctacatggaatcttgtttctttttatagttttaatgattttataatttttgtatgtgttttaatcaaattgcttcttttatttttttctgaatttaagtacaaactccttgtagtgatccgcctgtcaccatcagcctcgcggatcattgtcgaccttctcatcagtgagcctttcttgatgcattggacataacgtggcgaggctcggtggcaaaga

SEQ ID NO: 38050 - DNA, 1501 bp, Oryza sativa
cacacccaagaacattttgaatccaagctgttttaaggagagacaaaaaaactttagaccatacacccatatcttaatgcaccaccaagtctgggatatctgaataagggcaataagctctggaaacatgtaataatgttaccgactgataatgttcctattcaatctgaaccatataataacaagtttaacgaaatacctttgcaatgacatcggcagtctccttgaagtcaacacaccttgatacatttgatttggccaggaactcatcaaccaaccgagttccaatgttgtagcccctgcgaagtgaaaataaatatagctgtgacttatttaggaaacagataaaaggcaaaggcagatggtagtagtaaattatgaaaaaatgcagccagcaagccatagatattgattactaaataagaatcccaatattcgccagataaccacttgatttattatctactacttcaaagtcaagattcagttaatatcatccttacatatggagatattaattgtcgtggcacactaaccccattagtgcttaactaagtaaagaagttccaaaactggaatataataaatttgtacatattatttccccacattggaccatgacacatgaaagtgttgtgaatataaggtgccgtgagcccgtgaaatgtcatatcaaaatgatcaattaccattttgtcgcagtgtaaaatctgcactaaattggaaagtcagattatccaggtataaggttgaacctctaaatcccaaatcgctgtaatacaccttcatgaagaagtttactaaaagttacctttacaaatacttcaatcattcagactacctgaacgttacttagtttgctcaaaattccatagcaaagtctacatagatcctcttactgaggccattgcagctgcttcactgtaatttgaggggtggcaaaaagtgaatatttccgaattcctactcctataacacgatcggtccaaagtacccacgaaactccctaaaattgaaccagaaaattagacaccgaggaagagaagaaccacacatacatctgatcaagctgcttgttgacctcctcgacctcctccagatccgtgagcagctgcctcacgatggccccatacgtgagcgtgaacagctccgcgttctgcgagcaaaacgaagcagatcagggcccagatccagtgggggtttctgactccctgtgaagcaaacagggggggaggaggggcgggaacttacgacgcgctcgacgctgccgaagagagcgtccccggacttgggccccgtgagcggcggcatctcccggatcgcgcggcgcctctcgccggcggcgaccggagctcgtcggcggcggtggtggtgatgcggaggagagagagagagagagatcgggggagaggccacgtcgcgagaacggcaagtctataggtgcgatggctcacccgcctatgggcctcgtagaccgctagttgggccgaaacgtaatcgc

SEQ ID NO: 38051 - DNA, 369 bp, Oryza sativa
acaatcacgtctacatcttatcgtgccatattcaatgatcaaaagcaacaacaaatagatgtgaagtgcacgtgaggacgcaagcagcaaaagagcgatgaaaagttgaaaacgataaagcaatgaaaacgatggtgaaagtttggaagggaagaggagaaaagaaggcggctcccagcatttggaaagaaatatactactccagtagagatgaaggcagagacaaaactgtagcacttttaataggaccaaccatatccaccaataggggaggagcatacatggaccccatggcattcaaccccacctgaaagtgggatggcctaacgcatctcatgtgacgaaggaaacaccctggagtatacacca

SEQ ID NO: 38052 - DNA, 1501 bp, Oryza sativa
tcagagtttcagtgggcgaaccctctgataaactgaacttgagagtttcagagttggagattcgctggcaataatcacatccgtagagtagggagagcaacgcgtcattcaacatggccaccggcaggatgcatgatttgtttacaaaatggtgattgcctaatataatgcatgtactccgtgatttatgcagagcggtgagtttaatcaaattgaacagtattaaatttcttgcttaacatttttgcttcagacagcggcaaagctccctctgctggtttcaggaaaggtctctcaccttgtgaacaacagcgaccggggaagacattaacttgtgattacaaaccgtgtcattgctgattagccatgaactccaggcaaaatgcagaagagaagaacaaaagtcagctctgacaatgccaagtgccaactaggttttcttcagccgaaatgaggtttcctcaccaagaagtcaagaacatgcatcctctaaagtatctactccagatgaattgggctaagatacatttcaatcattatacgtgcttagctgtttgtaccgcaccgacttaactgaaactgaaactgatcatccccttggcaacagctaataatctcaaccgcttgatgaagccggtgtggcggtgtcgattcagtaaccacatgaatgaaatgtttaatattcagagtttctcattatttatacagagatttggtacaataaaatttactttccaatgcccaagaggccaagaaactgcataccatccacaactctaaccaacgtttccattgggttgtgttgtcgtgcagaaaactccctaccagacagtcttgttgcttgcaaacaaactattgagtggaagttcattttaattagtccatgtatattaccaaaaaaaaatgtttgacatatcctaaaccacatttttgccaagtgcaactgtgcaagtcatgtttagttcttagcttaccggaacagagttctttgacactactgttcttgctctcagtaatacgatgataatgatacagattgccaagttgatctccatccgatgtcgtttgaaatgtagatttgagattttgttaaaatttgttttgaattttgtaacgaatatttggacatctaaacgatattgttaactacaaagttgtatatctccttgagctctacgattttgatataaagtttgatttcatccgactttatatggtgtatattttaaattacaaaatcatagagttaacaagctatattggaaattttatatttaggcccctcaacatcttttggagggttttttttttaaaaaaaaaggaggatgtggaatgtatagatttgtaaatttttgaaaccaaaaattactttttaattcttttaataaaaatgtaaaaataaaaaaaaaactccagcctagaggaatgggccataaacccatcagcaagcccaatacatttgggcctgttgcccaagaaagaactcataagcctagaaata

SEQ ID NO: 38053 - DNA, 1501 bp, Oryza sativa
tgtagtttatgccttgctaatacttatccatttattgatctttgttctgttcagatttttgggatagtgttttctgttctctctcataactcataagggtaaatgggttcagaaggaccttcagttgttactgtccatgttaccggatttaagaagttccatggggttgctgagaacccaactgagaaaattgtgggcaatcttaaatcattcgtagaaaagaaaggattgccgaaaaaccttgtacttggaagctgcacagtgcttgaaactgcagggcagggggcacttggcacattatataaggttttggaatctgccattgcagaaagagagaatgggtcatcggctcaggggcaagtaatttgggttggtatccaccttccttgattccatattacataatgatgtaatgcagtcagcaccttgcgtattgcaatgctgtcctatcagaaaaagaataaggaagtttctatttgccttcaatgccactcgaatagtcaaactaattatcatttgaaacttgttcagatccattttggagttaatagtggtgcaacaaggtttgctcttgagaatcaggctgttaacgaagccaccttccgttgtccagatgagctagggtggaaacctcaggttgtgattttgtccaattacttatctttgtctatatatcttgacattgtgtttaccggtttgattgttccgtgcagagggttcctattgtaccatcggatggagccatctcacggacaagagaggtacaagttaaaaaaagtttgtctggaaattaatggatgtttgttgaaagtacagctacgaacagcagagttacatattatcttttcatagttcactagtcctttccccccacataattctaatggccatgaccccacaagacaccttcccattgaatgaaaaaaagaagtccaaactgccaaatagaacaccataggtctgctgcgatcactttcttcactgttacgttacctacgcgagcttgattttcagaagttctattgaacatctcttttcttcctatttctttcaatacgaacaaatcagttaggaatatattcaaaaggacaatggtaatctgtgattgcctgattacagcacgatcttctctacaaaataatatcacaaatgccccctattattttccccacatgttcagaatacccatattttgtgtttaaaacttatcataatggaatgtttaaaacctaccataatggacttatgtggtttgaatatgttgcctgtatgataacaaacaaagatagttcatatgcgcattattgaatgaataaaatgtcaatcatcagatatttcaagttttggattgagagtactgttgatcttgagactaatcacatttatctgaacttttcatgaacaaccagactacgcttccggtaaatgagttgaccaagtcactccggaagacaggctacgatgtaatgccatcagacgatgctggtcggtttgtatgcaa

SEQ ID NO: 38054 - DNA, 338 bp, Oryza sativa
gcagctatctcgtgcttttccagggtattaggtttgggggggaggagagtaagtaggataaccaggttgtgcatgactgcattagcttgcctcgccgggaaagcaatttcttggagcaggtgagacgattcccccgaagtttttggtaggctagatgatgcaagtgtggttggtctctgtttgggcttactgtgcgtgtaatcttctgctttgcagtggtgtcaaagcagcggctgggtgtggtctcggcttgcttccgcagtggcgcggcgtgttccggagcgtgagaatggagagtgggagctctcagggtggccgtggtgccctcatagtcctgg

SEQ ID NO: 38055 - DNA, 454 bp, Oryza sativa
tgcatgtggtatccccttgagatataaaaggaggaccttgcccacttaagagaaaaaagagagaagaggggggggggaaaaacaccggagctcggagaggagagaaagaggaagagggtctttagagtttgaactctcttgctctccagctctttgtaactccttcatacacagatccaccagaacacaggagtagggtattacgcttctcagcggcccgaacctgtctacatcgcccgtgtcttgcgcatttgctctctcgcgaaacattccacagatcgagggcttagaacctcaccttgcgcccctggccgaaccggcaaaggggggcccgcgcggtctcccggtgaggagccccacgctccgtcatctggcgcgccaggtagggggcgcgtgtgtttttctaagccctcgtcctctttcgtgtgcgccaagcttctcccgctcagcccaa

SEQ ID NO: 38056 - DNA, 1501 bp, Oryza sativa
cctattgctgatatgtgaaaactataacgatgagacacaatattgtttgtgctatagtaaagttttctgttgtaacttgcgacgggctttcaataaattatttttgaacattattttaccccgtgagatataaaggtgatgcagatttattttccaattacaatgtactcatatcttgaaatgtaaggcataattatcttttcatcatatttcataatataaaggagtgcatgcatacatacattaactagcacatgtaagtcctctatcatcaaaccccaccacttgcatgtatctaggtgatctaaccaatgagacgaggtgattaaattcttttcgtctttgtgtttagggtggttgtcttaggctcccattgtttcgcttcttccaccgtttttaaactaaaatttgaattttgaaacttaattttgaagttgattttgtggtttttcattgtagtttattttacgaccttttcttttaaatcgctatgaatgtgtatataaaagttttatccaaattattttttgattgttaataagctgtgtcatttttgattaaaaaagcgaaccgatgggagctttatattttagcatgaagaaagtatatttatggaactgtgtctagaaaaatcgctaccgggcatccgatgattccgatcaaataggtgtatggacgaaaatggattgaaaaatgaaaaggcatactccctccatacaaatcgtttaggacagcgacacggtctccaaaacataattttgacttcttatttctataaaaatatttattgaaaaatgatatatgtatacttttatgaaagtatttttcaagataaatttatacatataatttttatattttcaaactcaacaacttaagagttattcataatttatattcccaaggtttgacttaaacattgttctaaaacgacttctgttatgagtatggagagagtattcacgaatacgatgattacgtagcaagtcgagtaccagagacgggcagacacactgataagaagccaaaaaaggacaggacaacgaccaggccagcacgaatctcctggcgagtatcctgtggctcgcaattcgactgatgagatcgacaagatctgtccacgcaaaattcaacaaaaatgcttttgtaacattggatggttcatactgggttgtactccctttaaacgttggcctcttgttagtcgatgcaatcatcttcttgccacgattggtacagcacccacacgaatcgagacgcatatgcagctgagaacaaaaacattcgatcgagtaaaatagaaaacaaaattcatctttttggttgccggatcatcctattgaccgaccaaaacgacacgatcgaggctagtgaattattggagaggaaggaacgatagcaagcgaaaagaggagaaagaagaagaagaagctgctgatgtgtggctgtgcatctggagaggacgcaatggagaccaggcgtcctctgcatccgctgctcc

SEQ ID NO: 38057 - DNA, 176 bp, Oryza sativa
acccgatattaataatatagtaagcaactattgtataaattagctattacattagttatagatgatttggagccagtagttagctaatactattaaacttgctctcacgcagatctggaccgcactctccaccctccctcgtggcccgtgcgcgcgcgcgcgcgcgcgtgcgtagc

SEQ ID NO: 38058 - DNA, 655 bp, Oryza sativa
aaatgctttatctacttaaattatgagctactactaatattaacatgggactgtaatgtaaaataataaaactaatttattttttaccaaaagagaaagggtgtaccgaccagggcagcattggcccacgtttgtctctacaagcccaatgatatagcgaggaggatgacatttgaaccttttttggctttagttgtctattttaaatcataaaaataaagaataaaaacgacatcatcataaagtaaaagtagaagacatcaacatcaggaggcgaatgtaaaaaagatactagtttcggtgtaacttacatacatttattttgcatacttttctgctctttcagttctctctctatctctgtcttttgtcctctccaaataaacaggacctaaagcgacatgagccgtgcaataagcaaaaggagtagattacacatcacgccaccccggatttcccttcgaaaccaaccaaaacctcaccaaattaacttgataaaccggcagaaaaaaatgagaggaataggcatcggctggtcaagtaatgtttaatttgagccaccaaaaggtgcacttcctctctcagcaagagtcccgtgctgtctgatggctcgagaacctaagatcgtgaacctacgtactgcaaagagatgata

SEQ ID NO: 38059 - DNA, 1501 bp, Oryza sativa
attcggaataaaaaaaaagcaaaattaaaccatataggaatatatataatttacaaataactaaattttaatattaaaaataattaataactaacgcgtatataaaatagaatatgaatattacgtttcgttaagttattgcaaaatttaaaattatgatgttattctaatatatttgaataatataaggagaaaacataagaaaatatagactgcgcgggccaacatgctatttggtcgactgtcagcattttgcccttgacgctcatgcatcccagccgtccacgtcccggaggaataacacaccctccagccttctcctcctcaatccaccgacgccgccgccgccgccggctacttctccggctactccccatcgcatgttccgatagtccaagagcggcggcaacgacggctggcttctccagcgaatccattcagctccggctggcctcgacctgaccctgcccccggcggcatcctcgaccggatccgtctagcggcgacctccgcaatggcggcggcggctcgctgccccggtgaccatcgcgggggtgggcttctcccacgacgacggcggccgcggcagcagcagcacacagcgagcagccggagccgggcaacctgccgccattgtcaaggccgacaggtaataaacaggtatgcgcagcctggttacagtattttacgcccttctgaattttgctgcgaaagtaactgagattatcgatgatatgaacatgtacatcactagagaatattgcgggtcccgtgattagcgacattgctgtgtgcaacgtttgttccttttaggtattattacgttcctttcatgtatctttggacgctgtcgattagtccagtgactcctatcccaattcctcttgccacacaccacttatccgctgcagcaacctcgcaatcccctcggcgctcgctggttccagccaagctgcttccgtcctccttcacttcatctgtgcaacagggtaaagcttccagatcttgctttgctgtttttttttattagttcatatccatcttattctactacaaaaatacttgatctgtctccggtgccgttcactgatttcgttttttctttgttgttgtttctcgatgattttaggttattcatccggccctggtggttttgccgtctgcaaacacctgtcttccattcgcatttcagaagaaaaagaaacacacacacaaaaaaactactcgtcagagttttcttcctaatttcccatccaaaaccagtagttttcattgaaaacaaaatcatttgttgttgtactgtccccgtattttgttcgtagcaattcccatccaaaaaacaaaatcatcctagctttttactttcaccttgttcccatcggtccttgtttagatcttcctagtctaagtttaccaacatttctccatcttcacatccaatatctctgtacctaccaaaattacaaagagagagaacagggagacagcaaattcaatccga

SEQ ID NO: 38060 - DNA, 168 bp, Oryza sativa
ggtcgcctggcccgcctctcgcgccccgccagccaccgcatcggcgcagatcgacggacgccgagacgcgcagccgcagtcgcgcagaggcgccgagtgcctgagggctcagccagccgccgaccgccgcggccgcctggcccccctgcccgtctcgtcttctccagt

SEQ ID NO: 38061 - DNA, 642 bp, Oryza sativa
  unsure (1)..(642): unsure at all n locations
ttgatatctactgccacccagccgcnaggagaaagggccccctgcatgtctaaatcctggctctgccactgactcgtaaatggaactgataaggttgatgggctattcagctgaatgaacaagattttgatgcgtactgcatgaatattcggatacttgttggatggtaccaactagtctttacttttaaaattacagatttatttgcttattgagagggaacagttgagtcaaaagggctgtaatgctgtatggtgtgaaaacagctgcttgctaatttatctttgcccaatatcaacattttgtcagcctgttacacaaggttggtttccggccaaaacctcaagtgttatctgaaaccatatcttatgatggctaaacccttcagttttgttttatttggtcagtaataccacatgttagaatctaatttgaggtgcaaatagtagcaggggtctctactgactatatttttttatagatattaaaatctctttaactaatttcaaagattattatgctgagatgagcattatgtacgagaatatttctatttcattggttaattgggcccctaccttttatgtccaactacccaatagttatagatggggcaccttttttcctttgatacttcagaca

SEQ ID NO: 38062 - DNA, 223 bp, Oryza sativa
ttagtttgaccaaatgtagttagtgtttggtttgtttctataactttggcatgccacactttctactcttttgatcccactagtcatagacccttttcttagccaaagtttgctaagtgtggctatcaaattttaagccacacaatttgcatcttgccatacctttggtaaaaaactgtggtaatttgaggtgggcatccaaacagcccctatatgcacccga

SEQ ID NO: 38063 - DNA, 1501 bp, Oryza sativa
ctaacaacaataaaaatacgaattataaaaaaatttctgtcgaaactagatttcggcaataataaaaagggggtggctatcaagctggagaagtgtatgggtttggagacaaaggatttatacaggttcaggccttcttattcaagaagtaataccctactcctgtccggggatgaatccgccgagtgtcttattgattgtatgatttggagaaaatcaacatgtgtacccctagaggcacccggaccccccttatatatgggaaggagtccgtgttacaaaagataatctatatccctaacgaaatatgcagatacagataaaatacagtcgtaaccgactaagtctcaaggtatttccttgatgtacaagttgagaaacaaacccgagacacaaataagatattctatctatatttggtatcctgtattcagtccaaataccatcgtcgtgtagatatgggatatccataatctccacagtagcccccgagacctttgcagtcaaccatcatagccttctcaaagataataatccgagtgcttcaaacctttcatgccaagatctgccgagtaacgaagacaaagactgtaaagggcgaaaagataaagaatatagtgcatcgaatagatgcacctaattaggtgtagctcccaactatgtgattagttaacaaactaaacatatagttgagaacaaaataatagcacaatcgtgcatcatatgacaaaagcatacgcggcgcctaaagaggcattctagccgactgctttttagccataataaaaggaatccgagtggttagcactctaaaaggttcacgaatgaacacacttgacgggcatccgaatagaaaactctaaagattacccaccaaaaattataaaaattatggtaatgaataagtctaatagcctaggctttgactatttaccataatgaaaacaggcatataacataccaaggaaatgactatggtaaaaacaagtcattctaagttaacccagacagcttttgtagcctaaaaaagcttacaaaaacagcataacacctttctgtcgggcaccttttaatttgcattgcaataattccaaagaattatatgaccgcgtaaaaaggattttatcagcattgggcaacactattgtgcgcataaattgccaaagcaaaaaatgcctaagtccctaaggagcacaatgggccacgctgtcaaaagtactgggctgaggtactgttcaggcctaagcccatttgcacctccgatacccttaacaagaaatcccaagatccaagcgacacttcatcttccccgccggaactctcgccattttccccactccctgctacagtacagagctgcaccggcaaactagggttcaccattccactcgaatccaccttcgaaaagttcatcaaaatccttcccgtgatccactgcctcaatccctcacctctccctagccatccctcgaatcaaatcaacgcattcggaaaaaatcaa

SEQ ID NO: 38064 - DNA, 1501 bp, Oryza sativa
ctgtgcacgacggcgatctctcatctcccgcggctcatcccgcgaggagaaaaaaaagaaggcgaggataaccctgtgacgcatgcgggcaaacatggccacacgtagaaacagtctcgttacttcgttcaccggtgatttttcatttttcatgctttggctgcctcacaggtcgtattctgctcactgttgcatggttaatgtcgaagcaaacggggaggtttgcttttttgtcgagcagtcgttgtcgccccttgccgtcggaagcatggctaattaagccaagatgacagccgtagctagctccgctttgtccctgagtgtttcggaagcattcgctgtccggccacagatacacacacttgaatttgctcatattggttaaaagctggaacgctttttgcaagggtttcaaaaatggaagggaagaagacctccgttgttaccgatccaaataccgtctactagtttattgccggctagaagctagaaacgtgtaacaagtccatctcacagctgtgtaagtgtaggttaggctttggcttttgatccattgatggcgttgaaggttggcaagagaacgttgaaattttaacgagaggcttctaacggtagttgcaacggcccacgtattgttgacattttcgcatttcaacgtctcgagctacaggaacgatagcgtaaactacacttattgagtggtatagacataatcgcacagtgacacacaaacatcacgcacgcaaaatcacggcatattgttccgcagctaggcgctgcaaagacagcaacaatactatactacacagcttcgttaacacgatctttgacggtctctgaaacagtgacagggacagttcagaaggttgaatcctaaacacatcggttttcggagctcaggcaagtctctagcaaaaaagaaacaaaacagaagatgcatagaggaaaagcgtatgtgccgcagtgattttcttgttaaatcacactgctaatatggcttgatgttcttaaccgtttaagattagagcctcattatttggcttatgatttatatgccaatattaatatttgaattctaaaacttgattttaaagttgatttaatattatttaaaatgtaatttttatattaacttttaagtcgataaaaacacatatacaaaattttaattataattattttttaactattaatgtgccattatggcttataataagaagtaagcaacaaataagaacatagattattaacccaattattagcacgattatataataaaataaattaacaaatagcctggaataataataatcttaaaaatacagtagaaaaaatgtagtaatgttttgtgagagaacttatttttagatacttgaccaaaataatccagcaaaaaaaccgggcagactgtgagagattagagataagacggcgccacggcggacgccctttccgtcctttttctctcgcgcacacgccgttagacaaccggagcggcgac

SEQ ID NO: 38065 - DNA, 1501 bp, Oryza sativa
ggccattcgcatggtttcgggtgtgcactctggtgtatacccttcctcgatagccaactgtcgatgaaaaattttcttgtaaccgtttattccctctctcttaatgccattggatgtcctttctttggtcatcccggtaaaaaagagattgaagccattgtatgatagtatcacaaatttaacactttctcttctttttttttttttgcaaaattatagattaattgtagaggctccatccttacatttttatctggaacttctaacattgtgtttgcctattagtactgggtgtaaaaatctgagcaagaagaaaaaattcgagtacacaatttaaaatttgtttttctatttttttatcacccaaacaataagaaatcggcactatacgcaccgttattttctccaacaaaaattggataaaattttagattctcgtggcacgctttttcaaagtgctaaacagtacgttccgtgcaaaaactttctatatgaaagttgctctaaaatatcaaattaatctatttttaagtttataataattaaaactcaagtaataatatattaataccaccttattttacctaaaacgcttaatctacatatttatcttctatccttactccttactgtctgtcatcatcccgttggttgggttttctcctcgcggagcacgcgactaataacgaattaattacagaaagagaacctaacatgcctctgaaagatactaaatattaccatttcttaagctaagagcaagtataatagagctaattaggttggcgataagaagctccacatcagcatactcctacatggaggagaaagaaaataggagagagagtgaagtgggcgcttgcagaagcgccgagcgatagcatgccgaagtaggcgctgccgtcctcccgcagcaggtgtggatatgatgctagttattgttgatcccgtgtgcacaaacaattctgcctgctctcgccagtgcaacacgcaaaagaatttgctctcatccggcatatgacacacatatggtcacacaaatgaaagctagatttgatcttaaggtatgtttagttcacaccaaaattggaagtttatttgtaattggaacgatgtgacagaaaagttggaagtttgtgtatacaggaagattttgatgtgatggaaaagttagaagtttgaagaaaaagttgggaactaaaccaggccttacaaaattttagtacacacatgcaggcaatccattatatatactccctccgtcccaaaaaaagacaaactctggtttccgtgcccaatgtttgactgtccgtcttatttaaaacaataatgaaaaaaattaaaaagagaagtcacgcacaaaatattaatcatgttttatcatctaacaacaataaaaatacgaattataaaaaaatttctgtcgaaactagatttcggcaataataaaaagggggtggctatcaagctggagaagtgtatgggtttggagacaaaggat

SEQ ID NO: 38066 - DNA, 1501 bp, Oryza sativa
atataaaaaccaggaaaacttttacattctaaacgggcatgatgacacgaaaaaaatagctccgaaagggtcatatttttgttttttgttatgagacaaaatttatgacgcatgagtagttaccaattttttatgagaattaagcgctaatcatgtttgaattaaggagaattatgagcaacctcagtagtggcaaactattgtttttcttttttgctgacggaaataatggaagcggtaaagaagaccatgtgcccatttatagctgatcaccggtttaatgaacactgttttcatacagttgtagtatacagtagttgggtttttgctaggctggttgacccatttatagatgattaccggtgtaatgagtctattaagattttaagatcgcttttcacccatttatacctgatcacagtttaacaaacgttgtcatactcagggagtcaggatagatcacatctggttacttccaactccctccaatcctgaactttaatatagagatgattttttatgggacggagaaagtatataggagcctttatgcgtcttttgctaccttgtttctagagttagtatgttagtatgtgttttatccaacactacaaaatgagggaaccaaataggcatgctcttcatcatttttttattcaatccattctatgccatcaacaaagctcgggttctacaatatatcactaacaaagctcggttttacaatataccttggaacaacttattttcttccttatatgccatcagcgttagtcaaccgttagtcatacaccattaaaggagaaagatggcaattttacccctaggataaaattgagattttgcacaatgccatgcctaattaaataatcttggatgatagaaagacaagtgatttctatttttcatcaatgagaagaattagtggatcgtgaccaatgaaatccatgatcgtacgcacggtaccctagaggtaaaatggacattttctttctcttaacggaattaaactaaccgttgactagcggcaatggtatgtaagtaagaaaactagttgttcaacgctatattataaaactcagttttgtcggtggtatattgtagaattcatcctttgtcaatgttatggaatggattatctcttttttttttcaaaccctagtaaccaaataaaactcaatggtactgattagattatctcttttcctgaattctatgcatgcttaaatggatgcatggtcatttaaaaccaatcacatcgcctcttgtgccattatctgactggggctgatgaacaatgcaagaatgacaaagagttagttgacaggctgctcgtaaatacaagcggccaatgctgatagcagttgatgctactagcatatataaacacgagcgaccaactgcactgtgcgtgtacaccatcttagctggaacgtgcatgcgtacgttgcccacatggcgctcaagccaacgctcgccgccctcctcttctccctggccg

SEQ ID NO: 38067 - DNA, 211 bp, Oryza sativa
ccagcttgtagccattgcacatggagttgaacttctcaacaagctcaacgttgctcctgtacacctcgaacctcctctgcttctcgtcggcagtcgtgcagctcccggcactgcgctcgcacgagctctagctcgtcggagacgggcggcgccgcggccccgatctcctccacgagcccccccgcgccgacgccgtgagcgaagacccagc

SEQ ID NO: 38068 - DNA, 1501 bp, Oryza sativa
tgggaacggatctcgattctgcagggcttaccgggcttgaagaagatggagaggccgaaatcgatggccttgagcggcgagttctccttcttgttggcgaagaggaagttctcgggcttgaggtcccggtggataacgccgtggcggtggcagagctggacgacctccacgatggtgcgggtgacattggcggcggcgcgctccgtgtagtggccccgcgcgacgatgcggtcgaagagctccccgccttcgcagagctccatgacgaggtgcacggcgccctcgtcctcgcacgcctcccgcagcgacacgatgctggcgctcttggggaggtggcgcatgatggcgacctcccggcgcacgtcctccacgtcgaccgccgtcctcagcttccgcttggagatggacttgcaggcgagcagctccttggtgtcccgatccatgcacaggtacgtcaccccgaactccccccgcccgagctcccggtccagcgcgtacttgtcgtcgatccctccgatcagctcgcacccttcctccccgagcacggggagccgcttctgccccgctcctcctcctcctccgccgccgccgcccccgccgccgcctccccccacgccgccgttccgcgcctggtggggcttcttcttcccggccgatgcggggaagtgagacgacttgacgtcctcccgcgccgcggcggccggcgagcggcagcagttccccatgctcgcgcgagatcaaggggagggagggctagggtttgtgctgcattgggcgccgcggtgggggattgggagatgggaggagaaggaattggtgaagtgaggtagaagagagagaggagatgagtagaggagcggtaaaactgtgacgagtttggtaatggtaacggtaaagggacgggagggaggcgctggggacgcgtagccggcggtagcttttagccttgggccgacgaggacgagggtgggggaacattcccacgtggcgccgtggcgtgtgcgagatttgtcgctgaccggtggggcccttacggtttttttgggtgggttctccggtgcgtttttgggctttcgcggcggtgcggtgagccggtgtggggaaggacggctaggggggggtttgactgcgctggtcgccgctccggttgtctaacggcgtgtgcgcgagagaaaaaggacggaaagggcgtccgccgtggcgccgtcttatctctaatctctcacagtctgcccggtttttttgctggattattttggtcaagtatctaaaaataagttctctcacaaaacattactacattttttctactgtatttttaagattattattattccaggctatttgttaatttattttattatataatcgtgctaataattgggttaataatctatgttcttatttgttgcttacttcttattataagccataatggcacattaatagttaaaaaataattataattaaaattttgtatatgtgtttttatcgacttaaa

SEQ ID NO: 38069 - DNA, 352 bp, Oryza sativa
acgccgcatcgccgagcaacgcggcgtcgaaatgctcgacgccaccgggctcccacggcagccgcggcgaagcgtcaggcatctcgggcgcgtctcctcccccatcacgtaggctcactccatcaaaaacaaaaaaacaaacaaacaaacaaacaaaatcaagagaaacgcgcgaggaatcgatcgattagctcctggagcagttgggatttgggaaggatcaaacgcaatggggaaaaaattgggtaggaatttttgggggaaacggtggaggctgaggtgtgcggtcggggagaaccaggaggcctctgggggaaaatgcccgcgggagaatagcggcggtggcatggca

SEQ ID NO: 38070 - DNA, 1501 bp, Oryza sativa
attgggcacggaaaccagagtttgtctttttttgggacggagggagtatatataatggattgcctgcatgtgtgtactaaaattttgtaaggcctggtttagttcccaactttttcttcaaacttctaacttttccatcacatcaaaatcttcctgtatacacaaacttccaacttttctgtcacatcgttccaattacaaataaacttccaattttggtgtgaactaaacataccttaagatcaaatctagctttcatttgtgtgaccatatgtgtgtcatatgccggatgagagcaaattcttttgcgtgttgcactggcgagagcaggcagaattgtttgtgcacacgggatcaacaataactagcatcatatccacacctgctgcgggaggacggcagcgcctacttcggcatgctatcgctcggcgcttctgcaagcgcccacttcactctctctcctattttctttctcctccatgtaggagtatgctgatgtggagcttcttatcgccaacctaattagctctattatacttgctcttagcttaagaaatggtaatatttagtatctttcagaggcatgttaggttctctttctgtaattaattcgttattagtcgcgtgctccgcgaggagaaaacccaaccaacgggatgatgacagacagtaaggagtaaggatagaagataaatatgtagattaagcgttttaggtaaaataaggtggtattaatatattattacttgagttttaattattataaacttaaaaatagattaatttgatattttagagcaactttcatatagaaagtttttgcacggaacgtactgtttagcactttgaaaaagcgtgccacgagaatctaaaattttatccaatttttgttggagaaaataacggtgcgtatagtgccgatttcttattgtttgggtgataaaaaaatagaaaaacaaattttaaattgtgtactcgaattttttcttcttgctcagatttttacacccagtactaataggcaaacacaatgttagaagttccagataaaaatgtaaggatggagcctctacaattaatctataattttgcaaaaaaaaaaaaagaagagaaagtgttaaatttgtgatactatcatacaatggcttcaatctcttttttaccgggatgaccaaagaaaggacatccaatggcattaagagagagggaataaacggttacaagaaaatttttcatcgacagttggctatcgaggaagggtatacaccagagtgcacacccgaaaccatgcgaatggcctcaatctcaggtttcgtgataattttaccaatgtacctattgacgacttccaactctgaaaattggtagatacatgatgatatgccactaaaacagaattgttcttgcaggagagcatacaggatggtgttcagagtagtagcacccatcactcaaagctgagcatggaaggctgtggagacagaaccatcatccaccttga

SEQ ID NO: 38071 - DNA, 521 bp, Oryza sativa
ttcgatttcttcgcacgtatttcgcgtgcatgtggatacatatatacgttcctgcgcaggacttttctttgcggaaatcttacatggttttatcgtttttattaccggtttgtttcgatttgcaaggtgcggctttagttgtgcatgctagaaaacgagtgtacagggcgaaacttcagcttcattgagaattgggatgacgccatgggattctttggccaagtgcgtaacgtaagtgatgatatgcacatgcatggatgtggtcagctcgatcgaagcaagaagccagcgtcgggtcatctggtcgctagttttgtttgcactttgcacacggcttcatcattgtctcgtggccttcgttttctattatactcataaatgggatgagtttcctgttcggttgatgatcatgttctgttttcagcgatcgtgttctcttccgttccaaaatacaccctccgttccaaaataaggggtgtttagatgtaggggtgtaaaattttagcgtgtcacattaggta

SEQ ID NO: 38072 - DNA, 722 bp, Oryza sativa
ccgaccccctcggggggactaagaggagggcgaacacatcaccctcgggcccgacgtccctcgagggtgccaggccacgtgggcgattgtgtctgcctcaaacctctagtcatgatactcctgatcccatgtcaccgacagtagcccccggcgttatgccagggcgatcgccctctttaagggaagcggtcgggcgtgacgccactcctaaggcctggtgacaggtgggaccggtctccacaattgggcagaaacccaacggtcacaaatcacgcacatcggcaatggtaactcggctgtcaataatgagcggtctcttcaagactgccacattactcgagtagcacacgaatctggacatggcgattcgtttcgtctggagatatggtaacgtcgcttcggccggcgagcgtaactaacgcgcacacgatatgatctatctcgactgccacaaccgcatatccacctcatgcgccgcaagcgggcgaatgggatttagtggaagcgtgggcgcgagaaacgagggggcgaaatagtgggcgcgagaagcgaggagccgggcacagcgttggcaagagtataaaggcactgaggaagggatctgtttccttcctttcgccattattccccttgtcttcgccgcttgcgccctaactctttctttcctgtgccctaccttcgccacacgcgctcgctcttaatcttctcttcctccggcgcca

SEQ ID NO: 38073 - DNA, 317 bp, Oryza sativa
gcttcacttaaaaaatgtcttaataatcttgtttggtgttgctttctctaatggatcactttcctctaccaacaatgatctgatctctgcagactggagtgacatttaagagaaatcccagtggtacatgtcacaaaagcacatgataccaaatgaactggggtcagctgttgtcatattgctacaaaatttggcacagcctaagcagggagagggtttttgataggcacttcaacatgttcagaaaactttagatagcttacagagttagctatcactgagtagtccgtcgaagtggaccatttcacgtgcctaga

SEQ ID NO: 38074 - DNA, 692 bp, Oryza sativa
  unsure (1)..(692): unsure at all n locations
cctgcctcactgaacgttggcatgctaattcataggctcaaacatatggcatcataagttagaatggtattgggctgtnagctatcgagtctaattctactagatgaatctgactgagctaactatgcatagtatggccagtatatgggcacagcgcgcagactgatggtggattaacttagctcagaagatagctttcacaactacatccgtagatctgaacagggtaccttaacatagctcggttggctcctgcaatctatcgataaacagtctgagacactcggactcataacagaagaagcgcatattctatacagcctcagtctacaccattatgactatatgacattacatggcgacagagcagcatacgtacatatcacctgcggtttaattgttgtccctgatgctagaaaaaacaccatcccaaaggaccccaactctcacaagtgaccctaaaccacttgctccaagttgcaaaaaccaccgttacaaatggcaagtgtaattgagtaagttgtcaacttgtgtgatgaccatctcagtattggtttagcttgattggtgatttgctgttttgctccaaggtatataagtagccagaccgtgtctagtgctctctctctttcttgtgtgaaaaaaatataaaaaccaagaaacctgtgtgagataagagcgtggtgggatga

SEQ ID NO: 38075 - DNA, 1501 bp, Oryza sativa
ggcattaaaaatactcctaatctcgaatcctccgttaggttggaaagacccacgaacagatcgatcggtgttttctttctccttcgagcttaaattctcacggaatcaagcactgagaagacgctgcaagcgagaaaatctctacagatgtagcgggtgatttcgttctagaaggttctagaactagtttatttaagtaaatttcataatcccacgtattatgggtccaaaattgcataaaaccacgaaaaatttgacacgtgacacgtaacatcggatattatagtcctaaagtttcacaaaaccgtaccgttaaccattttgacatatgccatagtagatagtacatgattatgtgccacattgccaaaatccttataattttgtgtaacttggatcataacagatgtggttttataaaatttacttttttttttcctcgttgatgtggttttataaaatttactttttttttccctcgtcgatgcatcgcgtggtggcaaaatgggccgcacggcatggcctggccatccatccgcagtggatctgggcctccaaagtgcgatctaatggtcacgagaggcccacgataggtcacaatccaattcggcccattcactgtatcttttcaagtgggcccacgagcccacccgcggccgcgtccgtctccgcccaagcggtggcggctcatataccgccgcgagagagagaccattcccccccgtctcggcctcggaagtcgcgcgcacccccaaaccctagccgcgcctccacctcccgattcgccgccttttcgttccaggtaattggcagcggcgtggaaccgaatagtggatgcgtctatgctacccgattactccgtaatctctctcctttttttttggtggggggtaaatcatcttcggtgtttgatctgcaggtgtgtgttgattagtagaagagaagcggcggctgcgacgaggcggaatcgaccatggcgacccgtaagtttcagcatgtttgaggttttgcggctcgtggtttttgtgattaggtagctctatattcatttctgttagttacttcgatgagatattttgtagcgttggggattggcaacgacggattgggcgattagtactgttgggtgattagtcttgtggccagatgcctagatgagtagttttgtgactgaagcagcatcacagaatggatttcggggctagtcaagtgggtttaatgtttgttgagatttttctgaatgatcagtgtttagaatgtaatgtttttgaggacaaaagtggtagcttgttacggtagcttttagtaaaagatctttttcttagcatctcatttgttgttctatgctgaaatttctacacttaatcatgtgatgtagcgcacctctaatttggttggttaggtttcattgctcatactgggttctgaactggtgggtgatgtttgattcaaatgccttttacacatcttccgtatctaatctgctttttcttgaatacac

SEQ ID NO: 38076 - DNA, 1501 bp, Oryza sativa
atggtatattataatgaatatttagacccttaaatgacctcaaataataaaatagtcaataataaagttgtagatctcatcaagctctacaatgtttgtcgaaacaagatttcggcaataataaaagggggtggctatcaagctaggaaagtggatgggtttggagacaaggaattttatacaggttcaggccttcttattcaagaagtaataccgtactcctgtccggggatgattccgccgagtgtgttattgattgtataaactggaaaaaagaatcgtcccgagaggaacccggacccctccttatataggggaagggatccgtattacagaatacagtccatatcctaacggaatatgggattacagataaaatacaatcgtaaccgactaggatcccgggtattttcttgacatacaagtttagaatctaacccgagtcctcataaagatattctatctatatttggtaccgtatatccagctggaatataaccgccatgtagatatggggtaaccataatctccacagtagcccccgagaccttcacagttgacaaaatagccttctcgaaacaaaaacaataatccgagtgcttcaattcaacttgctccagcttgctgagtgctaaaagactgtgaagggcgaaaataaaacatggtgcatcgagtagatgcacctaattaggtgtagcccccaactatatgattagttgaaaaactaaacatgtagtcaagaaccgagtggttttataacaaagcatgcatggtactcaataagatacccagccgactgcttttcaacttgaacatatcaaggacaaaaaatatgaaaagacccgagtgacaaacactcaaaaaggttcataagtagacatatttgacaggaatccgagtagaaaactcgtaaaatgatccaccaaatatgataaagatcatggcaattaggaagtttaatagcctaggctataacccttaccataatcaaaataagcatataacatgctaggagaatgactactaataaaccagtcatctcaaattaacccaacagcttttgtagcctaaaaaagcttacaaaaatggtataacacctttctgtcgggcacctttttatgtgcatcataataattccaaagaattattgaatcacgttaaaaggattttaacagcatcgagccacatcattgtgagcacatattgccaaagctgaaaacaaaattgggctgaagtactgtacaggcccaggcccattagcacccccgataccctaataataccgaagtaaaaaacgtctcttcgtcttccccgccgagactctcgccattttccccatttcctgctacaatgaaaactgcgccgggcaaactagggttcatcaatccgctccaatccaccctcaaaaacttcacgaaatttctccccgcatccaccgctgcaatttccctccctttccagccgtatctcgaattaaatcacaccatccagttcacattca

SEQ ID NO: 38077 - DNA, 222 bp, Oryza sativa
tttcagaactgtagtgcttctgagctgaagacgaagttagaggaccaaggctcagaccccagttgagttttgcctgtggagtggagctgaagccccgctaggatcgcctttttccgctgctgctgttttcgtttcggtgcgaggactaagtgcctcttttgtaagtattttacgctttatttacgtttggaactgtatattacttgtcgttttgtgtaccct

SEQ ID NO: 38078 - DNA, 1501 bp, Oryza sativa; identical to SEQ ID NO: 19397

SEQ ID NO: 38079 - DNA, 1501 bp, Oryza sativa
ttaattggcagatggtatcagccaaactgacacagttcacgaccactgtaaactactccaatcaaactccaaaatcaaagaaaatttgcaaggtgtgtatggggagtaatggtccgtgatagatgatgactgatgcatgtgagttgccacttgcaagcgcacactcttccagtgaggtggccggacgattgatcatacggatcgaaatgggcgcaaggagtacgtaggatctggatcactcgatcgggaggtatcacgtttcggaccacgggcctacgtgtgtatgtaggcctgatgccgtcaagattagatttcggatggaatcttggagaagaaaagggggagccaagcccaggtagaatgctaggcccaaaaactggtcgattattttagtggaataagtttattttgtctccctcaactcatgtccctggttgaactgcatccctcaaccacaaatcgggtataaccagtcccctaactcctaaaaccgttgcaaatcaactccctggtttgtttcggaggtggttttattccacgtggcatctttaaccccgttgactggctgagtcagctcgtagaacccacatattagtgttaagcattaaaatgaaaaatggtagggcccactgtccgccacacttctcctctacttctctaggccttctctcgctcctccatccgctcggaagactcgccggggatggctatgtacgggtagggttgaaactagttcgcatagtttccgtccgtccggaccattttacgaattcggatagtttcggtcggaactatccggaaattctcggattcggaaacgaattcggatattttttctcggaaacgaaaatgaatacagtaagggtactatccgtcaaaatcggaaaacggtcagaaactatccggaatttttttcagatatccgcagacattgagcaaattttagaaaaaacacgtatatacacataactttttcatacgaaatcagatggagacaaactttatatcaacattgtggagattatgattaccccatatctacatggcggttatattccagctggatatacggtaccaaatatagatagaatatctttatgaggactcgggttagattctaaacttgtatgtcaagaaaatacccgggatcctagtcggttacaattgtattttatctgtaattccatattccgttaggatatggactgtattctgtaatacggatcccttcccctatataaggaggggtccgggttcctctcgggatgattcttttttccagtttatacaatcaataacacactcggcggaatcatccccggacaggagtacggtattacttcttgaataagaaggcctgaacctgtataaaattccttgtctccaaacccatccactttcctagcttgatagccacccccttttattattgccgaaatcttgtttcgacagttggcgcgccaggtaggggtagcgtcaagttctcgccgactaagtgcga

SEQ ID NO: 38080 - DNA, 469 bp, Oryza sativa
ccccccccccccccccgcttctcctcggtgattgcagcggctgaggtcgactcccctgcctcgccgtgctcttcctcggcgagtacgtgcctgaccacacgctcgacgcagtccacgtcgtagagcgtcttcatgccgccggagtagctcgggatgagcacgtcctccagcgtggcgtgctccagctgcgtcgcggccttctgcccgagcgccgcgtccaacgcgagcaggatgtgcgccgtccacagctgcgcgaacaggaacttggcggtgacgacgcgccccgagcacttgtcggtggggacgctggtgaccaccgcctccaggaggtccctctgctccacctctgacgacgccggcgccgacgcaagccgccgcatcgacctcgatagggcggtgatggtgcccctggcgtacgacacgagacaactctccctagcctccgtcctcacatcggcgcgcgccgcca

SEQ ID NO: 38081 - DNA, 1501 bp, Oryza sativa
tagtgagtgtaaacatgttaagattaggcatgtcaaaacctataccgaataggtaaatggacatgaataatcatgctcgctttgcctctttgcccgccaaaactaaccggcatgtgaggtatactagacactactgtttttgtatgtactacagttagtgtctaattagtatgttacacaatgataatgtcgtttttatattaaaaccatgtttgttttacctaaagatgcattgtatttgctggttaattcctaagtagttttattaagagtaaaccgtactttggacaaggtttcttacataagttgcataatggattggatcttatcgtgtgctttcactttgggtcaggtttccttttttttttcctcattggaccaggttcatcttttggttgccaccagcccaccaagctggaggactacaattgtgtctctttccgacaacccaagacatatgtacttttctatggttttgcccatgaacatatccgtgaaacatgtagcacccgtggataatgggtatgagccaaatgattatggatatgtttagatccactgataaaatttttcaccctgtcatatcatatgtttcgatatatgtatggtgtattaaatataaacgaaaaaaaataactaattacacacattacgtgtaaattacgagacaaatcttttaaatctaattgttccatgatttgacaatgtggtgctacagtaaacatttgctaatgacggattaattaggcttaataaattcgtctcgcagtttataggcggattctctaatttgtttttgttattagactatatttaatactttaaatgtgtgtccgtatatcccatgtgacacggtaaaaattttcaccactaaaactaaacgcagcctatatttatttttctatcgtttttcccatgaccatatccgtaggacatatagcaccgtggataatgggtatgagcaaatgtttataaccgttctacatagtaggtggtatatccgtggacataaatttggctgtgtttagtttcttttaaagttgaaagtttaggttaaaattggtacaatgtgactgaaaagttatatatgtatgacagattgatgtgataaaaaaagttagaagtttgaattagatctaaacacagcctttatctcgttggtacaatgtagtactacaatggtacactgcatgtttctttcaaaaaagacagtacagagggagaaattcgagacggtttgggtgtttgactatttgggctggtccatcgctccgtccggcaaggtggccctgaacggtgggcccatcatgtgtcagcccactggcatcgacggcctgccagtgccggcctgccgggctgttcgctcccggcgcgtcgaaattccttgcgtgacgtgtcccccccttccggttttcttcaatctgtggtcacgccctctggaagccgagagcccgagaaggcggagaccccgggagcagaggggagagcagcgcagccgcca

SEQ ID NO: 38082 - DNA, 1501 bp, Oryza sativa
ggcaggaggcccttgacgccgagcgcctccacgaggaagtcgctcatgatcttgccgtcgcagaacctccccgtcggcgcgccgccggggaagtcctggccgtagggcgggtggtcggcgcgcaccgcggtgacgaggcggttgttgttgcccgcgtcgagcgtggagtccccgaaggcgaagacggccggtatgcgtcgcgcgctcccaccccgtgacacggcggcagcggccgcgtcgacggcgacgacgacgatgccgtggatggcggccagggagaagaggagggcggcgagcgttggcttgagcgccatgtgggcaacgtacgcatgcacgttccagctaagatggtgtacacgcacagtgcagttggtcgctcgtgtttatatatgctagtagcatcaactgctatcagcattggccgcttgtatttacgagcagcctgtcaactaactctttgtcattcttgcattgttcatcagccccagtcagataatggcacaagaggcgatgtgattggttttaaatgaccatgcatccatttaagcatgcatagaattcaggaaaagagataatctaatcagtaccattgagttttatttggttactagggtttgaaaaaaaaaagagataatccattccataacattgacaaaggatgaattctacaatataccaccgacaaaactgagttttataatatagcgttgaacaactagttttcttacttacataccattgccgctagtcaacggttagtttaattccgttaagagaaagaaaatgtccattttacctctagggtaccgtgcgtacgatcatggatttcattggtcacgatccactaattcttctcattgatgaaaaatagaaatcacttgtctttctatcatccaagattatttaattaggcatggcattgtgcaaaatctcaattttatcctaggggtaaaattgccatctttctcctttaatggtgtatgactaacggttgactaacgctgatggcatataaggaagaaaataagttgttccaaggtatattgtaaaaccgagctttgttagtgatatattgtagaacccgagctttgttgatggcatagaatggattgaataaaaaaatgatgaagagcatgcctatttggttccctcattttgtagtgttggataaaacacatactaacatactaactctagaaacaaggtagcaaaagacgcataaaggctcctatatactttctccgtcccataaaaaatcatctctatattaaagttcaggattggagggagttggaagtaaccagatgtgatctatcctgactccctgagtatgacaacgtttgttaaactgtgatcaggtataaatgggtgaaaagcgatcttaaaatcttaatagactcattacaccggtaatcatctataaatgggtcaaccagcctagcaaaaacccaactactgtatactacaactgtatgaaaacagtgttcattaaaccggtgat

SEQ ID NO: 38083 - DNA, 519 bp, Oryza sativa
atccaattaaccctttcaggaacgcttgggacgtatcggcgaggtatcttttttttatttaactgaaaatcgcgaaaatctgggatacgtatcgaagtgtatccaatatgtatccatatccatacacgtatccgatactgatacgccacttttgtgctgtatccaggtaacatagattatagataatcggattcgttgacatacctcagatgaacttattcctagggcaaattagtcccagccgaaactccacacagcccaactatcattcagcccaacccatcagtacaacgagaatgggcttcgcaaccacgcgcactatataacctacccacctgactcgccctctcccctttaaaccctacccgccaggctccgccttcggcttcggcttccgcgacgtcggcgagctcctcccgcgcgctccgagcccatcatggtgagttcctcgctctcgaactttcctccgttggtgatcccccgtgcatgtctccgtcggtgaccgcgtcgtttttccgc

SEQ ID NO: 38084 - DNA, 1501 bp, Oryza sativa
ccgtccgactttagctttcaaagcttcccacccccctcccttccgcccgactttagctttcaaagcgggactaaagatgtttttagtcccttccttaatattggaggatgcccttacagtgggtaatagtgtaggatgtcctcatcattcccacccctttaaataagggcccaggtggggttggctgaggcccatagtggaggatgtcctcatcattcccacccccttaaacaagggcccaggtggggttggtcgaggcccaataagtaataacttaaggttgctcggaccccaacagttcataggcacacccactcggggaaaggcccaatctccctaaaagactagtccaataggggaagggtggctctcctttttaaggtggcttcctccttccaagctaaacaagacgctttccaccccccctcccttccgcccgactttagctttcaaaatgggactaaagatgtctttagtcccttccttaatcccccttcttccttccaagctaagcaagatgcttcccacccccctcccttctgccctccttcaaagctaagcaagactaagctaagcaagacgcttcccacccccctcccttccttccgccctccttccaagctaagcaagacgcttcccaccccccctcctttccgcccgactttagctttcaaagcgggactatttagtcccttcccgcccctctcccttccgcccgactttagctttcaaagcgggactaaagatgtttttagtcccttccttaatagactttttcaaagcgggactaaagatgtttttaatcccttccttaatagactttagctcccttccgtccgactttagctttcaaagcgggactaaagatgtttttagtcccttccttaatagactttagctttcaaagcgggactaaagatgtttttagtcccttcccgccccccctcccttccgcccgactttagctttcaaagcgggactaaagatgtttttagtcccttcccgccccctcccttccgcccagcgggactaaagatgtttttagtcccttcccgcccgactttagctttcaaagcccccctcccttctgcccagcggaactaaagatgtttttagtcccttcccgccccctcccttccgcccagccgcccgaatttagatttcaaagcgggactaaagatgtttttggtcccttccgccccctcccttaaagatgtttttagtcccttcccgcccccctcccttccgctttttgaatagaaagttaatgtatctaaccaactattttacaggagtatctagttggcgaaggcgatttcagaataaaaaaaagtaaagtcaaaatcatttagaacttctaaaaggttctcgaaaaagaggtaattttttttgggcctgtattctttttctaggttcactaggattcttagctttctttttctaggttcactaggattcttagcggttggggcttccagttatcttggtaagaatattcaga

SEQ ID NO: 38085 - DNA, 482 bp, Oryza sativa
aaaaactcaaaatcccttatattatgggacggagggagtacctaacagcccattttcctcaacggtatcggcatgtaaagactatatgtcatcggcccaccagccgatcggctatcgtttacaagattaattattttattttccttgttggttgcaatatcaaaccaactagtacgcccttgaagaaagcgagattttggacttgcactagagttatgtagatctcttaggccactgtgtgttcttttgcatcaacagtagttaagtgtcgagatacgtggttaaagagatgagtacgatttagattcgacgacgagttaagacagtcaaagcggacttaatccgatttttaataaagatggactgggctggccaaaaacaaaaccagtcttcggctcacatcgcaataccaacacaccgcatcgcatatttttcctcacctttgctcaaaactccggaaagaaaccagacgaaaccctaag

SEQ ID NO: 38086 - DNA, 1501 bp, Oryza sativa
gtctcggtcttttcggttcggtctaattttgcccacccctaagcgcactcatcgccgacgcccacgctaacgacctcctacagccaccatcctcgcccgtgccataatactgttgcgcaagacagccacaatgcatcctccatggtgttgagctcctactcagccgtgtacagatccactcccaaggcaccaaatcaagagacatgagcactagagtcgtctcacgaccaaaatgccaatagatccagctaccacttacaacaagagccagttagcgccaccgtcaggaccccaacatggcttgctaccatgatcagggaagactatggggaggagactccatcgccgttatctttggctggcatgccctttgggtggcgtgctcctgtggttgtgaggtggagggtggggagggggagaaactggatacgggtgtgacagcaatagtccacctagatagtccggattataacaccatgttccgatcatctttcgagtctggctgtctctaaatccgatgaattgggtgtagtcgcacgttaccatttgatttacataagtggtattgggaaaagccacataagcaatttccttttcttggatcactctttttgtgtagccttcggtgaaagtaaaaaaaaaaagtggcccttagatgaaagttaaggttaccgcaaggctatgagatgcttatactgttataactcttttggaacagaattttcgaaggacttttccacgaattaaattagttcgtgtaaaaatccgttaaaaattatgcgttcctaagggtcaagactaaaaacaacgcattaggcatgtactagtagatgatttctgcaaactcaacagccaattgcaatgggaaaaaatattaataagctttcaatgcatcaattggtggcgcgggtgcactgttcaatgccgcctctgctcctcatgactgggagaaagtctttataaccgtgggaaggccggaaacatgcatgtacacacgacaagatttgcacttctcgtttttaatacagaaatgatgacgccataggcttccaaattatcaaacacaaatgatgtacgcaaaccagcccccaacataccaacgcgagaaacaacatgctatcaacaacggcgtcgtcgacaaaatgcggaggaaaatcaggtggagaaaaacaaatagaagaaaaaacgcacacggaacgctcaaatactataggccacttgtgcctcggctcacgttgacctgccttaggccaccgttctcaccggctggcaggctcgcgcgccattggttcatgccgatcacgtactatctcatcttcccactcaaattccacgtccaccaaccgccgcttcgcccttcgctgctgccgctgggctccaaactatttttaagcgcgtcccgcgtcgccagtgagccgcgtcgcgttgcacggattattgcaatcgatccaaacaatcacgtcggtcgacgagaagaagtgagtgatggcgtcgccgaccc

SEQ ID NO: 38087 - DNA, 187 bp, Oryza sativa
ggtacccatcattcccttaacatccagctccgcctcgcccattgtgttttcttcaaatccgccatactgagccgagtccggaatgttctcatcttctacttcatcttcttccattgcaaccccaacctctccgtgcgaggtccaacatttgtagctacgcatgaacccccattgaaacaggtgggca

SEQ ID NO: 38088 - DNA, 363 bp, Oryza sativa
tgcatttcctaatattttttttagtggttctcgttcaaaatttattctagcgttattagtactgtacatctattactgtactaatggctcattttaccaacaaaagttttacaatattgtttagtttaatcttgctgcaatgaaataaatttagcatgttgattttataactttcttttatttcttttgaaaccggttgttcaaaagtacaaaatttgtgaccttgtttccaactgtttcaacttatcctgcaagtttggcttaccttttactttgattttctaactttattcaaattaatccaaaaacttgtgctattaattggataaatgtcttaactccctcctttcacttgtctttaga

SEQ ID NO: 38089 - DNA, 360 bp, Oryza sativa
gtttggctaagcatccacatttgaggctatttttttacatatttttccctctagaaaatgtgatggaagatgatgagagagaaagtgtgtgtagggaataaagaagattataaatacttgtttgaataattaaatataattttgtatgaaattataaaactaagctaatttaatattaaaataagaaaaccatattaaatatttgtttataatgtaattaaaacatgaaaaatatgtacaatgaatttaatagtaatgattaattgtatgaataattatattcaattattgtattattatgtaattaccttgtaaatcttggattttgtataattacgatttatatgtatttcatataga

SEQ ID NO: 38090 - DNA, 269 bp, Oryza sativa
attgcaaaatgattaatgaaaaagatggagccaatgcattgtttaatatatgacatcgttgatttttagatttacatttgactatgcgtcttatataattcttttatgcaaacattttaaagaagttttaaagataaattaagttataaaataaaaaagaatgatgagacatatcttaaaaagttaatgatgttatatattaaaaaaccaaaattattaaataaaaggaaccctaaacttagaagcaaacgggcctttaaccggcagca

SEQ ID NO: 38091 - DNA, 1501 bp, Oryza sativa
gaactttactgcaaatttgttactaccaaggttgctggttgcagcattgagaatgtgtagttgtgtgcttgtggtcctctggagttcgaccgcaaatgctaggattctggtgaagtttcagaaccacggtccacccatgaaattggaattgccacttcgcccggaattatgggataatcacctaggattcctgcagcctgcaggagggattatactgttcctttctcgatgtcgcaacatgctgcgatgctattctactgtttttgcctcgacgctgtcagctcgtcggcactcgacacctcaacatggggccaaacgccaaacctagataccgcctgcatgcgctcatgtaatacgagttcctcaaaatggagaatttttaaaatggagcatcgataacagagtagtactactagtactcctatctgatgtggggctcacggaaacaaatctcgctttcttcgtgtgacgcaatgatgcgggctgtcagtttggtgactgttcttctgggagactgctcgttctttcgtacgactcgtcattatcaccgtgtctctcgtaagcaaatcccgtcttgagcgcctcaaagttagcaaacgcctcaccatctcaaatcaccctcacgatctcaatcacgttgcgccgcgtgctccgtttctgccttccgctttccatcgcgcacgcgcgcacgagcggacgccgctgccgcggcaaggaaggcgcgcgcgtcatcctccgcgaattttgttattcgctgccgctgccgctgccgcgcgcgcgggggtttccctcccagtcccatcccatgtgctcgtttcagcttcttctacctccgtttcacacgcgcgccctcgctcgccgccagcgccgccgccaccaccaccaccgccactgccactatactaatgccgagttgccgacacccccacttgccccgccgcgtcgctgcgctacagcgctagagcgagctagcacactagcagtgagccagtgagtgcccgatctgtagcgcacgcagccgcttacctaatctcgcaatccatccggttcggcgtgccaatagtacgcgatctgatccgcccttttcctccgtccctgagctgtactcgcgccaatcaatcatccccggcgcggggaaagcaagagaaaatctccgcacactacctctctgtcccgcgcgccgctggtcagagcgaatgagctcaaccgccgtcctcccgccgcctccatttctttagcggttgccaagggttcttgagctgtccttggtcaatgagagtgcaggaaggtggtggcgtaaggatcaaagctcacgaccccgcctcactgaaatccatgcaagcaacctggcctcctttggtggctagtagctctggatttcttatagctcatcttgttcagtagcagcagcagtgttgcgtacttgagcaagtgcaaggcttcttgcttggcacgctcaggtgtcccgtggtccggccattggagattttggagctcgtaa

SEQ ID NO: 38092 - DNA, 969 bp, Oryza sativa
atggatcgatctcggccgtccgttcccgtgaaccgccgccgtgcacccggtccaccgtaaaccctagccgctgacacaataaaccccgttttccttttcaaaaataattcattattgcgtcataattcaattaaaatccatataagtgttttaatccgattaaatcttcaaaaattcataactaattcatcttagctcggatttagttggttcaagtctctaaatttttctaaaattgagatctacatgttaaaaatatccacattactgttcgtgcttgtttatgtgctgttttggtgtttttgcttttttctgtttagattccgacgtttccagagagtccgttttcgcaggagaagaatttgaagagtttcaaggccagcaaggcaagtcacccagatcccaaacaaccctttgagcgtattgatcccgtttaaagctactgtttctattcaactattgcatttattttcgaatgtcattgggtggaattaacctattgtttgttatacccctttttgttattggttcctttattccttgataccttgggttattataacttgactagttgggctttatatattggttcagctagatattagatgtgattgcttagccatgcttagaaacattagcacactattgggataacttatgattcactattatttaaagatggcttaatgatagttcacgacggacaatcatgattggttaattaattaatgtgctaactaaaacctgataatggtgggttgtgagcacatggttttgagagtcgtgctcatggcaattaaggaccggttcacgagtttcggttgtgaaacattaaccgtgccaaccacaagccagcatgggcaacggctttatcttttatatagcatggttcattgcggggcaccagactgagaagtggcggagataagcccacgggggtcgctggggagtccataccttgtttataag

SEQ ID NO: 38093 - DNA, 394 bp, Oryza sativa
ttatggaaaaattccgcccaaatgttggccttccagagtttcctatgggatgcaatcagtgctgtgccaaaattttccccaatcccaccctcagggaccaatcacctaccaccagaaagtgagtgattttagttagttgcagattgggatttattgcattaggattttataataaattgagaaatacggtgtctgagcatgcggctgaggaagtgctttgcaccatatgataaaataaacacaaatacattaaaaggattgattttttttaggattactctcaggtgcattctatgcatagaatattatttgccagattttgctgaattcattagcaacgatgtagagaagtggtaattgaaaagcccaactaatccgtggttgtggttgtagg

SEQ ID NO: 38094 - DNA, 539 bp, Oryza sativa
gatcgtgctggtagacgcttggcctttgcagctgactgaaaggcaaaagcctgggcaaaggaatggtaacctattaaaataaatactcaaaaactagagaaggaaaaggttaaccagatagacaacccattcttgagttgttgagttcgtttgcacagtgtaaagaaccatttagttacagagatctaaccgtgtcctttttaaggaggatatttaccatttttctttaaaaagcatggatcatagccagtgaccacatgacctccaaccaaactcataaaattccatatatagacggcagaaaatatcaccaaagcataaataaataaatgcatctattgcaatagcttgctaataatacgagcacgggcactcaatgctatctaaattctacattttaagctaattgcactggactataacactgtattaatacagagcaacgctgttagcacagatttaaacacagtttacaatatccaatctgtatggcttgcatcagatgctcaaattaatattgttccaatttctccaataga

SEQ ID NO: 38095 - DNA, 187 bp, Oryza sativa
tcatctattatttctatattgcagtgtgcaaggcaatgttgtttgtgtatgcacgtaacaagagtgaaactaaggttgaatacaaagtgtggaacttctttcgttctaagctggcatccgctgaaggaaattgtggcctccttttttctgattctttttttattttgtgttctttttttcatgtagg

SEQ ID NO: 38096 - DNA, 1501 bp, Oryza sativa
ttcgaacaacgaacaacttcaactgaaatgctccgacaaacacaaccttcgtatgaattgatacacgtatattaatatataattttattgcgaataaccagagttccctaaatacatgtggcttcatatttaaaacaaattttcgagaaactattggagtttcagcctaaaagggaaacctgtccaaatacttgtgcatcagattgtgcatcagatgattctatattgcttaacaaactgtacaacagaaaataaactaatcctaacttttcaaaaaaaaagagaaataaattaatcctaaccgagcctttttttctgcagtcagtatagtcacggactcaattttccgtcagtagccttctttgcaatccaatgaatacattccgttagcatcgcgccggcgccccactatgcagtaccaaaacagctccctgatgggtatacacctgtagcgatgttctgtacgttgaatcgtgcgttattcgccatccccattcaccaatcgccacctgaacgtacgtgaatcgcaccgtccgaaatcaaagcccgtttcttctgacacagatctgtgggagcgcggatatataaaagtgtcagcgataggtggggtgcagctgtgatgtgagggctgggttagttactaactttttcttcaaattttcaaattttatatcacatcaaaatttttctacacacataaatttttaatattttcaaccacatcatttcaatttcaattaaactttcaaatttaacgtgaactatacacacactgagctttcagatctgcgttttagagcaggtacaatagcaggctataagccagctgcaaacatattttaagtagataaatgaggagaaagaagggcggtgggctacagatttatagccagctgcagtacggactctaagacgcagtgtctgtatgacaggtggaaccatatattaatagtgtagtatgtaaatattgtatgaataagctattagattagctatagataaattgaagctagtagttggccatactgttgaacttgctcttacgggggccttccgcacacgaagattggatgcggacaacagcacgagcatgctgtttcaggaatccatccgttccacagttcccagccgcgtcgctggcgtctccctcgcgtgcccacgttcgctcgcggatagggggcgcgtacgtgcgcctcgaacgacgtgtggacgcgatggaagatgcgttctgtaccggacacatgcacgcacgcggcccgtgccacacaaaaaccgtctcgggctttgggcgccgcgcgagctggtgggagtgggacaccgcgacgatcgatgcaggcgattcgcccgggccgttcgtgccgcctgggccgttcctgcggccgcgacggcgtctcctcccgctgccttgctcggctccaccgtagcagcggcagtagcaacgggggcggaggagcagtgaggtgcgcgaaggcagccgcgcagtcgatggaggccgtgaaga

SEQ ID NO: 38097 - DNA, 294 bp, Oryza sativa
atttaaaaaaatttagagactttaaccaactaaatccgagctaaaatgaattagttatgactttttgaagattaaatcggattaaaacacttatatggattttaattaaattatgacgcaataatgaattatttttgaaaaggaaaaaggaatttattgcgtcagcggctagggtttctcggtggaccgggcgcacgcgacggttcacgggaacggacggccgagatcgatcttatccaaaacggacggccgagatcgaccgatccacggccggaccacgagagacgacgacga

SEQ ID NO: 38098 - DNA, 1501 bp, Oryza sativa
tggcttggtctgtccttgtctggattgcggctgttcctgatgctacttctttaagccaaacggttgacctggcctcaccggcgtaccttcgaatttaattagacaacttgggatcagtgttactctgctgacgccttgcagctggccctttcaagtactaaccaacttgctgcactgggttgaatctttaagggaaacggcaacgaggtgaaccaaaactcatctctgcgacctaccccccttacagagagtagtcatactttcgcgtgaccgagaacctttgaactgttgtccttgaaaaaaatgaccaacatttctcggatttacagatgccctgactttgaagactgaaacttcatcggtccatcaaattgaagcaatggcgatgcactttcatcccgacaagatttggaacttaagccttagttgatgataggaaattccacataaaagtgactctcatttagctcatggacacactgactcttgactgcaacacactactgctggagttctttccgctactcttgaccttgcatcgagctttgcatctcccgcatcaatacatccatcatctaatcttggacaccaaatgttgatcacgagcagggttcttctggcactgggataccttgtagctttcaactgaaccattgattggtgactttaattgagcttatctctgacactgaccatccgctgccaggacggaagagaggtggaagagaggggttgctaaagataaggtcttaaaccgattgcctactgatctgttgtgagtagacttttattgttcaagttgcttaagcaaacaacctagtatggtcgcatccccaccaatgatgcaaaccatacccctacacacaagcaaacaacacacgacctagcagctaacgaaactactcttccaggaaggattgggtttaggtaaactccgggaaaactccacttgatcttcgcagaacgacgactctgaactgatcttctcgctccttgcacgaagcttgaggcttgacttgacttccgaacagacacgaagctgacggtttatcctccacggtttaacaactataagaattggagggacagggaggagaattttgaaaaaccgtttcgcaaagaaaagccgaagggcgaggggagacatttttcaaatagggttttcagaaagcttgtccttagggtttgaccatttggctcaacctacagtcaagttggctctgataccactttgtcacgcccagaaatttagcccaaatttccagactattttgtgtattaaatccctgtccaggaccagccagggtacacaaaacgacaagtaatatacagttccaaacgtaaataaagcgtaaaatacttacaaaagaggcacttagtcctcgcaccgaaacgaaaacagcagcagcggaaaaaggcgatcctagcggggcttcagctccactccacaggcaaaactcaactggggtctgagccttggtcctctaacttcgtcttcagc

SEQ ID NO: 38099 - DNA, 1501 bp, Oryza sativa
atcttcggctttggcatactcgttggctttttcgaacatttgcttaaccgtcctgggaggtttacgtccgaacttgccgactaggtcatcgtggcgaatgcctttggtaaaggcagcgatgatgacatcgtcggtgatgtcggagatcttattgcgttgctcggagaagcgtcggatgtagtctcgaagggattctccaggtttttgaacgatgttgtagagatcaaactgtgtgccggggcgttcaaaggtgccctggaagttggcgatgaagtgatcacgaagttccgcccatgatccaatcgtgccacggggtagaccgtggagccaggatcgggcggaatctactagggccacaggcagatagtttgccatggccttgctgcctcctcctactgcgcggattgcgagtccgtagacggtgagccaagactccggattggtggtgccgtcatacttttcaattccagtcggcttgaaactgactggccaatccactcgacgcaggtcattggtgaaggcagccactccatccacgtcgtcgtcgtagcgatcaggtgaatagcggtgacctcgtgctgcacggcgctggttgatcatgtcgcgaagatcgacgggatgctggtgaggcggagagtgaggccgttcgactcggcgttccctgtgacgttcgggaggcgagtgaacagatcgttcgccgtggtccctgctcctacgactggatcctgtgccgatgatgctgaggcttggttgatgataatcttgagatcgaagatgagggactcggcttccagtcggggtgcgggtacttgcagagttggccggaactgaggcagcgatcatagtcttcgtctggttcaagatgttgacaacatgatcagcttgattgagtgcgtcttccttgaggagggtgtcgaggagagtgattgctgcaaccgcgttctgctggggggtgcgaaaaaccgttgttccatcgatgtcctgttgcccaatgaggtctctcgctcgtcgcccggattccaaggcgcgctgtcgtcgatcttcagcctcctttgcaactcgctcgcgatcttgttgctcacgctgtagtcgttctcgctcttgtcgttgtcgttcttcctccagtcggcgacgttcagtctcttggcatgtgcgctcttggtccgcttctcgggcttggcgctgttcctccgtttcgttgtcagccatgaatacgccgaagaagaggggcatgtagttatcctcatagctatcgtcgaagttgtcgaggtcgccgtggtcatagtggtagccaaaatcgtcgtagtggaggatctcggttggtcgagaactgacgccgggggagctgaggtagccatccaactcttccgtcgagactgtcccgagaggttggagtataacgccaacctccctggatctagatcggatcggggccgaagccggagctcgcctagatcttcgagtgggagatgtcttgactgtgaagacagcggccaaatca

SEQ ID NO: 38100 - DNA, 1501 bp, Oryza sativa
tcagctgtagcgcccgtaggtgtagcataattttacaccatactctctccgttacataaaaagcaaacagaatgtgatattctagtacaacaaatctgaacaagatatatcatattctattctatgttttctataggacagagcgagaactctgtgtacccttttttctgttgtaggcaggtccagcaatgtatcagtacggcatgtctcaacaagaaaagtgaagtcagggatgacataaacaggggaactgtttagctatagtcactagtgacatgaaatactctgaaatcttatagcgccattgtttcgcttattcatatgtttactggaatcacttactggcaaataaaaaatcatctgtgggaaaagcttttatacacatatacttagtgactcaaaagcaattgctataaaataaagtacgatgaaaaaaacaaattcaaaattaagttctaaaattcaaattctggcttataagcatcagcataattaagccaaacaatgagtaaaacttttgtttgcaataacgtgatgttaataagaatttatagaagtattcaaattctctgaaatcttagcaccttttcaaacaaacacaacagctccttcctagccttgaagtgcggataccacagtagtggtataaacatatccttgatgtgcggacatccttggtacacggccgagatatacttttttttctccaaaaaaacaaaatctttacttaacacgggcggtcgatcggtctgtgctcgatcaactacagaaataccaacatgtaattgttatctggaattaagcttcagatttaacaacttggagttcttgacgtgcaaaacagtttgctcttttcatctccatctccccatcttttaaaaaaaaaattgagaactccatctccccatgttacctacgtttttgggccgggcagaatttatgagaagttgcatcagtgctgagatagacttcagagagctcccccaaaattaatctgctgatacactgagacccatttgactctcatggcgacagctagttatcctaattaatcaatcccggaattattgtccggaatgtgcttaacatccaccccagcagagtaaacaaatcaatggcggctaaaacaaaagcttatccttccaatctgctcgcagggtgttcgagcttgaaatcaagcccatactccctcatgcagagtcatgcagtgagacaatataatacacatgctcacatgcgacgccggattaataatttttcgatcgttaattattttctccttaattcctagctccaaagtcagcgagcctcgcatgctagctgagctgttcttgcatgtgttcttcccgcgctgtccgcgcagacaaaaaccctgcaaatttcttccggattccgaccactagtctgtcactagctagctctctgtccatctgatcgattcggatttgtgctataaatggacgtgcaatggagagcttagccattcagacaacggtagtgg

SEQ ID NO: 38101 - DNA, 1501 bp, Oryza sativa
gaagatcgaatccatcgattaccgagtgtttcacaagctagtggcgatttatcgtttccatcaattaatgtgtaaatattatgtcaatgatatagatcaaataatttatagccaaagatcttttatttcactataggtggcatagtttcattagaattgctagctaataaatctatatggtttaacgctagtcaataataaatgagagtttggatttatcgtatcaccttaatttctcattttgatttatttttatcttcaccttcatctttttattaacaaatttatgaccgtgtgtgtcttataacataagctagagatgtaatcaatttctattattaaaaatagatcaaataatatatataatgcgatgagcatacagaagagaatcacacttttctctctcaaaaaataagataatacgtaaacatggcaaatacaaccatacatcgtacaagacgcatcagagatgagaagctaattagttatttatttattttcaaagaacgagacagtattgatattaattagttcccacgcatcaaagtggaatctctgttgagtcttccatgcatttgtcacaaaagggatcaatgaaggttttgattcgatcgacacaaaaaaaaatgttttaaaaaaagttcaggaatgactagattttatgcaatttgcatattataaaacatcaaaggtcaactgtatagatgaatttatgcagtgacgaacataaactataataattataattaagacatgttttagatttcaattttttttttcaaacttatacttttccgtcacactgaactttcctacatataaactttcaacttttccgtcacatcatttaaatttcttcaaactttcaattttagcgtgtactaaacacagcctaagtaaaataaatcacacaaattaagtttactttatttttgcagagaattaagtgtagtcattagccgttgattaattagggaagcaactgtagcaaatagccaggtaggatacgaacctggccgaggttgaccgccgggaagcagctgcggaagcgcgccatgtgctcgcgctgcaacggcgcgccggacgacaccacctgccgcagccggagacgacgccgcgacggctcgccgtcgccggccgccgccgcgaccatcttcacgaccatcggcggcacgaccagaagcctcgtcaccccgtactcctccaccgccgccatcgtcttctccaccgagaacctgccggggaccaccaccgccgtggcgcccagcgccgccgtccccatcacgaacgacgagaagccgaacatgtggaacatgggcagcacgcagccgtacgcctcgtcgtggtcgtcgtactgctgcggcttctcgccgccgccgccgccgccaccccacgcgcgctccagcgacgcggccatggcgatcgcgttgccgtgcgtgctcaccacgcccttgctcctccccgtcgtccccgacgagtagaacagcagcgccgcgtcgtc

SEQ ID NO: 38102 - DNA, 1501 bp, Oryza sativa
agcaacagggatcagcttgccatccttgtcacgttcgccagggccaacagccaccactttaccagagttgagctggattcagcggaacattcagagttaaacaatcaacattagcaaggtgatgcaactagtgtaataaaacagtaacagtgtaactagcaatccagcatgattatataatccaaaagcgcaaataatagaaaaaatcaattctttacgagagactaatgacataggcataaccaaatttctgttactacaattgcaaaatgtattaacagtttgcggcctacaaaaacgcaatctgaccccgctaagcacaatcatgcatcattcgaacaagtaatttcaacaaattgttccctagccatcagcaccctaaacgaggcaatcgaaatcaaacattctaagcaagaacaccacgctcccaacttaacccccacgcgcgcgcgcatggaacaagatctaaacactcccctcccctcaccggatcgcatcacactcgcagccaactcgaagcagcaaggagaagcagcagtagcaccacgagagatcgagggggggaagaacagcgtgggggaaacctgcttggacgtctcagggaggaggatgccgccggcgctcttcttgggctgcaccagcttctccaccagcacgcggttcagcgacgggatcagccgcctcgccatcgccgccgccctcttcttcttcttcttgcgaagcaagcaaaaaagaccgagcaaaagttctacactcttcgatcgcctccgccgcgctcgtggggtttagggttttaaggtggaggcgacgcggcggcgaatttacgggcttgcccctctccagggccctctagaacgttccactcctactggaccggcccacctccacggcccatttcatttaagggaccagctaatacattttgtcataaaacttttttagaaaaaaattgatatatgtaaatataatacaatgtaattatttgtaaattgtatgtatataattataatacaaattgtatgtaacttttcaaagatcctgtgataagtgatacgtagtagcatactatttccatgaagcgtgtatgtcttgtaagttgtgacggaataccctcacctatacgcgcactgtcatttcttccttgcttgcttgtataaaccttgaaacaaatttaacgattttataattatataaaagttacatataatttttatataatataattacactatgattataatatatttacatgtgtgaattgtttagaaaaaaaattgcgacaaatataggaaatcactatatagcaaaatcgtcatttaatgcctattacttagttggcccttgtgtaatcgagtttgggcccaacttgattatgagcccatgactctggcctttgtatagcccacgagcgaataaagggtttgggtcgccgactcgccgccgccgccgccacgtccacttcagttgcagtcaccggcggcgatggcggactccggcagcg

SEQ ID NO: 38103 - DNA, 1501 bp, Oryza sativa
gaacttgccgcagaaccctgccgccagctcgctgcatcccaccgctcctcccctgagagctggcccaggccacctccgtcccgccacccgccggcctcctcgccaagttcgaccaaaggagaatccggactggacagtgtcacttcggccgcctgagcttcccctgctgaccagcagccgcctcaacccaaccgaaactccccacaaagaaggggaggagttcaagaagggagagggtgctgactggcaacaaggaagacgacgcaccgccgccagctcccatgagcactgacactagacctgcaacgccgaatccggccgccgcccgaggtctccagcgccaccacctgacttatctacttctcctgttcctacttctcgacgaatgattcaacagtcctcaaccctaaactcgtgcaagaactcagggtagttcgttatcaacctccctcttatgcaagaatttcctcaccaactctctctccttagcctccagattcctgcgaactctctctccctcttatgcagcttcttcttggcccacttcactgcctctgctcttccatggaggaggggaactagcctttatgccagttgccaaatgtgtatggtgtgcttcgacacaaataacttactcccttcgtttctaaatatttgacaccgttgacttttttaaacatgtttaaccgtttgtcttattcaaaaattttaaataattattaattcttttcatatcatttgatttactgttaaatatacttttatgtatacatatagttttacatattttacaaaagtttttttaataagatgaacggtcaaacatgtgctaaaaagtcaacgctgtcaaatatttagaaacagagggagtagtaaataaatattgtctcagaaactcatggaataaaccaagtgggcattgagcacgtcgatggttcctgctcccgcaatatcggtacttgaattttttttttcatttttaaatttttattttttaatatttatagaaatattgcaccagcgaaaatatttacagaaatagaccctactgccctcggcagggtgacgtgagggacagacaagttgaaaaaaaaactagaaaaatgcatttttggcagggcgaaaattgtatttacccccttgcagcccttgtagagggtacaagggcggcaagggacctaagtgtaaaatgcgcacaccttgccgccctccacttgggcggcaggggccatttgtgtaaatattttggatggtataatatttatgtaaatattaaaaaaattaaaattaaaaatgaaaaaaattcatctgtacttaagcttggtttcgtgcccattttattgtgtcctttctgggcctagcccagaagaggcccaagacctgagaggtttattttgggccggaatctgaaacagagttggacccgataatccagcaagcgactgcgccgcgtagacgtcggctccgtctgggttggactcgccgtcgtcgtctcgtctcg

SEQ ID NO: 38104 - DNA, 1501 bp, Oryza sativa
tgagaatcatgcccgagcataaattattactccctccattccaaattgatttacatatagtttttaagtttattcctaaatgatctacatatttgtgttcatttagtagagtctattcgttatttgtgtattggagtaaatggacattgatgcatgcatccatacacacaagtatttataacccatatgcaatatcttgatttgctattggctaggaaatattggggatggtgcatgcattgagtttgttgctagagtaaatataacatgagagaattattaatttttcttggtcttagtgtacctatgaaatatgtagatcaatttagaatggagggagtataaattaatttgagctgttgaaaatcatgcccgggcataaattaattagagctagctgttgaaaagcatgccccgttatgtattttggttattgtgcatgactgcattttagatttgccttgaatggatatgtttatgctctcttggactctatttgatcgtttagagagttgtctttggagcctggtgttgatcttgatttcatctataattctgtttcaaaaatatttttttcctctttgttcgagtattagattgtaacaattggctgtaactctgttgagtaaagaccgggatgttatctattccattattaaaaaaataatccagaaatagcaggggaagcccactgctccattttcatgaaaccggaaaatagagtttgttgcagagagtggtcgttcgccacgacttgacctcctccgccaacgaaatgtattcgccaattacgcatactagttcatatgctacagatcgatctgagacgtccaccgcctgatctgatcaagaaagaatgtgaagtattcgccaattatgcatagttcatacggtacagatcgatctgagccgtccactgcctgatctgatcgggaaagaagattgctcgagtggccttaccagaaaatcaggctatcgtcagacacaagccactaccagcgacaatacaacccatagcaattcaaaataagcagaacaggagatctatttatattgttaaaaaaaaatgaataggcgagcaattgcaatacaaccaaccgcatacgaattgtctgtatcccacaacaaatggtagtgcgcaatagcaccaatgagcgtgcctggtgattttctcaaatgtgactagaattggaccacagaatatgctgaaaagccagctcattactagattcatacagcacgaacaatgagattgagacattgaggtggataattttcatggtgtgtaggagagcagctctcatcatcacttccgagaggcctggagtctatatttgttttcagttcccacagtttgaaataagtccaaagtcatgcggataccagcaaggaactcctgcaaatgcaaaagggagttcagacttcaaaggtttcaagaaaccaaattacaatgacaaatggacaacactgattgttaattcagggcctcaggggtaatgaa

SEQ ID NO: 38105 - DNA, 987 bp, Oryza sativa
ttttaacatgaggcaatatgatgaaaagaggttactgggtcccaaaattttggtttttagtgtttctcaaacgtctcatagcaaaagtagccaaacatgcatgcatactgtggcttgtgcatttgatcctacacagactctaggaggtgtagcaactaactttcctacacacaaacttgttttaaaggaaggtagtgttgttatgcttctacgaaatttgaaccaatcaataggcctttgtaatggaacaagactattacttattgctttaggcgaaacaattttacaatgtactatactaactggatcaaacatcggtgaaacagtttatatactaagaattacactaagcacatcgaaaatgaaatggccttttgcattacaaaggagacaattcccagttcgagtttgttatgcaatgactatcaacaacagccaaggacaaacacttgagcaggttggcatataccttaggaaacctgtctttacgcatgggcaactctatgttgctatttcaagagcaacaaaccgatcaggcctcaaaatactgattgaaaacgatgacgggtcaagtggaaaccaaacaagaaatgttgtttataccgagatactttctgctacaatggaagcggtgtgccctcgctgccgctctgcatattttatctctatgtttacctacattcttggtgtcacagtggacgttctttcctattgcaggcttcaccactccatgtgtagcatgctttccctcatcagctaattgcaatggcttttgtgctcacatgtagtatatgcaatgtagtataaatcttggagtatatatattgtgctcacatgtagtatatgctgtagcactggtgcaccaacagactactagatttccatgtgctattttctcactgcttagttcattacattgatgctttatatatacgtaaaactaaatatcttcaatatttaattacaggcttccaatggtatacgtgc

SEQ ID NO: 38106 - DNA, 1501 bp, Oryza sativa
gataaaagagatggttctccatttcgaggacctttggagggggaatatactgaagagcgatcccatgggaccaatctccagtattcagatgcaaactgtacctccgttgtacagatcatttttcagataagaaaagcaggatgccatggaaatttatatctgaatagcatggttttcttagctacagcgtacatgacatgattcagccacatgattaatcaaacaattgcctgcttttatttttgctagggaaaaaaatgcctacattgacctatgtatacaagagagttcttatcaatggtgacggtctctctttttttttttatctttatttcgtagtggaattggattctcgaaactatgtcttatgtcttaaatatgtagttttgtgatactttatattaatgtgtactccatccatctctaaaacaataaccttttagctatggccactgtccaagttcatagctgaaaatacacttttttagagacgaaacaggtagtttcgtaataaatttggtgttaaatttatagttatgttatacactgtcttgaatttataaatttacaatagtttaatcaaatggtttttctgtttcacttgcgatagctttttttggctcctatctttcattttttcatccacaggatcttgcatcaagatttgttacactcacaccgaaaaatttatagttacatgtttgtttttttatttgtttatttcatttaatacgggccctattcattggttaaaaattctataatatttgaagctataaatctgacgaaagattaataggttagtcccatcatttgaatgtacctttgtaaaatgtacatactcaataccgaagactaattttgatgcatctaaacaacttggaattggacacagtaccgataaatagatgaatttcccaactaaagctggcgactttactgttatgtatcttaaatcgaagcccctaacacattccaaaattggagattctcagctgaaaggctatctagcgggcatccgcatggctgcccccacaagcatacatgctggagtggaccactcacatgtactgtcagcatatcctacgttctctcctgtatcctcccgtgcatcggacctcggttgacaagcagttcgtttgcacaaaaaatcgcaaagaagtttaagaaatcaatgaaagacttaacaagaggttaaggaagaacaaactgtatgtatccctccatagtctaaccatgggccagagttgccctggttgacccggaaaccggctacggctccccacatttcgtccccacctcgcatcggttcaagcgcgcgtcatcacgactcgcgagagctcgtctcaaaccaataattaaactcacaaatcgccatctcggcgcggctattaaacgcccatcacaacgtagctagccggccacttcgcgttccatcgctcgctcgctctctcgctttgcttcgagctgagaatgcacctaaggatggcgtcgccgccgc

SEQ ID NO: 38107 - DNA, 387 bp, Oryza sativa
ttccctgcttggtagattgatctcggttttgtatatttcacctgtgctaatatctaggtataaggtggtatcggactactagctgatacatgttaggtttgccctatcggctatgctgcgagcatacataatccctactgtggggcacatttagatactgagtgatttatactgtctcggcataatgtccgatctatcccaatcactcgatctaagcacgttccattggatggattacgtatcatctacagccgatcgagtaggcctaataatctctaagttttatctacctttgctgatctgatgcaagttatatcagcttgcctttgctgatctatcgttgatggatttaactctttgtcttttttctatcttgttggttgcagg

SEQ ID NO: 38108 - DNA, 166 bp, Oryza sativa
attcctgcaccccttattgtctaaagttgattggagttagtatgattgaacatttaaacggtgctgcaaggtaatattgtgtgtatgattttagaatcaccttactgtgtaagttaatgggatatatatgactcagcttgttatttatgcttgtttctttcccaga

SEQ ID NO: 38109 - DNA, 1112 bp, Oryza sativa
gcttttcaggggttgatagcaccgatcaaagaaaagttttcggctcaagattttgagagtttatcacatctcacacaaaaggtgactcttcatgagcagaggtttgctaaggccaagaagaacttcaaaaagattaatcatgtatatccttacatgtatggttctgatgatgaagacgatgattccgaggtggcggcagccgaatgggtcaagagcaagaaagtaataccatgccaatgggtgaaaagttctggaaaagaggaaaaatttgacttcgacatcaccaaggatgacaagattttcgacctattgcttcgagaaaaacaaattcagcttccggctggtcatgtgatcccatcagccgaagagctgggcaaaagaaggtattgcaagtggcataattctagttcctattcaactaataattgcaaggtttttaggcagcaaatccaggcagccattgaagggggaaagatcaaatttgatgattcaaagaagcagatgaaggttgatggtaatcctttccctattaataaggtgcatacatctagaaggacagccgatggggggatgaatagaaattttcacatgaattcgactaggattatcaacaaataccaaagaaagtatgataaacagcatgagaaatatcatgaaaaagatgatggttttgaccctcattgggattgtgagtttttcagattttgctggaatgaaggtatgaggttgccatcgattgagaattgccctggatgcagtgaagatacagggagttcaagccgatcctataatagaggtaatcggccaaatcagaagagagtacctgttcatcaaaggctgggcctggtaaatcaagatcattatcaagataaagatgaaaataggaatacacagtggtgtacctacaggcattttcaccaagaatcaaaagagaagggttcaaaggttgaggaacagggagcaatttcagagggtgcatcaagagattaatcatcggctgaggaaaacaaagactaagcaagaatggcgtgttaaaagtacagttgtatcagccgatgaggtcgaagccgaaaaggcaaaaagggtgctcaaaggcaaggctcttgcatcgg

SEQ ID NO: 38110 - DNA, 1501 bp, Oryza sativa
ggtgacgtgcgcctggtcgcgcgcggagcgggcggcggtgtaggatccccgaatcacaagaactaagccaaccagagggggggtgaatggttggtatacccaaaaaccgaaaacttttagcggaaataaaagttaccctcaaaatcgacggagatcggtctgaccgaagttgccttgccagtctgaccgctcggatgtcgtcggtctgaccggtatagatcaaccggtctgaccgctgaagctgcttgccgcgcctgtcgtcacctccggtctgaccgccgtgcacccgccggtctgaccgccgcttgccgccggtctgaccgccggtagatcgccggttagaccgccgaaacccggtgaaacacaaattgaagaactcttaaagtagatgacgactttattgattctctctgtgtttacaaagtgcaccaacagcactccttacaaaaatttcgactaaactcgaaaccctaactctaaactcaactcaattgctctctaaagcgataccgggaagcctcacgctccccctctatttatacatgaggtaggcagcctaaagccacgaaccaaactcatactaagagtcctaaacaccttaggaaaccctctagtacaagaaagaaactttacataaccaatcgtaccaaatttggactccttccaaattcgactccgcatcccatacgcacacaacacctccatcgtatgccatataaaatctccatcaaccacgtgcatcaactctagcctaagtatcccgcatgatctctgaccatcacggacgtcgtcttatccccaagccgactcccggtccatcaccgcaaatactctcccaagacatcgagtcacctacacatgaaacaaacaaagaaaccatattccgataccaagctatctccaacttgactcattagcagcaaacaatagtattacatacgtatagtatccatctagaagccataatcatgaaataaactcggatatccaaataaacaacccgaaaccgaaaccgacacagtgtcggccagtcagaccgcgggctgcgccagtctgaccgcgcattacacaccagtctgaccggcacacactgcccggtctgaccggtcacatgaaataacgatcctgcgattcacctgtaaatccaatcatctccaaaaccacttcgtgaataaattccaaataacaaaaccaataatctccaatgtccaattgttcgtcacagaataataaccaaaaacacctttaattttacaggcggaagaccgcggcggagtggccgcggagggagcagcgaaacgacgaggaagaactcaccgcggcggcggcggtgaggcagtgggaggagaagtcggcggtggcggcggcgacgtggaccacgcacttgtgcacgcttgccatggcaaatggcaatgatgccatctccgttgctttatatgcttgcagcgcgcgagcccacgagagaaaccggaagtctcttttgagcttgcaacgcacgcac

SEQ ID NO: 38111 - DNA, 1501 bp, Oryza sativa
atttctgggacatttttctgaaagcaatatgaccgctattttagatagcatgcacatgttccatttatatttttctaattatatgcgcaaatgtaggttataactgttccatttataattttccaagtgtatacaattaggctgtgtttttctcttaattttttcaacctccattccctcatttttttcgcacatacgttcaaactattaaaggtacgctttcttaaaaaataagaaaaatattttaagctaatatttaattaatcatattctaatcgttcactcagttttgccctgtataagaaatccatgccttactcaagattacagtaacaaattgtacaacaacaaaaacacatgcgttcctggaaaaatcaattcgcatgattgaattcgttaacatgtactcaagtataataatatgtcaacgttactgttcctcgattgatactttgtcaaaatcaaaccagataggataaacacatacgcaagcaggaaaatacatacacaagtagtatgtactcgtccgttccataaaacccaatccagttaggaatagaacattagatatccaacgattcgttgtactaggcaatgtcgcatccccaattaatttagttttttttgacggagggagtagatgatacacaggagatggagaaacacatgaagtgagtttagcttaacttattacgattatggctgtgtttagtttctgaaattgaggagaagttcagggaaagttgttattttgggaaaaaagttgggagtttatgtgagtaggaaagttttggatgtgatggaaaattgggagtttgggagaagtttgatgtgaactaaacaggacctatgattaaattctttgtgagaaattagtctaatagtaaattcgtactaaacttgacacagacgtttgtatttatgtctaattattttttagaggtagcctggtaggcgagatatatcagattagtcttccagagggcatatagaggtagcctggtaggcgagatatatcatattagtcttccagagggcatatagagatagggtgtgggtgtccgcatcacatgggtgtgagtgtgagcggtttgcatgttctttctagacaaatttaggagaaaacttcgtgtgcacgtaagtataatcacactcccggcagctcgccagacgagccgagcctctcactgacaactgggcccgctaaatctactcctgtaactccgctaagtccacacggacacgggcaaacgaagcgccaacacacacacgcacacgtagacgaatacggactcggggcacccgcggcctccccctcaaacacacgaccacgaccagtcgaccaccacgtcctcctccccccctcctccctcctccggttgcctctccggcctcgccaccgccatcgccttcgcctccccgcctcccaaccgccccacgttgcggggagacagctcgccgcgggcggcgatcatggcggcggcggaggtgtactcgccga

SEQ ID NO: 38112 - DNA, 217 bp, Oryza sativa
ccattgatgaggtcatcatgacgtcatcatcgtttttctttttcctgtttttctaatagattaaatcttcggaaattcataactaaatcatcgtaactcggttttgagtggttcaagttgctaaattcatctaaaatcatgatctacatgtttgtttactttatatgtactgtttatttggtttttattagtctttttcttcgttttgcgtgttagc

SEQ ID NO: 38113 - DNA, 1501 bp, Oryza sativa; identical to SEQ ID NO: 31048

SEQ ID NO: 38114 - DNA, 1501 bp, Oryza sativa
gatggtagatgctatgctatgaccttaattcatgatcatcaagctaaaaaggagtggagatactaatttagtatccagtaacagctgattctgtaaatgaagccggttgaatagaacagcgctgttctacatagacttcttcaccaaaatgacaaccatactgagcagtataatgctcaaccaactatgctttttttttttttgcctctaaactaggctatcttagcagtggtttcaggcttccagccaagaaaatttcacccagaacagactagctaagtagaaattaaccatattttgcatcacaattgggcataatagagcagctttctggaaccatttccacatcaaagataactatacctctacacttagcaagaaagaacgagtaggagcaggaggtactaactggaagcagcgcggaggcagaggaggtggagcacttgcgagccgaaggtgaacgtagtcgtctcgtagcttccctcccagatcgacgaaccccagcaacaaatcgggacaaagcttcagcacacaagcaagccgatgcagctcgaccaaacaaaaatcagcagagagcgaaccagcgaagcacacctgcggtcgacgaagaacgacgggtccagacagacgacgtcgtcttcttcctcctcctcccttcccttcttcccttcctctcgccgctcgctcgcgctgccggagtccgccatcgccgccggtgactgcaactgaagtggacgtggcggcggcggcggcgagtcggcgacccaaaccctttattcgctcgtgggctatacaaaggccagagtcatgggctcataatcaagttgggcccaaactcgattacacaagggccaactaagtaataggcattaaatgacgattttgctatatagtgatttcctatatttgtcgcaattttttttctaaacaattcacacatgtaaatatattataatcatagtgtaattatattatataaaaattatatgtaacttttatataattataaaatcgttaaatttgtttcaaggtttatacaagcaagcaaggaagaaatgacagtgcgcgtataggtgagggtattccgtcacaacttacaagacatacacgcttcatggaaatagtatgctactacgtatcacttatcacaggatctttgaaaagttacatacaatttgtattataattatatacatacaatttacaaataattacattgtattatatttacatatatcaatttttttctaaaaaagttttatgacaaaatgtattagctggtcccttaaatgaaatgggccgtggaggtgggccggtccagtaggagtggaacgttctagagggccctggagaggggcaagcccgtaaattcgccgccgcgtcgcctccaccttaaaaccctaaaccccacgagcgcggcggaggcgatcgaagagtgtagaacttttgctcggtcttttttgcttgcttcgcaagaagaagaagaagagggcggcggcga

SEQ ID NO: 38115 - DNA, 1501 bp, Oryza sativa
ttgcgatgaaattcagtaaacgttaacgcatctgaagagcctcttcctttttaatctgctctgtcttctatgcatgtttgtgttctctgtgtgctggttggatatgtgtcgctgtgacccgagcttaatgcggagagatcgataagcggatgtgactatgattccctcgttaaatagttgattgattgaattatataaccgctttcatcccatttgattggggaaataaatcgcgctcatcgctcatctatcttggatgaaatagttgattgaaccctcttcacctcttatgcttcaggctgttgaagtcgtgaattatcgcatgcaactttgctgtaacaaatgtcatttcaaaccaggatttaacttaaattacaatatagtataaatcacggatgtagtaaactaggatatgtccatatcccatcaggctctaggttgctatattctgagacggaaggttctaggttgctatattctaagacggaaggagtatgtggttttgtcatcttttggaactatatttttcaccattctcattgtaataaagtttggcagaacagacaaatatacttctagaacagtttcaggcattttcattctcatgaaagctgacataaatccaatcacaaaaaaaccgatcagttgattggaactgtcgtctgttcgggaggatgtaataatctgaaataatgcggctagctcatgtctattgatattatcgtctatcacaattagcagaatcatacaagaaccagcaatcagaattatcaacagcgccagcacgccgcgcctcaataaaatccctcagtttggcgtctgcagatctttgaacaatatctggctataattcatgatcgtttctcataggcattcagaaatctttgagcagcatctaggttcagctctttgtaaacctggcacagagaacaatatcgtgagatctcaaggcagttttgcgtggtggtggttattgaagtgatggctgggagtcaagtccatacaagtttcttatgggcttcttcaaatgtcttgcagaacaactctgcctttgttgctccaacctgagacagtaaccaataacatattagtgcgcaatcagatcggcctgtttcaaggagagatgccactgagcactcaacagcgccattccctcttaaccaacaaaatatgtaccatacagcctcaaaaaacagtgcatgtaggatgtagcttacagatgtactatttatatttaccagctttaattgatggacacctcaaatttttcaaaaaaaaaaaaatccaggacagccatgctcacgatcattttgccaaatatttaaaatctcttaccaaagttcttaaccgcataacagcagacttttatgacaaatcgcatccaaggagatctttgatttattccttactggtttacttattcatataaccgacacatgatattaaacaatctttttgaaacttccatattatactgagcaggtagttttgtgaaacaaag

SEQ ID NO: 38116 - DNA, 1501 bp, Oryza sativa
ccaaaaatgcatttttctagtttttttttcaacttgtctgtccctcacgtcaccctgccgagggcagtagggtctatttctgtaaatattttcgctggtgcaatatttctataaatattaaaaaataaaaatttaaaaatgaaaaaaaaaattcaagtaccgatattgcgggagcaggaaccatcgacgtgctcaatgcccacttggtttattccatgagtttctgagacaatatttatttactactccctctgtttctaaatatttgacagcgttgactttttagcacatgtttgaccgttcatcttattaaaaaaacttttgtaaaatatgtaaaactatatgtatacataaaagtatatttaacagtaaatcaaatgatatgaaaagaattaataattatttaaaatttttgaataagacaaacggttaaacatgtttaaaaaagtcaacggtgtcaaatatttagaaacgaagggagtaagttatttgtgtcgaagcacaccatacacatttggcaactggcataaaggctagttcccctcctccatggaagagcagaggcagtgaagtgggccaagaagaagctgcataagagggagagagagttcgcaggaatctggaggctaaggagagagagttggtgaggaaattcttgcataagagggaggttgataacgaactaccctgagttcttgcacgagtttagggttgaggactgttgaatcattcgtcgagaagtaggaacaggagaagtagataagtcaggtggtggcgctggagacctcgggcggcggccggattcggcgttgcaggtctagtgtcagtgctcatgggagctggcggcggtgcgtcgtcttccttgttgccagtcagcaccctctcccttcttgaactcctccccttctttgtggggagtttcggttgggttgaggcggctgctggtcagcaggggaagctcaggcggccgaagtgacactgtccagtccggattctcctttggtcgaacttggcgaggaggccggcgggtggcgggacggaggtggcctgggccagctctcaggggaggagcggtgggatgcagcgagctggcggcagggttctgcggcaagttcagaagtcaaccagcagagaggcgctggtgcggtcttggtggaagccacgcgctgccaatgcttgtgtggtggttactgagttggtgggcgacaaactacttgagaggttctaggggttccaggcgaaagcctcactcggtgatcaccgggccggcaacggctacaccttcgagtgtcgtaaccctcttgggggcgctgtcgtgggtacctctccccctttcttggcgagttctctttgggtggaaaccacatctttcttagatgggcgatagcggcgtccttgatgtcgtgacctccatgggggcatcgtttttggagtcttgcctttgtggtgttgttgtaggccgggcggcgatcagccatgcttaggggggtcattttggtgc

SEQ ID NO: 38117 - DNA, 1501 bp, Oryza sativa
ctctgtagtcctggtgcggatgatcggcagacggcagctgcagaatgcgtgcacgttgtaaaagctttagatttttgtttttgttgatgcaaagcaagcaggatccaagactccagttccctgcagtccgtagatgactgcaacataatcagtcacgttaagtttgagcgatttggaactcttagccaatcatgtgggtaagccaatatttcacttcaaattttaagcccgtatccgaagttcccaacaagggagcctattactaatccttccgtcctaaaatataagtatttttagactttgacatagtctatgagatgctattttgaccaataatatctataaaagtaatatgttttaaataaaaagagttacattaatgataaatttagtaacatcaattttacatgattgatcctttttattcttttgctattaatagtcaaagttacaaatatttgacttgatactatgctaaaaatacttatattttaggacggatggagtactgtttaatcgtttgaaacataaagaaaaaaattcaatcgaattttggacggccgtgatcactctagaattcgcgcaacaggctgggcccataaaaacctgggcccaaatctcaataggccgcgaggcctctgtgatgatcgggccggatccaggcccataaaaaacctgggccaaaagctgtttgacctcctctccctctctctctctctcacacagttacctctcacctcggcggcgggcggcggccggcggcgaggtccggacagcggagggagcaagcggggaggacgaggcatggggaccctggggcgggcgatctacacggcggggaagtggatccgcggcacggggcaggccatggaccgcctcggatccaccatccagggcggcctccgcgtcgacgagcagcgtaagcagcagcagccgccgtctctctctctgacaatttggcagttgttattgggaagaaattggtaggaatggatagggggtgactggattcgaggagtctcgaaatgagcctaaattatcgtcggttatttgtgaagttctgcattccaggttttcaactagtgatcgatctcgtgtgtgaaaactgcagcaagtaaatcaaggattgcgcatattggttattgcggtcatactgcccattgtgggagtgtcacattggcaatttggcatgccaattttcgagtggttatgcatctattttctgttgcgtagcatcatgaagaatgtcatttgttccaccttctagttaggtgtggtgctgtagttggtgttgattgatttccaccatgctgcatcttgtagagggccttgaattagcataaattggacattgtatcaaaaaggttttggtattatgtctagataggtcattttagaataaccacgagctaatgaatttagcaaggtacataaactttatggttgagcctgactatcatgttaccgttttgtatgcccttgtcagtgccaaggcatcgca

SEQ ID NO: 38118 - DNA, 1501 bp, Oryza sativa
tctgaaatcagaatccatatttgagttcattcctctgctcttctgttcagtgatctactctcatcttggaataacactgaaaattgcatttcctctttcttataacagatcatttcatccgtatcagacggctttaatttaaacggtatgaattttgcgtctgggcacctgaacgacgaacaaaagaaaactgcagaaaataagctgaaagagagagatcaaaggggagtcggagtttcatcctccgaaccccaccgttttatgctctagttgtgttttgggcttttggcagtgttagctctgttcttgccatggatttccagatgccgcaattgactgatgaacttgcggcgcaggcgcagccacgactgactggacaggttcagcacctaaacagccactgtcctctaacaattccgagttcaattttctactaaagcaatttcttactagtacttccactgtttgaggacaaattttttttctctcccatttatcccaaaataaggcctcagttcttttttctcaattccaaacttcaactttcccgtttaccgttagcacaccgaaatttgtgaaaaatactccctctgtcccattttaagtgcaaccataagttttcgcgcttaactttgatcgtccgttttatttgaaaaatttttataattaatatttttgtagttataagatgataaaatatgaatagcactttactcgtgacttatgttttcaattttttttaagaaaatttaaataatacggacgatcaaagttggacgtaaaaaatcatggctacactgaaaatgggacggaggaagtaaagaataaatgtattaggagtagataaataactgtattaggatttgatgaagcgatgattattttaaattttcttttggttttggttttgtattgatacatgtgaaatggatggaaaaatattttttttttggaacgtgtcccatcgccgacagcgacacgttagtacaatcactgtactcctcatttacgggacggcgataacgtgcccatttcggaaacagcgttgcgtgatcacgactcacaaatccacaccgaaaaagcgagagaagaaaacgagagtgttcgtcaagctcgcgaatgggagggaagatgggcaaggacgtggccgccggcggcgagagcaaccgccgcccgccgccgccgccgcctatgccgctgggcctgaggctccagctgatcgggctctcggcggcgatcgacgcggtggagcggcgcgacgggacggtcaaccgcgcgctctactccgtcctcgtcgaacacctgatgagcgtccgcgccgacccgtccccggacgccgccaccggcgccgtccgctccttcgacttcaccatcgacgccgcgcgcggcctctgggcgcgcgtgttcgcgcccgcggcggcggcgcaggcggcggcgccgatgccggtgatggtgtactaccacggcggcgggttcgcgctgttctcgccggcggtggcgc

SEQ ID NO: 38119 - DNA, 1501 bp, Oryza sativa
ctcgcaacaatggacttaataaccagatttccattgatcttcacatgcttcccattcctcggcaaatataacaaagctggcagcgtttcgcttccattctgaggtaccttcggatcaacaccatttgagacactattttgtggcccttcaacagccagaattctcccatgatgtgacggaacaatcgcagcgccttccccagtgtacgctgcaccatacatccgatttaccgcaggaaccaaacacccgcagaccatcatcaagaacagcaatccaagcaggctaacacctgcaaccttcttggtcttccgggccttcttggccggtggctccggtgtggacgcaggctgctgcgtcttgagccggggtatcggcacaagcggcacctgcgagccacgcattgcgtaggctgggtggatccatggcatcggcaatgggtaaaccgcagggtacatgggcattggcggcggtggcgcggcggcaccagcaccggcggcgccacccaattgctgcttgagggcggcgttctcggccgtgacgcaggagatcctggcggtgaggtcggcgatggtggcctgcatcaccttcaccttcccctccagctcctccacgtactgcttcttcctctgccgcgactggtgcgcgctctcccggttgcgcaccagccgcgcgcgccgcttcgcctcatcatccttcccatccttgccgccgccgccgtcactcccgctcctcgacggcgacgacgaatccgcggactcctcgttcttggaacccccgtcgccggccgacgacgtccccgcttccggcgatccggcggccgaggacgacgacgacgtcgtcaccggcggcggcgcatccggcgggaagagatccacatcgaagtcgaagtccagatcgtcgagatcgaaatcctccagcgcgaaggcgtcatccccgagggtcgggaagtcggggaaatcgtcgccgggggggaaggggaggtcggcgaagggcgcgagtaggtccggctccgccatggatcccggtcaccggcggcgcatacgcggcggcggcggcgatggaggtggatgggatcacggacgcggtggtggttgcggaagcgtgagggctctgcaatggaaaagagagcgaaggtgcgtgatttggtcgtagtcctcgcgattttaggtcgccgcggagacgaagctgctccacgcgtctcgaaccttctctgggcctagttgggcctcaaacatcgggccgattttgcggatgggcctagttattgagcctgatgatagagagagggggggggggggacagatggaaggctaattcggtttataggattcccaaatcaaaggtacagggaaggtaaagaattaggatgttagatgcatcttatttcttaggaatttttctaagaggtcttatctcatgataataagaatcatatggaataagcttgtaaggctataatccttaggtatttgataggattttataggaatggaaggaatga

SEQ ID NO: 38120 - DNA, 1501 bp, Oryza sativa
cacaatgggcagtatgaccgcaataaccaatatgcgcaatccttgatttacttgctgcagttttcacacacgagatcgatcactagttgaaaacctggaatgcagaacttcacaaataaccgacgataatttaggctcatttcgagactcctcgaatccagtcaccccctatccattcctaccaatttcttcccaataacaactgccaaattgtcagagagagagacggcggctgctgctgcttacgctgctcgtcgacgcggaggccgccctggatggtggatccgaggcggtccatggcctgccccgtgccgcggatccacttccccgccgtgtagatcgcccgccccagggtccccatgcctcgtcctccccgcttgctccctccgctgtccggacctcgccgccggccgccgcccgccgccgaggtgagaggtaactgtgtgagagagagagagagggagaggaggtcaaacagcttttggcccaggttttttatgggcctggatccggcccgatcatcacagaggcctcgcggcctattgagatttgggcccaggtttttatgggcccagcctgttgcgcgaattctagagtgatcacggccgtccaaaattcgattgaatttttttctttatgtttcaaacgattaaacagtactccatccgtcctaaaatataagtatttttagcatagtatcaagtcaaatatttgtaactttgactattaatagcaaaagaataaaaaggatcaatcatgtaaaattgatgttactaaatttatcattaatgtaactctttttatttaaaacatattacttttatagatattattggtcaaaatagcatctcatagactatgtcaaagtctaaaaatacttatattttaggacggaaggattagtaataggctcccttgttgggaacttcggatacgggcttaaaatttgaagtgaaatattggcttacccacatgattggctaagagttccaaatcgctcaaacttaacgtgactgattatgttgcagtcatctacggactgcagggaactggagtcttggatcctgcttgctttgcatcaacaaaaacaaaaatctaaagcttttacaacgtgcacgcattctgcagctgccgtctgccgatcatccgcaccaggactacagagagtgtgcaaccgaacaaaaataattgaccctgtttggatggtgttacatcggatggatgtttgtacaaagtattaaacgtaagctattgacaaaacttattctatcctagttaattcgcgagacaaatttattgatccaaattaattcatgattagcctatgtgatgttacaataaatatgtgttaattatgaattaattaggcttaaaaaattgtcgcgcgaattaacactcatttatataattagttttattaagtagtgtatgtttcatactacatcagtcccaaaatacttgtcgctttgatttttttcttgcaacctttgaccattcgtct

SEQ ID NO: 38121 - DNA, 1501 bp, Oryza sativa
tggggtgccccggaggatctggagcaggacctggaggaggaacccgatccaccccaccaccgcctgccacgcctgcgccgccaccttcccccgctgctgctgctgcgccgccgccgccgccgtcggcgagtacacctccgccgccgccatgatcgccgcccgcggcgagctgtctccccgcaacgtggggcggttgggaggcggggaggcgaaggcgatggcggtggcgaggccggagaggcaaccggaggagggaggagggggggaggaggacgtggtggtcgactggtcgtggtcgtgtgtttgagggggaggccgcgggtgccccgagtccgtattcgtctacgtgtgcgtgtgtgtgttggcgcttcgtttgcccgtgtccgtgtggacttagcggagttacaggagtagatttagcgggcccagttgtcagtgagaggctcggctcgtctggcgagctgccgggagtgtgattatacttacgtgcacacgaagttttctcctaaatttgtctagaaagaacatgcaaaccgctcacactcacacccatgtgatgcggacacccacaccctatctctatatgccctctggaagactaatatgatatatctcgcctaccaggctacctctatatgccctctggaagactaatctgatatatctcgcctaccaggctacctctaaaaaataattagacataaatacaaacgtctgtgtcaagtttagtacgaatttactattagactaatttctcacaaagaatttaatcataggtcctgtttagttcacatcaaacttctcccaaactcccaattttccatcacatccaaaactttcctactcacataaactcccaacttttttcccaaaataacaactttccctgaacttctcctcaatttcagaaactaaacacagccataatcgtaataagttaagctaaactcacttcatgtgtttctccatctcctgtgtatcatctactccctccgtcaaaaaaaactaaattaattggggatgcgacattgcctagtacaacgaatcgttggatatctaatgttctattcctaactggattgggttttatggaacggacgagtacatactacttgtgtatgtattttcctgcttgcgtatgtgtttatcctatctggtttgattttgacaaagtatcaatcgaggaacagtaacgttgacatattattatacttgagtacatgttaacgaattcaatcatgcgaattgatttttccaggaacgcatgtgtttttgttgttgtacaatttgttactgtaatcttgagtaaggcatggatttcttatacagggcaaaactgagtgaacgattagaatatgattaattaaatattagcttaaaatatttttcttattttttaagaaagcgtacctttaatagtttgaacgtatgtgcgaaaaaaatgagggaatggaggttgaaaaaattaagagaaaaacacagcctaattgtatacacttgg

SEQ ID NO: 38122 - DNA, 1501 bp, Oryza sativa
tgatcctacccctttgtcttctctagatggccgaccacccacccaaccaccacggagaaggcatggatgattttgtggcagagttggctcgcatgaccctggtggtgggctacctgttaacaaccgaatttggtaacatcagcatcatgaaagaagattagatcgaagcaaaattggaggcggagatcgagttcggaaacagggcaggaatcgctggagtccaaatcggctacgattaggatcggctgggtctgagtcagactaggtaagccgatacagctgattccgacaatgcagcttgatgtatgatatcgggttggattgaggtgcttcaaggtgattgccgcacatggatagagtcctgagaaggcaattgtatctattaattagggtgttttatgtaatctccttagagatacgattgggcaaaagtctgccacaaagacttatgctatcttagagtttgctagagatagtagtcgtgtccgttatgtacatatcttgtaattcagagtatcataaagctgcatcggtttcgatcttcaacaagaggtaaaacttgttatgacgacttgtgttctcgggattagtgcttccatctttatgatactctgatctcgtttatgtaattcgtcgagttatcatatatcttacataatctccggcaatactgctatctaatctacaatcggctaacatctgtctgtagaaggcagccgattaggttagatatcgatgttgacttagattgtataaggtatctaccactctatgaaacttctagcggcttgattgtctagatattgttcttcttttcatacttaatgctgcatcagttgagtttgatctattaagtcgtgcttagaatatcaatctctagcctgccttctggttgccgattagggtagcatcggagtttcagccgaccttatctgatttaactatatttgctctatatgcttcattgacatgttaaatctgcccattatgtcaagatattgctgtatctaagtatcttaggcctttgtttgatatattatacctgttttaatatcctgatatagagtagtatcagagtattagccgatacatgctagatctatctgatcggctatgctataaacatatatagccctgttattaatatatacttcgatctaagtgatttataatgtcttggcatggcggccgatctatcccaatcacttgatttaagtatatatcgatataagaactatatattggaaatatctacagccgatcgaatagatttggttctttattgtctatttacaactgccgatcaattcacatatgacatcggctcaaagataaatgatatgtcatcggcacctagccgatcggctatcatttatagatttaaccgcggtttctttgcctttatttcttgttaattacaggatcaaatcaactggcatgctagtacacccgaaggcgagctttggacctgcactggagttaagcagatctcccaggcctc

SEQ ID NO: 38123 - DNA, 1501 bp, Oryza sativa
ggatcacgtccaagcgcttcgaggacatcttcctcggccgcgccacgagcttcgtcaatgaccggtcctcccgccgtgcaccagcggaagcctccctcgccacgccgtcctcgtcctcgggcagaggcccgaaacactggcggcgacgcaccacgcgccgcgatcacgacgggcagcagccgacggccaggcaaagcaacgaccaccccgtccaggtgcagcttttgccgcgcatcaacatcaacggccgcgacgagcagatgtcaccgagagcctgcgggctcatggtgttcttcccctggagcgccaagcccgccgtttgcgggttcaggagcccgccggcgcagtacgcgccgtcccctctcgccggcgccagcaacccttcgtcctcacagagccgcaggttcgtcaccctacgcgacgcaatgcaggaggagaacaagaccggcagcggcggccgagacttgccgcggccgcgtggcgagaagaggagccgcgaggaatggcaggccgcaagccgtggatggggcgtgtcgtcgctgctcgacgcgagcaagaagtactgcaccgacgcacggaaggctctgagcaagctgtccatcgggttaggaacggacagcggcagtggcagtggcagcccgagagttggcagcagggagaggaagtgcggcaagcaggacccctcgtcgacgatgccggccatggccaccaagctgacgcagctcaggactagcagaaactaaggtcagatcattcagattgatcggtagttgcaagaacaactgcgcgtggagcatgtatatctatgcatttatgtaggactgctctcatctcctgacagctagaataaatcagatgtgcctataaacatgttaatcatggtgttatgcctataaagtaattatggtatttatctttgcaactattgatatgatctttttaggattgtaatggatgttttgtgttactgtggcgatctagtgagggaattgtgtttctatgtataacttggttcttcttcttcttcttacatagccaatgtaaagtggcattgtggtgagacagcaaggaggtgtttggttagttgcctcacattaccaagctacactttcttagatatgtgtttatttcaatgccgcaactatgtcgtactacaatttcttagcctaggaacccatatgtcattctctcaaatttgaaaccataccacaccgttaaacaatttaaaaagcgtgtacgtggaaaacgaatgagagaggttgggaaaagtggcatccgaatacacccgatttgcttggactgtatcccttgcttattgggtagagccatataaaagttgtgaaatttatgggtcattctggtttgatgtcaaaatatgtcatatcaatttggtaatttgaatattgatagtgtatatttggattaaagccaaatcattggtaataccaactattagtataaatctagaactgatctctatatcatcaatattcagttttct

SEQ ID NO: 38124 - DNA, 1501 bp, Oryza sativa
ttggtgctttcttaactttttcattccggtgaaagacatcgcacccacgtgtgccaatacaggacaatattggcattaattgacaaaattccccacgcaagtcacgaagtaatttttcgacatggtctctcccaagatactataatatgtccaaaaatcatgttttggtgctttttgaagtttttcattccggtgaaaaacatcgcacccacgtgtgccaatatgggccaatattagcattaattgacaaaggttccccgtgcgagtcacggagtgatttttgaatacggacgctcccaatactctacagtatgttcaaaaaccatgttttggtgcattctgagctttttggttccggtgaaaaacatcgcacccacgtgtgacaatataggccaatattcgcattaatttacaaaagttcatcgcgcgagttacggagtgatttttcaacacagacgcaccatatccactccaatatatccaaaaatcatgttttggtgctttttgaactttttcattccggtgaaaaacatatccactccaatataggccaactttggcattgattgacaaaagctcgccgcgcgagtcacggagtgaattttccatatggacgcacccaatacactccaatatatcaaaaaatcatgttttggtgcttttgaactctttcattctggtgaaaaacattgcacccacgtgggccaatattggccaactttggcatcaatggacaaaagctcgccgcgcgagacacggggtgatttttcgacacagatgcacccaacacactccaataggtcctaaaatcatgttttggtgctttttgatgttttttattctcgtgaaaaacatcgcacccacgtatgccaatataggccaatatttgcattaattgacaaaaattcaccgcgaaagtcacggagtgattttttgacacggacggatccaatactctacagtatgtccaaaaccatgtttcggtgctttctgaagcttttcattccggtgaaaaacatcgcacccacgtgtgccaatatgggccaatattggcattaattgataaaagttcgctgcgccagtcacggagtgatttttcgacacagactcacccaacagactccaatatgtccaaaaatcatgttttggtgatttttgaggtttttcattccggtgaaaaacatcgcacctacgtgcgccaacataggccaatattggaattaattgacaaaagtttgctacgcaagtcacggagttattttttgacacggacgcacccaatacactccagtatgtccaaaaatcatgttttggtgctttttgaaatttttcattccggtgaaaaacatcgcacccacgtgggccaatataagccaactttggcattaattgacaaaagctggctgcgcgagtcacggagtgatttttcgacacggacgcacccaatacacttctatatgtccaaaaatcatgtttcggtgctttttggactctttcattc

SEQ ID NO: 38125 - DNA, 1501 bp, Oryza sativa
ggcttcaatgactcaagggccttggcctcatattcagtcactccctcaaggtcggaagaaatgatggactcaacaccattcttaccaagcttaaccctagatgcaaagaacagcagctcagttaattcagattgaacaaatgtgcactcgtaaacatctggatcaccagccaatgcacggagggatgactcaacaaatctggcagctgcataggccatcgacagggtagcagatccagcaccagctttcgcctccaccacctctgtcccagcattctgtatcctccttgtcagctcttcagtttcctcatttgtgaaggtgacagatggtctggtttttgacagcaatggtaggatagtaatcccagcatgaccaccaacaactgggacatcaacatcaatgagcttcaggttcttcttctgagctataaatgtgttagctctgacaacatctagggtggtaactccgaaaagcttcttggggttatagacacccttctgtttcagaacctcagcagcaatgggcactgttgagtttactgggttgctaatgatatggataaaggcttctggacaattgtctgcaacagcctcaacaagtgtcttgacaatgctcgcattgatgttaaaaagatcatcacgagtcattcctggcttccttgggactccagcagggatgacaacaacatccacacctttcaagcagttggctaattccgagggcccagtaaagtccagaacctgagaaggtgtgttgcagtggctcagatcagcagcaactcctttgacatttgcaatatcatacagatgtagtgcagagaccagaggagacatcttaattaacaagcccaacggttgaccaatgccaccagcagcaccgagaactgccactttgtaagatgcctcaggagaaatgtgagatccagagtttgcctttggtacaatccttggagagatagatgatcgaagagatgcattctgacccaggaatgatgaccttgactcaaaactaatagatgatcttgcctttaagccactgtagcttgtgatgtcgcaattccttaactttgagataatgccagcctgagcaccaatcaaattgatggcaacagttgatgccatgcctaactgcaggaacagttccattagatttatattgaggagatgccgaatagaaaatagacaggtcgtgacatgaatcatttgtatatcattagggaagtgcatctaaaacactgacaagtaatggtaatacatattaaagcgattctttatcttttggactacatgatgaaatgtcttcttgcaaatagcagtgaaacaactgatgacatgacacaaaagctggatccttcagaacttcaataaattactagcttgtgaatttcttagaaattttctaaaaacttttagtatgaaaattatctacaagctgatgattatcatttaaatattggtcataacaaacaaaaggttcagaagaaatgagcccacgagaagca

SEQ ID NO: 38126 - DNA, 1218 bp, Oryza sativa
ttagcattcaaagaaagagctgataacacatttcaagacaatacttaacaggtcgaacctaaccgatgccgtgttaagcgtgaaaagaaacataagatctaagcaaatagatgaaaactcattcaagatggtagatacaccgcataatctaggctgacatcgacatctaaacctatcggccgttttcgatgatagaggctggccgatggggttagatgacgagatcaatctagattatgcggtatatatgataattcagcgattcacgtagacaggattagagtgtcatagcgatgtaagcactaatcccaacaacgcaaactgtcataacaagctttaccttttcgtcgaagatcgaacctgatgtagcccaacttgaaagcaaaaactcgtcgaaacaataaaaatagaaaagggtggtgatgcaccaaagtattattgaactgtcgtcccttgattacatggtgtcaggtcatattaatacccgaagtacataatgtgtccttgccggacacgcctcttgtctctaatataatttaaaatacgaatgagtcccctaggtgggctcttaccaaacatatctctaaggaaactgaaaaaatatcctaattaatagatacaattgcccctttttaggactccaatccttgtgtggcaatggctatgaagtgctttggctaaccctgatgaccaacgtgggaccatcattttcgagactggttgcatcggcttgattccgcggatttggcgctagccaatatgcgcagccaatattgcctgtagccgatcatgtggcagctgatgctgttcttagccaatgcgtattctaccttctcaaatggaatctcgccaaatcggctttgactctagctttgaatccggctcatggcattaccaaatttggtcgttaacacatgccccccaactattggaatagccatgcccgcagttattgggcggtcaaccagctcattgtgattagtcccacaataataatttgacttatagaactggagttgtttaggtggttttggttgggcgtgttgcaccgtggatttagcgttagatagtgatgatttaatactgcttaattatatattgtttttactatttcaaaatatgatttataaatgctgcttttaccgcaaatatccaatgctatttttatggtggttggtactcagtcttgctttatttcctccccacccccttcgaagc

SEQ ID NO: 38127 - DNA, 665 bp, Oryza sativa
taacgcaatacttcaggcactggcaacccgctgttcccagatgtcgctctactacgtacccggacagggaggacttaagtgatctcgagggctgttaccacctctacaccaacctcaaacgtactgtgggatatgcaacaattactggataataattacctaaacaccacgtctaagcaattaatatctactttagtgtttataactcaccaaagcaatcactatattttagttgattattgtgaacaataataccgtatgctacttaggaactaaccaagagataattctcgcaaaataaatcaaaattactcaagaagaatattacgttgaattcagagtaataaacattttagttgattattgtgaacaataataccgtatgctacttaggaactaaccaagagataattctcacaaaataaatcaaaattactcaagaagaatataacattgaattcatagtaataaacagaataaaagaagtaggagaagattaccgacaactctggaattctcccgacttcttctactctactctcttcctattccattatacaatatagtacaatagagcctcttataattcagctcaaacttggaagtgtgtgtgtgaagtgagagagtgaagcctttatatagaggtaggtattacggttgtacta

SEQ ID NO: 38128 - DNA, 1501 bp, Oryza sativa
tcgcaatctgtgcaattagttatttttaagcctatatttaatattttatacatgtgttcaaacattcgatgtgatgcggtgtaaaatttttgtgtgcgaactaaagcgggccaaagtagaaatgatgcattgtttcaggagaacccgatgttacagttcttctgcatggtttgtcttagcaagctttatattggcacgggattgttgttcttaaatgtaaatcatcatcgtgaatttgttttgtttccctcagcgtatgtaatcatgactattaccttttcagcttttttagctgtaaaattgtttgagctgactgctgaaaggcaacagcaacagcacatgacacatgagccactgcaactgggtccacctcatttgcttcttttaggctattaagagagagatgggtttataacgtgcaagataataacacaggtaaaaagtatttctttctacggctaatggctttccaaatcccaaattaacccacgttcacctgacgctagcacgtttcagcaacttgcaagccgcaaacctattcttctctgctgcggtaaccaaacccaataaaaagggcacctctttttggcaccacattgctgctactctctctccccttctcttctccggttctccctctcctcctcccacctcagccgccgcttaccggcggcgccgcctgctaatctgccggcgtgagcaccggcggagatgtgttactgctacccaacctataacgcagctctcccgcgcagtgcctctgtctctagctagggttttcctcttgggggagacgacctactatggtaaggtggggagctgaagccggcgacctggtgctgtccggaggaagctggagctcgtcgccgtcggatggacgccgatgaggccgcggggagtagcaggaggatggatctgaacctctaccttggcctcccacgcgccccgcgcccgcgccgctccgacctcggctccgacctcgccctcagcaccccgatgccctcctccccgtcctcctccgcagcctccgtcgacgcgccgccgccaccgcccgagctgtcgcatcccccgtactccccctctcacgccgacctttcccctccgctgcaggaggtctactccctgtacaaccccgacgacccgcctgcttccgagacgcacctgccgccgtatgcgccgcctccggctccggtggtctcggagctccctgacgacctcgagtttggcctccaccccccgccgccgctggtgcgtgccagcgaactgctaggttgggaggaccggccgtcttcgtcgacggcatcgtcctctttcctccctgacaccgcagcccgttactggcggcttctcgagcagactggaagcagatggctccgtgcgaggcggtttaggtcggaccttccgccactcagttctgaagcttacccagctgggcgtgatgctgccgcagtcccagtgctgcagcatgaaccgatgaatgatactgttgaacataataagg

SEQ ID NO: 38129 - DNA, 284 bp, Oryza sativa
atgaagaaccagctgtattatatgtatgaattatttactaatccagggcttgatacattaatcatggtcggatccaagtcattagttttgggacccgacagaactggtatcagagcatatgtttgactataggatgaaccttaaggattactaacccagttaagtttgaatttatttcaagcttattgttttaaggggggtagatttaacttgcgaacacacactatatatttcatttgtgtatttcaggtcaatggcagaaaggcatgagcgttttgagacaa

SEQ ID NO: 38130 - DNA, 1501 bp, Oryza sativa
aactatttgccacttttataaatggctactctccgtttgccattcttacatttctctacggatttgccaccagagagaaggtttcttaatcatttgccactttcacctattaagcatgctagtgaggacagccaatgtggacaagagacacaaaaagtccattttacccatggcccttcccttgtgttcccccctctctccctttccttttcagatttgagctcacctccgccgctgtttctcgtccatcttctgcactgctgtgtagtgacaagccattaggtagcagtaacacttaggtgcgtgcatggatgttctttggctgctattgattgcggatgtaccttctccttgtggctgtcgatgacaaccttcaaccttgcggatgtaccttctccttgtacctcaacgtgctcctcacttgccggccttgccatcaatgaaccgcatgacgacctgcaccggggtgctccgccatcctcccagtgagtttgagggcctcgcggttatctggcctgccgaagaagatgatgcagatgcagtgcacaaccttcttgccgctgacacatgattgacgaggcttgatgagacagcgtggctggtgtggccgcggatggtctcaatgaggaggtgaccccgcaagcaggaagccagaagcatacgtgcaccgctgtggatgatctcaatgagatgaaggggagtggcaggggcaaaaaggacattcacgtcctcagtccatgctggtatgccacatcggtgaaaggggcaaattgttaagaaaatttctctccggtggcaaaaatgtaaggacaatcgtaagtggcatttggagagtggttattcgtaagagttgacaaatagttagtaaggatagtactgtaagcagaatatgggcttcatgctagtcaattttgtatattggttccacatccctccctgtacaaatttcataacctgctagcatttctaccttatttaattaatcatagtaatactcatcgtcttgtctcgcaaaaagaaataaacatcatcaattaactcattgcttgatttttgtatccatgccagcggaatctaatgagatccgagatgctctgaaagattgtaagcttcagcaaatgctacttaagattgatggctctgcagagccagaaaaggtaattctctactcttgtgataactgcaagtttatttaacaagttaactatgtttgcaatttctgtccggctgctcaaataacatgcacataatatgccaatacctattgaggacaatggtttgcagtaatgaacattgtcactgttatagtacaacacttctgtttcttattccaccatcatgacttcattttcctaccagtagttgagaagcttcaaatgggcacgttcgatgaattaattccttttactatagtctgctgaatactgatacgaatataacttttctcacttacatttatttttttcctctctctaccacctttattttatgatgcccactc

SEQ ID NO: 38131 - DNA, 208 bp, Oryza sativa
caaattaatgccaatatagatatatattggcacacgtgggtgtaatgtttttcaccagaatgaaaacttcaaaaagcaccaaaacttgattttttgacatattggagtctgtttggtgagtctgtgtcgaaaaatcactctgtgactcgcgcgcgaagttttgtcaattaatgccaatattggcccgtattggtacatgtgggtgcga

SEQ ID NO: 38132 - DNA, 408 bp, Oryza sativa
acacacgaaacagatgggacaatgatgacgccctgctatttatgagacactatggaaaactgaggatgtgcttgatggagaagctatcatatcccacaggtgcccttgattcctggagctggctaatccacagccagcggatccctaatcaacataatttacattattctctttaacaaaacacaaagacactctaatgatactccatatatactactactactactacccatagtactgatgcaataactacaaagagaggctcatgggtaatgcttgtgtttgaagccaaagaaaaaaacttaagctcacgatgctccttgaaaaggattacatcaatgtctagatgttcctcaacggaatgcttctgtactcatgtacttagatgtcatggctcgccataaagca

SEQ ID NO: 38133 - DNA, 1501 bp, Oryza sativa
aagtctattggttgcatggcaagcggtgtttatggcttccgcccaaaaagaatcggaaacaccatattcatctagcatagttcttgccatctcaatcaatgtacgatttttcctttccactacaccattttgttgaggtgagtaggtagcggaaagttcgtgtttgatatgaagatcatcacaatagtcctcgatattggtattcttaaattcggaaccattgtcacttctaattttcacaagagtgcaactaaattcattttgggccctttttgcaaactttttgaaaaactcggcaacaatagacttatcatgcaaaaagaacacccaagtatagcgagaataatcatcaacaatcacaagacaatgactattaccaccaatgctcttataggttgttgggccaaacaaattcatatgcaagagctccaatggtctagatgtggacatgatactcttagtagaatgagaacctgcaacttgcttgccggcttgacaagcactacaaagcttatctttctcaaacttcagatctttcaagcccacaactagatcacgttttgaaagtttgctcaattgattcatgccaacatgagctagcctcctatgccaaagccaacccaatgaagtttttgcaactaaacaagttttcaaatttgcttcactagaattgaaatcaaccaaataaagatttccatatctaaaacctttgaacacacaagacttgtcaagaaggctagaaacaataacttcttgtgggaagaaggcacatgacaagccaagatcacaaatttgagcaaccgaaagcaaattaaaatttagagatttaacaagagagacattttcatttgacaaatcattggagataacaattttacctaacccaattacctttcctttgctattgtctccaaatgtcactttctcttgttcattctctcctacttcaaatgtggtgaacatagccctatcaccggtcatgtgttgagtgtatccactatcaagcacccaatggctcccaccggtgcggtagttcacctacaaaagaagatcaagctcttttaggtacccaaacttgtttgggtccttggaggttagagaccaaagctttgggcacccaaatggcattctttttaccaccgagtataggggaacccacatatctagcaacaatactaccatcataagccttcctaagcatataatgagaatcgaacatgcatgtcttaggaggcttaccaccggggcaatcactcaccaaatgcccaacctcacaacacttggagcaatacttaccattgctcttgacaaaacgagtggcatggtgagaaggtttcttacccttctttggagtgaatccaagtccctccttgttaaggatgcaccgttgctcactcaaaatcttgtcaagagtgttcttacccttgaagcatctctccaaactcttgttgagcttagccacttgctccttaagctcattgttctcaacaataagtgaggc

SEQ ID NO: 38134 - DNA, 1501 bp, Oryza sativa
agaaagacattgctggagggaaatgaagagaagacatcgctaaccaaaatgtatggagttatatgctcacaacactatgaattcatatggacgtcattgcatacacagtcaagaggaaacaacttacgataaactcctacagtcagctcattatcatcaggtgaacggcagaataccaaatcttggtggaatttcttcatcaaattatcaattattttttttcgtgtcaatggaactcgttccagtgcagtgcaagcaagcttcataagaggcattgtaaaaggccggattccatctgcttcctatgatgtcaagaaagtttggtatcagtatatgttacataagaaactagaaaatcaaatacataaagaagagacttgcaaagaagttaaattcaaatataattctgggctgtgtagatgagaagcacatcaagtaaacagaattcgttgtaacatctcctgtcacttgtaaaatagatgatgtttgattgcagcaattcagccatgaacatatgttacagttgaaggcagtaatcaatattaattggatgcacacccgtgatgctaatataaccaaagaacaaacaaaaccgattacttatgacatgacagatcttttaattcacatatgcaatatggaagtatagagcagctgactacttcctaagtttacccaccgcaacatataagtacagacatacatacattttaagggttgccatgtgaatatgtgatgcaaatgcaaaggcgcaattgccttatgaagtttgcttttacttagctgctggaatcaacctgataaatttgaatacagtccatcttgtggtagtactattatagggatgataagataagaaccagacaacaaaataactctaaatgctgcattcttcatatcctactgaaacaataactctataataccagtatccgaattaattaggagtcctggtcatcttctttgctacttcccccgtttcacaatgtaagactttctagcatttcccacattcatatagatgttaatgaatctaggtatgtatatgtgtctggattcattaacatctatatgagtatagacaatgctagaaagtcttacaatatgaaacggaaactattctttaaagctgaacaatatttgtagttattctagctgctctagccgcaacagggagaaagaaaagaaatgtaatgccaaaaccacctctaattgcacgatctaaatcatcgatgccactgccactgaatagtacactatggcaagcgagattcactgattgaatagatttaaattgcacaaaatccttccgcaactcattacagttctgggttaaactgaacttacaagattaagatcgacctaagcgctactagtcacccaatttccatttcgaatcatttgatttaccatcttccatccgaatttgagtaatcttacactacagttgagcagcataaccaatcgagggccaatcaaacagaagatggggatcatgacc

SEQ ID NO: 38135 - DNA, 1501 bp, Oryza sativa
tatggaccatcatgatgatatagctagttatttaaacaagaagggtgtttccgtgatatttctcttcaggagaaatacattgcgcaggcttatctctgttttggctaatgattacgacagagatgcgaagcagctgaatggaacccacaaatcccatgtacactcaaaagaagaggttatatccatgcaacagtttatgtcctctccttactattttcagttcatatttttcacattgaacatggtttcatactaggtgcacttttgatgaaatatgaccatagtatatttgaatgcatatgggaaatattgtatcaatattggaggaatgactatattgcatttggaaggagccattttctctacatataaaagggctcctcctttccgaacttgtacccttatattaggttatattatagaatatagacaactactggacttctggtatagatattttggtgaaacttaaatcctacatatttccattccaagagaaatgtaacatcactatcaatcatgttggcaaggaagaaaaaaaaaatgaaatgcttatatattttttctgagcaggctgagatattagcgaaattcaagccggtgctggatgtgtcaaatctgattccaaacatcagaaatgccgagaaatacatcagagattgcttggaccacttcaacaccacacggcacatgatcctctactacgaggatattgtccgcaacagaaatgtactaaaacatattcaaatgctgtaacgaaggatcaatgataaccctcgctttgctaaaatatcatctctatgaatgcaggcattgttccaggtacaagaattcctcggagttccggtgagaaagctggtcagcaggcaggtgaaaattcacactagtcctcttccaggccttgtcaggaactgggatgatgtgagcaacaaactgaatgggacacagtatgctcattttcttgacggtgcagattatgtcaggtgatctacatggatgtgagcgacaggattttttttttcatatggggttttagttgccatatgattgattcttttggtacaaatgagttggtaaaagaaagggataacgataaatagatcaagatgagagaccttgtgatcaaattgtacatgctttccactactcattaccttcagagctcaaattgcaaatatatgctcaaaattgctgacagttttgtgatggttattttgtgatcaaaggaatacactattttggttcacttggaagaatccgaattaacgaaatttgtagttttgttcacctatcaccatcattatattactcggtctataagccgtagctcaactaataactttgcaaatgaaaggctaaaccacaggagacagcaacagaaatgcagtctcccagttccatttttcaggtttcaacactccagtagcagtgtacactttcgaaatcaaataatgtttcctcgcaaaaaagaaaaagaattgaataatgcatcatgcatgat

SEQ ID NO: 38136 - DNA, 1501 bp, Oryza sativa; identical to SEQ ID NO: 38119

SEQ ID NO: 38137 - DNA, 1501 bp, Oryza sativa
gcaccaaatcgattaaaatctgacaacctcaagtcaactggcatgaactctagtgctaataatatatcataattaacttggcagtaaaggcagcatggctctctttcggcgatcactatgctgcattgttttaaaagggtttgacttgtgcgaaattaaaatcgatggacagcgacctgaacaaagatgcaaactgcactgcaccgcgatatgctcactcatgatcgctctcttcagatatccaattagtaaattgttaatcgcatccgacctacttagtccactcaaagtctggatggtaaccaaaagcttcagcgcctgtagtgggacaagaacagattactaactaaaactaactaactaaagccttttacagttcagatatcttagtgagatcaccattgttaattatcgaaaatacttgtaaaatgttactaatgagcaggggcgaagctagcgtccaaacagaggtggtgcactatcattaaagagaaaattccctatctagcatcaagaaaaattgctcttccctctatagcacccaaacttcaaaagttccctatctatgcaccatcaaaatttttgttccccatctaacacttccgttagttttgagggtgacggtgttaagttgcatgaggaaagacggttttgcccttctgtattttatacattttttccctctctctgttcacaatttttttttgttctttattttttttcatttagtgtccagatgtctgtacgtctttttttcattttgttcacagttttttaacctttctatatctaaaatttttagagaaatttgacagcatgtctgcaacaacagcatgtttgcaacacaataatgaaccaaataaattttagagagcatccaaattcacatccatagataaccataaccatccaaatcatccaaattcacatccagggcaaaagcaagaaaaaggttgtgttcatcgccatgccggactgtttgcccgcaccatctagggggttgctgtccgtgcccgcctgggagctgcctgcatgtgccgccgtggccatgagctgcctgtcctgcgcccgcctgggattagccggccgagcaggcctagggatggcctcccgtgccgccggcgctggccgtccgggggagcccgccggcgccaatggccgcccagggggtcgccatcctcgctgcacggctgattcgccgtcctcgccgcccggggggtctccatccatgggggcgacggcgatctagggttttgctgagaggcgcacgcgggttggggaaagcaggtcgcgctcgcgctctgtcctagagaaagagcgacgaaaaaaattcctgagggtgggtccatgattgttttgacggtggaggctaacgggagtaacggaagtgttagatagggaacaaaaattttgatggtgcatagatagggaacttttgaaagttgggtgctatagagggaagagcaattttttttctgatgctagatagggaattttctca

SEQ ID NO: 38138 - DNA, 194 bp, Oryza sativa
atgccgtcccgtcctccacccctctttatatggcacagtgtgacgggggcccaccagccattgggctgggcgcccccgatcagggcgcgggtcaaggcccccttgagccattgggctcaaggggagggagatccatctaacattctcccccttgatctcactatttcctttagctttttctattccatcacaga

SEQ ID NO: 38139 - DNA, 1501 bp, Oryza sativa
ttcaacgtgtggaggggacgacgtataagagtacacgcgaagactgtaggtagaggtgcttttcccgcgaaaagtggcagtagcggcggttggacagtaaccttcgtgtatggttgtgtgttcatctcacgtactgttcttttgcctctcgctagctcgttcccgtgatcaaggtgcatgctcgatggccttaatggtggaggttgccgaaaggtagcagaggaaatcaggctaaaacttgcacacattacataggctaaaagcttgtgatgtgaaacgtacgcgtgtctgcattggccttgccatgtgtatagggtggttggtggccgccttggggattcgtccgcggactcgggatgcactgttcaagtgtccagggcatgtttgttcggcgatggaatcccggtgatcgccgtggcttgaggggaaggtgagagagacgccacaacgggtttagctctgttccgctattcggcccattaacatttgcttatgggccacctatcttgtggcgtgggccagcaggttagtttggtgcacgacacgactccacgcaccgttccacctagcaactgacgtcgtagtcagtagatgggtcggggactctcggagagcggttcgagggggccgtcgtttgcgaggccgcaagtcgccgtcggcggccgtcgccatcgccgcaacataaaaaaagcgagcaaacccgttgctgcgcgctctgcgcttctgcccttttacgaccgaagaggtagccaacccacgcatcccccccctgacctgccccctccacagccgccgccgccgccgccgctacggctcacgagagtaccgaacgatctgctgccacccccaacccaagtgaccaaccgaaggcggagggtagcaacttcggtctgctcatcccaaggtactagactgtttagtcgattggaggatctcccatgcccgtatttgtgtcgattgctggtggtttgggacgagatctttgcattgggcggatctgttttgtgtatcgttgttgcttgtccgcgcaggtggtgggttcctactttcgtgttgcttccttggtcctgatctgttcgcgttggtgcggtttgggttgcagcgtagttcttagttctagcgtgaagctttgcggattggtgttgtctgtagatttgtgagatttacaaaggattggcgccggctgtgctggatcagtagattgtgaccgagcagaattgagcgggctgcaacggcgtactagagaaaagaggaaccgggacaactaaagattctggtatactggtattctctggatgctgatggattggaggaagacgatcgtagtattttttttttttttgatgtagaaaggcatcaacaccttagttactttaggatggatatagataccttgtggggaaacggtatggaagatactttagcacccccaattttctcatcttgctcataagttttgtaacttggatgtcaggtgatgataatgctagaatttagcttc

SEQ ID NO: 38140 - DNA, 1501 bp, Oryza sativa
atacatgtaatgagataaataaaataagaacaacaaacgaaagattatccaaattacggttagggtatcttttgttattttattactgtccaacaaagttttcacaaggtgactcatcactggtcgtgggcatttccgaccaaaaggagaagtcgacgaagtcaagtgctcactcactcactcactctctctcttccatgtgccaggtcagtagggtgggccccactgcagcagtgacccccaccaattctcccacctcctcgtcgtcgcacaccgtacgaccggtgttacggaaggatgcggccgcctggcacgttctcactcacggatgacgcgaagcggtcccgacccgacccgacccggagcctgactggccggtcggtcagggtccagccggagaaaaaccgggtgctagttaaggcaccggcccgaccgggcccacacctcaccggcttattgccgcttgtaccttccgggtactcgtacggtacgcgcacttgtacctcctccccctagccacgttctttccctgcatgttttgctaacctcacacgcccatcgtcccccaggtttgtatcaatcggcatttttcttttatttgtgggaaacacatatacatgctaggctttacaaatttcaacggataggatgagcatctactagtgctggttttcggtcccttcaattttgaattctatcaaatctgacatactcgagacaactcatatactccatatgttaaaaaccttaaatgtcaactagattacgacgcattagtagatacatgatgacataactatcgagttagtccaatccaattttttattttttttatcttttggctgtgtatatccacttgtgaatataaatgtcagatttatattcattacttaagaaaataaatggaagaagattggatatgtcaatttgacctgaagattggatgtgtcttgatagcttgaatatgctatcaatgttatgggcaaggtttatgtgcatttttacaaagccaaaccaataaatcctctaccacctaaaaaaaataattgattaggtttttattgaaacaaaattcttgctgaaaaaaccattaggtatatttaattgcttaattgcttgatgtagggatattagagcaatggtgaagaataaagtcaacggttgatttcaagagatactaatccaataaaatatatttattagtcgttagcgatttaattatatacaataatcttcacgtgtgcgtaactagcggttatacatatttcccacgaacggtgaacagaatatgtcatcattgggtaatctgaagttgtccccaaagcaggtgcacaaaattaataatcctacaacccattctggacaaaagaatttgtaaaggcccggagagagagagagagagagaggagaggaggaaaggaatagccaaaaaaaaaatcacaaaaagactttggcaactcataactcccatatcttccgttatataagaaggagccatggc

SEQ ID NO: 38141 - DNA, 1501 bp, Oryza sativa
agccggtggcggatgatcattgtctacggacggatgaaccagtaaatcggcgaagaatcagggagctatgatctcttcttcttctttttttttttgtatttttaggtgcgttcgtggatcgtaccttcctcatggggacaatggcgaggagaccgacgaagctaacgaggaagaagaaggccatcatccgaccgaactccggctcactgacgctcgcgctggagtcgtccccggtgctcgtcttctccgccgtcttccgatccatggccagcagatacgatccaaacccacctaagaacaggccagccgccagcgacgtcggcgttacgacggcgagatcaatggaagaggcaatgcaggaagaggcaagagcgcggcgtcgtgtcgcgcgcggtggcgtaccgctgtatgtcatgctggcgcaggcgacgacgcaggtctggacgacggcgttctcctggcgggtgaaggggcggcccggcgagccgagctggtcgagcaggcgcgtccaggccttgaggaggaagaagccgaggaggccggcggagatgttgagcgacgggatgatccccgacgtgaacaccaggttcatcatcacgctgctcagggccacgcccagcgccacgctcgccaccacggcgcgcagcgtcacctgctccgtccacggcgggacgggctgcccctcgaacgcgcgctccgtcgacggcccatcccgcgggtcgccgaccgactccatcccggccacttttcctcctcctccttacgccgcgctttgcctcgccggagtatcgtcggtgcggatcgagctggcagccaatgcatctactgcgttcgatcgtgcctgcgcatgcatgcaagtgatggtcgatctggaggagggcaaggggaagaggagaacggaggaagaggaccgaacgagtgaacacgagaggcaggaaggctacatatgctttggctattcttggcagagcccaagaggcaagagatggtaatgcaaccgcgaaatgttagatttggaggtgtcactgctccttcgcaccctcttggctcttgccatgcatgaagccagaagcagaatctcgattagccggtaaaattcgagctccaatcattttttcgctgatttcaatcaatttttgataaatttcgaacgaagttcaacagttgaacagaccattcgaaatgatggctcgagatggtcgaaattcgtggagatcgtgacccttggctagaagttactcaaataccaacagcgcaacgttcttgccatgcaaataagtagttcaattaccagcggtgcaatgcgagggatgatagtcccaaaaatcagtgaatcgtcgtcatcttggttgttttgaggaatggtactcaggaaaagggaatcgtaactattgtgactttcatggatcctcagaccaaacaactctagacattaaaacaaaatgtttctataagcaatcatgcatgctcaggtggcgctcacacagatacaatgcaaata

SEQ ID NO: 38142 - DNA, 434 bp, Oryza sativa
ttttattcactcatgaactaagagttaactcatacaatatatcacctctattacacaaaaatcaatatctctaatactatcatatttttcttaaaatttatgtgaaagttgcctcttgatttaggggtggctcattatatctctcctcacttctcttatccacctcatcacttaatccaatatggtatttttaagggcaacatattggagatcatactacttgcgctcacatagatggcttcagctccagcctgcgacaacttctctccaaaacggcacaacacgtggatgcatcatggattcatggacgcaaaatgaatcagattcaggcgccacacgatgttttttcttctctatctgcgcccgtgacggcctcaaaattctccaagcctacgaaccgatccacggagtaggggtaggtaactgtgccgcca

SEQ ID NO: 38143 - DNA, 1501 bp, Oryza sativa
tcagggatcttgatgaccccgcgttacttggttctcctgcactctcagagataccagcatccccctgtatcactgcagcagtgcttgagttagatgcttggtctgcagaaggtgctgcaacaacatgagttctgtcaaatgttgactcgagatttggaggattcgatgatgaagccgatgcaccatattggcttggtccagttatccttctaaaatcactcatggcagatgcaaatctttccgtgtcttcatacccaagaagggtaagtccacgcaaccagtcaattccatctggtaataatgagctcggaccatttctggatggatccgatgcattgtttctgatcaaaccactgtcaggggaagtggatccgccatcgggagggttagggttgtctgcttctctcagcaaccgtcttgctctcatccttgacgccaatctacttaggcgactggtgtgctgagcgtgagcagtgtcaaccatttcctgcacagctgattcaggcggaccttcaaacctactcgcagtattcataatctgttggtccagaaggcgcctccatgatgacaataacccatgagcctcaccaagccttcttgagatcggtcgcaaatggtgaaactgctgcctgaagctttcgagccgatttccatgtggtcttggtgggatagtaggacctgtttgtttcccaccttccacagccttctcggcatccaaacatgaattccctctcccatagatcggagtaatattcgcctcagtcacctcgcctttgcagactgggcattccttgtgattggaataaacattgagccattggtacaagcaaggccagcagaagagatggccacaagaggtgaccaccggctcgctggccatatcgaagcatatattacactcaaatgtggcagcgctcctgccctgctcctccgattcctcggaggcgcctacttccgcgccatcggcagctaccttattatgttcaacagtatcattcatcggttcatgctgcagcactgggactgcggcagcatcacgcccagctgggtaagcttcagaactgagtggcggaaggtccgacctaaaccgcctcgcacggagccatctgcttccagtctgctcgagaagccgccagtaacgggctgcggtgtcagggaggaaagaggacgatgccgtcgacgaagacggccggtcctcccaacctagcagttcgctggcacgcaccagcggcggcggggggtggaggccaaactcgaggtcgtcagggagctccgagaccaccggagccggaggcggcgcatacggcggcaggtgcgtctcggaagcaggcgggtcgtcggggttgtacagggagtagacctcctgcagcggaggggaaaggtcggcgtgagagggggagtacgggggatgcgacagctcgggcggtggcggcggcgcgtcgacggaggctgcggaggaggacggggaggagggcatcggggtgctgagggcgaggtcgga

SEQ ID NO: 38144 - DNA, 492 bp, Oryza sativa
ttcgtagtggtaagtaacagtttgatactcatggctcttgactatagctaggttgctgggttgctacttgctagcagctgatggcgatcgattgagatatagaaaattcggatgactgatgaggattgaggagaagtacggagtgatattaacttaaccaaaccttgattaaaccggccactgtctagcttctcacgcaacacacgcgtgcattcacaaaaaatacattttcttttcccttttgaatggacagcaattcaattatttgaccgagaaagcatttctgtcacggtcaagacagtacaaatgaatgatgctcagtactgtatcctttgcttaaatacagggataattctgaccggaacagttaatggatatgattaagctgaaacggccggatcagcggagattaattatcagtacataatcagcctgataactaccaaaaattaatcaaacaaattaatccgtgctttggggttgatcgataga

SEQ ID NO: 38145 - DNA, 1501 bp, Oryza sativa
ctagtatcttaaataatcaagaagagaatgatctcttctaccggaggaaaaaagggagaaaaatatatgcctcgcgtgcttagtcgttggatcatggattcagaggtctagattaaaccagcaaccgtgggctactccaagaagaatggttagcatggaaaattgttccctcaactatggtttgagtttcattcacgtcccccaacagctcaactgtaaaccagttatataacatcccctaattactaacacaagtgcaaatcaagtctctcgacgctttagacaacggtttcatcttacgcagcatcatgtgactcgttgaccaaacgttcatctgacgtggctggaaacggtacgtgacttgatgagatgtggttcaggctagggccatgggtaatcaggctggggctcctatctctagcatcgccccttagaccaccaatatggtggtgtggagcgacgaacgaggatattattgctacggttgctatcttgccttgccgccaccctcgagcgtcgactgaatctcttccacccacgctacaatccgtgataagttgctcgaatctctcttccacccagagctatgccaatgtgttcactaactatggccattgcctggctcctctcgatggacgcttgtcacccgttttccactgctacaaaattatcggggatacaatgttctattgatggcaaatttagtcacacagaggaagggtagacgaagaagaagggaggagaaggatggcatggttgccatcgtttggtgacttcttggccagcaatcatccgtctaccgctcgtcacattctccactccaacgccgagctatgacctcaaatcctctttctccactgcccttgagtcccccttctctagtacgaggagaggagagttggacacccgcagcgccagctgtccttgttctcgttcgcaatagatggtgggcaggcaacggttgggacacctaagaggcgagagtgaggagtcggggtgactggccgggtcgagagagaaaagaagatagtagaaagaaagtatgaaatgaaatgtggaccctataatttttttattaactttttgttggttggattgtcacgtcagacgaacattaagttaatgtgccacatatatgtcacgtaggatgagtttgtcgtccacaccgctgagggactcgatttgctctggttttgatatttggggatgctctgattgcacatgcgaacgttaaaggaaactcagaccccggtgtgagggacctacggtggacctttcgctggttagcattgctccataagtaggtccaaaattctggaaaggtgtcctaaaggaaaatgtatactttgactcccatgattcatgtcctccaactacaaaaccgggtatatcgactactccaactccaattatcaaaaccagttttggaggtggttttggctgacatggcgcctatgtggcggtcttgaccgagtttttgtcctacgtggtgcttacgtgg

SEQ ID NO: 38146 - DNA, 1501 bp, Oryza sativa
catataaaatatatgatgaattgtctaatttactcttatgtatatcatagaaaaataaatataagggtgaattagacataaccataggaaaaaaatacttatcttttcccccttttgaggtatatttttgctcttacatataccatatatttttttaaccttttctttttgtttttttattttcatatgcgtaaggataaattggacaaatcatatagattttgcataggaaggtgacatggcatatccatgtggcgattttggtgggaccaaggactatattagcctacatgacaaatttaaaggacttatttggagaatatgaaagattaagaactaaaatgacccaggagcgaaactttagggaccatattagctattatcccattaaaaaatattgaaatttgcaaaaaaacataagtcatgcttataattaatataattaataataaaacgaatcaaaacaaaacatacaatattttttaataaagcgaatagtcacacttcatgtaaaaatttgacaacattatatatatttacaaacagtgtttcttcaggtctagaagtctcaaaccggcagttggctcgacgtgtggtaccaatagtcacaaagctgcaagaactccacgtctcgcatcattctaccaaaaataaacccaaaggaggaatcaaggcctcaagggccaactgcttccctcgcaaaagaaaaaaaagggggccaactgcctcatgtgaaaacgtcaccatgtaatcgtgtaatgtgtatgcatgtttgttaattctctgctccctcccagccaatctgtacccataagccaccacgttgaccataatgatttagtaccatatacgataatacgagtagataaaccgctatatggggtcgcgcggagcaaatctgctcgtcgccgaaatcaagtatagtaagcataattaagtttcctaaccagcccaaaattttactaaatccgttctggagagaacacctaatcctcaccaaagcttaacagtattgtgccgcagatatacacagtacttaataatggctcccatgagtggcgtgctgtaccacgtttctgcatgcctcgtattggccaagtctgcgaggctttgaattggtaaggaataaaaccctccctgtttccgatccacccgtccaattaaatcatgcttagtggccgattcaacgcctgatcacggaggagaagggagggggaagcatcacgcgaaattttaagtgtgagatggcttcccctcaccaaatccccagcctccctctatagctttgctatgctgactacttcctcgccatctccataaagcttagcttgcccctctcgctcgcgtctctgtctctcacgcacgcgcaccgtgcagagcgaagaggagagggggctagctccgggtgccgtcgccatggccaaccggcgcaagttctcgcaggcggggggcggcggcggcggcggggtgttcgacccgttcggcacgaaacaggccgtgt

SEQ ID NO: 38147 - DNA, 1501 bp, Oryza sativa
tcaacaaagaaacagcaggagactttgaattcaatgggattggtgattcaaattggtaccggatcaagaaggcaaataagagttcaacagcaatatataggcacgacaaaaattgggcctgggaggttgttgttgggcttggctgggctaaggcttaaactgggcctagaagtggcccagatttagcctgagttaggaggaggactactacttgggcccacgcgcgatttagcttttcttttttttaatctttttggggataaagtttctgaattggcgtttcgtttatactcccttactcctaaaatataaaaagattttgtttgaatgggatatattactataaactttttcatgaacgctttactatgaacttagatatactctgatccctatattttagaacagagagagtagcacaagttcaaaatacaaatcaaactttccttttggtgtaaattcaaaaacaactttgtactatgaatttctcacgtatccgtgcaactctatttttcgaactacatcatccgctttcacctacgtttcaaatcctgtcctttttttatcttcggttgtgtttttttcttctgaagatgaagattaagtttttttttatataaaataaggtggtattaatgaatgattaattgagttttatttattataaacttaaaaaatagattaatatgatattttagagcaactttcatatagaaagttttcatacgaaacataccattccacagtttaaaaagcgtaccatgaaaatcttaatcatcattcaatcaattctaggtttagggtttagagaaaagaatgtaacctttcaaaatagggctgtcaacgagccgagcctggatactgatcgagcttgggagtgagctcgagcgagcttcgagcctacttgagcttgacagcttgacttggtggaacttcaaagaacttactcttgtataaaagatattaatgcaaattatcggtagtcaaaattaatgggtgctactcgttttgaatgaagcctatgcagcttttctcatgaatttatggctttgaaacgttgcaattaacaaaagctagctactacatctaataggaatagtagtactattactagcagccggataattgttttattgagaagcattgatgaggtcttaagacttaagcaggtcaagcatagtgataagtatacattgatccataagaacatattcctaaatataatgcatcttatgctaatcaagctctgccaaactattcgagctcgagcttgctaggcttgcgagcctcagcctaggcttaagcttggcttatctagtattcaagcttgtaacgaatcaagctcgagcagcttgagagctctgagattttctgagcagcttgagagcttttttgacagctctattccaaaacccaatctctttctatctatctctaggtggtggggcccacatgtccgatgtgtaaaaccctaaacctccgcgacccaatccaaactcca

SEQ ID NO: 38148 - DNA, 1501 bp, Oryza sativa; identical to SEQ ID NO: 38134

SEQ ID NO: 38149 - DNA, 1501 bp, Oryza sativa; identical to SEQ ID NO: 38135

SEQ ID NO: 38150 - DNA, 1501 bp, Oryza sativa
atatcactgttgggttttccaggtgtgagctctgattccaagctctatgcagatagagaactcatgacttgtgaactctaatgcagttatgcatcaatgatctagcctccaaaagggtgagcatttgtactcataccttcatatgtttttgtaactgaagtttgttgatacctctgactaaggacatatattgttcttcaatgccttttggaaaccctataatgatgatcttcttctcttttcgctttcgtatcgtttttactagcatatctctgtgatcctctagattgcccacaactgatgcatcaaattgcttgcaactacaatatgtttctacttaaagaacttgcaagagaagcaagcacttggatgagggaaaacaaaaggtagttgaggtaaggatataataaagataagaggaacatggggtaacatggaccatcaggggtactttcatgccattgcaagaaatccactttgcagttgaaccatgcaatccttctggattacatgagctcctcctactttgatttgcaaccacttcagtatgtgtcatcacctgtgtggaaagctccatttgctggttttgttttgacagtataaaattagtggctaattaagtagacagtccatgccaggaagcaagcttgataccattcgcacatctcactatctcagtctcttacttactgcaagtggttctttgctcaaagcatcatagaagcataaaaaatagttacacatgaatgtcactgtgcccttttttatggcaaatgaaattactctcatgcaccttcctagaactcatccacacattcttcctaccccacatcccttaaatacatggccgtgcgtatccatagttgatgcagagactggaagttatctctattatctaaaaaattccctgtttataacaaaggaaatctagaaaagttcaatcctctatttacatttagatgttttgactagttaaacgtaggcaaaagaagacaattggcaactaaagtggacaagatggtcaaaaacatagtcttagaaagctgaaatgacaagtatctgaaactaaaaaaaaggctaaaactggtgttttctttagtccaaaaaatgacatctgtttttgaccccaaaaatgtaacataaaactaaaattcaagtattagatattcgacagatcactttcttaaacctacatttcaaatcatgtcatggatatgcacgatcagttatgcgtaacctcatcagctgaatccagtggcaacgtagtagttgacttattaaagtcggagtagatgatacatatattggacataatcagagtcattgtactactataccaaaaatgaattaagcagctattaatcaataaatcataagactacagcctcaagtacactatcaatcaatgttttgacagaagatctgatgatagcacaatttgatatttgagaaatctcagtacaaacctaacaagctagttttaacaacttaacattaatct

SEQ ID NO: 38151 - DNA, 1501 bp, Oryza sativa
actgaacaatgtatgcatgccatcatgcagcttttgagtccactcacaaaaatcatgcatcttttgaggtgttaataacatatctgatcttgcttcgaaactctaactgttgtctgtcttttatgaccctccagtgttcgaattttaacattaaacatcacaaaagatttcttcagactttaaacaaagctcacatcatttgccatgattcgagcttttggtgcaactctcaagtcttttaagaaactttcagtgttatacttaactgcatacaaagtgcaggagacttcagagttcagaagcttgagccatttcttctgcttctttgcgacctttgagaagaggcctcctttttctttcccatttttttaataaccttctttgttcatatcacagcagaagcaagtacaataagtagtaaatttttaccattactttactgtgtgttgctcgaggaaccttgtgacagtaaaaacaagcacataaagtcactctactaaactgaacctgtgctcatggttttacactatccatccaaatgcagccaaacaggtccaaaccgaggaccatacagcctgaaaaacctgaactttggcatgtcacgtggcacaccatgccaaaaatcttcacacattttgcattcctttcacgatcatcaaacatctttcgacatataaaattgctcacaaatatattatccatctaagaacatgcaataccataatatcataatatgattactccctctatccctaaataattgtcaccggatattgttcgtatccaaaattttacctcttacatgttatgaaagtgcattgcatgttaaatatgagcacgcagtttttattcgtttaaacactataatttaaaatttatcggtggtcaaatttagaacttcaatagcatttcaattatttcaaccatgttgggtcccttcctgactgtcagtgggtcccatcttgccggactccttcatcagaatttgaccggatttgctttgccgtacgggcaccccagatccagtgcttttgcattcttgcacagacagcgacaacgcggcattaacagcattgcattgcacacaccaatatcagcaatgtcactgtgtgatgccttttcttttgctatgaacacttgaacagacagtgatactactgattgctgaacaaggggtgagaccctgaaaaaaggaagtggttgtcttgatcctgaatagccctcttccagggcatcttattacatttggagagatcacttcttcagaattctggtgatactctgaattttagagaatggaaatggtttagatccccggcttctgcggatcggccaaggtcattggtgatatatgcatatcgccatgaatatatgcatatgcttgggtagatgcagccttgcagtaaaaatgcagattctcccatcatcaatggacagtgaggagcagagattgttgcattggtaccagaaggctgcagtagaagcaattgcaacaacaagt

SEQ ID NO: 38152 - DNA, 1501 bp, Oryza sativa
ggacaactaggggggtgctttttatagcggcggagggcgccagctaagcccatggaggcaccggtggattaggaaagctctagggttttggaaagagaagcaaaccaaatcggcatcgaatccgacgatttccaaatgaattagctcgggattccaaaagagaaaaagaaaaggagatcgagtcaagtgatttcaagagaaaaagaattagctcgggatttccgtatgcgttggaggaatccgttacaaattatggaaaatattcctatgagtcgagtgatttctaaagtcttacttggaggggatagagtttctattatatcttatgggatccgatgtcatgctgcatcggttaggttcgatctactagattgttgttgataatatatatgtcttgttaagccgataggttcatgctaatgttttatcggggtgctagccgataagttatatggacgttgcattggcttgtaaggattgcatatacatataagttggacttagccgatcgcaacaaaggtttcactgtttatctaaaattgtggattttatgacatcggacctccagccgatgtatgctttaaccttcggatcagtgcttattctatcatatcattgcctttatatcgatcagtgcctttatatcattatttacatcgagtgttagactctacattggacatatagccgataactcaaaaccctatcgctataccaactcctaaaaagtcgagtaactgcggtataaaaggattttaaggtattgggcacttgatcacgcgcactttggcctaagcgaaaagtgcctaagtccctaaaagaacgtgacaggccacacctgaaaatatgggctgcagacatattaggcctaggccaaaaaatatgccttcgacaccctttaaaggatgacgcatgtaacatgctcccgagtaataaatcttccgggtaatatagaccaagtgtagctcatatgaatagcttctgatctgaatgattatcccttatgggatactccaaaataaatataataattgaatcccgactggcgcaagtattcggttgtaacccttatggggaataataaatagtccagtctttaaacatagaaaatagacccatgatcatgaattcatattgcatgtatccagagcaagtccaaattgaaggtatgatacttgtgtttgaactagtaagcccctgagcacgtagtcacaattgttcattgatggtagctgacgcaactggcatagagacaagacgaccaatacagagataatattgcccagcagaggtggcaaaaatattggtggtagtgaagatagtgataccaatcaaaagtgatgaagttgcacagccgtggaggcgaagaaaccagtcggcagcagtcagccagcaatgaatatgaaggcgctcagcaataaagttgtgtagctatggcagcgaaataatcagtcggtgacagacgaggcaaatcaaaggcgatgacgaaatccaccaatca

SEQ ID NO: 38153 - DNA, 1501 bp, Oryza sativa
tcatatcacatcaattgtttttagcctttagatgattaatctacggtcaaactatctctctacctttcttcttccataaagtcataccaccttattttttacgtttgaatcaccattccacatactatttaaatttaaattatcataaaccacattaatttacttaatctgatgttatctagctatcttacacgttatttttttaattgttatcatactaaattcccgcagcaatgcgcggggtttcacttagttatcctataagtaaaactcatttaattttgatcaaaagtttataaaaaaagtttgtcataagtaacactagattagttttattaattaattagatcccaattgaatatatatatcatatttttatatatttgttttgcatgtagaaaataatgccatgtttttgtttttctgatcagacgtgaagaggtttgacttcaaataaattagacatcaaacatctaattacaacatgaaacaaacggagtgtgtactacttatctagtagcttatactatacttctatctctgttccaatttaagggcaattatcagttttcgtgttcaacgtttaaccgtccgttttatttaaagttttttttaaaaaaatagtcacacataaagtattattcatgttttatcatctaataacaataaaaatactaatcataatttttttcaaataagacagacgatcaaacgttgttaaaccttgtaaaactacaacctttttgtaacggaggtagtaagatttttatttttagttttgcaaccctgccagcgtaatcaactctagctaatacggccagactcggacttcttcatatataaacagtagatttagccatgttacaatactactagtgtcttcaaattaagcataattgaagcacataattatggggttgtcaatttaatctttataaatatatgtactatgtattaatacatttttagataatagaaatggttacatttccggtctctgtcaacaatcacacacacagccaatatatgagtttagcgttgaagaaaaaggaaaaacaaaattgagtgatggaacaagcccccatccatccaaaacagaacagaagttcattagttaccaatttcatgagggctagcaattccatgagtgtacatatatagtaccactgcgcatggtatcctactacttttgatagcatcaaataccaagtacgaagctaattggtagacatgaagataacccagcaattttttattataaaaaattatatcatttcggtaataccaaattgaccatatagtacactaaccacaaataaaatcgattttttttggacctggccggtattaccataaaccaatttccaaataaatacatacgctggcgattgtttaactcgtggcttagatacaccattagaccggtaattcatattcgctagcttgtgggcaccgcaagtggtccccttcaactacatacgaggtgtcttcatgtgtccct

SEQ ID NO: 38154 - DNA, 1501 bp, Oryza sativa
cctccattgaagcaaggagaaaagcatacagaaaaaggaacagacgcaaccaagtttgtgacacaagatcctgaaataggcgaaggtgccgttgctacgaaagatagtggcaacgtcaatgagcaaaaggacgacaacaagaaaatcgtggacaggaaactacatgcagctttactgtcacttagtgcggcaatatttgaaaaattgatcagtaatgatacagatttggctcaacttgctaatgcaattgcaacaggagattctgcatctagctttgccgggaagctcaagaagttggtagaagaaaacagtgaaccaacagccaattgcctgagaatactgaagattgccagtaggatgatcatatcactgataaatctcgaaggaaactaccccaaagcagagctggagagcttgatggaatctctgtccaaggcttccaaagagatgtttgaactggaagcgttcatgatgttctctagcagcgaccagagcgcaatgaatccagtaagcattctcggttctcaagtgaaacaagcacaggtccttctggagaataagaaggaacaaaatgtggcaaccacagcaactagcactgtgagtctgtgaatagaaaccagttgattcagtagattatcaactaatctgctgatcttcagaatgcagaccgttggcgatccctgaaaattatcttagcggtattcttgtaggataaattacttattccgtgtttctgtagcatgtgtgctgaaatctagctatcttgttccatctacttatcaaatgtcatgactcctgtacgggtgtggtgtctgataagttgggactacctgtacatttgtcgacaaattttctcctaaaaatttgacagaatgtagtacaaccgtattgtaattacactgtaacttgtatgtaattacactataacttgcatgtaactacagtgtaacttgtatgtaagtttcatgtaattttgaatcgttagatctattacaagatttgttccggtgaggaagaaaaaaaaatcacagcacacacatgtgaaaggatttattcccacgacctccattttaccgaaataacatgttacggagagatttttgaaagttacatacaagttacatgcgagttacagtataattacatacaagttacagtgtaattacactacgattatactgtaattacatctgtcaaatttttggaggaaaatttgtcgacaaatatatagcaaattcggtttgggtttatggggtcagctgggccattactttgggccttgttaaatgtttagttgggccatgtctttgggctgtgagagtatgtgtttgatgtgtcgtgctagactagcggtggtatccgtgtgcgtgtgtgtggtataagaggagaacccatggttgggagtttatgcgataagagaaaactgaatcctcctgccaactttgtcttcttcttcctctgttcttcttctctcccacgaaagggtcactttggggaaatg

SEQ ID NO: 38155 - DNA, 1501 bp, Oryza sativa
ctgccatagctacacaactttattgctgagcgccttcatattcattgctggctgactgctgccgactggtttcttcgcctccacggctgtgcaacttcatcacttttgattggtatcactatcttcactaccaccaatatttttgccacctctgctgggcaatattatctctgtattggtcgtcttgtctctatgccagttgcgtcagctaccatcaatgaacaattgtgactacgtgctcaggggcttactagttcaaacacaagtatcataccttcaatttggacttgctctggatacatgcaatatgaattcatgatcatgggtctattttctatgtttaaagactggactatttattattccccataagggttacaaccgaatacttgcgccagtcgggattcaattattatatttattttggagtatcccataagggataatcattcagatcagaagctattcatatgagctacacttggtctatattacccggaagatttattactcgggagcatgttacatgcgtcatcctttaaagggtgtcgaaggcatattttttggcctaggcctaatatgtctgcagcccatattttcaggtgtggcctgtcacgttcttttagggacttaggcacttttcgcttaggccaaagtgcgcgtgatcaagtgcccaataccttaaaatccttttataccgcagttactcgactttttaggagttggtatagcgatagggttttgagttatcggctatatgtccaatgtagagtctaacactcgatgtaaataatgatataaaggcactgatcgatataaaggcaatgatatgatagaataagcactgatccgaaggttaaagcatacatcggctggaggtccgatgtcataaaatccacaattttagataaacagtgaaacctttgttgcgatcggctaagtccaacttatatgtatatgcaatccttacaagccaatgcaacgtccatataacttatcggctagcaccccgataaaacattagcatgaacctatcggcttaacaagacatatatattatcaacaacaatctagtagatcgaacctaaccgatgcagcatgacatcggatcccataagatataatagaaactctatcccctccaagtaagactttagaaatcactcgactcataggaatattttccataatttgtaacggattcctccaacgcatacggaaatcccgagctaattctttttctcttgaaatcacttgactcgatctccttttctttttctcttttggaatcccgagctaattcatttggaaatcgtcggattcgatgccgatttggtttgcttctctttccaaaaccctagagctttcctaatccaccggtgcctccatgggcttagctggcgccctccgccgctataaaaagcacccccctagttgtcctctacccatcccctcaagtcccgtccgccgacgagacccgtagcaccctagccgcgctagc

SEQ ID NO: 38156 - DNA, 1501 bp, Oryza sativa
tactcccttcgacgacggcggcgcacgagctagcgcggctagggtgctacgggtctcgtcggcggacgggacttgaggggatgggtagaggacaactaggggggtgctttttatagcggcggagggcgccagctaagcccatggaggcaccggtggattaggaaagctctagggttttggaaagagaagcaaaccaaatcggcatcgaatccgacgatttccaaatgaattagctcgggattccaaaagagaaaaagaaaaggagatcgagtcaagtgatttcaagagaaaaagaattagctcgggatttccgtatgcgttggaggaatccgttacaaattatggaaaatattcctatgagtcgagtgatttctaaagtcttacttggaggggatagagtttctattatatcttatgggatccgatgtcatgctgcatcggttaggttcgatctactagattgttgttgataatatatatgtcttgttaagccgataggttcatgctaatgttttatcggggtgctagccgataagttatatggacgttgcattggcttgtaaggattgcatatacatataagttggacttagccgatcgcaacaaaggtttcactgtttatctaaaattgtggattttatgacatcggacctccagccgatgtatgctttaaccttcggatcagtgcttattctatcatatcattgcctttatatcgatcagtgcctttatatcattatttacatcgagtgttagactctacattggacatatagccgataactcaaaaccctatcgctataccaactcctaaaaagtcgagtaactgcggtataaaaggattttaaggtattgggcacttgatcacgcgcactttggcctaagcgaaaagtgcctaagtccctaaaagaacgtgacaggccacacctgaaaatatgggctgcagacatattaggcctaggccaaaaaatatgccttcgacaccctttaaaggatgacgcatgtaacatgctcccgagtaataaatcttccgggtaatatagaccaagtgtagctcatatgaatagcttctgatctgaatgattatcccttatgggatactccaaaataaatataataattgaatcccgactggcgcaagtattcggttgtaacccttatggggaataataaatagtccagtctttaaacatagaaaatagacccatgatcatgaattcatattgcatgtatccagagcaagtccaaattgaaggtatgatacttgtgtttgaactagtaagcccctgagcacgtagtcacaattgttcattgatggtagctgacgcaactggcatagagacaagacgaccaatacagagataatattgcccagcagaggtggcaaaaatattggtggtagtgaagatagtgataccaatcaaaagtgatgaagttgcacagccgtggaggcgaagaaaccagtcggcagcagtcagccagcaatgaatatgaaggcgct

SEQ ID NO: 38157 - DNA, 353 bp, Oryza sativa
ctattagtgttttgtgagaacaaaaggatggataggaacttgtggcgttcggtcagatgaccgcgtttcttgctgtaactcactgttgtatcgataaatctattaggtttgttgttgcggagagtgaagaatctagcatcctaccgaattttgctacataagcttcaacaattgtgcttgttttgatgtttggaactgcagtagtgtgagctgcaaactatgtaataagaattggctatagcttctatgaagcaaatccgggttgatttccattatatataaaaaaacaaatgtgcttgtatttgtagcaggtttctagatttttaattttctttctttcttgatcttgagga

SEQ ID NO: 38158 - DNA, 1501 bp, Oryza sativa; identical to SEQ ID NO: 38154

SEQ ID NO: 38159 - DNA, 247 bp, Oryza sativa
tgatggggtgcagcagtaacagggtcactcgcacccatgcttgaatcactctgactatctaataagcatgtcaaagaacacatcccccaagaaattctgcagtgcaatgttctaccaaggtaacaacaatgaagtgtccagaacactgtctcaaagtctaaggatacgtgggttcccatatacattggatgcaaggtctttcaagacatccgccatctgcgcctctgaatacagcgtcgcaccggca

SEQ ID NO: 38160 - DNA, 353 bp, Oryza sativa
atcggcgccaccatcgcccgcctccacgctgtccgggccgccgcccctcacgccccgccgggccgcagccgcctccatgccaccggatctggaggaggcgaggcccggcccgccgcctccacgccgtcctagccgcagcgccgccggatgtggcggaggcgaggtccggccggccgcctccacgccgtccgacccgccgccgcacctctcctccccctcgatctagcggaggggagggcgtcgccggccctcccgccgccgccacacagagagaaaggaggagaagtggagagagtgaggggggtgggagggcgccgccgccgctcgctggggagagggcgccgcgccgccga

SEQ ID NO: 38161 - DNA, 204 bp, Oryza sativa
tacaatggtagaatacaaagggtgtgcctttcacaggcaatcctgtgcgtgctttttaatggcttggatggaattactacttttttgatgttccaatctgaccttagtaaattcgacaatttatcacatttatagtactcctacatcatcagcaattattgtcaatgcaacttcatttaatatatcaactatgcagggacaaaa

SEQ ID NO: 38162 - DNA, 439 bp, Oryza sativa
tatgatccttttgacgatcctcctcagctcagtgaacttattcctgagaattctcctgtagggaaaccacaggatgaggtaatatgagttctgctattttgctcatgttggaaagatgataaaccaaaattgtctcaccaaaatcacaggctgtcttttgtttaattcgttttacctccacattcttgaaaactatttatttgtgcacatacctttttaaaagaatatggtatgaatttcagttgaggcagccactgggtgtaggtgtattttttttccttgttctgtctgtacaaattatcccgatccctaaaatatctagacaggcatgtttcagattagtcctagaagggtgtggttttgccgtgattctcctgaatgctatgtgttgtccttttaacatggtcatgatattttcttttcactgtcaatgtacaga

SEQ ID NO: 38163 - DNA, 1501 bp, Oryza sativa
tatacttcatatttcatatgacatatggtatatggtttgttttttttaaaaaaaggaaaaaaaacagctgcccaaagattacctccatcgaactattttttttcatgaacggacaccagacgtgctaatttcattgaatacagtagaaaaaaagtttatttaattacaagtgtgaaagtaaatataatgttaggttagggtgcttaaggtagaaactccgttaaccgctttgctcctgctaagacccaaattatgctctccttcttcacctttgaactaacgaaagcacactacaaattgatccatgatgttcattagttagaaatcacatggtttaatcgaggtctctcttctccaaacaacactcaatttctcagagatgcacttgatagtgcagtggcaagggatgtatggtttcaatctcgaggacatgtgttcaatccccaacacgcttataatttcttcttaaatatttggaggaatgtctctccctttaaatattactccagagttactatatatttggagtatgtccagattcatactcaaaagttactatatttttggacagaggtagtaactcaatatttagaggaatgtctctcccttcaaatattgtttttcttttaacactcaatctctctctccccctcttaactcaacacgtactaactcaaccccatgaccatgccctaaacggccaattaagcatgggattaccacaatgctaagtgccaaaagaagctcctcgctcctactccagctgcgtccttctccccaacacctaagctaaggccccgtttagttccccaaaaatttttcccagaaacatcacgtcaaatctttgaacgtacgcatggaaaattaaatataaattaaaagaaaatctaattgcacagttaggagggaaatcgcgagacgaatcttttgagtctaattagtccatgattagccataagtgctacagtaacccacatgtgctaatgacggattaattaggctcacaagattcatctcgcggtttccatacgagttttgaaattagttttttcattcgtgtccgaaaaccccttctgacattcggtcaaacatccgatatgacacccaaaaatttccatttcgcgaactaaacaggccctaataagctaagctataccaccatagcactttgaaccgccctcacacaccctgcacccactgctccttgcacagatttccatgcacatgcatctataatcatgagagagagagagagagagatgcaacagacacacaccaccaccactctcttctctactacactccccctagagctcatgagagagaggtccaggcagctgagctgagagagagtacgtgagcccacacgagaatatttgaagcgcggggttcgtggtgtgtgcgtgtgcgtctctctctgtctcactctctgtgtgagtgcgagacagtgagacactgcagcctttctcctctccccttcttcttcctcctcttctagcta

SEQ ID NO: 38164 - DNA, 1501 bp, Oryza sativa
ggttggtacatgtaactcaatagatcaaacgaagcatgctaattctagtagagaacttcccttcagaaaatgttgtggcaaaagttttataatgggagaaactgtatattgtgtgacagtttagttagtacagttgctctttttccccggatgagtgagtgatgactagcaagtaacaaggcctgtttagttcgcgaaaagaaaatttttgggtatcacatcgaacgtttgaccggatgttagagggggttttcggacacgaataaaaaaactaatttcataactcgcttggaaaccgcgagacgaatcttttgagcctaattcctccgccgttagcacatgtaggttactgtaacacttatagctatcatggattaattaggctcaaaagattcgtcttgcgatttcctccttaactgtgcaattaattttttaatttatctatatttaatactctatgcatgtgtccaaagattcgatgtgatgtttttgggaaaaagtttgtggaaactaaacggggcccaagtaagatggcaacaaaaacaggaataaaagaaatggtgaccaaggcagtgtggaacaccccggggcttttaactatttgccactcttacgagtggtgcttaacgatttgccactagactcatatgtcaaaaacacatgagggcccacatgtcattgacagggtgtggcaaatcattaattgccatgtcataagagtggcaaatagttaaatttcccggaacaccccaaccccacttccctcaccattccattcaccaaagcacagcagcacacaccaaggaaggcctagaaaagagaaaggcaaagaggaccaaaagaaaagaaaagaaagaaagaaaaaacttgaaaaaaaaaagctcaaaagaaagcaagagagaaagcaaccaggcaggcagaggcagaggcagaggcagaggcagtagccctcccttttttttttctctcttctcttctcttctcccaattcacacaagattcactcaccagctgtgccctcccattcccctctgatccaagcctttcactcaaagcttccagcttttccaattgcttggccacttcaagaatcaaggaatatgttcttgttcttggggttcctctgatccgactctccatcttccagcttccaggcttctctctcgttctgtgccatttttgctctgcctgagctctgtgcttgttgcattggtcactccaagaaaaggattttgaaggctggttttattgttcttctgttcctgggatccgaattgcaggcgagctcgctgttcgtgtggaggtttctttctttcattcattcgcttgaagaattcggcaaagccatgcgagcaattcgggatgatttctcggggcctttggaacgcgtgatgattctttgacccaccattgcttcggttttttttttctgggagaattctgcaatttcgcgagtttggtcgttgagctcgagccgtggtggtgttcttgatccggtcca

SEQ ID NO: 38165 - DNA, 1501 bp, Oryza sativa
tctggacatcttgattcacccaaattagggcagataatattgcgaggaacctcaccatcctgaaaggaagaaaaaaactatattggttagttatgagcaagggataatttcatctatagtaaacaaaacctaaaacatctggctaggtaattcactaacatggtcacatgaatgcagacataaacttttctgtttactcaggcttaacaccattaagccctgtaaagcacttacaaatggtactgctcataaacaacaaatcaaccatatgtattttacagttaagccttcgtgtatttagaacttgttgttgtacaattaaatcgatgaagattctatcatggcgtatacatttcaatcatatagaaccttaaagatatattttaagccaaagtaaggcagcggaaatgcaaaattgtatcaaatgctacacttctacataaatgtccgttccacgaacaaaacctctaatagaagaacatgccagttgcatactctcacagtactacacaatcagcatccaacgtaaccatcataagattgtgagaatacataggaaaccacctcttgagaatggttgtcagaatctagcaacatatacagctgctattcatagatataaatatacaaatcacaaatgattgatctgaatgacgtttaccgaaactacaacagcacaactcgaccacaagaagcatgcgaaattctcttgcagcaaggatgattagtactaattagtaacttggtgtgcatagcactagcaaggaagattagtactaatcagtaacttggtgtgcatagcatggcgtaaaggtgaacattctaaatttgcagggacctcgttaatttaaactagaggtttccactacatccatctcgtgttgcttaaaatctataaaaatactccctcctttcatattataagtagctttgacttttttttcttagtttaaagtttgatcaagtttatagaaaaaaattacttcctccgtttcacaatgtaagtcattctaacattttccacattcatattaatgttaatgaatctagatatatatatatgtctatattcattaacatcaatatgaatgtgggaaatgctagaatgacttacattgtgaaacggagcgagtagcaacaactataacaccaaattattttcatcaaatctaacattgaatatattttgataatttatttattttgtgttgaaaatgctattgtattttcctataaacttaatcaaatttaaacaagtttgactagtaaaaaagtcaaagcgacttataatatggatcagaggaagtaactcataaactcaattggacccatactttgtactgctagagaatactacccccaaaatcaactagattgcgccaaaacaatacagcaacgaaatgagcaagccaccccccgccacaaccaacccattctcttccattgcctcgacaccaaatcgcccctccaactgaccgctccaagccccccacgaaacccc

SEQ ID NO: 38166 - DNA, 1501 bp, Oryza sativa
aaattagggcagataatattgcgaggaacctcaccatcctgaaaggaagaaaaaaactatattggttagttatgagcaagggataatttcatctatagtaaacaaaacctaaaacatctggctaggtaattcactaacatggtcacatgaatgcagacataaacttttctgtttactcaggcttaacaccattaagccctgtaaagcacttacaaatggtactgctcataaacaacaaatcaaccatatgtattttacagttaagccttcgtgtatttagaacttgttgttgtacaattaaatcgatgaagattctatcatggcgtatacatttcaatcatatagaaccttaaagatatattttaagccaaagtaaggcagcggaaatgcaaaattgtatcaaatgctacacttctacataaatgtccgttccacgaacaaaacctctaatagaagaacatgccagttgcatactctcacagtactacacaatcagcatccaacgtaaccatcataagattgtgagaatacataggaaaccacctcttgagaatggttgtcagaatctagcaacatatacagctgctattcatagatataaatatacaaatcacaaatgattgatctgaatgacgtttaccgaaactacaacagcacaactcgaccacaagaagcatgcgaaattctcttgcagcaaggatgattagtactaattagtaacttggtgtgcatagcactagcaaggaagattagtactaatcagtaacttggtgtgcatagcatggcgtaaaggtgaacattctaaatttgcagggacctcgttaatttaaactagaggtttccactacatccatctcgtgttgcttaaaatctataaaaatactccctcctttcatattataagtagctttgacttttttttcttagtttaaagtttgatcaagtttatagaaaaaaattacttcctccgtttcacaatgtaagtcattctaacattttccacattcatattaatgttaatgaatctagatatatatatatgtctatattcattaacatcaatatgaatgtgggaaatgctagaatgacttacattgtgaaacggagcgagtagcaacaactataacaccaaattattttcatcaaatctaacattgaatatattttgataatttatttattttgtgttgaaaatgctattgtattttcctataaacttaatcaaatttaaacaagtttgactagtaaaaaagtcaaagcgacttataatatggatcagaggaagtaactcataaactcaattggacccatactttgtactgctagagaatactacccccaaaatcaactagattgcgccaaaacaatacagcaacgaaatgagcaagccaccccccgccacaaccaacccattctcttccattgcctcgacaccaaatcgcccctccaactgaccgctccaagccccccacgaaacccctcagaccaacccacctcgtcg

SEQ ID NO: 38167 - DNA, 1501 bp, Oryza sativa
gtgccatctgaatgataactatcaccaaaaatatgcaaggcaaacgagacaaattaatacagcagactgcatatggtattttatcacatttgagacacaaaccttctcgaacgaggaaatgaacagaccaagttttccacaagccaaattatatgtcttcccagtcaacggcaacttatcttcagcctttgttagcaactctttaattaccctagaatctttaactgagacaagcagttgagagggtccgagccacagtcgaacaactgggccataactgccatgtaacttcgataggtagcctgtttaataatgcagttgaaaggaacatatgatcagtggtgaaatacagcagttcaggggaatatgatcagaaatcaaaccatccacagttttagtgttttactcaacaaatactggtagatcgcaattatgaatctgctcaaaatctgcattagctatttctttccagaatttttatgcgtaacaatgtacaaccgactatctgttatgtagagtatttgatgcaccatgtgctagagcattgtataatcgggccctaaagactacagagttgagctaggccagtctacgcacatgctcatttgactaaacaggaaaaatgagaaatacaatatgatgccacaaacataggacagcatggtatcaaaaagttatccgtatttccctgcaaaaaaaaaaaagttatccgtattaaagttagtaaaatactcgtgtgatgcctatctattcctatatttatatgcaaaacacctaccttatgcacagcgaattctgttagtaactcaatcctcatctggcaaaatcgtaatgaacaacttattcatataagggagatgttttttttcatccagataggttatttcagcaatttttgtccaatatttcctaaatcatagtttggcgcaggtcagggtaggacggttcatcctaccttcatgtacatcgtattcaaaataaggtgtaaatgtttattttaaagaaaaactgaaaacattcaggcacaatggatataccagaccacaattcattatacatagtttaaaatcgaactttgtcatggaaggtgaaataaagaagcaaaatcaactgaaagaggataattgaaaaaaaaagaggatggtactatattattgtttactaaaatctgtctattcaattttctgccctgtgttaaactaatttagaaactgtggcagcgtagatccatgcagtatcattgttttcaaattacctcacactttttaatgaccatttgcaggtgtttttgatagggtacatgatgcaccgatattgttctctagcaccaatagccaagatgtattgaagagcggaggattagatctagacaattgacatgaagatcagcatacactgatgacagatttgatttgatccgattgccatgagcccatgagaaatgtgtttttttttctcaggaaacagagtattaattcaattctcctgggaattctactat

SEQ ID NO: 38168 - DNA, 1501 bp, Oryza sativa
tcgcgcacgacaagcaaccagcagctgcaggagctatgcctcaccctacttgtcgaaactagatttcggcaataataaaagggggtggctatcaagcttggaaagtgtatgggttcggagacaaaagatttatacaggttcaggccttcttaaaaaagaagtaataccctactcctgtccggggatgaatccgccgagtgtattattaattgtatgattcgggaaaaatcaacaactgcccctagaggcgcccggaccccccttatatatgggaaggagtccgggttacaaaagataatctatatccctaacggaatatgaaaatataggtaagatacagtcgtaaccgactaaatttcagggtgtttccttgatacacaagttaagaaacaaacccaagatacaaataagatattctatctacattaggtatccggtacccaatccaaataccgtctccgtgtagatatgggttacccataatctccacagtagcccccgagtcctttgcagtcgaccatcatagccttctcaaagataataatccgagtacttctaactcttcaagccaaaacctgccaagtggactgtaaagggcgaaaagaaaaagaatatggtgcatcgaatagatgcacctaattaggtgtagcccccaactatgtgattagttaacaaactaaacatatagttgaaagacaaaataataacacagttgtgcattatatgacaaaagcgtatgcggcgcctaaataggcatgttagccgactgctttttagccataataaaagaaatccgagtggtttacactctaaaaagttcacgaatgaacacacttgacaggtatccgaatataaaaactctaaagattacccatcaagtattataaagattatggtaataaaaaagtcaaatagcctaggccatgactatttaccgtgaaaacaggcatataacacgccaaggaaatgactataataaaaacaagtcattcctagttaacccaaacagcttttgtagcctaaaaaagcttgcaaaaatagcataacgcctttctgtcgggcacctttttaatttgcattgcaataattccaaagaattatatgaccgcataaaaaggatttgagcagcattgggcaacactgttgtgcgcataatattgccaaagcaaaatatgcctaagtccctaaggaacacaatgggccacgctgttaaaagtattgggctgaagtactgttcaggcctaggcccattagcacctccgataccctaaactgaaaaatcctatatccaagcgacgcttcgtcttccccgccggaactctcgccattttccccactccctgctacagtgcaaagctgcgccggcgaactagggttcacaactccggccaaatccacctcaaaaaagtgcatcaaaatccttcccgtgatccaccgcctcaatccctcacctctcccaagccatccctcgaatcaaatcagcacatttgagtgaaaccga

SEQ ID NO: 38169 - DNA, 1501 bp, Oryza sativa
aacgaaagctccagaatgtcggagtttcgagtttggcgcatctattttccatacagcattggacccagcatcacaatttctaagccttacaatgtccagctgagtgcaacagtcaaacagaatatgatgaatgtctcggtgaagataacacgttgtacagagagccttgtgaggaagtgaagcacacgaggaaaagcaccagcaaaggctttcagaactctggcctgacaaaacatatctttgtcatcgcaatcttcaggttccttctcgttcaaaatagcaaggtccaaatcttttactattccaccatcaatcgcttcacttaatagaaatcctttatctctcgagtaattgcccatcaagtagagcttaaggcatagacttgtaatgaaggtttctctctgcggcacagctagcagactccttgctgctttggtgagagttgacatagcttcgtcaatgtacacggtggttatccagtttagttaactgccaaggtaggtgcctccaccttgttgacaggacacttgtttttgcagctgtacaaatgtcaactctccccaggattgatagtaaaatatcatcatgaagcatgctgagtctatcttcatcctccacttgctacaataattagattgtgctaaattaatgaattaaagcatcggtaataaaaatgaaaaaatataattattacgacgggaactggagagcagaacttacgaggatatgttctttgtttaactccatggagaatctgtgttgggccgtttgtaacaaaactagtaagtgtaaaatccaatgcttgtagggaaaaaccaacgatcctgcttattgtttatgatatgtaaattgtaagggtcgttgagtccgattctaacaatgataagctcatggtggcatcccaaacattccggaacgaattcatacaaccacaaaaccaacttgttcttaacttaacctactacttatgatcatttcaattgcagtaagtaataataacaactactccatctgtcccaacatataagcatttttagcatattgtcaagtcaaacatttttaactttgactattaatagaaaaaaagctcaatcatgtaaaattgacgttactagatttatcattaaacaaacaatcataatatgcaacatttttatttaaaacattttatttttttaagatattgttagtccaagcaacatctcgaagactatatagaagtaaaaaatacttatattttgatatggagggagtagcattctagcaactacagcagaatggtaaatctcacgcgataccgaaaatcacacgttttctcccttaggaacagccggaaaaaaaaagaggatccgggaaatccaccgacaacatacatgaagagagagagagagagtgtgtgtgcaggcgagcgggcgggggagcggcgagggcgtgtcggatcgtagttccgtgagcggtggcggcggaaacctaaggagaataaaatcagatttttgaaccc

SEQ ID NO: 38170 - DNA, 1179 bp, Oryza sativa
tatgttgtgaataaagaaatttccaaagtattgggcatacgccatgcgcacactgctttaacagatgtgcttaagtccctaaaagacacatggttccaccacacctgaaaatatatggcatatgtggtataaaatccgtgtaaataaactcataaaggatttaccaaccgcctgaaaaatgaccacaatatataatcagcctaagccataatattggtcaataaaaatgcacacttacgtggcaaaaagcaacgatattgtatccaatcaattgcttaaaaacccaaacagcaccatgactatattaaaaagtcagcggggcagctatataaagctttactgtttgacaccttttaagatgcattgtaccaactcctaaaaagttgagtaactgcggtataaaaggattttaaggtattgggcacttgatcacgcgcactttggcctaagcaaaaagtgcctaagtccctaaaagaacgtgacaggccacacctgaaaatatgggctgcagacatattaggcctaggccaaaaaatatgccttcgacaccctttaaaggatgacgcatgtaacatgctcccgagtaataaatcttccgggtaatatagaccaagtgtagctcatatgaatagcttctgatctgaatgattatcccttatgggatactccaaaataaatataataattgaatcccgactggcgcaagtattcggttgatagcccttacggggaataataattggtccagtctttgagcatagaaaatagactcatgactatgaatccatgtggaatgtatctggaacaagtccaaattggagatataatcctcacgcttgagttgatgagcccctgagcatatagcttgtccttttgtcatagtcaaaattgtccattgatggtagctgacgcagttggcataaagacaagacgaccaacatagagataatattgcccaccagaggtggcaaaaatattggtggtagtgaagataatgataccaatcaaaagtgatgaagttgcacagccgtggaggcgaagaaaccagtcggcagtagtcaggtcagccatcaatgaagatgaaagcgcccagcgataaagttgtgtagccatggcagcgaaataatcagtcggtgacagacgaggcaaatcaaaggcgatgacaaaatccaccaatca

SEQ ID NO: 38171 - DNA, 1501 bp, Oryza sativa; identical to SEQ ID NO: 38152

SEQ ID NO: 38172 - DNA, 1501 bp, Oryza sativa; identical to SEQ ID NO: 38154

SEQ ID NO: 38173 - DNA, 1501 bp, Oryza sativa
gttgaaagttttcaagtcagagttgaaagttttcaaatctgagttaaaagttttcaaatccgagttgaacgttttcaaatccgacttgaaagttttcaagtttgaattgaaagtttcaaatctttagttgaaagttttcaagtccgaggtgaaagttttcaaatccgagtttaacgtttttaaatccgagttgaaagttttcaagtttgaattgaaagttttcaaatccgagttgaaagtttttaaatcttgacttgaaagttttcaaatctgagttaaaagttttttaaatctttaacttgaaagttttcaaatattgactcctactcttagatgcgtgtggtagttaatggcaaaaagaaaaaaaagaaaaaaaaacacagcagttgcgcaaccgaaaaaaaaggaaaaaaagaaaaaagaagcgtgcacgatcgatcgtacgatgacccgccacgtggtacacgtgcgacttggataagtcacgcgcaaaaccgcattaagtgcataaaaagattgtaattacggttgtgagaataaatctcaggaagcaaactgttaactaactatttcaactacgtgtttattacgtaatgatttcaatatgagggagaacatcatttgaaaaaaaagacacttcataatttcacatgcaaaagtaatccaatctttattcaacataagcaaccgctatattttactccctccattcctaaatatttgacgccgttgactcttctaaaacatgtttgaccgtttgtcttattcaaaaacttttatgaaatatataaaactatatatatatatatatatatatatatatatatatatatatatatatatatatatatatataaaagtatatttaacagtgaatcaaatgataggaaaagaattaataattacttaaattttttgaataagacaacggtcaaacatgtttaaaaactcaacggcgtcaaatatttagggacggagggagtattttcttgttgactacaagaaaacgaagcaataatgccaagaacaaccattttatcattttcagggtgtttacaatcacatgcggtagcttcaaaactagctaggacggaacggtaatctttaactacccaaaaactggtcatttggatgagcagaccagaccatccagtttgcttgggatgtgccaattgtggctgtcaacactatgtttgtcggacaattcgactccatcaacacgtatccagtaacaggaggataagagggatgtagggatgtttccatacattattaattaggcaaaatttgctatagtacataaaaaaagtgcaattaggtaggggacattgtaagaacgtgtatttgctgtagaacatcgtaaaaaaatggtaattagctgctggacaccgacaaaattattttattatttttagaggaataggagagagaaacaatcattaaagaccattttgcccttggctcaaattaatccaaagtgagtgtaccgtagagattggca

SEQ ID NO: 38174 - DNA, 1501 bp, Oryza sativa
ttatggtatcttttccattaaattattaccttttaaatcctccactcccatgttatctaattctattgaatgcatgtattatattattaggatgattcaaactataagataataataattatttcttgatttttgagttaaggatggttgtgccttatattttaaaatggagggagtagttggaccagatgagaagtattaccaggtctgaggcctgtggtgcgcagatctttttctccagggagccgtaggcgaatgttccatctctcctctcctcttctcctctttattactgcacgcagagagctccagctcgcgctgctccgaccaccgccgcgccgctcgccgcctccgccaccgcctccgccggcaaaccaccccctcgccatggcctccccctgcgagcaccacgtcccgtacaccctcctgggcgcgctcctcagcggcggcggcccccacgccgccgcgtgcggcggcgccgccttcctccgcgactacgcggagcggggcaccaacgcgctgctgtgggcggccctcctcgccgtcacgtggctgctcgtcctccgcctcgccgcgctgctccgcctctgggccctcggcgcccgcctccccggcccgcccgccttccccgccgaccctggcctcgccgccggtgacatcaccggtaggtttccgtcgtcctcctcctccttcctcccttctcttccctgttcgtgcgagtagcggttggtttggtggtagttccggtgggtacggatgcggagctactgtggaattggatttggcgcgagttcggcgccttcgcagggtagaattattgggcatatggccttctctttttatgcttgctcgggtttccgtgggaactgttcgattgggaggaacgttgccgcagtttgattcgagattcagcaactcatcatcctccagttgctacgcgagcgacctgagtacggtgatttgggaatctgttcttattttgattaattgatgtgggatttgatttagttgggcgctgatctgggtggagttcgattagaatgtcaaatcggctgatttggactgtgtcgaattatttgatctgttttacgacagattcgtgcccaaatttgtagcttcagtggctgtaagcctgtaatatttccgttcctctttgaggaagtggaacctgctggtatgaggtaggggaagacaaaaaaaaaagaagctagtgattgaggtatgaactgtttttggcggatctgttttccagcaactgagcgtgacctataaattgttgcttaatttgttttgccgtttagattctagagtactttttactttttatgtgaggttgtttttgctgaattttcatattttgtaagtcagcaagggaactgaattattaccaagttgaccttgatttgggatatatttccaaaggattggacggtgtagagatctgctacgtattactttgaggtttgtctgattatatgaatatagtagaattcccaggaga

SEQ ID NO: 38175 - DNA, 1501 bp, Oryza sativa
atgtactctgtaatggctagggttaaaaacttaaggtttctattcatcttcgccattgtttcgctctcactatgtgtgcaatcataagctctctttctgttgcgcctatcatctaggcaccatattcgctgatgcactaccccatcctcctcttatgcatttcattcatcctcttgtttagcaaatttaatttaattttaaagtaaattgcgttgacggtacaataacttggcaggtgggtgcgattaggtgtaaaaacttgaaaatacactgtccagcgtagcggtacaataacttggctaggtgggtgcgcccatagtgcataagttgccacgtaaacaaaaattgccatgttaccattccaccttatcacaattgccgcatcggctttgacacgaaagacctatctcattttatagaaaaccacttaatatcatttcttgacgtacacatatctcctttcatctttcttaacgtgatcttgaggtggttgcgctggtggcggtggcgacgcagcggcggtgttcaagccctaaaccagtaaccaaaccaattcaagtgtcgacgtgatcgctgcaagctttgggatggctccgactcggcgagtttttggagcatctgctccttgttttggtaaatcacttgctgatggttgtagatttctatttcttgttcaattgatggatggtcgcaaagacatcagccaacactgagaagtggcacttcgtcagtcccaaaatagctcaccagatttgctaacccctgcaacccttgcagcttgttcttcagaataagctcctagaaaaagcaaaaatcagatacaagataaaataaaagtgcaggtaatttgtcgtagcttcaaagtcatgctagtgctagtacagatgaggccgctgcaacagctgatttgagtcccaccgagggcacgaccaccatcgcttgctctgaaaccttatgagtgatgatcgtcgccgccaactgcgagcccaaaccgtcgcggactatagtagtgtggagattatgggtaacccatatctacacggagacggtatttggattgggtaccggatacctaatgtagatagaatatcttatttgtatcttgggtttgtttcttaacttgtgtatcaaggaaacaccctgaaatttagtcggttacgactgtatcttacctatattttcatattccgttagggatatagattatcttttgtaacccggactccttcccatatataaggggggtccgggcgcctctaggggcagttgttgatttttcccgaatcatacaattaataatacactcggcggattcatccccggacaggagtagggtattacttcttttttaagaaggcctgaacctgtataaatcttttgtctccgaacccatacactttccaagcttgatagccacccccttttattattgccgaaatctagtttcgacagttggcgcgccaggtaggggttgcgtcaagcttttcgccgatcagtgcaa

SEQ ID NO: 38176 - DNA, 1501 bp, Oryza sativa
tcacggttgggatcatgtttgccgtcgaactcgaatgctgtgcgggatctttccttgattggcgccagtcggcatttgatgaagtgccgagtgatttgctctccctgtaagccttgttctttaaggtttaacatacgatccaacaactccaaggcttgtactgcttcatctccgatcggaagagagttccaagtgtcttggtacattggaggaagacaagagtacccgggaagagcaggctcgggattctgaacatagaaccagttcgcatgccatcctttgttcgaagtcttgaagggcatcgagaaatatttttggcttagagttccccttagttggaatcctgcccccccgactacacacggtttgttcttgtttggttggggtttgaggaagaagattcggcggaatagggcaaagtgaggtttgatccccaaaaaggcttcacaagcatggacgaaattggcgatatgcactatggaattcgggtttaggtgatgcaagctgattccatagaaattcaagatcccgcggaaaaattttgaggtcggaagagcaaagccgccgtagaagaaatgcgagaagaccacgatctcatgagtatccggagacgggaaagcctcaccgtgcgctggtcgccacccgatgatttccttggcaggaagaacgccgtgcgccaccatctccttcagattttcttctgtcacgtcggatgtcgcccattggctttcgaagctttctccctcttccgccatcggtttcactcaaatgtgctgatttgattcgagggatggcttgggagaggtgagggattgaggcggtggatcacgggaaggattttgatgcacttttttgaggtggatttggccggagttgtgaaccctagttcgccggcgcagctttgcactgtagcagggagtggggaaaatggcgagagttccggcggggaagacgaagcgtcgcttggatataggatttttcagtttagggtatcggaggtgctaatgggcctaggcctgaacagtacttcagcccaatacttttaacagcgtggcccattgtgttccttagggacttaggcatattttgctttggcaatattatgcgcacaacagtgttgcccaatgctgctcaaatcctttttatgcggtcatataattctttggaattattgcaatgcaaattaaaaaggtgcccgacagaaaggcgttatgctatttttgcaagcttttttaggctacaaaagctgtttgggttaactaggaatgacttgtttttattatagtcatttccttggcgtgttatatgcctgttttcacggtaaatagtcatggcctaggctatttgacttttttattaccataatctttataatacttgatgggtaatctttagagtttttatattcggatacctgtcaagtgtgttcattcgtgaactttttagagtgtaaaccactcggatttcttttattatggctaaaaagcagtcggctaacatg

SEQ ID NO: 38177 - DNA, 1501 bp, Oryza sativa
gaaatcggaatggataacctagcttctctagaaatagggtcttggttgtgttgttcccactcctttcccaactaatctcctcgtttttcgtgcgcacacttcccaaactactaaacaatgtattttttaaaaaagtttttatacgaaaaattcttaaaaaatcatattaattttttaactaatacttaattaattatgaaaataaaccaccgtgtgtttccattcaatcccgaacacaacctaaataaactggtttaattcgttagcatgtaaaaaaagtaaatttcacaaaactacagaatttttatcaaattatcactaaactacatatttagtgtgatatattataaaactacatacttaacactaaatttctcacataactacatctttaaggtggagtatcgtaaaactacatatttagtaacaaaattattacaaaactatatgtttagtgacaatttaatctaaagttacatgtttataactcaaacataacactagtgcgaaggacttaaactctaaaatctatagtttcgtgataactttgttattaaatctgcagttttgtgatactccactttacatctgttgttttgtgataaatttagtgttaaatctgtagttttgtgatacatcatcttaaatatatagttttgtgataatttgatcaaagttttgtgatacgtagttttgtgaaatttacttaaaaaaagtttcaattcgtcgatagaggttccctcacctctcccggtcgcccacattgcctgagcttgagcttaatcggttccctcaccttcctcttctttttctctggaccgtcatagccctcgctcttattgttgtagactttccagtgccactcagtcatctcctacgccggccgccggccctctccccgccaacgggctctagagaaagtgagggggagagatggagagagtgaataggtgggagtggtataagtccatttacatgtgagtattacatattttttttattttttaactaagataccacgtcaaccaaacattgattcgtatgatctgtatgattttattcaacccagttttaaaatatggggttcaaaaatctgattttattctccttaggtttccgccgccaccgctcacggaactacgatccgacacgccctcgccgctcccccgcccgctcgcctgcacacacactctctctctctctcttcatgtatgttgtcggtggatttcccggatcctctttttttttccggctgttcctaagggagaaaacgtgtgattttcggtatcgcgtgagatttaccattctgctgtagttgctagaatgctactccctccatatcaaaatataagtattttttacttctatatagtcttcgagatgttgcttggactaacaatatcttaaaaaaataaaatgttttaaataaaaatgttgcatattatgattgtttgtttaatgataaatctagtaacgtcaattttacatgattgagcttttt

SEQ ID NO: 38178 - DNA, 1501 bp, Oryza sativa
gctcaacccaaagtgaatgtgaatgaatgagttgggtaaccctagaaaagggttaggtggggggtattcatagaagcccccaaaatgtggccgttgggagagaatcttttcatcccacctcggaaagtctgaggtgacatcggatagtccgatgtttttgacccccaagcaggccagagacagagaacgaaattctagagaatttcggacaatccaatcgatcggatagtctgatgtcatatcggatattccgttatttttgaaccaagaatttcatcctctcacagagactcaagttccattgaatttcttagtctctggatcattagatactccgatcatatcggatagtctgatttaaaactcactcaaaaggaataaaaagcaattcaaaacagagagtgaagttctgagaaatttcagatagtccgacgtatcggatagtccgaccttatatcggatagtccgatattttttagccaacactcagacccaagacagtgagcaaagttctgtgaaatttcggatagtctaatcaacatcggatagtccgacagacataaaacaggaacacttcaaataaatgattttgagcactagtgttctaccaattatatgcatgtggcattcctcttaatagtacggcatcctaatactcaagaacacaagatatgcatggattagaagacaattaccacaaaagatgccgcaatacttattgtgttgacatccactactttttcatccttgcatacgtctcaacaaaaagcattagttaccctctaattgtgttgtcattaacaccaaaataaatgaggggtcctagatgcactttcagtgagaatcataatcaagatggcaacacggcacagctacaatttaacaacttccaggataggattgactatgccgtgcaacatgctttaattaatcaatcttgggtgttagtcaatactttgtcaaacatggtgaagtcgatggttgattgctcgatagctgagtatcaggctacaggaccggtttatttgccaggaggtgttttcccaaactatcggcccttggtcactaataatcagccagctgttcagccaattcctcacagtgcaccatcggctcaaccgacagcaccagtctcggctcctgcaccggctgcaccatcatcggcaccaggtcaactaattaatccttggttgttggtgagagaacagccatagcataatggacaaaatgtgaatcggctaactcaagaccaagttgctgctatgttcttaccagctcagcctactgttgacacaatctagcaacaaccgattcagcagatgccaccaagacagcaggttgtgtagccgattcagcagacaagaccgaggcaacaggttgttcagccgattcagcatcaaggtttggtgaatgcatcggctgggttcggaacacctgacaattagctaagacagcacgctgcgaatcaagttgtcccagagcatttggttcataatgtgca

SEQ ID NO: 38179 - DNA, 1501 bp, Oryza sativa
agtagataggaattactacatgagagcgcataaagtgtcccacagagccatgataccagtacagataatcctcagacacagtgccggtatctacggtaacagatatgcatgatcgccatccttattacataatagaacatatttaccttactttagttgcaacttcaagcccttccaagattaacatatctagtattcaattaaaccaataaatcaacaaactcatctgtgcacaataagtacatcatggcgtgcagacgttctgctactcccatttcctcgcgcacacatgccacattaagtagggggttgctagtgcgtgcgtgcgcgccaggaaaggagccggcgcgcgctagccgcgtccctacgcgtttctttttttctctagatctcctattttggcgtcaccttttcgtttcctttttaaaatttccagattttttggaatcgcttctttcttttccacttgcgcgcttgatttttatacgatattttataaattcaatctttcagcttcaacatcagttgagagttttgaatttgagttgaaaagtttctaaaatttaagttgaatgttttgaattttgagatgaaagttttcaaatttaagttgattattttgaattttgaagtgaaagcttttaaatttgagctaaaagttttcaaacctgagttaagttttcaaatcttgacttgaattttttaaatttgaattgaaagtttcaaatctttagttgaaagttttcaagtcagagttgaaagttttcaaatctgagttaaaagttttcaaatccgagttgaacgttttcaaatccgacttgaaagttttcaagtttgaattgaaagtttcaaatctttagttgaaagttttcaagtccgaggtgaaagttttcaaatccgagtttaacgtttttaaatccgagttgaaagttttcaagtttgaattgaaagttttcaaatccgagttgaaagtttttaaatcttgacttgaaagttttcaaatctgagttaaaagttttttaaatctttaacttgaaagttttcaaatattgactcctactcttagatgcgtgtggtagttaatggcaaaaagaaaaaaaagaaaaaaaaacacagcagttgcgcaaccgaaaaaaaaggaaaaaaagaaaaaagaagcgtgcacgatcgatcgtacgatgacccgccacgtggtacacgtgcgacttggataagtcacgcgcaaaaccgcattaagtgcataaaaagattgtaattacggttgtgagaataaatctcaggaagcaaactgttaactaactatttcaactacgtgtttattacgtaatgatttcaatatgagggagaacatcatttgaaaaaaaagacacttcataatttcacatgcaaaagtaatccaatctttattcaacataagcaaccgctatattttactccctccattcctaaatatttgacgccgttgactcttctaaaacatgtttgaccgtttgtcttattc

SEQ ID NO: 38180 - DNA, 1501 bp, Oryza sativa
tagagtggtggtggttgataggacactaaaagatataaacaaaacccaaatagaatgtcactgatgattaagtggagggacgatgggtagaccattaagcatcacggtcacgatggcgggacttatagaaagtaaaaaatataccctaacgataatcatattttatttttaaaatctcatgataaaaaagaggggaggcagcgggtggtccatagaggagtacggtggcaaagccgctgacagtttgataggacttctagaaagtaaaaaatgacctaaatgataattatgtttgtcttttaaaatatcaatcgcaataaagagataagtcggtgggctggtcataaaggagtaaagtggtggcatttgacgagacttctaaaaattataaaacaaaacccaactagacaatgaactctaaaaactacaatgtctaatttttaaacgttccaagaagaatgaatataagcagtcatagatcgcatgcaaataaaggagtgataaaggagtaaggggtagcgactggtgtgacttttaaaaaataaaaaaaattagaaacacgtgaactatttaacaaaatttaagaaaaaatcatatgtaaaaagtagataattttgtatgggtgctagccacgcaattgcgcgggtcacccagtagttctattgaaaagcatcatccttttagtattgggttgaaatgaaatcttcctattggggcaagatgggctttgctttactctagaacttagtggattagaaattatggccccgtgtagtcaggcacctcgcaaatgctacaatattgctagcaaattcctttgcactctatctttccttccaaatgaacatgaacagtactagaaattcctgaagaatgatcttatgaaaatctttgttccgaaagtgtgttttgttagccccttttcagagaaagaaaaattatcattgggagcaataaatggtcagaaaagaaaagaaaaaagtgacgaataggaaatacaacaaatgtatagtagaattaagaagtctaacccagctgtctggacaagggtgataatggtgagactccaaaaatccttcttctcaagcatggagacgaagccaccaaggaggacgacggtggtccataaacctactaggaagcccatccccttgacggccattgacaggtaccccataaacagagcataactgttgataccgtcaacttccttccactcggactgatcaggttcattagccattgtcagttcttcctcaagaaagttgggatcatcgtttgcaaagcagcaagccaatatatatacaagctcctcgagcatatgggatgattaactatcaatacgtagaccaatagccgattaatgaaaaatgttcagatcttgactttacctgcacgaagcgatcgaggtcattgtaaagtatatattgttcatccagcctgttcagttttggaccaagcaattagctaggtctttattatatttatgtattagtagatc

SEQ ID NO: 38181 - DNA, 1501 bp, Oryza sativa
ggtggaggaagatttgggcaagtgaggtgctcatgaatctagcgcacacaacctgttcgatagaataccaaaccaacataaggtgtttaaggacgatgaaaggatatcagagcccgtttccatcaaatccaccatgaacaaggagggaatatccatggacgaatctttagatcagaatcttgggaagcttgagttgatggaggccaagtgcatgcaagaggagaagttcaatcaaatactacagaagttggaggagatagaggcttgtaggagcaaggctaccgaggtgacgattgctgccatcaggacaaccaccgccatcctcaaggcttcatcatctccaacaccatggcaccacctcctccaacaccgaccaagtgtttgacaaaatgccccaacaacaacttcacttgggtgatggcgaattcaagtcacattggtgaggtgcttgctccaacggctgcctgggagctaggagacaacaaggacaaggggcacgccccctgcatcgtcaccaacgactcacccaaggtcacgcccgccaagtgctcgaattgttctagccctgacatcatgctagacctcaccgtggctgtgggggtttcatgtgccactacttctatggcctccatggagttgttggttggcgaggatgaaaccagtgtcatctacattgacaaccctcattgttccatagcgacgcatgccaagtgttcgactttgggcctcgatgtcaatggtagcgccaaccaacctgtggtcgtgttccctaccattacagctatgaatgggcatagcatcattccaactctgcctctgaccattatgaatacgtcagtcatccttgttgtcaaatcaagttgtgctagcgacaattctatcagacttatgactctatgttagccactaatggagtatgctgagaggaatccatggccacctcctccttcgaacaagctaacgggtagcatatgtgagctatggccagaaccatggtcatcgtttgcgtgtaatcgatgcaaagtgtggtacttgttccgattggagagcacactattactgtacgtgaatggagttgagcagtttctaaaggaattgccatgctggccaccgcctcaagaagatgtgattaaatctgagttttatcatggagggaatcaattttggttgaggaattcagcttgtgttatttttttttagataatggattcagttgtgttattgcagagacaaaaatgatatacgtagctactgttgtgaggttcagtttgtgctatatgcagatgggtgctatgaaaccttcaagtgttatacaatggttaaatttcccctactgcacatatgacggattcaagcggaagcttcgaggcttgttcacaaatggagccttgtgcatacattcaagtcagtatgatcctccagatgggctttgtgaataatccggttgctatttagtagaactagaaagaaagcccgcgcaaatgcgcgggcatcttattga

SEQ ID NO: 38182 - DNA, 1501 bp, Oryza sativa
ggagccacaggcgtatcctcctccgttccggcttgcggaaccccaaaccgacctccttgtccacctcgtccaccttggcacacaccggtgccctccactgcaatcgcattcattccctccgctaagcaacccgcagccattgctcgcggcgaggcagctcgaagaacctgggggactcacgaagcaaacccgagtgcgtgggacggaggcagcggcagcgcagacgggggacaagcaagccgccaccaccaccacggcagccatgccaatctctacggtacactcactttggattaatttgagccaagggcaaaatggtctttaatgattgtttctctctcctattcctctaaaaataataaaataattttgtcggtgtccagcagctaattaccatttttttacgatgttctacagcaaatacacgttcttacaatgtcccctacctaattgcactttttttatgtactatagcaaattttgcctaattaataatgtatggaaacatccctacatccctcttatcctcctgttactggatacgtgttgatggagtcgaattgtccgacaaacatagtgttgacagccacaattggcacatcccaagcaaactggatggtctggtctgctcatccaaatgaccagtttttgggtagttaaagattaccgttccgtcctagctagttttgaagctaccgcatgtgattgtaaacaccctgaaaatgataaaatggttgttcttggcattattgcttcgttttcttgtagtcaacaagaaaatactccctccgtccctaaatatttgacgccgttgagtttttaaacatgtttgaccgttgtcttattcaaaaaatttaagtaattattaattcttttcctatcatttgattcactgttaaatatacttttatatatatatatatatatatatatatatatatatatatatatatatatatatatatatatagttttatatatttcataaaagtttttgaataagacaaacggtcaaacatgttttagaagagtcaacggcgtcaaatatttaggaatggagggagtaaaatatagcggttgcttatgttgaataaagattggattacttttgcatgtgaaattatgaagtgtcttttttttcaaatgatgttctccctcatattgaaatcattacgtaataaacacgtagttgaaatagttagttaacagtttgcttcctgagatttattctcacaaccgtaattacaatctttttatgcacttaatgcggttttgcgcgtgacttatccaagtcgcacgtgtaccacgtggcgggtcatcgtacgatcgatcgtgcacgcttcttttttctttttttccttttttttcggttgcgcaactgctgtgtttttttttcttttttttctttttgccattaactaccacacgcatctaagagtaggagtcaatatttgaaaactttcaagttaaagatttaaaaaacttttaactcagatttgaa

SEQ ID NO: 38183 - DNA, 1501 bp, Oryza sativa
caccaatcatggagatgaagaaaatagttggcgacgacaaatgcaactgacatgatgaagatgacgatgtcggtgatccagtcaatagcagtgtcgcaaccaatgataatgacgaagacgctcatcagcatttgcatagtaggtcaaccgtcaaggtgaaataataagtcggcgaaaacataatcatccattagcaacagcggagatgtcagggccgatgaagcagaggtgctggtgatgatgtcagtgacaataatccatcaaattaatgttatggctattgtagatgcttcacttggaggagagttgatgttgttgtctaactcgtccaaaccgaaatatttgaagttgttgaagtagaatgtctgctccgaagcaaagatgaagataatgactcctggagttgactcgtgggttgatgaattgatttcttcagcttgacataaaatttgtcaaattttgagccttgtatttgtgtagcccccgactctttgattagttgggaaacaactaaacatagagtcgagaactgtagcttcttgtcatcgaatagtcattgcttgattgaagatatgtgttgaagatgtccaagtagaaatccggtggtgaagacgcgcagttgtgaagataaaagcaccagtcggcggcggcataaccagtcggcgacggaagacgatgatgtccatcagtagtggtagctgtataaccagacgtagaggtaagcgcactagtcagcagcagacgagacgaccggcgatgaagatgtaggtgcccaacaacagcggcataataggccagccgtgtaggcggtgacaccagtcggcggcggatgaggcggccggtcggtgaagacgcagacgcccatcaacggtggcataataggccagccgtgcaggcggaagcaccagtcggcggcggacgaggcggccggtcggtgaagacgtagacgcccaacaacggcgacataaaggccagccgtgcaggcggaaacaccagtcggcagcggcgaaggcaagccggtcggtgaagacgtagacgcccaacaacggcggcataataggccagccgtgcaggcggaaacaccagtcggcagcggcgaaggcaagccggtcggtgaagacgtagacgcccaacaacggcggcataaaggccagccgtgcaggcggaaacaccagtcggcggcggcgaaggcaagccggtcggtgaagacgtagacgcccaacaacggcggcataaaggccagccgtgcaggcggaaacaccagtcggcggcggcgaaggcaagccggttggtgaagacgtagacgcccaacaacggcggcataataggccagccgtgcaggcggaaacaccagtcggcggcggtcgaggcgagccggtggtgatgttctgactgatccattcctggagcgtaagagataagcttaaagccatgaatcccttttatgcatatctggatctggatcctgcagaacaaacatataggatgagtagtatctgat

SEQ ID NO: 38184 - DNA, 1501 bp, Oryza sativa
cagtcgaaaagataatcttctctcgaaccagattactccaaagccgagtgcttcaatcatctttgtcatggtctcccgagtacttttaccaaatctgaagactgtggagggctggaaaataaagtcaggtgcaccgacgagtggttttgataatcgtagtcaaccaagtgacttgataccaatatatagcatatgcggtgtgaatcctcgaataatatgatccaagtgatataccgactgctttgtaaaatatgatgagtgtaacctaaagttggctacatcattgaaaattcacatagcaaaatagctataaagaagcttgtatgttgtgaataaagaaatttccaaagtattgggcatacgccatgcgcacactgctttaacagatgtgcttaagtccctaaaagacacatggttccaccacacctgaaaatatatggcatatgtggtataaaatccgtgtaaataaactcataaaggatttaccaaccgcctgaaaaatgaccacaatatataatcagcctaagccataatattggtcaataaaaatgcacacttacgtggcaaaaagcaacgatattgtatccaatcaattgcttaaaaacccaaacagcaccatgactatattaaaaagtcagcggggcagctatataaagctttactgtttgacaccttttaagatgcattgtaccaactcctaaaaagttgagtaactgcggtataaaaggattttaaggtattgggcacttgatcacgcgcactttggcctaagcaaaaagtgcctaagtccctaaaagaacgtgacaggccacacctgaaaatatgggctgcagacatattaggcctaggccaaaaaatatgccttcgacaccctttaaaggatgacgcatgtaacatgctcccgagtaataaatcttccgggtaatatagaccaagtgtagctcatatgaatagcttctgatctgaatgattatcccttatgggatactccaaaataaatataataattgaatcccgactggcgcaagtattcggttgatagcccttacggggaataataattggtccagtctttgagcatagaaaatagactcatgactatgaatccatgtggaatgtatctggaacaagtccaaattggagatataatcctcacgcttgagttgatgagcccctgagcatatagcttgtccttttgtcatagtcaaaattgtccattgatggtagctgacgcagttggcataaagacaagacgaccaacatagagataatattgcccaccagaggtggcaaaaatattggtggtagtgaagataatgataccaatcaaaagtgatgaagttgcacagccgtggaggcgaagaaaccagtcggcagtagtcaggtcagccatcaatgaagatgaaagcgcccagcgataaagttgtgtagccatggcagcgaaataatcagtcggtgacagacgaggcaaatcaaaggcgatgacaaaatccaccaatca

SEQ ID NO: 38185 - DNA, 1501 bp, Oryza sativa
gtccttgctcatatgtattgtcatccggtatatcataggtgcctctttcatcctcaactatcatgttatgcaaaattatacatgcatacatgatatcagccagttcttccctttcccaaagacgcgctgggtgacgtatgatggcccaacgtttctgtaaaaccccaaaagctcgttccacatcttttcttgctgattcttggcgttgtgcgaacaatttagctttgtcattcagaggtctcttgatagatttcacaaatgctgcccactctggataaataccatcagctaaataatatcccatattatagtcagacccattaactgtaaactgaacagtaggtgctcttccttgtagtacctcagtgaacaatggtgactggtccaatacgttaatatcattgttagaaccagcaaccccaaaaaatgcatgccaaatccatatatcagcagaggcaactgcttctagcatgatagtcgatactccataatcaccacgggggaattgccctttccacgcaaccgggcaattttcccattgccaatgcatgcaatcaaggctacctaacattctagggaacccatgtgcctctccaaattgaagtaaacgttgagtatcctcttgagtaggcctcctaagatattgctgaccaaataaatgcctcacaccttgaacaaaattaatcatgctttccattgctgttgtttctgctactccaaaggtttcatccataaggtcagctggtgtaccatatgccaacattctgatggcagccgtgcatttctgcagtggcgatagacccatcttgccaaatgcatctcgtcttagacgaaaatatggggaccaaacaccaagagcttcaacaatgcgcaaaaatagatgctttctcatgcgaaatctccgacgaaattggtcatcagtgtacaaaggattgtcataatagtatttagcaaacaatctgttatgatcctcttcatgatccctgttgatgtacctgcgtgtgtagcccccacgctgagtagatggtccagctagttctgcctctagctctgcttcaatctgatcttcaatttcagcctccatagggtcattgatttcttcccacatcaactcttctagattggaactggtgagagaatcttctatacgattagattgttcttgggagttggctgacattttcctaagttggttgaggctgaatggagggggcagtgagaggggagtggtatcttccaagaggctgaatgaagtgggtagtgagaatgtgagtagtgtcttcctcacttcatctcttatatgtaggatacatttccaacagcttgtttgcaacagctatattttacttttggcagcattccaacagctagtttgcaacagctattttttacttttggcagcattccaacagctagtttgtgacaactatttcttccttttggcactattccaacagctatgttttgcttatcatctatatttcttattatggttatatgt

SEQ ID NO: 38186 - DNA, 1501 bp, Oryza sativa
agaggggagggaagggggaagtgaaatggcggtccacggctcaccccgggtcgatggcgacgacgggaacggcgaccggagcggaggaaggcggcggcgcggctcgggtcgacgaggacggcggcgttccggcggtcggcgggcgaaacggaggggtggacgaggtcggcgaggttgcggcgaacccgaagaaggcgacgccgaaacgggagagggtccggggcgacgacggcggcggaccggagctcggcggcgacggcggagagagagagcgacggcgcgagctcgattccgacggggagagagagcggcgagggtcggaaacggcggagggaggcacggggagcgtttatatagggttgggagggggagagagcggccggatgagggggaatcggccacggaagatccggccgccattgatgcgccggcgaagttagggggaaactttccgaacgaatccgagggagagagagagggaaaagtggggggaaagagggagggaatcatggggagtgatttccccctctttattgcgcgcggggacggcggggaagcggctcggattcgcggacgtcggacgcgctagggcacaggcgacgcggcgggagcggcgggaggaatgggatgacgggtgggccccacccgtcagcgagggtggcgtgcgggcacgcccgtcagcggcacgcacgcgcgggaagggggccggatgggccgcgggtgagaggagagagagggagggaggtggtccgctccggcccaagagggagagggggagggaaaagaaactttttagggtttttcttttttataaaacctttttaactttgtttatttcttcttaattattatttgtgctctgaaaattccactaaaatttatttacgcattttaggcttttaggaaatatacaaaaatcctccaagccttatttgacttttaactttgcacattttaattgttggaggctttcacatggattttacttattctatgcatagttttgaggatgtattttagagtcgttttgggacgcgacagcaggagaggcgttatgaagaagatgatggcggttttggtcctcattggggttgtgagttctttagattttgctggaatgaaggtatgaggctgccatctattgaagactgtcctgggtgtagcaatgttgcagaaagttcaagccaatcgtataatagaggcaatcggctaaggcaaacaagagttcctgttcatcaaagattgagtccagtgaaccaagactgtgaccaagaagacagtgaagacaggaagacccaatggtgtccttctggtatttttacaaataatcagaagagaagggttcaaaggttgaggaatagggaacgtttttaggaggttgagcaagagatcaaccatcggctgaagaaaacgaattcgaagcaggaatggcgcattaagaaacaagttcctacagccgatgaagtaaagagattggctagaggaaaaagtgttgtgactg

SEQ ID NO: 38187 - DNA, 1501 bp, Oryza sativa
cgcccggtcgtgcggctgcctcccacagcgccgccgctccgtgccgcatcccggccaccggcccactcctcaaatccacccccgaagcaccattcccgccgcaaacccgagccccaccactaactgccgccaaccggccgcctcttgccgccattcccatctacctcacgccgcgccaccgcctccaccgcattcgctgcatcccatcgcccctcggccgtggctccgccgtggtcgggcgtcatcggaacgccgttctcgtcgcctcccgtgccgaccgccgccatcctttccgccgccggtcgcctctccgtggtcgtctcgcaaggaagatcgcgttcgcaaggataagagttcagaagatccaagtgaagaagcaaggcaagtcacacattctccttgagcatgttgattccaatttataaatgttttaccgtttacaaataaatatgcatgttttgctaattacatgggatccgggtattacctatctgttcgcttgtgccatgtttacttgatgtatgttctttgtcaaccttgggtaatgaatcaactagctcatgttacttatgtgacctagctagaactatatgcttagccatgcttaattaccactagctcagttgatgggataattacagtattagacctttttagtatcagaatgagctgcgtgctcaagacacctggccatgcttcatggtcataattatccaactaaaatgcgactgaatgatgggctgtgggtgcatggttttgctagtcgcacccatggcaattaaggaccggttcgcgggatgccctggaagaacttatcgtacttaccacaagccagcgtgggcaacggctgggcttgtagtgtagctttcctctagccgacgcatccaggcaagggtgggcgtgatggagtttggatgggccctgcgacggcctatgcggcttccggattcacctaggcacgagaggggactgcccgctgccttgcgaggagtgggggtgaaacctgaggtgtggtgtgcttggttagagggggttatgcgaagggtcctgtcacggtctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcgaccagattcaccgtgattagtcccaccttaataaatcgactcaatgcactatagttcaggtgggttggttgggcctgttcaacgtggtgtagcgttgatcagtggagatttaatgttactttaattactcaacagttttactattttgctcaataaaatgttttacaaccgcctttatgcaaatagccacaaaccgtccttgtgttccccttgcacgtctgcatcgttggtgtggcttgctgagtacggtggttgtactcagccttgctattattcccccttttcagaagtgtagtgcttctgagttgaa

SEQ ID NO: 38188 - DNA, 1501 bp, Oryza sativa
actgccctttgcaagctaatcttggttgttttaacttttgttttggaaacagggtagtgcatgactggtttcaacttgccggaaaacttcaaagaaaatccagaagctttctttcggagcgtcagacagtgagtcgttgctccgcagaaaactctaccgacaaagaaaccagccgtaccaatgccaccgactttcaagactatggctgacaagaccctccgcgagttcactgctccctctgctgacaatgtggccatcgggccgcagatcaacatgggagacgtggatttcgatctgaagtcccgcctcatcacaatggcttaggctagcccattctgtggcaagcctaacgaggatgccaacgctcatctgtagcagttcttggagatctgtagcacgtacactataaagggtgtcagtccagacgctgtcaggctgaggctgtttccgttttcccttctcaggaaagggaagtagtggttttacgctaaccgtgctgctgtcaacacctgggacaaatgctctatggcattcctctcgaaattctttccgatgggcaaaaccaatgcccttcgtggaaggatttccaatttccagcagacgagagacgagtccattcctgaagcatgggaacgtcctcatcatgggatggacaactcgctaatcctgcaaaatttctataatggactcactacaatgtcccatgaccatctggacgcggcagctggaggagcgttcttctctaagacggttcgaggagccattgatctaatagagaagatggtctccaatatgggttggagcaaggaacgactccaaacccgacagcaaggtatacacacagtcaaggagacggaattactcgctgccaagctagacctcctcatgaagcgattggacgaccacgacaatcggccacaagacaccgtcaaggccttggacttacacgtcacgtgtgaggtttgcggtggcacgggtcattctgggaacgactgcccggaaacccatgaagaggcgatgtacatgggcaaaaacaacaacgagtatcgtccacaaggaggtcaggggtggaaccagccacgcccgtactatcaaggagaaaacaacaacagtaacttctctaaccaaccctccttgaaggatctcatttttgtgcaagctaaaaccactgatgctttaagcaaaaagctagctgccaatgacaagatcctagagaacatcaacgttcagctagatggtttcacttcctcttttcaaaaccaactgatcttcaataaaatgatagaaacccagctagctcaattggcttctctagtccctgcaaatgaaattgggaggattccgaggcggggaggtaagtccactcgtgatcggccgtatcctaaccctgcaggaactaatggggtagctagagaagcgccatctagtgactcggctaacaaagaggttcaaccagaaaaggccgtgccgcaagaatactacgacacacgattgttgtcgt

SEQ ID NO: 38189 - DNA, 1501 bp, Oryza sativa
atgcaagtgcacaggataacaaaggatggcataatagggtttcatttgcataaacagcatttaagaaatatttaagaatttaataaaacagttaagtaataattaaacaatattaatccaacgctatacaacataccctgttgtataggcccaacctttctgaacaaccatagccggctgtacagatctatctccaaaccaggaatataccattccaaaccaggagctaaacaaattattaccagttatagcatcttttattatgatgagaggtgtgagactaatcacgaatgatattgttagacccgcccataaccgcgggcacggctattcgaatagttttactctgatcagaggtgtaccactgtacccacaagacacagccccacatcatgtcaccatgtgcctcaataccaccacggtacctcggaaaggagctgtgacagtacccctcgcacaacacaatccaccacagcgcaccattcctggatcataatcacccccttataaacaaggcatggactcctcagcgacccccgtgggcttatctccgccacttctcagtttggtgctccgcaatgaaccatgctgtacaaaaggtaaagccgttgcccacgctggcttgtggttggcacggttaatgtttcacaaccgaaactcgtgaaccggtccttaattgtcatgagcacgactctcaaaaccatgtgctcacaacccaccattatcaagttttagttggcaagtaattaattaaccaatcacgattgaccatcgtgaactatcattaagccatcattaattaatagtgagtcataagttatcccaataatgtgctaatgtttctaagcatggctaagaaatcatatctaatatctagtggaaccaatatatacagcccaactagtcaggttttaataacccagagtatcaaggaataaagtaatcaagaacaaaaagggctataacaaacaataggttaattccacccaatgacattcgaaaataaatgcaatagttgaatagaaacagtagctttaaacgggttcaacatgctcaaaggattatttgggatctgtgtgacttgccttgctagccttggaactcttcaaattcttctcctgcgaaaacggactctccggaaacgtcggaatctaaacaggaaagagcaaaatcaccaaacagcacataaacaagcatgaacagtacatgtggatatttttaacatgtagatctcaattttagaaaaatttagagacttgaaccaactaaatccgagctaagatgaattagttatgaatttttgaagtttaaatcggattaaaacacttatgtggattttaattgaattatgacgcaataatgaattatttttgaaaaggaaaaaggggtttattgcgtcagcggctagggtttgcggtggaccgggtgcacggcagcggttcacgggaacggacggccgagattgaccggtccacggccggaccacgacgaacggcaacga

SEQ ID NO: 38190 - DNA, 1501 bp, Oryza sativa
tcgtcgtcgtcgctcggggaggtcgccgtcgtggtcgccgtcgcgtcgccgtcctcgtccgccccttcgccgtcgttgaagaccgtcggagcaccgtcgccgtcgtcaacccgaagagtgccgccgcttcttcctcgacgccgtcgccgtccgttgatcttccgccgccgttttggtcaccggtgagttcgccgcatcgccctctacgtgctggtgccctccgttcgcgtcgccgcgccgtcgttcgccggcgagtttgcaagcccgagtcgccgctggtgatgacgtcatcgccgacgtcatcgttgccgttcgtcgtggtccggccgtggaccggtcaatctcggccgtccgttcccgtgaaccgctgccgtgcacccggtccaccgcaaaccctagccgctgacgcaataaacccctttttccttttcaaaaataattcattattgcgtcataattcaattaaaatccacataagtgttttaatccgatttaaacttcaaaaattcataactaattcatcttagctcggatttagttggttcaagtctctaaatttttctaaaattgagatctacatgttaaaaatatccacatgtactgttcatgcttgtttatgtgctgtttggtgattttgctctttcctgtttagattccgacgtttccggagagtccgttttcgcaggagaagaatttgaagagttccaaggctagcaaggcaagtcacacagatcccaaataatcctttgagcatgttgaacccgtttaaagctactgtttctattcaactattgcatttattttcgaatgtcattgggtggaattaacctattgtttgttatagccctttttgttcttgattactttattccttgatactctgggttattaaaacctgactagttgggctgtatatattggttccactagatattagatatgatttcttagccatgcttagaaacattagcacattattgggataacttatgactcactattaattaatgatggcttaatgatagttcacgatggtcaatcgtgattggttaattaattacttgccaactaaaacttgataatggtgggttgtgagcacatggttttgagagtcgtgctcatgacaattaaggaccggttcacgagtttcggttgtgaaacattaaccgtgccaaccacaagccagcgtgggcaacggctttaccttttgtacagcatggttcattgcggagcaccaaactgagaagtggcggagataagcccacgggggtcgctgaggagtccatgccttgtttataagggggtgattatgatccaggaatggtgcgctgtggtggattgtgttgtgcgaggggtactgtcacagctcctttccgaggtaccgtggtggtattgaggcacatggtgacatgatgtggggctgtgtcttgtgggtacagtggtacacctctgatcagagtaaaactattcgaatagccgtgcccgcggttatgggcgggtc

SEQ ID NO: 38191 - DNA, 1501 bp, Oryza sativa
cccaaaatgacgcgaccttcgccaacaggtaaattggtatgtatccacttatttgctttcaacaatttaaatttttgcatcaacacatgtttgaatttcaaatttgcatttaggatttttgaattttgaggaaacccttcaaatgaattttttagagcaaccaaaataaaattttcaacgaaaattcactgtgccatgaccacactgatcattggaacccaacggccgaaagtggggccagttgggttcaccaggggttcggccgaaccccctggtttggccgaaccggccaggcaacggtcagctgcgtcccttttcgaggcaacggctagtgggccccacaggtcagttttgaccgttgtgggagcactacttaagccaaccagccaggagcgggaaatccatcccatttcaacacattttcattccctctccaaagtttgctctcaaattcattcaggctttgatagtttccctcaaattcaaatacatagttgcatatatacaagttgctttagtgaaactgatcggcgggtgaaactcttgctattctaacccccgctgagttagtccgttcttgctccattgtgtagaatgaggaggcgattgtctcgtctgttcaaggggtccggctcttcgtcaagttgtcatgatgagtctagtactcattcatcagctgacctcgaccatgttcaagaggatgccgaagctccacgacgtttcctgaacgacaccgacctcgaccttatcgatgatcgggaaagacaagcctactacatgctgagtgaccgggagtatgctcacatgcgagaatactctccggagctgctgaaaaagataggtatggatgttgattttcgtgctatttggaaagctgttggttggcagagatttgctgtggtagataagcctagttctcgtttgcttactttgcaatttctgtgcactttgaaagaaatagaagatggaatttcctttcactttttccataaggaatacacatttacatggaaaggattaagtaaacttcttggttttcacgattcttgtaaaatcgatctccagaaaggaatttctgggttcgagaaaaataggttttgggaagatatttctggtgctccaatttgcaagaaacctaggacgaatgatatccataatcctgatcttaggctcatgcacaattgattgctatgactttgtttcctagaggtgatcttagacccattaggggggataaatttactatcatgtttgccatggttaggaagataaaaatttctcttgtgaaatgcatgataagacaatggttagaaagtatgaggttttctgctcctattgaatgcacttctccgattgctcggatagcgaaagggctgggggtcgttagtgaccagattgctttcatctctactgcttgtccatgtattgatgagaattatctagtgcaaggacatattatgaaacatggagtaggtggatctttgatatactttttcctcgg

SEQ ID NO: 38192 - DNA, 537 bp, Oryza sativa
tttcagatttggtggcgtggttttgtatgttattctgacattctcacttacattgaactcacgtttacatttgtacattactcacacgtgatgctcctctggcgtattgaagaaacgttgatcagcaacaatattgtctatattataacatgggtgcgacttgagcaacgctgtgcaatttttagctagctttctttttaaggcgttctagaacatcctggtagagctctattaagaaatagtacaaggcattttttttctagaggacactaagagttcgtacatgcggaaagatacttcctccatttcataatataagacttttcagcattgcccatattcatatagatgtctatatgaatatgggcaatgctggaaagtcttacattataaaacggagcgagtatcataaaaacaattttatggctatttgttgtaggacattggagataattattggaatggaattatcatgcatgcgagattatttcccgtttcgagaagatttttttaaagtaaactgtatgttgggctata

SEQ ID NO: 38193 - DNA, 716 bp, Oryza sativa
tgactcgtgggttgatgaatggatttcttcagcttgacataaaatttgtcaaattttgagccttgtatttgtgtagcccccgactctttgattagttgggaaacaactgaacatagagtcgagaactgtagcatcttgtcgtcgaatagttattgcttgattgaagatatgtgttgaagatgtccaagtagaaatcatgaatgttggagagccacttgttgtagtaaaataacacggcatcgcatgccgagatgtcgagattcacaacaacgtcatggttggtgatgtaacaaaacttgtgaagtagcagcaatagagtttgctggtaccgaagataataaagatgaagtcgctccaccatgttgacaaagttgtgttgccgtgatgaagtgaacacgagtcggcggcaacagaagcaaactggtagcgaagacgcgcagttgtgaagataaaagcactagttggcggcggcataaccagtcggcaacggaagacgatgatgtccatcagtagtggtagctgtataaaccagacgtagaggtgagggcactagtcagcagcagacgagacgaccagcgatgaagatggtaaggccaatcaacactggcagaatcatgcagccatggaagtgaagaaaccagtcggcagccatgacaaacgtaggcagcttgtgttgaagatactaatgcctattagtagtgacagcgatgtagcca

SEQ ID NO: 38194 - DNA, 1501 bp, Oryza sativa
atgacaaaaagggagagtattattggaaggatgtggctgatgagttcaataacaaccgtcctacaaatggccacaagaggacagtcaagcaattgaagacacactggggaaatgttaagaaggacattgggaagttttgtggagtttatgctcaagttagacgtacctgtaccagtggacactctgatgacatgatcatggaaaaagctcatctatggtacaagaatcaatcaaatcagaagaagcctttcaccttagagtatatgtggagagagctcaaggatcaaccaaaatggcgaagtattatcaaaaaggaagaaaacaagaacaagaggactaagatttctgagtcaggagcttacacatcctcatcaaaccaagagactgaagaagaatcatcaaacaaagagagacaccccgagggacagaagaaagcaaaagagagattaaaaggaaaaggaaaaggaaaagctcaatcttctccgttggggaaccagccatctcagaacatagttttgtacaacgaagctatgaaaattaaagctgaagcattattgaaatcagcagaggcaacagcaaaatcagcagaggcaaaacgggaacaaataaggatggaaaagtggcaggcatacattaaactggaagaaaaagatacctctaattttagtggagaagctgagaaggcatgaagctatgttgaacaaattatctaaagaactagctgaggaataaaggagaagcatgttattgttccactgtagtgcttagtgtatgataagtttagttgtcaaatttggtgtattgctgatgtacttgtcattttcagaatttagctctagtactaatgtaaaagcttagtgtacgattaatttagttggcaaatttttgtgtattgttgatgtacttgtcaatttcagaatttagctctagtactaatgtaaaagcttttactatatccccacttgtattatgcaagaaatcacattttttaccgcacatctctgctcttaatattatttttcattcatgagtcatgataatcttcatgaatacattgcagtacagaaaaacccatacttacaagatgtagggataattttcttcgcaattcagttattactccatacctgcacatataaccataataagaaatatagatgataagcaaaacatagctgttggaatagtgccaaaaggaagaaatagttgtcacaaactagctgttggaatgctgccaaaagtaaaaaatagctgttgcaaactagctgttggaatgctgccaaaagtaaaatatagctgttgcaaacaagctgttggaaatgtatcctacatataagagatgaagtgaggaagacactactcacattctcactacccacttcattcagcctcttggaagataccactcccctctcactgccccctccattcagcctcaaccaacttaggaaaatgtcagccaactcccaagaacaatctaatcgtatagaagattctctca

SEQ ID NO: 38195 - DNA, 1501 bp, Oryza sativa
agcttgacgagtatgtgggaagaagacgcggatccggtgagcagctgcctcatcagcgcatggtgtccctgcaactggctttgcacgagagagtcgataatcctcacgccattgatgaaattgtcagtgtcgatcgacgaagattctatcagtccaatggcatgtgtgaccatgttccttcctctgacgaacgacgggtccttcatgcatccagccatggtttcgaccgcgtactcacgaacaggtgattttgccccataattgagattgtacttgtcggccactttcctctccatcttccttcccgttgtgatgaaggtcatgccgtagaagtaaagcacgccctgggcaagagccatcaggtagaggacgcgcaacgccggcttctgcaggttggcgccgccatcggcggcggcgttggccatgccgaagcccaagtcacgccgtgtgaggcggaacagcgagatcgcggtggagatgtacatgcccaacgtgtagacaaacaccagagggacaacaatggtggtgaacacaaggagccgaaacaactgcaacgtagcatacgctacgatgggcccatggtcaagtatatagtgtttcaaccactcggccacaatcttggccggagtcttggccggagtctcggccggagtctctgccggatcagtctctatcttgcgaagtgaagaatatgcaagagtatctgccgtaatctcggccttttgctcggtcgaagttggaggcgacttgggtgtgctaaatgctgtagcgagtaagcgggtgactccagaaaacccctctataactccaccagtaatggcaccggatgccctgttgttaatttatatttgatctcagctcataagttttctcgagagagggtcaacggataaacataaactacattaggcgattttcatatgcaattttgcacgaaattcattttgcatgtagaataggattcgagttgcatctcgacccagtgattagcctgtcctcaccagatctgatggctgcgaagatttcactgtcacgccatttctccatgacagggaggtggcatcaactccatctgtcctaaaataaatccaatattggatttatatgtgtgaccaccttcatttttaggattagatttattttagaacaaagggagtagagacgacaagagggtagatctggtcaccaagtcacatcttgccgacaaagacaggttgacggttgaattttgatttggctggacttttcactttttggttctttttgaaaacttatttaatttgtaaataaatccctaaaaaagcttattctgggaatggatgcttttcgccgagtcaacatcgtcattgtattggtccaagataacagagccaatagcattgataacgtccccctaacctcctcgtgaaaggtaggtggtcacttatatgaagggggctaattaagtaaggggggcgacgccattgtttttggcgccgatgacatatttgtacatattttt

SEQ ID NO: 38196 - DNA, 1501 bp, Oryza sativa
atggcacctccttccctgtccccatcctttctcccaccctcttccttccccctccatttccttccctttccctttctctttttctgcagatccaaattcaggcgatatgcatggtgggtctccgtgaggggactagctataggcagctggtacttgaccggtggtgccgcagcgcaggtttagaatcggaatacaactcgatgtagttttagggtgtgtttggtttctaagattggatgggatatggcggtccagttttttgtttggttatgtgaatatggcgatccagttttttatttggttgtagggacgaaggtggagttggtgatctaatttttttgtttggttggaggaagtatggtggatttgtaggtgtggtcacctctcacttgagatggtgaatatacccgttgacgaaaaaattgaacacaccggcctgagagatctgcttaaatcctgtgcaggtctaaagattgttgagatgcgggcgtgctagtcagtttgatcctgcaactgacaagatatgtaaacagtagatcaaatagccgatcggctgacaagccaatgtagtgattccagccgatgccgatactagccgatagcgatagggtttgagcaatcggctatgtgtccaatgtagataatgatgcaaagacaatcagctgatgatattaaaatataacaataatataatccagtagaaaccaatcggctaacaatgacatgatagaataagcactgatccgatggttaaagcatacatcgactggaggtccaatgtcataaaatccacaagattagattaaacagtgaaacctttgttgtcatcggctaaatccaacttatatgtatatgcaatccttatgagccgatgcaacgtctagataactcaccggctgaaaccccgatgaaacccttattggcaatcaagaagcaggatagagattatggttctaagcacgacttagtagatcaaacttaactgatacagcattaagtatgaaaagatacacaatctagacaatcaaaccgttgaatgagttttcagggtggtagatgtctaagctaatctaatctagcaacgcgatttagctgataccggcagaaaccctaaaacaagaagcagccgatagagctaaattgatatgctaagactagattaacagagacatatgataaataggtaggcaagtatatcatccaaaccagagcaatctaagaggtcgaatgtcctgatgcagccttgaacgacgccgacgtagacgatataattgcctgggccgacggaacattggacttaccccttagccggagatcgaacaccgatgcagccccgcgtcgggtgccaagttccgccagaacgtagaaacaaaagtaaaagtaaaaagggtggcgatgcgccgaattgtattgatcgtgaggatagattacaatgaccccgcgtgtacatatttatacccatgggtagatactaatccttgtaggacaagaaagaaacttt

SEQ ID NO: 38197 - DNA, 1501 bp, Oryza sativa; identical to SEQ ID NO: 34668

SEQ ID NO: 38198 - DNA, 1501 bp, Oryza sativa
gtttctgagaaaaatatggttatggtaatggttgagcctgttttatgatcgtttccgaccgttttcatcccaacttgacacgtgaggagtttggaagttttcccaaattttgtaacttcgtatcaaaagattgagagccatgagcacaaagtttttgatttttttttttgggaagtttcagtttttggattaaaagttttgggatattatattgaaagtttgagccaagaatattttttttgatcttttagttgaaagtttcaatttttggataaaaggtatgtgattttatatatgaagtaggtttatttttttcctagttaaactttctttaagtatgaccaagtttgtagtaaaatatagcaatatttttaacacaaaaacatagtatcaaaatatatccaatgctacattttataaaactaatttggtattatagatgttgctaatatttctataaacttggttaaacaaaaaaaagtcaaaacaatttataatatgaaatggagggagtactcattacaaaacaaaagaaaaatctatgaattatatagagatactactaggagcgcagtgtgctcctagtattccgagcgccaagcatgcatcagcccaagtccacctcaatccatgtcccgtcatcccgctcttgatgcatcaagtccacctcaatccatgttctgtcatcccgctcccaccattatcagagtaaacgatttactttgataaaaacaacttccctgctccccaccccaccccacgtcctgccatcccgctccaacaattatcggagtaaacaatttactttgataaaaacaacttctctgctcctgacgtggactgcagcaggtgtcggctctgtcaggccgcggcacgcaactgcattgggcagcggtggtggctgcagtgggaggacccactattatgaatacaattttcttagacggggtgcatttatttttccaggtgaagatcattttcacgtatggccacctaggaagattattttaataataggtaaaggttacgaaaaatcagtaaactaatgtcacaacggacgaaaaggtgggtgcctacataatcatcttaaattttaataataggtaaagattacgaaaacccttggactcgggcgcccgatgggaacgagaatatcgggcacccgcgccccacgcctcgctccacccaccgcccacaccctcgcaccccctccatcttatccattcccctcctctctctcaaccatttctctccacccgttcctcacgctcactactacaaaatcgatttttcatggcatcaacttatttgttttctctggcggccatacgtgaaaacaaccagcgaaattttaacaagggtcggcagcgaaaatggatcttcgttggcggccgggttaagagggccgccgacaaaaatagaggtatttttgcaggcggtgctcttaagatgctgccagtaaaaaaaacaatttttactggcggggtgttgggagctccgc

SEQ ID NO: 38199 - DNA, 1501 bp, Oryza sativa
attggtagataaagcttttagctcggtcatgcatgatacatacatgtagtcccaagctaatttgccccctcacgctgacagtgtcctgagtaatgtcgatgggggcaaaattgtgaccgatcaaagtcttaatttttttcagttcaagaaaaaaaaatgaatctcaattttttagactactatccaatgtcttgtactctatatgtacgaacgaagctataaccgatctcttttcctttgcgttagatcaatgtatatggcccacaccattaatttatatatatctaatggttaaaattaataggtccaccgatttgaatgaaaaccgatggtaagatatttttcttttttttagaatttataggattttacctaatttattatagcgtaaagtgatgatttaggagcatttgtagaatatgcatgtggtggcttgataatgtttattggaagtataatggacttttagtatttttttaagtttcagaaagaaaaatgaatctcgattttttagactactatataatgttttcttcttccgtaagtgtacgaacgaagctataaccattctcatatcctttacattagatcgatgtacgcatggtccacaccattatattattttatatagatctaatggttaaaattaattggtctaacattttaaatgaaaatcaatgctaaagatatttttctttttttcttagaatttgtaggaatttttctaatttattaaagagtcatgtggcaatttataagcgtttatagtatataatataatataagacacgtataattatattattttgacttaccggggagtaatttattttctaatttaattattgtgtaattatgtttgatgataaaatctatatcgttattttttcataatattttggaattatttaaatggcacgtaaaagtcagaaattgtaaccaaaacatgacattctttttgaaagattaaatataagcagtttagatgttatatttgtttaattgtcaattgtgctcacctattgtgctttctacctaatattgcataagaataggaataagaaataagagagggaacagaggaggaagagaggaggcatacgggtccaagtacgtacgtatacctactacgactccacgtaggtacaatactgatagggattggaggattattttttctttatagattgatctaatggttaaaaatatcgggtccaccagattaaatgaaaatcaacggttgggtgttgtctttttttttagaattttaagaatttctataatttatcatagtgccaagtggcagcttgggagcgtttgtagggtacacgtggcagtttgggagcatttgtaggaagtttaatggacttttattatataatagatgtcagacatttctgattacctcaatattctgttatttcagttagaagttgagaactctccacttaggtgatctcttcctgatcaaccataagattaaatctattttttctgtagg

SEQ ID NO: 38200 - DNA, 1501 bp, Oryza sativa; identical to SEQ ID NO: 34673

SEQ ID NO: 38201 - DNA, 1501 bp, Oryza sativa; identical to SEQ ID NO: 34678

SEQ ID NO: 38202 - DNA, 1501 bp, Oryza sativa
ccattggttacagaggaaaaaaaagttcattttacatcctaacgatattttattcttttaaactttttttcttctctacatacaagtcatatttcactttgacacatcaggagatgaaggtcaatgataattaaacgaatacactaaattccacgacctgcatgtaaatgcctctaaggtgtcaatacaaaatcaataagcatttcgtataacgatatgattagaaatttcctactaatttttattttaagactcatattaacttggtatttttcttaaaaatactgtaggatcctacgcataagaatcactatcttacatatgtatatttggtcaatttaaaaaggtgatagcaggttagtaaaaaatatatatttatgagcaattaaagtttctcaagatttttaaagaaaaaatacaatgaacattcaattaagaagggaaacacctcactttaatttaaacttattttgttagacatgttttcgaaacgaaataaaaacatgcccgcgcaaatgcgcgggctaccttcctagtttcataaatagacagatccacacttattctgtgaaaatagaagcgacgaactcaggttccatacttaagctaagtcaaacagcatccgtaatacctctcagatataggcatatatcgtgccatgaaaagaataagtggacataaaaaatgaaacagttctacaagttctgctgatctgcatctttgatttcagggattaaatgcgtaagattaataaaaccaacattgatgcactaacacgttactgagattagcaaacagaaaatggctttatgcttgaggggaataatgaaaaactacaagaataaatttggcatcccttcaacataactcaattttctcaactatgcataaacagatttagattgttctacagtaccccttcactgtgtatttaagacattgcaagttgcaacaactgtcatgctgcatcgcaaaatgagattgcctaaggaaacttggacctgttcaagtactggaatttgaaacacgttgttgaataattcaaacaatctcacagtagaaccacagagatcattgcatttattaacaaaaagagtaaaaaaaatgaagaccaaattttggaattctgatgggcacaaaaattctacataatgacatatatagcaaacatcttcaattgtactgcacgaactaggcagcaaattagatggttatcagagcatccaaaataattgccatgaccatttccatatgcgcatcacggtacaaaagcaactcctacttggcaatcaacacaatgtagcatgcctaagtgccatattttcatcagtactgtctgccgctgacagcagcaaggcaaaattcttactttcagttcaagttcgcttcctttttttccaataacttatgtcaataaccatagaatattccagaaacgggtactaaaattttagactgactcttctcaacaaaaaaggaaattcagactggccaaagcaac

SEQ ID NO: 38203 - DNA, 437 bp, Oryza sativa
taagtatgtcacatactcatccactagcaattattactattctagagtatctggaaacttatgtgcaagtatgacatatcatctagagtataatgttttagagctcaacatataatgatatcaaattatcttccttatatcatttctataatatttagggcctctttgactcgcaggattgaaaaaaacagagggatcagaaaaacacgggattctaataggaatataattcaagtataaaacagaggattgcaaaacgttgaaaaaacacaggaatgagtgttcgattggactgtaagaaaaacgaatttcataggatttggaaaaccgcaatcctttgaataaaatggtcacatagaaaaaattcctataggatttgaattatacgaaattccttcttaattaaaatcttttgattcaaaggacccttaacatat

SEQ ID NO: 38204 - DNA, 281 bp, Oryza sativa
attttgaatccaaatgggcaaagagatatacatgaatcaatttgtcaaagtacgttaggattattacaaccacaaatgggattattgagggaacaacttgaattatatgcaaagcaaatggctgtagaagctgaatcgcaatttgaaagttttgaagctaatattcaaacacaaataaacgatttattagcatttgatttagatacaacacttatcaatcaattgaaagataaacatcaacaactgaaaactattttatattaagaaagaaggaacgtttt

SEQ ID NO: 38205 - DNA, 245 bp, Oryza sativa
aaggggttatgaacagtatactctccccattactccgcaaatgtgtgttggtgtttgtcaacgatattcttatatacagtaagaccctacaggagcatgtgcagcaccttcagcaggtttttcacattttgtcaaagcatcagttacaagttaagcgcagtaaatgttcctttgctcaacagcgtttggcttatcttggacatattatcacccccaacggagtttccactgatgatgacaagatt

SEQ ID NO: 38206 - DNA, 1501 bp, Oryza sativa
attcaagaagtggttgctggttatgcttctgacccggatgcttgcagtaaagttcaaacattgtgtatcagtgtaggagctgttcctaatttcactttgaaagatggtgtgttgtattttaaagatcgcatgtggattggtcataacaaggctgttcagcagaaaatcattgctaatttgcataccgcagctattgggggccattcgggtataaatgtcacttatcaacagattaagcaattgtttgcttggcctcaattacgagctacagtcacagaatttgtgtcggcctgttcagtttgtcaacaagccaaatctgaacatgtgaagtaccctggtctgttgcaaactctaccagttcctgagcactcttggcaaatggtttcattggattttatcgaaggattgcctcgatcagcttcctttaattgcatattggtggtagtggataaattctccaaatatgcccactttgctcccaccatttttccgtgcggtctgacttacggaccgcatggaaacaaaatggagcggcgtccagaaaaatcaatcctgtaatagtgttattgacatgtggatcccactgttttattttactatgtgccatatggaacgaggaaccagtcaaactagacaacgtcacagccgaaaccgctattcaaaccgtcttgggactaattttgtatcggttttaggagttgaacaatacattatatctagtattggttcggggataatttcacattgtaggcggctcctgaataaaattcgactggctttgagtgaagaatatcttttcttaaagggctagaattaattacaaatgttgaacccaatcattggttgtcgttatttttatcacatgttgcaactcacggacaatttgtaattagtctcacaaaatattggacaaaatttggttaatataaatgtgttgaaatagaatcaggtctaaacacagcctaactctacaattaggaatggcaatggggaccggaaccagatctaaacacagcctaactctacaattaggaatgacaatggggacccgaacccagatctccgttgggtaaaacatccattagaggccacagttattaaaaccagaccggaccggtggttgtgttagttgtaactcacgagactaagtactccctccatttctaaatatatttgataccgttgactttttagcacatattagactgttcgtcttattcgaaaacttttgtgaaatatatatgtaaaactatatgtctacataaaaatatatttaacaatgaatcaaatgataggaaaagaatcaataattacttaaatttttttaataagatgaacgatcaaatatatttaaaaaagttaacggcgtcaaatatttagaaacgaagggagtatataagatttgctctggtctggtctagtaaaagttcatatcttgtggagatcaatagtttcaaactttggagcaaaactttaaaaaaatcagttcagcacttgagca

SEQ ID NO: 38207 - DNA, 156 bp, Oryza sativa
ttccaagattgcaagtgctattcttcgtggggatggtggaatggaagaagtggaagtgggaggaacaagtgcaagcaatgcttgtcttggaggagctttttacttgagcgttgcaaattgaggtgccttcctcctggccttgccttccatgcaagg

SEQ ID NO: 38208 - DNA, 919 bp, Oryza sativa
agatccatatgtcaataagtatccaatttaaaataaaaaatatacgtaatgtcccaccttccttttcttttctttcattctctttttctttttcgatgcttcttctcgttctcttctccgctgtggcagcgagatggggtcgccaaggtagatgccaacgcggtgaagcggccggtcgcagcagcggcggggaacggtcgatctgctgctaactaggtggcgatgggatggatggagtagtgaagcggaatcgaccaggaccttctcggcgactccaccgatctccggcatcctatgtcgtccgcgccggtcttggctcgcagatccttgtccacctccagtcaagtccatcctgaggttcaggtccttgtgcaagtcgtggcgtgccatggtcgccaacacgcgcttcgtacgtctcctatgcaaaatcaccctcctatgcaaaaatgaaaaaatcataatgatttgtgcaattttcgcttacatatatcatagtaaaataaaaaacaataggcaatttttttttaaaaaaatatggtatatataagagcaaaaatatatgtcagaagggtgaaaaaaagggaaattatttttttcctatgattatgactaattcacacttacatttatttttctatgacatacttaaggataaattgaacaattcatcatggattttacatgaataatgacatggcatgtatatatggcgatttcggttgatccaataactatttctgagccatatgacaaaatttaagggtttctttggaccatttgaaagattcggggactaaactgaccctagagtgaaacattaggaactacagtagctattctcccgaaaaatttggtatcagagcatcgatcctggagaagccaaggtatacatctcgtttgcagtcacaggttgaggcaa

SEQ ID NO: 38209 - DNA, 1039 bp, Oryza sativa
ttcctgcaccctctcagaactcaaatccccaccctcgaactcaaaattttccaaggaattcataggaactgcatgagtttcgaacgtacccttgcccggagttgggatcagggtggtgaccacccccgatgccctcctccggaaattttgtggaatgccgtggccactggtccatttgccatcgccctccgctgcggtggggtgagcagcaagcggcggtgtgggcagcaacggcgccttcctttcctcgtccgtcaacggaactcgaggggaagacgtcgtcggagaggcttgtttcgtcttgccgacgaggtccagctgctggcggagatctcccacctcctcccgcagttcctggattgccgactccacttggggtttccatccgccgaaccccgcgtccagcttgttcacgatcgcttgcgtctccgtttgcttgttgttcaacgccaccagcgactcatggatgtcgccgaggattttgccgaaatcgaggttctgcttttccattgcctcaacctgtgactgcaaacgagatgtataccttggcttctccaggatcgatgctctgataccaaatttttcgggagaatagctactgtagttcctaatgtttcactctagggtcagtttagtccccgaatctttcaaatggtccaaagaaacccttaaattttgtcatatggctcagaaatagttattggatcaaccgaaatcgccatatatacatgccatgtcattattcatgtaaaatccatgatgaattgttcaatttatccttaagtatgtcatagaaaaataaatgtaagtgtgaattagtcataatcataggaaaaaaataatttccctttttttcacccttctgacatatatttttgctcttatatataccatatttttttaaaaaaaaattgcctattgttttttattttactatgatatatgtaagcgaaaattgcacaaatcattatgattttttcatttttgcataggagggtgattttgcataggagacgtacgaagcgcgtgttggcgacca

SEQ ID NO: 38210 - DNA, 1501 bp, Oryza sativa
tttttgaactataaaccatatataaaaaaattgagttgagaataggccgatattgtcgaaacaagatttcggcaataataaaaaggggtggctgtcaagctaggaaagtggatgggtttagagacaaggaattttatacaggttcaggccttcttattcaagaagtaatactctactcctgtccggggataattccgccgagtgtgttattgattgtatgattaggagaaaaaagaatcgtcccaagaggaacccggacacctccttatataggggaagggatccgtattacaaagtacagtccatatcctaacggaatatgggattacagataaaatacaatcgtaaccgactaggatcccgggtattttcttgacatacaagtttagaatctaacccaagtcctcataaagatattctatctatatttggtaccatatatccagctggaatataaccgccatgtagatatggggtaaccataatctccacagtagcccccgagaccttcgcagttgaccaaaatagtcttctcgaaacaaaaaaacaataatccgagtgcttcaattcaacttgctccggctcgccgagtgctaaaagactgtgaagggcgaaaataaaacatggtgcatcgagtagatgcacctaattaggtgtagcccccgactatgtgattagttgaaaaactaaacatatagtcaagaaccgagtggttttatagcgaagcccgcatggtacttagtaagatacccagccgactgtttctcaacttgaacttatcaaggacaaaaaatacaagaagggccgagtgataacactcaaaggtccagaaatagacatgttcgatagaaattgagtaaaaatctcataaaatgatccaccaaacatgatagaaaatcatggtaattaatgactctaatagcctaggctgtgacccttaccataaccaaaataagcatataacatgctaaaagaatggctattaataaatcagtcatctcaaatcaacccaaacagcttttgcagcctaaaaaagcttacaaaaatggtataacacctttctatcgggcaccttttcatatgcatcataataattccaaagaattattgaatcgcgttaaaaaggattttaatagcatcgggccacatcattatgagcacatattgccaaagcaaaaagcgcctaagtccctagggatcacaatgggccacgctgaaaacataattgggctgaagtactgtataggcccaggcccattagtacttccgataccctaaaaacaccgaagtccaaacgtcgtttcgtcttccccgccgagactctcgccattccccactccgtgctacagtatagaaccacgccgacgaagctagggttcatcaatctgctccaacccaccctcaaaaacttcgcgaaatttctccccgcgtccaccgctccgattccccattcctctccagccatatctcagaccaaattaaaccatccagttcacattca

SEQ ID NO: 38211 - DNA, 1501 bp, Oryza sativa
ctggaatttaaattagggaaaaggccgaagcctagcaaagagtttacagggactgtaatagagatgaaatacagcttaagaagcaaagtaaatcagggggggcttaaaagctagtttgcgcaaatccaaatcttgcttgataagatgtgctacttcatttactgagaagtaaaaattttgaaaaaatcttctgtttctttcttgcaagatgttccaccaagtagtaagtagcgagcctctgataatccgtatttgagctttgcttcccacatggttggttccattccaccaagtttcaacgtcagggggatgggacgaggttataggggtcaggttttggaactggtagattagaactacaaaacatactatcgagggattaaaagagtttccctctaaactttgtaaacttgttctgttgtaaaggtgggtgacgatggttccgtcgtacgcatatgctatacttatgcagaaataatagtttgacccattcttacaacacaacaaaaaaaaagtataacaatcgaaaaggggattgaattaatttgaagcataaggttatgcaaattttcattaactttagattgagactcatcaatacgagtgcttcttaaataatgatgtatcttcttttgtgttggtgtgatttatgagtgggttatcagcatgccatttcatcttctgcctcttaccggctggtgcattgcttcgctcgatcgatgaatatgatcgagagggccagtcttcggtaatgaatggttacatttttatgcaaagttaaaatgatggaaagcacaggagtggaatatctaattctgaataagatgacaagatggaaacacaggaagctgctatcgtacaaatatggagtaagcggcagtaaaccagattttgctaccgttctcttgggtggacgatttccctctatcaactagtcaaagctgaaatcagaaagcaaaatggattaattaattaacgttgttcttttttttaagaaaaagaattgtatatctgtggagattatggttaccccatatctacatagcggttatattccagctggatatacggtaccaaatatagatagaatatctttatgaggactcgggttagattctaaacttgtatgtcaagaaaatacccgggatcctagtcggttacgattgtattttatctgtaatcccatattccgttaggatatggactgtactttgtaatacggatcccttcccctatataaggagaggtccgggttcctcttgggacgattcttttttctcccaatcatacaatcaataacacacttggcggaattatccccggacaggagtagggtattacttcttgaataagaaggcctgaacctgtataaaattccttatctctaaacccatccactttcctagcttgatagccacccccttttattattgccgaaatcttgtttcgacagttggcgcgccaggtaggggtccgtcaagttctcgccgactaagtgcga

SEQ ID NO: 38212 - DNA, 1501 bp, Oryza sativa
cttgtactcttgtctcgtgtttctgttggtcagaaacatgcttggaattaatgcccataaagagagcataaggaaggattaccccagttactaacgctaacacgctttgcagctgtcaagattaccccagttaccccataaagagaccatcactaacacgctttgcagcgggcatttggagtagcacttaacaagcagagcctaaaagcagtaaagcacgcagtaatcggaataagggcatgtttggttggacaccagacgtaagcctgagaccagccgggaccttgtttggttggtgtcctgaccttagtttctccttccctggcctgagctcttttggagccttattagcctgagtcaggcgagctccagggcggcgcagctacgctcattaatcctaattaccgcttataataatgtagtataggtactgtaaattgtagaagcaaccgaccatacaaatatattttatttgtgctttcaaggagggatacaacacatccaaatattttatttttttgctaacactttataacaaccgtaataattaaaagcttaatcacgtttagttttcacaggcgcggaagaacaaccaaacagacaagtgagacaagtgttcaggctgcctgagcaggcaaaatttatcatcctatcaggtagctctcaggcacccaaatttttcaggcatgttggtgagggcatcaaccaaataggccctaagtgtgcgtacgactgcacctgttcgacctgcatatcactgtacataagctcaagttttaaatcgttttgacaggtccaagtgaatgcttatgaactccgtgattgattggttcagcgcagttgtatgagagttggatgtatagcactactccacagtaatatgaacgccagtggtcatatatggatgtatatatacgacgccagtgttcgactgatggccgacttcattacggcatcacctgcgcgtgtcagattctattacagaatgagacatttgccgtctgagcctttcattgtggctatggtcatactctcttcgtcccatttaatgtacaatcatgcttttccgtactaaattttgttcattcgttttatttattttttaaaaaaaatcatacctaaaatattatttatgttttatcatcccataacaataaaatactaattaaaaaaaattaaacaacatggacgatcaaatttaaacacgaaaatttatggttgcacttagaatagtatggaggacacaatagctggacaacaaggttgtaccggcacgtatatcattttcgccgtaatatagctctcttgtactactgacgtgccgaatcggtctcggtctatagagccccgaccgagccggactcgtccgaccgagtcggactccacctcggactaatcgatcccatttaaatcgccatcactccgcgcgctctcccatccatccatcatccaagtcaacaagacaagcccgagttttgtgccactctacacaacacacaca

SEQ ID NO: 38213 - DNA, 1501 bp, Oryza sativa
gaaccgtgagggcgcggtactgctgggtccccttagggtgtgtgtcacgcccggaatttctatccaaaattccaaacgcttacatgtgtgtgaaccctcgtccaggaatcagccgaggcacacaataacaaattgataatagagtacaaatattactctaattaataagcgaataaaatgtcattacagaggtagatagttcctctcaatcaataaagttctaagcagcggaaaataaataaacggcgcagacggctccactccacaggcagcttgaccaaggctacacctaatcctccacaccatcagcctcattgtagaactcttcctctgatgaatgattgcaaggtgagtatatgacatactcagcaagccacgcagcaaatatgcaagtgcacaggataacaaaggatggcataatagggtttcttttgcaaaagcagcatttagcaaacatttgagaatttgataaaacagttaagtaattaaacaatattaagccaacgctatacaacatgccctattgtataggcccaaccattctgaacaaccaccccggctgcacagttctatctccaaaccaggaatgtaccattccaaaccaggagctaatcaaattattaccagttatagcatcttttactatgatgagaggtgtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtatctcggaaaggagttgtgacaatacccctcgcataacacaatccactgcagcgcaccttcctggatcataatcaccccctcataaacaaggcatggactccccagcgacccccgtgggcttatctccgccacttctcagtctggtgccccgcaatgaaccatgctatacaaaagataaagccgttgcccatgctggcttgtggttggcacgataaatgtttcacaaccgaaactcgtgaaccggtccttaattgccatgagcacgaccatcaaaaccatgtgctcacaacccaccattaccaggttttagttggcacattaattaattaactaatcacgatcgaccatcgtgaactatcaataagccatcatgaaataatagtgaatcattagttatcccataagtgtactaatgtttctaagcagggctaagcaattgtatctaatatctagttgaaccaatataaataaagctcaactagtcaaattaatataacccaaggtatcaaggaataaggtaatcaagtacgaaagggccatagcaatcaataggttaattccacccaatgacattcgaaaatagatgcaatagttgaatagaaacaatagctttaaataggatcaacatgctcaaagggttgtttgggatctgtgtgacttgccttgctggccttggaactcttcaaactcttctc

SEQ ID NO: 38214 - DNA, 235 bp, Oryza sativa
aactgatatggggaaggagctatttgtgagggattcggacgcgaaaattggtcgctagatttgggagggagcgatctgagtggggatcggatagaaaatttggagcgttctggggatggagtcggacaaaaaaaaatcgctacggatgtgatctgaaagaaaaaaaaggcgtgcgctattacggatgcgatatgagaaaggaaaaaaccatgtgctaggtagaactaattaatta

SEQ ID NO: 38215 - DNA, 194 bp, Oryza sativa
aggatatacaaatcaaaatggtgggctaattattcctctcatttgcttcaatatatatttgttattttctgaaatgcatgcatggatgcatgttttaattgcattgttaagatttgcctctggacgtgtacactattttatataggatttttaattaatttttatctgtcattatcattgatgtgttcatttgc

SEQ ID NO: 38216 - DNA, 1106 bp, Oryza sativa
  unsure (1)..(1106): unsure at all n locations
ataactggtaataatttgattagctcctggtttggaatggtacattcctggtttggagatagaactgtgcagccggggtggttgttcagaatggttgggcctatacaatagggcatgttgtatagcgttggcttaatattgtttaattacttaactgttttatcaaattctcaaatgtttgctaaatgctgcttttgcaaaagaaaccctattatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttatttattttccgctgcttagaactttattgattgagaggaactatctacctctgtaatgacattttattcgcttattaattagagtaatatttgtactctattatcaatttgttattgtgtgcctcggctgattcctggacgagggttcacacacatgtaagcgtttggaattttggatagaaattccgggcgtgacaagttggtatcagagcatctttgaccctaggttatgccaaatggttacccatagaagccctctgaaaaatattggaaaagtagaactgttctcctccctttctcttttaattaaaccaaactaatggcacatgcacttcttaaatctcttttaatggttctcattcgaaaatttattccagtattattagtactgtacatccattactgtactaatggctcatttttcagcaaaagttttacaatactgttttatttaatcttgctgcaataaaataaatttagtatgttgattttataactttcttttgaaaccagttattcaaaattacaaaatttgtgacctcatttccaactgttttaacttatcttgcaaagcttggtttactttatttacttcccttctactttgatttctanaactttatnntcanannatntnananntncnncnannannanaacttgtgctattaattggataaaggtcttaactccctcctttcacttgtctttaga

SEQ ID NO: 38217 - DNA, 1501 bp, Oryza sativa
tcattaagtttcttgtagtaaaatgttttgtgctcttcttattactaaagactccttgaacgtgtgttgtaatatgatggaaattgatcaatggtttagttttctatgagttaacggttgcatgtagagcttttttagagcacgttgtttctaagggaaacgatttttctgtttttctttagaaggagcattgttcgtgtgactgtaatataggggaggagaatggatagatgtatgcgcttttaagtaacggggataaaatcagatttctcagttaagacaacactttatattgtttatatttttataaacttttttcgcatgttaaaccttcacatatgcaaattgatatagccaagtcaaacaatcgctcacccatatatgtcacaacaaatccatactatatttatctatatatatttttttcgtaacatgtagtttcaatgtccaagttaaatgctgaaccctaaatgtgaaacacaaataaatctggatttatattgttcgtgacaatatgacatactaaactccaaagcatagtggatggtatacacaaatatttatttgatatatttaactacaaaaattcttttgatgataaaaaatgtggtccttgtaaaatctctaagacaaaccatttcaacaagaaaactatatacaaataccatagcataaatttcaatgtacacaagaaagttgtgtggtatcgtacaagcttcagtactgatgatctctcttttccctctgaaggacaagggttagctcatagctggctcaaagtcaaaaacaacgtgcacgaaacctgcaatctttcgtaacaatctctgccacggtgcacccctccatgtaccaaaaccaccctaccccgcgaaaaacagaattccaaataaaaataatttaaaaactgcggtaggtttataaaactgtcatacatattataattaaatgtaattatatttgaaatacactcataatataattaattatgattaaaatataattatactgtaattacccaataactatattataactgcattgcaggtgtgtttttctcattattttatttcttaaggttgaaccataagtctatggctagttttagcatttaatgtcttatggctagtgctgcaatatatatggctagtcataaagttttatagctcattcatatgatacattgtggatgcccttataattacaccataaatacgatatatcaactatggattggttggttagcaccgatatcttacacatgatttgtgcgaaaattttttctagtattttaatttcatgtacatatctcgagataattcgataatcataaatttaaaagttttattagaaaaaaaacttgcagaagttttatagcaattccaaaaaaaaaaaaaaaaaagaaaaaaaaccgcgcgccgcggctctctcgaccacttccattccttcccgggctcgccgcgccgccacctcgtctcccccgcggcggcggcgaaggaggcca

SEQ ID NO: 38218 - DNA, 1501 bp, Oryza sativa
cgcggttttttttcttttttttttttttttttggaattgctataaaacttctgcaagttttttttctaataaaacttttaaatttatgattatcgaattatctcgagatatgtacatgaaattaaaatactagaaaaaattttcgcacaaatcatgtgtaagatatcggtgctaaccaaccaatccatagttgatatatcgtatttatggtgtaattataagggcatccacaatgtatcatatgaatgagctataaaactttatgactagccatatatattgcagcactagccataagacattaaatgctaaaactagccatagacttatggttcaaccttaagaaataaaataatgagaaaaacacacctgcaatgcagttataatatagttattgggtaattacagtataattatattttaatcataattaattatattatgagtgtatttcaaatataattacatttaattataatatgtatgacagttttataaacctaccgcagtttttaaattatttttatttggaattctgtttttcgcggggtagggtggttttggtacatggaggggtgcaccgtggcagagattgttacgaaagattgcaggtttcgtgcacgttgtttttgactttgagccagctatgagctaacccttgtccttcagagggaaaagagagatcatcagtactgaagcttgtacgataccacacaactttcttgtgtacattgaaatttatgctatggtatttgtatatagttttcttgttgaaatggtttgtcttagagattttacaaggaccacattttttatcatcaaaagaatttttgtagttaaatatatcaaataaatatttgtgtataccatccactatgctttggagtttagtatgtcatattgtcacgaacaatataaatccagatttatttgtgtttcacatttagggttcagcatttaacttggacattgaaactacatgttacgaaaaaaatatatatagataaatatagtatggatttgttgtgacatatatgggtgagcgattgtttgacttggctatatcaatttgcatatgtgaaggtttaacatgcgaaaaaagtttataaaaatataaacaatataaagtgttgtcttaactgagaaatctgattttatccccgttacttaaaagcgcatacatctatccattctcctcccctatattacagtcacacgaacaatgctccttctaaagaaaaacagaaaaatcgtttcccttagaaacaacgtgctctaaaaaagctctacatgcaaccgttaactcatagaaaactaaaccattgatcaatttccatcatattacaacacacgttcaaggagtctttagtaataagaagagcacaaaacattttactacaagaaacttaatgaagaaaatgcaagagctatatatcgtgaataagaccatcaataacacatgaaatttgcccctttcaaccaaaacctttctttctttagg

SEQ ID NO: 38219 - DNA, 1501 bp, Oryza sativa
tacttaaagaaagcttgtcttatcttccaattggtgattagtgctaatatcaaatagtgtgctccattatgctaatttaacaaacttgatagaatcggagagatccttgttggtgcaccggaactttccaggaagcagcagcaatcagatgagattaatattgttttaattttgtagagcacccatgattgtgatttgggaatcggtaaagtaagattagtgctagtaggagtacctagttttaaatatttattaactaagcctacttgtactttcatccggttaactgcccactaggtttagtacatagttctaaattacgatggaaattggctgtaaattatgttttggagaccatgaaattgacatagcaaaaatgacatgttttagtggtatttgaataactcagatcacctaggacaatctggcacaattaactattattactcagtactaatctatttgtcccttggctgctagttgttcacgcagatacgttgttagattaccagtaattaattgcttccacgatgcttattatggaaggattagtggaaacaaagatgcaaacgtatatacggtcctatcaagaacgtcgtttggttgagtagaacaaaagcaaccagcaaaatgtccctatcgttggtgcctgcctgaatgcaactcccaaccaatattcaccaaactcaacgggtaatgatgttgagacaggaaatactcaccaaactgaaattttacgttgtgcatgtttgaagcgtttttttcatggataattgagacggatttttttacttgattagcatggtaaattgatatttttcagaaataaactttacaaatacttcagaataattggctaaacaatgcagtagaagaattttcttttctaagaaattgtatctttagaagcatgggcaaataatccatgaaaaaattagagagaaaaaaaaagctgagcagaacaagacctagtatatcggagtaatagaaactaagtacacaggaaaaaaaaacaatatttgattatcttaaaaattgagaaaaattaaaacatggtgttaatttcaatcttgcggcaagtggtgacttggggtatttttgatatgacagaaccagaagaagatacaagcaagcaaccttgcatgtccatctatcaaagtcttttgaataaatgggttacttatctatctctatctatctccgtactgttctttcttgcgtccagactcttgacgacgtgtgacaccatggtcttcttgttagacttgtgcaagaaacaaatttttagagatgcagacaaagatggaacccggcaatttttccaaagtctgcacctggggccttaatttctctgtctatatactacctagctacctggccttgctctgtctaaaaacctagccatcaaccaatcttttatgacatacctctctctcctctcgcgtcgtcctccccgggcgactcggaaggcgacgacgccgccgcctcttcgtcttcagcg

SEQ ID NO: 38220 - DNA, 206 bp, Oryza sativa
attgctccatgatttgataatgtggtgctacagtaaatatttgctaatgacggattagttaggcttaataaattcgtctcgtagttttcaagcggaatctatattttgttttgttattagtctacgttcaatacttcgaatgtgtgtccatgtatctaatgtgacacgtcaacaattttcgttcgcgaactaaacatgccctaaga

SEQ ID NO: 38221 - DNA, 1501 bp, Oryza sativa
gaggatacaacagatcaacagcaactcgtgtttcctggtaacaactgcagagctgagcaggacacaagccgccgcaagatttcatcagtgataatcttcttttgaaaatttatcatcagtgataatcgagcggggcaggcgtatccttgagatccatcccccggaaatggacatcctgcatgcacatcacaagtaaaaataattcagtcatcacaaacctacacaaagcacacatcaagcttgggaattcacacgcacgcacgtaccgatgcgaaatggttgacgtcgcggtggtgcgcctcgtcggcgcggacgatgacaacgtccttgagcgtggcgccggcggggagccgccagtagtcaatggcgatcggcggtgcggggacgttctcgatcttgccggcctcgatgtccttgaggtactcggtgtaggggtggatggcctcctcctcgaggtagccgacgacgcggtgcgcgagcttgggggagaggaggtagccgaggaagtaggcgttgaagaagacgcgctggacggcgagcacgagcgtgcgctcgtaccacctcggcttgaccgcctccatgaaggtcatgaggtgcatccgctcgttctcggcctcctccagcagcgcgtgtatccagccgccgctgtgctcgaagctggtggcgctggctcaaccctgggccttcctctccgactgcctcatcaacgccaccaccggtcacccctttatcttcgagggtgccttcttcctctccctcgccacccgcatcaacttcggcaccccctcccaccgaccccgtccgctaccccgacgaccgcgtctgggagtccgacatggcgcgcagcccaacttcctcgttgaggtcgcgcccgctaccgcccagacctgaccgaggctcgagagcgaagctcggcgtcgcccagatgcggagctcagcggccgccgccccctgcctgccgtcgccggcgctgcccctcgcttgccgtcaccgctggcgccggcccccgcttgctgaattgggagggagagagagataaggggggagattggggaggatgaggaagggatagactgacatgtggccccacgaattcttcttctatgtgaatgacgaatgggtcccacgtgtatgtttttagttataatgccacctaagcgtcacgtcaactgcagaccaagtcaacattgccatgtagatgccacgtcagcgaaacaactattcaaaaccgccaagggattcaatttgtactggttttagtaattgggggagtcagtctacccggttttctagttaagggtcacgaattagattcgattaacaattaagggagtctaagtggactttttcctttttcctttactggattaaaatgcgcggcccagattagagtacggcccagtacattgggtccacaagagtaaccttgggccgaaactactgggccaaatttgaagcctcaaggcccacgaaaatccaacccaatccgcacccaacccca

SEQ ID NO: 38222 - DNA, 500 bp, Oryza sativa
attcctgcagcccaggaaaattttagaagtgcctagatagggaactttttaagtttaggtgctatagagggaagagcaacttttttttgatgctagatagggaattttctctacaatgatcatacttcccatacgggcattgcttatttgactctgttttgaagtctaataactaatttgaccctacttttttaggtttgctcatttaaccctgtttttcaaaattgaagataaaggttgaccctattctgtgaagtctagataacggtgttaactgagtgacgatttctcttttttgcccttgctcgtttgaccctaatgctacattttaacatattcgtaacaaatttgacatagatttgagaaaattttgacatatttgatttcaatttgataaatttagctttagtttgacaatttgactttaatttttttaaaaaaaattaagagcatttctcctatcttatccatcccaaaatgtataaaataaagcaaaaaca

SEQ ID NO: 38223 - DNA, 1501 bp, Oryza sativa
gagtaaggcagtaagcaggtagagtatgaactaaagggattcaaatattcagagatgttccccaaaaaaaaaaaaagatattcagagatgtttcagggtttcagagataatagggttttagggattcagaaattcagagttttgtcgtctgaaaaaggagttccagggttccaattaagagacgttaatcagtcgttcgacacctcttttttttcccgcaactgggattggaaccataaaaacactgtagtaccaaaggaacaaaaacatttcaacatacacaaatatcctctcaaaagaaaatatacatactcatgttacgaatcgacgattagatattgcatgatatgacgctgcgaattattccctgacatacgcccatctttcatttgactttatgcatgctgctttacctctagaatctggaccggaaagacagccattccatcaccacttggtaaacagccagattctcaatctcctttctacagtaatacataactagaggtaaaaaaaataaattaagtggtcacagtgacttgagtagcattttaaggtcctgaatttaaatctccgtaggagtgaatttcagattgggttatttgaggagttaagtttccgatttaaaaggttgcatatattcggttggatgtagagaccgaataaaaaatatccttctctaaaaaggttaaaaaaaaggtacaaaaatctgtctcaaaagctatttttaaggttgcatatattcagttgaatgtagagaccggataaaaaaaatatcctcctctaaaaaaagttttaaaaaatctgtctcaaaagctatttttaggccattcatctgcgcaagaaatacttgtgcaaatcatagatgggcctcaaagaacacacttgctttgcatgtatggcattttctacttggaggtaggggtcagagtttaatactccgactgcggccccagttctctcaattctctcgcatcttctcatggcatccatctctgaagaaaattaagaacttgctatcaatcattctgcaaaccatacatcatagctgaatgttcaggagtatacaaactggtagtctttgcaagaagataaaatttaccacaggacatctaaaaatcatgtaattaattagaagacacccaaaaaacacgacactttcaatggatactacaaaatttgtgtaattagctgtaggacacccgaggtaatattttattattttcggtgaaaaagaggagagagaaatttcaaaaggacggaaatgcccttagcctcagtacctgaaatccccatccaacttcaactgcggcggcgaactccggcgaaggcaccacgccgccgccgtggtgcgtcgtgcatgccagctgcatggacaaaaacccgagctcttccaaatggagaatcctaagctctctcgccgcccataaatcctttacccagcacagcgtcctccgccttcctcgcgagctctcgccttgccatggcgtcgttaggcgac

SEQ ID NO: 38224 - DNA, 1501 bp, Oryza sativa
aatcttcactgagatgtacagcattgtttgtctacatggaggtgtgggtcggagtttaaaattccgacccccagttttctcaaaatccttcgcttctcttcgtggcaacatcaaggtagccgtaacacaaaaacacctctaaacaagaacattcattggtgtcaggatccattgcttttggatgcagggtgcagcctgactgcctgggcgatgcatagtctcacagccataaccataagtagatcgttggagctacagccatagtcgcacaggcaaatctgcaatgctgcatgggcttgaattgcaaccgtgcgcgcaagcggaaattcagatcgcatgattcgcgtcaatctcgtcaaaaaaaaaaaaaaagagaacaatcaagaactgcagtatctccgatggtcatctgttctggtgctatgagaagatttctttatagcagatgctctgcattagcgcctgatactgaattcctgatgttgatactgcgttgctgaagtgcctgagtatacaaattggcagcctatgcaataacctgaatcacacctacgtacataatttctttcatttcatattataagtcgtttcgactttattctatatcgaacttctataataagttagatcaaatatattttaatagcacttttgtacaaattggcttaataataatatgaaagaggatgtagtagagatcagatagctgctgattagttcatgtatacatccaatccaactagcacaggccacacaacaagataggagtaggatcgataacaaaaaagagcatttgcagtggttttgtggcggtgacacagaaggtctcttccagacagcctggagagacgccgagttccagagccaagcttcagaatatatgagtgcaactttcaacaggtatcacacgaactaactccggagttccaaaaaacttctgcagtattaatgtgcatatctcaattgcactgcaaacaatatgcactttataaccaccactgaaacaattacccaacacacgttcacttgatgatttcaagaaatgtgcagggtggggctaccgatttgcaaaatcagagttgttgctcaccaatactgaccactgtgaactgagtggtgatcactgatacgaattggtgtttactaaaagcataggaattcaagaacacacaacattattcctaaaatagccaatgaaatttaagtacagatcaaacataacaatgcctgacagccatttactaacagaacacacagccaaataggaacgaacgcatctttctcacatcccaagttctttaaaaaagaaagaagcaggcaaagttcaaggcttcaacagttcagctcaatccagccacattaacaagatttttcgtatttaacaggtaacccttagcaaagacccacagatacgcaaattttctactccctccgtttcacaatgtaacaaaaattatcaaggtgatatggacattactacaaaacaacatgcatacattat

SEQ ID NO: 38225 - DNA, 1501 bp, Oryza sativa
ttttttgcagtctaattaacctcgtaattcagtgcctgttttgactgacaagtttcaaatatatgcatgtaaatattagttcctgctacctactgtcaggttattaatttgtccaaaagaaacagtggctgaaatggaaaggtttaattgatattattagctgttaattcggcctctgtattatgcttgagccttactggtgtatgattccaatggcatagtttctgaaggcaaattatcataattttttttaatagttgatctgtaaagttggcttgttcatggagaaagctaccaagttcttggcggtatgaacaaggtagctaagtaagattattctgttcttctgtgatcacaagactgaatcttgtggtcttctgcggcatgggttcacatgtgctcctgttctgtttttttacttcgaaaattcaaggtaatttttttttcttggtgttcaaattttgatgatttttccttgaaaaattcaatggtcaaatatttgagatggtcattcatgtattacctttacgtggtcaggacctcaaagaccctcagacaagaactaatttcccaacgagtagtattacttgcaaaaaggagaatttgacttctcctttgtcttttctctgtacaaagctttgatccatgaaaaaaaaaacatgttttttcatgttcttctcgtcttgcaaaaacaaattactgaagtctatacaacctagtagcaccgatacatgtcgtttctgtgaaatttatgcaaagtcgttgtcttcgatttaaaggctatgagctctatagccttgtgcttacgctacccttgcaacgtaaacctggcaaccaaattgccaagtgtcagaaaggcctcaccaccagtttcgtctcgttctgaactttggctgagactgcaaagaccagttaaaaactgtgaccaggttaatgaaatgacatttcaacaatcagccacaagcactgtgagatgttttactaatatctctcagatctctatcacggtaattaagaaattccaagcttggatctggggcctgcacaagatgatgatgataatttaattgtcaattactgaatcatgcaagaaagtgtcaaggcctgagctgagctgagcctgcagctaagcaattagattactctttgctgcccatgtgggggatgccaaatctacactagtgacagagtgacagtacaagtggatgcataatgctcttcttctatttgattgccccttctgatggttacagataattagataacaactctacaaggttgacataatggattggtgatgcgctacaacagtgtggtttaggctggttttcagctgcaattacgcgtgaactccacctaatttgcactacttttaattcaatcgattcgatccacttgtgacgctcgaacggctagtagttaaaagataggtaaaccaaaccattcagccactgcgttgagctaatctaatcagacggctaattaaccattaacaacacgg

SEQ ID NO: 38226 - DNA, 1501 bp, Oryza sativa
tttccgaccctattagggtctctactggccgttggatcaagttatgtgactcagattgagtagatcagctgctcaaagcgtactcaacgaatcgcaattgggccgagtggtaattcgatgtttctgttattaacagggggtcggcgtttaaaactccgaccaccctttgcgatttatatgtagtacgttacactgtcttcttcttttcttgcgtgcttgctttagcctaatattcagctgaacgaaatcctgaaaaccaactagcgttttaagctggtatctttgagccagtttatacgaagtacgttacactgttattttcgaagctgctgatagccttcgtatatggttgcatgtaagatgacaggtgttttactgaaactctgcatatcgtcagtgaaaagattaagcaagcagcaaaagatgagagtgaagagtgttgtttgcatgtttcatgcggaagtgtataagtaacacacaatcacgctgcggcagtgttgtaaggtgtagagaatatataaatatagtcttgtttaatcccatgggccttgtgcccttgtcttctttgagtaatttgagcacgaactgaatcgaattgtaacactgtatactacgcactttctttacctattataaaaattcaaggtgttttttgccaaggattttagtacgtcactgcgagatcgtgtcggacacagttatcgtaaacttccgacgttcccgtttcattccgtttttttcatctgttgaaatcgctcgcatcggatgcaagaatcatggagctaaggagacaacccggctgctcacgaagatacaataaagcggcgagcccacaggccccagcccacaaccgcacggccccaccaggtgataagcgactttatttttgagtttttcccgtcctcccttttcctctcgtaacaccttgatcgctcggttgtgcacgtggctgatggcccagcgagattcaacggagaggtggatcaatctactcatttatccttcctcgatccattatgccttgagttgtgtttgtatgctcggtgtagatatcatacttctgcagacctggctaccagtttcagctcatattgaattcaggaagtggtgcatatctctactattataaaaattgaatatgtttttgtctgtattctgttcgcttttggaaatactgatccgtgtttgagacggattttaagttcgtttgcttttaaaaataaggacccgtgcttaagtcggatcttttaaaaatacaaaaggagtcgtataagaaatatctttaaaaacacgcatgctaacttgagataaatgccggattcctaattgcagctcatggttttctaacaaaaaaatatccaagtgaattcccacaataaatttcacattagctaaaccgtataacaataataagatttaaatagtattcacctgttgcgcaacagagcatcttttctagtaaaaattaatatataaaggtgttaatacacacgtagatagt

SEQ ID NO: 38227 - DNA, 881 bp, Oryza sativa
ctcctaaccacatttatagcaggttggacgagcgcgccacgccgcatttaatgcggcgcagcgcacgcttatccggtccgtgaccggtcgcggtgagtgaccggtcacagaccggtcagatcgcgggttaggtggcaataggcgacctgtcacacgcctcgccccatcccgtcggaatgatgagagcttcctggctcttgtccctagccggagccggcgtgccaactccaggagttggtatgtcagtcccggtcagattcgttccaggcttcagcgcaagtatggcaaggaagtcgctggccattaaatgaaggttgaaatgggcgtccaccgggaaaagcgggcgagcggggcaggaggcgtgcgctctgctttttagaagtcatttccggctgtagattagccctgattgtaaaaagcatgtttcccttcttaggcagctagaggcccatgtggtgacccctgaccagataaaaaggaggcccaggcctaagaaaagaagaggggggaaaagaaaggagggggagttgggactctggcgaatggttcctagagcctgaactctctctcgctctccgccctctggattccttcacacacagatccaccagaacacaggagtagggtgttacgcttctcagcggcccgaacctgtctacgtcgcccgtgtcttgcgcatttcttttctcgctgacgttcctcagatcgagggcgaagaacctcacttagcgcccccggccgaaccggcaaaggagggcctgcgcggtctcccggtgaggagccccacgctccgtcatctggcgcgccaggtagggggcgcgcgtgtcttttgaagccctcgtcctctttcgtgtgcgccaagcttctcccgctcagcccaa

SEQ ID NO: 38228 - DNA, 603 bp, Oryza sativa
cgtggtacggaggggtagctttgtaacggcaggtaggcgcatcagcggttatgttggtgtagtacttgggcttgcttttcactagcttttggacggtcagtggagtggacggagagactagtaaggccttgtttatagtttctaaacaaaaactttttatccatcacatcgtatatttgacacatacatagagtattaaatataaaaaaaatcaattacatagtttacgtgtaaattacgagacaaatattttaagcataattgcgtcatgatttgacaatgtggtgttacattaaatatttgctaataatggattaattaggcttaataaaatcatctcgcagattcctggcggaatctataatttgttttgttattagattgtatttaataatttaaatgtatgcacgtatatccgatgtgacaaccaaaccaaaaaaaatttccccaactaaacaagccctaagattttctaaggttgcacccaggataacgagtgggtcgacccacgaacccacttatagataaaattagtgagtaatccacgaatcaattattaatttaacatataaatagatttatgggttggtccacatccttaga

SEQ ID NO: 38229 - DNA, 1501 bp, Oryza sativa
atagagtatagtagtaagccactgtaagagcagatacaatagcaagctataagccagttataaccatatatcgagaagaaaagagaagagagagaagaaaacgggatacagatttatagccagctgtaacacaaactctaagacgttatgtgtgtatgaaaggtatgaccgggtattaatgatgtatatttttatagttaactattatatgaataggctattagattagctatagataatttggagccagtagttggctatactattaaatttgctctaacaacaactactaactggagttgtactagggtagtagttaaagccaatcatttttttgagttagataaaaagaaaaaggggaaaaaaaggagagcagatgatcatatctgtccagcattttatgtggtgattaaaaagaagggaaatgctgagcctatcaatgatgctggcttggttggtgtgttggtaggctttggaaaaaaaaagcttattggagtattactagtattttttttagaagcaaaagagggagattatatattactgtacccaatggggttgggtgtgagtgttactgctggtcagttactacttccacagccattgaagtcttttgttgactgcttttatcctgcatcgttagctttgcttgttgctccggcctacgagcactctactccttttcttttttctttattttaattttttttctttggggtttgcagaacagaacggaaaccaaacctgcgttgaattgaatggcgacgttccaaggcgttgttgcgtttgtgtctggattctgcagagcggatatgacttttcagctggaacattttacttcttcccctgcttctgcttcctgcatgcatgagcaaaagattctgaaatctgaacaaccaagttactactgtacttatgttagttcaaatcagagaatttcattctatatatggagtttatcctgaagctgaaacgctgaatatgaaatgaacctccttgttatcctgaaagagcaaggagtaattgtcagtacttcagtattaagcttgtctcctgtcctgacaaccaaacaagaaaagggaaaggggatttaaaaaagagagagagagagaagctggcgacataaaaagaaaaaatcaagaactaaaaggaaaccaaaacgagccatgcaaagtaacgtgattcagcaacaacaatttctgttgcaagtgaggcacatcctccattcctgcctgcatttgcattcccataccaaacaccagctcacacacactgtcttccagaaacaaaaaaaaacattttcttcttcttgataaaaaaaataaaaattgttgcacatggaaaagaaaagaaaagaaaagtcttaccattccaagtagtagagtgactccaacacaaaaccctacaactataaaccattctcaccacactcttctccctcacttgtatagagagactcattttgtccatccaatcctcctccacccaaaggtggcaacaa

SEQ ID NO: 38230 - DNA, 678 bp, Oryza sativa
ttgtcaattactgccaatattggcataggtgggtgcgatgtttttcaccggaatgaaaaagttcaacaagcaccaaaacatgatttttggacatattggagtgtgttgggtgcattcgtggcaaaaagtcacttcgtgattcgcgcggggaacttttgtcaattaatgccaatattgccatatattggcacacgtgttggcgatgcttttcaccggaatgaaaaagttcaaaaagcaccaaaacatgatttttggacatattggagtgtggttggtgcattcgtggaaaaaaatcacttcgtgattcgcgcggcgaacttttgtcaatcactgccaatattgccataggtgggtgcgatgtttttcaccggaatgaaaaagttcaaaaagcaccaaaacatgatttttggacatattggagtgtgttgggtgcgttcgtggcaaaaaattacttcgtgattcgcgcggcgaacttttgtcaattaatgccaatattgccatatattggcacacgtgggtgcgatgtttttcaccggaatgaaaaagttcgaaaagcaccaaaacatgatttttggacatattggagtgtggttggtgcattcgtggtaaaaaatcactgcgtgattcgcgcggcgaacttttgtcaattactgccaatattggcataggtgggtgcca

SEQ ID NO: 38231 - DNA, 499 bp, Oryza sativa
aattactgccaatattggcataggtgggtgcgatgtttttcaccggaatgaaaaatttcaaaaagcaccaaaacatgatttttgaacatattggagtgtgttgggtgcattcgtggtaaaaaatcacttcgtgattcgcgcggcgaacttttgtcaattattgccaatattgccatatattggcacacgtgggtgcgatgtttttcaccggaatgaaaaagttctaaaagcaccaaaacatgatttttggacgtattggagtgtgttgggtgcgttcgtggcaaaaaatcacttcgtgattcgcgcggcgaacttttttgaattaatgccaatattgccataggtgggtgcgatgttttagaccggaatgaaaaagttcaaaaagcaccaaaacatgatttttggacatattggagtgtggttggtgcattcgtggaaaaaaatcacttcgtgattcgcgcggcgaacttttgtcaatcactgccaatattgccatagg

SEQ ID NO: 38232 - DNA, 173 bp, Oryza sativa
gccatatattggcacacgtgtgtgcgatgcttttcaccggaatgaaaaagttcaaaaagcaccaaaacatgatttctggacatattggagtgtgttgggtgcgttcgtggcaaaaaatcacttcgtgattcgcgcggcaaacttttgtcaattactgccaatattgccatagg

SEQ ID NO: 38233 - DNA, 245 bp, Oryza sativa
aaataaaatatgaattacaatgatagttatgtttgttgttagaatcacaatgacaataaagagtaggcggcggacgggccgtagaggagcatagtggcatcgtttgacgaaacttctgaaattataaaaaaataaaacccaacaagataataaactataaaaactacaatgtccaatttttaaaggttcgtaacttctaaaaaataaaaaaacaatgataatcatgctcgattttaaaatctcaa

SEQ ID NO: 38234 - DNA, 429 bp, Oryza sativa
cttacaactacaagtaaagaatgacagtcccagtcttgctaatcctgtatatacaaaccattgtttctcaaaataaacagaaaaaaaaatgcatacaagaaaggaaggcaacctacggtaaacactgcagtatatgagtataaaattgaggcctctgtgacagccaactcaacggcagtgccccttatttctgaaaaagcatattatgccagaaaatggttgctgaattgaaatacagtttgatttccgttcttcgcaacaacgaattatccaccctccaacaaggagtggggatggtggttccatctgccttgaccacccttcaacaatcatccctccatgatcatggaatctgcaagagaggggcagcttttgacatgctttccatcagatgtaaatgttgttgatgtcactaagttgtcctagcca

SEQ ID NO: 38235 - DNA, 1501 bp, Oryza sativa
aatttaaacagccaatttgtgaagctgaaagattactatgcaaaccaaattgtttaaggatatgaaatgcattgtcaactgagacatcatttctgaaaccaatggttggcctttacatcggcaccctataatttctactttagtcatgtactcatgtggtggcatgtttcagcttgatcacaatttgatgacagtatttcttctttcaagtcttgtatcaaacgtcttttgataggatgtcaagttaaaaagattctaaagttttgcactttaaaattcagtaattccttaaatatcatttcctgaagaaattttattagatctttgtacagtcgggagtaaaattcagtatgccttcaataccattttctgaagaaattttatcagagctttttacagctagaatctattaagattcatacatgatgctctccaaagaggaagacttgcaatcattcaaagatgatggaatttctcatgtatatataaaaaatacacatccaaccataaaatcctcaacacctatactgttgaaggagcaaaaatatattaactgtataatctaatgctaatactatcaactaaccgtgtcattggcaccagccttgccagggttcattctgcttgctttaagtgcggcagcaagatcttcggcctacagacaaaaagatgttgaaataagatggttatcaatcataaaattcaaatacagcacgagagcccgcaatgatgaacagcatacccttttagcccgggacaaatatatctgttcagcattttcctgttgatatctggcaattttagcttcaatcacctcgacatctatcccctcgatcaggttgaaagcttgaaaaacgaatttcaaacaagcaaatcttgatcaatcacatttgcttccttactgttgaatgatgaccaacctagagacaagttataaaacaacttactcatatcctcgacttcctcaagatagtcgttgtaatctttcagggacggaaaatgctcccgcgtcttgttgaatctgagatcgttatccacacaaagcatcaaactcatgaacttgacagctaaatcttttctttaaaaaaagaaaatccgaggagttcaggttaggtagctcacatgctggtaatcctgcggcggatggtcatctccttcgcccacgcgttccgccctccaccggatgccaccaccatctcgacgcctcctcctcctcctcctcctccgccgccgccgcctagaccgcaagatcactggccgcgcagcctcgccgtggccgcgttcgagccggagactggcgaaggtggctagggttcttgcccgagaagaggggagatgcctaggcccagaattgtaattactacaaaaacaagggggttttgtgaaaatgtatgtgccatattggatctgagccgtccattcctaatcgaacggctcggagagaactcgtcacgtgctttacaccctcctgtgacgtcacgccacgtcacgacaaaccaca

SEQ ID NO: 38236 - DNA, 1501 bp, Oryza sativa
cggtgagaggcatcattgtgttagacatgtgaggatcagaacaaattcttgttgaaaagcttacacttgatatcatctgcatgctctcccaagtaactgttcagagaacatgctttggatatatgaatagacaattgtagaatttgcagttgccaatatctggaaagagaataaaaggttcagaaagagatagaggaaaactgataactgctcctgtaaagtgtgaactccaaaacatgacaggaggaaaaaagataaccgcagagatttataaggcaggaacaatttatttgcatataaattagggctgttgagattgtagccaaaataaataaatttttgtaagttggcaatattgccaggttttggcaggatagccactactacgtagttgccaaattccttatgtatttttttaccaaagttggtaagaaaccaaatatatacacatatttgaaactttaccaaaaaaaaaattatggtttgaaatgatatcaatctgaagaacaccttaatcacatgtcaagaacagaattttgtgtttgtgcaatgtgcccttagttggtgaagcagggtgtgaaatggacagtagtctaatcattttgtagcattagcagttgagaacgaaagggattattcattacagaaacaaagtactagtacataagatggaggagcttcatatcctctccattgcatagtgctaaaaagacatcgcttgcagttaacctgcactgcactctgcacatcatactgagggctgaggctgctaaaacccagcattgtactgtagatatgatgccaggatatcaccaaaggtctttcagacaatggccttatcaatatcaccaaaaaaatataaatgcagctagaatacaaataaaagatcgtatggcatcagtataggagtagttgaaaaccttaagtgatgacaccatccttttctgggattccttcccatccataaggtctgaatactccgcaacagacaagtttcatgcctgtttcttcagagataagtatgcagaagccaaaaggggacaacatgcagacatggagattaagattgtgatacatgtaccataaaaacaattatctcaattctcaagaaggaatgtgcagagaggaccagcttgacattgctgccttaggaaccatgaaaaatttcctccttgttttgtttgtactttaatttttccctcaatgttcaatgagatacaagtagatatggtacagtcatacaatggaactacagaaatagcccgtcggttgccggtatggaaggcagagcagatggcgcccattggtcgagtcactatggtaaatgcggtattaatctcaataccgatctatctgctgatggccatcaatgtgccaaagtgggtgataaagggaatcgataaggtccgtcgcggcttcctcccgtccgggaaagcaagcgctagtggtggaagctgccgggtcgcttgggcacgggtttgtgcacccaaatcgtatggtg

SEQ ID NO: 38237 - DNA, 938 bp, Oryza sativa
caaaccaactaaaccaatgaagagctcatttaaaatgtacgaaatttacagcaaacatatcagtttcccccattactaaaccggagagctcccacatttcaaatggggcctagagttccaaccaattgcagcaagagcagtaacgacagcgaaggacgcataccatgggatcccggtgaggttatgaaatccgtcgaggatgtcaatcagcgagctgacagcgaaccccgacgcgcttccgccatctcctgcggcggctactccggctgcatccgccgacgccgcgctggtggcgaccacttccccgaaatcagcaccacccgcgtcgtgcaggtacgcgccttccccctcggcgcgcacgtcctcctcgggagccttctccgccgcggcggggccggccggcggcggcgagcgggggtaccaggagaagcttcgcgcggggacggcagcgaaagggactagcagcggcggcaagcgagggggtgacgggagcagcggcgcgcgggtggtggggcttggatccgaggcggagaggtggtggtggtggagcacggccagcggccgcgggaggcgccgaccgccgccgccgccgccgccggcgaggcggccgaggaggcgaagcggaagcgccatgtggtttgtcgtgacgtggcgtgacgtcacaggagggtgtaaagcacgtgacgagttctctccgagccgttcgattaggaatggacggctcagatccaatatggcacatacattttcacaaaacccccttgtttttgtagtaattacaattctgggcctaggcatctcccctcttctcgggcaagaaccctagccaccttcgccagtctccggctcgaacgcggccacggcgaggctgcgcggccagtgatcttgcggtctaggcggcggcggcggaggaggaggaggaggaggaggcgtcgaga

SEQ ID NO: 38238 - DNA, 521 bp, Oryza sativa
attaattatttattgcatcttatattttaaatttgggatcctttgcaatgcgcggatcatcatgctagtatagattaactacaattagctcattgtgctattttgtttctattacgtgtctttgcagatactcttggttctgtgatcccaggcataactcataaagtagcaggattcgcatgaagggtcattgcatcacaagagctgatgcgagtcgatctcaaagaaaaactagagttaaacttttattcatggttatctcatattcagaaaaagcgctgtctactacttcagagcaccttgtctagttgtcttgctagcggtgactgttatgtgctattgctaagtacctctagtgcatccaatgaaatgattttgcccactaccactaccaccacatacacacgcggtatatcttaaacgcttgcacatcagatgctgaatatttcagacatatttgtcagctattacagggcaattcatttattcaatatgatctcaggacattactctttgtttgc

SEQ ID NO: 38239 - DNA, 672 bp, Oryza sativa
tataggccatttatgtgtgcacccatggtgcatagacaaaatgcacaggtcaggcatgcttccagtttaggttagcattctattcttctatattcagtactccagttgctactgttttgaaattttggattgagaatattataggactattcgcaaggcattgtagatcgaatatctgaaataagcatgctttaatgtgtctatagaatatgcacacctcaacagatatcctgtattttctgtcactaatgtgccaagcgaatggttctttttgttttttttatgttgtgcatgccgtatcatttattatatgcactttgcatttgtatatggttttgtaatgtttttgtgctgccaaatttagcttttctttgtcatcagatttcttattgtttgtacatattggttcactcaatttcaaggtttctgaaatatttcaatttgcgtgctgaaccaactcaatttattcgctagtggcagtgccccctataagttcttttttcttttttgctgtggcaccagactcccatttcatgcttattttcatcaagttgcacttgatgaatggagaaaacatcaatggataaactttctttttatatacatgtaatcatgtcttactacgagctggtgaagtaatattatttacttaatttgcgcattgcatgcagg

SEQ ID NO: 38240 - DNA, 1501 bp, Oryza sativa
aaaaattaaagtacaaacaaaacaaggaggaaatttttcatggttcctaaggcagcaatgtcaagctggtcctctctgcacattccttcttgagaattgagataattgtttttatggtacatgtatcacaatcttaatctccatgtctgcatgttgtccccttttggcttctgcatacttatctctgaagaaacaggcatgaaacttgtctgttgcggagtattcagaccttatggatgggaaggaatcccagaaaaggatggtgtcatcacttaaggttttcaactactcctatactgatgccatacgatcttttatttgtattctagctgcatttatatttttttggtgatattgataaggccattgtctgaaagacctttggtgatatcctggcatcatatctacagtacaatgctgggttttagcagcctcagccctcagtatgatgtgcagagtgcagtgcaggttaactgcaagcgatgtctttttagcactatgcaatggagaggatatgaagctcctccatcttatgtactagtactttgtttctgtaatgaataatccctttcgttctcaactgctaatgctacaaaatgattagactactgtccatttcacaccctgcttcaccaactaagggcacattgcacaaacacaaaattctgttcttgacatgtgattaaggtgttcttcagattgatatcatttcaaaccataattttttttttggtaaagtttcaaatatgtgtatatatttggtttcttaccaactttggtaaaaaaatacataaggaatttggcaactacgtagtagtggctatcctgccaaaacctggcaatattgccaacttacaaaaatttatttattttggctacaatctcaacagccctaatttatatgcaaataaattgttcctgccttataaatctctgcggttatcttttttcctcctgtcatgttttggagttcacactttacaggagcagttatcagttttcctctatctctttctgaaccttttattctctttccagatattggcaactgcaaattctacaattgtctattcatatatccaaagcatgttctctgaacagttacttgggagagcatgcagatgatatcaagtgtaagcttttcaacaagaatttgttctgatcctcacatgtctaacacaatgatgcctctcaccgaatgcattcagcataacatttccttttcccatttcattttcttcagacatctctgaagtctgcacctgtactgggataatggtggggagaggagtacgtggagaaactgatttcaggtacgcaaaaatataataagaaatttgggcccccgtcttgactgattgaaaggaaaagcccaacaacctatccccatccatgcctcacacgacaatgttcttttttttttctcggcagactattaggtagtgataattttttttttttgagaactaggtagtgataatctctccctggaaatcataac

SEQ ID NO: 38241 - DNA, 274 bp, Oryza sativa
  unsure (1)..(274): unsure at all n locations
atttgtgctaagatttaaagaaaggcgcgtgccatttagataagaagtcctgcactggttgctttgttttccaatcgtctcctgttttgggacaacatttcaataaatttcctttaggtatcaattgtttggatagtttagtaacatagtggtattgtttgcttttgaatctattcacgttatctttcaacagtttnccttggtttttttaacccaaccttccctaaaaaaactaannagtgnttttaaaattgaaaatatnntattgtttagc

SEQ ID NO: 38242 - DNA, 1501 bp, Oryza sativa
gaaccggcattagaagcgaggagacgactaatcaagccaccaaaaaaaaatttaagacccctccctcctccttgccgcactcaccaccaacctgtaatgtgaacctgctgctctgcgagttatcggtgttcatccagcagcgagagcggtggcagtggtactaggagtctaggacgagtggtgggtactggttgtactggtggtacggcggtttcagcggcggagttctcgcgggattgtctcgttcgtctgatccggcgctggaggacggcggttggtttctttttcttctgctgcttcgcgagcgggtgtgagagatcggttccatgcgggggtcgctgctgctggcctcgggccgtcaggtgatggagaattccggctcccctgttcttcgctttgttcgtgtgtggtttttggttcttgggggagtttgcatggagaggagagggtgaggttcttgggggattcttggtatttgctgtgatggaaggcgtgttcttggatgcttggggtgtcggtttgtttgtgagttggtgccggattctgcaatgccgcggggttttgttagatttgatgattcggtgctcgatgagcgtttcttggttcgtctggtgatttcttttcttttttctttttcagtttttgtttgtttgtttgagttttgagcggttttgtgggacggatgattcgaagggatgttgaaaagttcatcggaaagtgattgcgccgtaaatgttcgattgggcttttctttgacagaaaaattcggttctcttttcggctcagcgcatcattgccgctcttgagaaagtgcctccttttcccctcggtttcctgaactttctgcgatgtaactgctcgtctgcctctcgctctctcccgctttttcatgcttttctttggtaaattcagttagattttcgtgagaaattttatttgggatcgtcggtttttctgacgcttatctgacagttactaccttttctcctctttccatttctgatgtttttttttcttaattttctctctctgtcttcatttatcttgcttagtgtcattggtactgtgatgcttgcctgaacacgtcctgaattcagccagtgcacaattcgctgaaggccatgccaagcaaaacttgttcttgagaaagatccttgtttttacttgtccgatgaaactccctctctttttctatctaccaaatggtagtacttctgaagatgcaattatgggcttagaacagtggattcaggactgctaattttgtggggacttttgttacactttcatgctttcactggttcttgtattatttcagacttccatgttctctttttggttttgatttgcacttgcgtttagttttcttgttttctctgtcatgttatcatttggaccgcaactggtccgggtggttggcatgtgaacgaataataacgccacaatctaggtggttggcatgtgtttctggctgcatgtggtttcgggttgagtgattcaa

SEQ ID NO: 38243 - DNA, 494 bp, Oryza sativa
cttttttttttaagcaccatccatttaggtcccgttgttttcttataaagacatattttactttagtatttatctgatttaaaaatgactaaaatcaattaatcacgtactaatgattttttttccggtttacatgttcctacttaatgtttatgttctacacacaattgtatttatctcgaaaaataaaaatgcccaattgtattacttaaaaagaattgcactaccttcttcttgtaaaaatatacaacgttttgattatccgttatatttaaaatcttaacgtacaaatacaagaatatatgcatgtttaaaatattttaatgataaaataggtcacaacaaaataagtgatgcatatatagttttaataggatagatggttaaacattcgataacttcatatatttaaaattagagggagtacagttttactacctttacactcacagttatatattatattcatgtaaaaaaaacagttttatttttta

SEQ ID NO: 38244 - DNA, 224 bp, Oryza sativa
  unsure (1)..(224): unsure at all n locations
ttttccatatggtggactatctgcaaccgtacttgtcctattcttgtgtcacaatggcgagtacctcactgatggcagcgctgcgtttatagccatttcaattagtcattttgtcctgccatggcctgcggaatgttcttcttgaatgcacttcggcaatggtaatgngatgaaccacgcacagccgtctttgctattctcagtcgtaacgatcttcaggacca

SEQ ID NO: 38245 - DNA, 335 bp, Oryza sativa
gcactggcgacgctgtcgtcgccgagccacatctcatactcgagcatgttgaggcccaggtcgaagtcattcttgttctcgagcttgagatgcagcgtggcggtggtctcctcgaaggagaacctgtggaacttgatcttctcgacgtcgacgtcgggcttgtaggggatggggatctcgccggacttctcgagggggagcttgatcctgccgatgatggggacgtcgatgaggaggacgaccctgacgaggtaggggatgatgctcccgggcttgatgtcgttgtaggtgctcttgatgtcgtcgtagatgagtgagatggggatcttgacggt

SEQ ID NO: 38246 - DNA, 307 bp, Oryza sativa
taatctgcttagtattatgttgatcagaagctggagattgttttctgctgggtgatccatattttgtagagatggtgataaatagtaccggttaagttactctgaaagtgcactccttttgccatcttttactgtaagtactaagtttgtaaattaattgctggagcaatttaaccgtaatgtatctcttgcaccttttttttatatatatgttactttttttcctttatctgtttccctcctatgcaaattggagccttgatatcatgattttatcattataaaatattctatgccgccttccagg

SEQ ID NO: 38247 - DNA, 1186 bp, Oryza sativa
atgcatttttcagatctgcttccatggatcagtttggtcaggtagtcttgttgcaatgcagagttttagatatgaacggttcatatacttcatatcatagttgtacacagtggtttgttctaatcattcccatctgattcttgggagtagccaaatcagtgcatggtcagatattaggaaggaagagcagtataatatctatgtgcagtttagttctaatttaccggctattctcacacgttggcttttttattgactgagatatcatttttcttctgttttcactgcagtccaaatgtgctggtcaattcataattgatcagcaggcctggaatttgtctcaaggtatatacatggaatagtgttccaatatgagtagtgactaaagcagattaatttgaattgtgaactcttttaccaagtgaacagagactctgtcaaataatcaggtcagtactaaaatcctattgatcactataaaattacaatctcatttgatgttgcctttttcctggtgatcataggagtgaccccttttttcatgcttcaaaggtatatggttttgtataaaattccatttctcagtatagaagttaaaactctcatttttgtctgaactaataaactattgttcttctccaagatttgttcactaaggctccgttcgttctggggacataggggagatttgagtctcgttttccgcgcgcacgctttttaaactactaaacggtgtgttttttgcaaaaaaatttctatagcaaagttgctttaaaaaatcatattaatccatttttgaaatttaaaatagttaatactcaattaatcatgagctaatggctcacctcgttttgcgtatcttcctaatctcctcaatccccttctcctcaaacacaccctaagttgcaattgatagcacatttttacattttcttggcgcgtccatttgtgcctccacagttgccccatatgctaccactgacatttcttattattcattcctgtttcttagagaattgtatttatctgtgcaaaattgcaactcgatgtactgaggattctataagcttttaaagattaccgtgaacacatagtgtactatccagagaattactcagattcatttatgtctaatggattggattccatgtaaattcagttgtaatcctttaagatgattttcagt

SEQ ID NO: 38248 - DNA, 1501 bp, Oryza sativa
tatagatgtaaccaatggaaggttatatctcctttcctttttttggcttcagatgcatcaggacaagtagctagtatcttggaggttgttgaagaggaaactccagaaggtttgttttttcattaaacaatcatataatattttgggtatcatagctggctaactgctacttgggttgcctctaggagcagagcatctgagcaagtagatactacttgtgaagttgctttggaatgtactctataattgattctttgaaccccactttcatctattgatgtagtagcacactgcttttgtgttgaaacagatatgaaaatatcatataacttccaatcttaacaaatacaatcaacccaatctaaaaactgaacatatacataaagggaataaaaggggaaactattactgttgagttttggagttcaaatatccatggtggtttatcatactaaggactatttccactgtttgttttaggattttttttcaagctaattaaacacccaaattagaattcagcatgatagcacttaatcagggttaagcaccagatgaatcccctaaagatctctattgagcgtaaatcaatgaacaagcagaaaacctctatgcagcagtatatctcaacagcagtaataccctgttataacatgaagatatgcatgttttcatgggagtaatatgcatatatccacatacagatagtttttctatttacgatgatcaacaatgatctctgttgtccagtgtgtgctcttgacattcaatcctttccctgaaatatggaaatgcatgaaattggccagctgctattgttggatttgcatccttatggtttccttttttatgttatttcatgtagcacctggtaaagacctttgtaatggtggcattcctgggtctggactacaaaacaaaatgcacaatgctcaaggttttctactcactccttttgctagttatgatgggcctaatgaatttctggaagtttctagttgctgcatattgagctaacattgttcatttatcttttaatttttcccatcgattataccttgattccttgcattttgagagagctcagaggtgctactctcaatcctgtgattgctttactgttgatttcctcttctctaaccaagactaatcttgtttagatggtggcacggctcaaggcagcgatatgtgcaatggcggaaatacctcaaggcgtctcaatgatcgcaagagtgttatcgttatcgactcagacagcgatgaagacgaggatcctcacccagagcaacatgaaccagaacgtgctgctcctcgggcagccatggacgtggtcatggctcccactcatggtgctccggtagccatgaatgggactagtgctcccactcttccttgtgctaagagaggcaagaacgggactaccgcgcctaaaggccgtgttccggctatcgctgcacttcacgcactgcaatccatgaatgcgccaggtgagcatgaatac

SEQ ID NO: 38249 - DNA, 381 bp, Oryza sativa
tcccaatcccattatacaaataatgcctcaagagactatgcagtattaacaatggtttgaccctcctgagaggtttgaccccgccgcctcagctttacgttgctcacgtaccggccagaaatatcacagcacacacacacggttaacttttttcccgcgcgaaatctctcgaagtgaaacatcccaagcaaaaatccgatcgattcggcgagctagcaggtcaactcgccatggctgacctcccatgcatatatatacgcgtagtacgtacacttgctttcccaacgctcgcgaatcaaatcgagggtgaaattaagtcaagaacggagagagatcacggtgaggttgatctcagctcgccggaggaggcaatgagccggg

SEQ ID NO: 38250 - DNA, 325 bp, Oryza sativa
agaccaaaaatggttggatccagggtctctgcgaatccgtcctccaaatatcgcattattgctgtaaatgattaagatgattttacattgattttttggcacgtttttcaaacggctaaacattgctgtctagatatattatactagaaaatatcatatctagttttagattcatatattttttagacgaatataatacttatcaaataaatttatttttaaatttatagtattaagagataattaatcagctttctcgttttataacttcatcctcaacttcgtactccgtatatgtcaaacaccacctcgtatatggcagcaa

SEQ ID NO: 38251 - DNA, 1356 bp, Oryza sativa
cgagttgcattacccgtcgacgccgacgaagaaggctgcgccgccatccgcggctagggttgccggttgcgccagaagatgtggggggacacacaggaccacgggcgcgccggcggaacggagcggcggcagggggcgccggagcggagcggatcggggagggagcgagctctagagaggagatggcggagaagacggcggaggcggaggaacgccgacgaggaggagagcccgctcgagagatagaatcaggattcagggcagaggggaattttctttttttttctttctttcttttttttttttttggctggcatatgtggggacacgccgagacagtcaattcgtcagagagctgcggactgcgggcaaaacgtgcgaacttttttggtttttttggaattattattacgtgcaagtttgattgtagcggtaaaaataactgaagcgtatgtgccgttctgatgatggtagaggtgaaaagtgcctgaggtgcaaatttcagaagctaagtggaagggggtgaatatgtaaaaatatgttttgacgagtttttaaatatttgaagatattttgttatgcaacgtttggattgtatttgatatctattatctattatctatctattatatatatatatagggaaattatttgatgctccatggagtatgggctccaaaatcatccaccattcagctgcttaggatttgtgcaaaccaaaaactcagtgttacaaaaattagcgggttttacccgataagaaagatctatacgtacattccattttttttatttgcatgcatgtatttccactggtggagaaaccatatttggtcggtcgaccaaaatccacaatagtcccggttccactaaaaaccgggactaaaaatcatctttagttccagttagtggctacagtgggcatatttaatctttagtcccggttggtaaagatcatctttagtcctggtttgtatgttgtcaggggctgtcaggccctcccgtgatctctagtcccggttggtaacaccatccgggactaaaaatcctaactgtctttactcccggttggtaacaccaaccgggactaaagttaggatttttagtcccggttgttaaacaaccggtaaaacaaagcctctatccacgcgcgcgcatgcaagtctcttattaattccatcattatctcctcctctcccatccagccattctctccatcttatcttcttctctcctcctctcctcccatccttctcttccttcttctctcaccccatctcctcctcccctcccttcccctccggcggggcggcgtgatggaggccggccatggcggccccggacggggcgacggga

SEQ ID NO: 38252 - DNA, 471 bp, Oryza sativa
ccaagccttgttagattcagaatcagaagatgttaaagaaaaacttgaaacaatactaaataatatagacaatgactcatgttcagatgaagaaaaaaatgcagagattaattgttgccaagacagtggttgctcttgttatgagccagataattcagaagaagagtctgatgaaaatatactcgttttaaccagtttagaagaatttgttctcgatacttttgaaaccattcaagatccagaagaaaaaagaagagttctcgaaaaattcctttcaagagtcaagactgataaggataaactaaaaaaggatattcaaaagagcaaattcctctctattgatgaagtgttcaaaagattagatgaacagaaaaagaagaatgagaaaccagatttgatgagcctattcgaagaccaaaaaattatgaaacaagatttagaagaaataagaaagcgtctatacatgttaga

SEQ ID NO: 38253 - DNA, 178 bp, Oryza sativa
gttactaccaggccgaggtaggtgtaggtgggtataataaatgtatgaattacttcgaattaacgaagctataagatatagatattacctacagtaaaaaaagatataaatattttgctttgaataatagagttaatatacaacatggtaaacggattctaactaattctaatatgta

SEQ ID NO: 38254 - DNA, 1501 bp, Oryza sativa
aatagttgcattgggatttgataaagaatgaggattatagtttttttattttatattagtatgtgtgtgatgattgaaaaataaacatatttcgaaacggaggaagtacatattagtaagtaaaattaaaatttgttgactgcacatattagaaaatgccacttccttttgatgaaaaggagtaaatggtttacttgtgataaatactgatgcagtgaaattcattaagtcaaggataatacaatgtactccctccggttctataataattgacgctttagacaaggttaaggtcaaacttttataactttgagcattaataactttaaaaatatttagtttaaagaaactagaacaacatagatttgtctttcaaagcactataataaaagtaaacatgcacttatttattgtgtatattataatagaaaaataaggttaaagatatattttgtaaatcgtatcattgtttaaaacgttaattaaaatgaaaccggaggtgacatttatattacaacctgaaatcactggagccggtctgtcggtccggtcaataccaacaagcggtgcaacatgggagggattgactacttcagatcggatgcttttattcagttttgccgcacgttttcatgctttttaattcgttggacgcttgtttttttaatcattttttttgtatgaatggaattattcagacattctccgcctaaatgaaacgaatatgccttttggtgtgtggttaggtattgccgcccatgttagtggctactactgtagtcttttgtcacatcactggacaaggcaaaactctctacggtcttggatgatgctgcactagctaggtgatcatacctaaaaaaaacgtactctgtgagtgtgtttagcaggcaaaaaatatgttaaatatgtacattcaattttttgttattggcaaaaaaaaaacaacaaggtgctccgaaatcaacatgaaccactttgaagaaaattttattaaaatgattttcctactgaaaaaacaaatttaaaaactcacagaatatgcttagtatttatttaaattattaatccgaataattgaagttacttgaatcgggttgaactaattaatttctagacactcagagtgtgtttggataatgggaaatggagagtggaattagaattgggaaatgaataaagggttaggactaaatggaagatggagaatgaatggttagaatttaaagataccttttgatgggtgggaaatcatttcccaatcccattatacaaataatgcctcaagagactatgcagtattaacaatggtttgaccctcctgagaggtttgaccccgccgcctcagctttacgttgctcacgtaccggccagaaatatcacagcacacacacacggttaacttttttcccgcgcgaaatctctcgaagtgaaacatcccaagcaaaaatccgatcgattcggcgagctagcaggtcaactcgccatggctgacctccca

SEQ ID NO: 38255 - DNA, 180 bp, Oryza sativa
gtttagtacacagtggactatgtagaaattttacttcattgtcaaaataaatggtttagccaatacaatatctcatatcagatatgtccagcttcatttcacatttttgcgcattgcattttagacataaactcatatcatacttatgtcaacaatttcacttttgttcattaccccagg

SEQ ID NO: 38256 - DNA, 1357 bp, Oryza sativa
ttctcccttctttctactcgcctccgcctcctcctcctcctcctcctcctctacctccttctccatctcgccgcagatgctgtaaacccaacacaaagaaaacctaggttgtggggggataattaaacctcgcgtaggggaggggtgaaatatattttttatgccgggcctatgctggaggcccatgtaactgcgctcgtttgttgtggggccagcccagcccagcccaaggcccaccaaacctacagacaagtcgggtccccccgcctacccgcccaccggcctggccacacaccgccgccacgctggaccgcctggtacggaaacgggtcccacaggtcagaacccggctgcggcacgccacatgtcacgggtggcccccacgcgtcagcgtcacgctcttcgggttctccgcctccgctgttccgtctccgacttccccaccacgaaaataaattcgattttttttcctttccgtttttctccatttcgctgacacggcacgcgcatacggacaacgccacgccgagttcgctcgtctccgctctcgctgcgtcggtgatctgatggcggcggcggcgtcggcggcgccgcgcgtcctctccgcggagccgaggaggagggatccggtcgccgtgggagtccccccgtggcggctgtcaccggggagtagggttcgcgccgcctcgcgcgctcgccaggtacccctcacccattatttcccctttgctttcggtgatcgaattggcttgctcgtcagattcgtagtaatggactgttgttaggagataatgcgttgtggggttgtgggtgttttcgtctgttgttgattgattggagcttaatcgctaggcttttgggtgcaatttttggtaaagtggtaggcgggtggcgaccgggtgatcagcgtaatgcagatgcaagcagggcagaagcagaaatgcattattactattaagtgcaccttttgtagtacacatttcttgcgtgtttgaaaacccttagtctttgtttagttcacaccgtggattgtgtttgtcgttatgttgtcgtgctcatacaaatttccctgatatataaacctatcatttggagtaggatgcacagggaaacattgttaggtaactaaagggtctaattgtcaccggttatgtgtttttaagactctttttaggtcgtgatctgttattagtgtaggtgtgagcaataatgctttggtaattatatatagaggacttttacagtacattctaccacaagtatatactagcagtatgtgaaaaggtagatttggtatttgttaaaactatgaaaagggctgtttagtaatttgaaattgagatttatttcttgcgat

SEQ ID NO: 38257 - DNA, 1501 bp, Oryza sativa
acaaaggcactgtttagttcccacacaaaaaaaattacaccctacacatcgaacgtttaaacacatgtacgaagtattaaatataggctaaaaaaataactaattgcacagattgcgattaatttgcgagatgaatcttttaagtctaattgatacatgatttgacaatgtggtgttacagtaaacatttgctaatgacgaattaattaggtttaataaattcgtctcgcggtttactgacggattctataattagttttttattagtgtccgaacaccctatacgacaccctatataatacccgatgtgacacgtaaaaaatttactcccctgatctaagcaccccctttgtggactcatgcaagatggactgcagtcagtgcaaaacctgcaaaatctacactgaaaataaaatgtgctatgtgctcaagtgcactcaaatgggtactactactacttgtttgtcaggtactgtcattttgaggccctctttgtttaggcttataagccgacttataagtcgaaaagtttaagccaaaacaaataagcggcttttttgtttggcttttctgaagtcataagccactctaacactattaagccaaaagctaagttagaaaagcttttttggcttatattaggtagatgcatgactccaccattaaacttaggacattaaatccaccggcttataaatcatataagccaataagttgacttaaaagtctaagccaataagtctaagcctaaacaaagaaggcctcaagcgaaggggtacacctcgatgaatgccaattttcagagaatagatgcatgacttctttcagctaaatgaatggcacaatggaattcctttgattataggagcggcactgctttgctaattttctgaaagaactgaaaacaatgagtgagagatacatgaatagtccgctgcatgatatcaatatgcaccgccaacatgttcataataggcataaagcaatgcaatggcaagaagattgagacagtgatatgaatgttatgagtcttatgactagggatgatgggaagatgtgaaagtgtttgcgttgaggaccaaggaaatgatgctaattaacaatgtaaaataccagcaagattcagatgtgaacgtgtttgctttgagtagtgagtatgttggtgagttcgtcttatttaaaaatatacgtaattattattcatttatagtgatttgatttatcattagatgttcttaaagtataacttaaatttttatatttacataaaaaatttgaataataagatgaatagtaaacgtttaaaaaaattgacagcatcgtcagggccggccctggccctatgtagccgaggcgaccgctggggcccatgatggtggggggcccataatgggtgtgggggggtgcaacacctaatttattagtagtatagtacctcatccaatgttgagatcaatgatttttattcggaattaaaagtgttgcaagtgagtttgccaga

SEQ ID NO: 38258 - DNA, 429 bp, Oryza sativa
tgcaaacacgcacgcacgcacgcaggaacaatggggaacgtagatgttcaatcgcaactgctggattggcgcggtcatagtagcaactgtaacttttggaagtaaccatgatccttaccacacaccacaacgcacgatcgatatttgtattcatcctgacttgttgctagttagcatgccactgccactgctaatgcctaatagcagcagaactgcagatctggacagtgttacatgccatcgcactgcgccgtaactccttgcttggtttgaaatgttttgttgtcatttactctgaatttgctgtcatttaatggagtacttaactgttggcctaatttttatggattgtttaaatgctcaatctgaattgttttcttcggtcgcaatggttggcattggctgactgttctatgtttctgcatcagt

SEQ ID NO: 38259 - DNA, 1501 bp, Oryza sativa
gatttgattcgcgagcgttgggaaagcaagtgtacgtactacgcgtatatatatgcatgggaggtcagccatggcgagttgacctgctagctcgccgaatcgatcggatttttgcttgggatgtttcacttcgagagatttcgcgcgggaaaaaagttaaccgtgtgtgtgtgctgtgatatttctggccggtacgtgagcaacgtaaagctgaggcggcggggtcaaacctctcaggagggtcaaaccattgttaatactgcatagtctcttgaggcattatttgtataatgggattgggaaatgatttcccacccatcaaaaggtatctttaaattctaaccattcattctccatcttccatttagtcctaaccctttattcatttcccaattctaattccactctccatttcccattatccaaacacactctgagtgtctagaaattaattagttcaacccgattcaagtaacttcaattattcggattaataatttaaataaatactaagcatattctgtgagtttttaaatttgttttttcagtaggaaaatcattttaataaaattttcttcaaagtggttcatgttgatttcggagcaccttgttgttttttttttgccaataacaaaaaattgaatgtacatatttaacatattttttgcctgctaaacacactcacagagtacgttttttttaggtatgatcacctagctagtgcagcatcatccaagaccgtagagagttttgccttgtccagtgatgtgacaaaagactacagtagtagccactaacatgggcggcaatacctaaccacacaccaaaaggcatattcgtttcatttaggcggagaatgtctgaataattccattcatacaaaaaaaatgattaaaaaaacaagcgtccaacgaattaaaaagcatgaaaacgtgcggcaaaactgaataaaagcatccgatctgaagtagtcaatccctcccatgttgcaccgcttgttggtattgaccggaccgacagaccggctccagtgatttcaggttgtaatataaatgtcacctccggtttcattttaattaacgttttaaacaatgatacgatttacaaaatatatctttaaccttatttttctattataatatacacaataaataagtgcatgtttacttttattatagtgctttgaaagacaaatctatgttgttctagtttctttaaactaaatatttttaaagttattaatgctcaaagttataaaagtttgaccttaaccttgtctaaagcgtcaattattatagaaccggagggagtacattgtattatccttgacttaatgaatttcactgcatcagtatttatcacaagtaaaccatttactccttttcatcaaaaggaagtggcattttctaatatgtgcagtcaacaaattttaattttacttactaatatgtacttcctccgtttcgaaatatgtttatttttcaatcatcacacacatact

SEQ ID NO: 38260 - DNA, 549 bp, Oryza sativa
tatcatatttcaagtttttggtcaaatcttggatgtttacaatcctatgtttataatataatattttgataattttatccaaattttggatatttttgtcataggggtattttggtcatttcaacaaatttgtacagtactaaaggtggttaaccggacggcgatggtaaatcgtagaagttaagcaaaagtcgatggcatattgtagaacgtgacaaagtcagtggcaaatcgtagacgtgcgataaagttaatggcatataatggattatctcgaaagaaaaagaagaagagttacaaaatgcaaaagaactattgtacccctggcaaaaataacctacctagtcccaactcccaaccccacctagctagcccaacacacagcgtccgtcggccgttcccatcccaatcccgtgcactgtggcggatccagaaaatcgattcgttggtgtcataacgtgtctaacggtgtcatagtatactaattatgcttagatcatgatgttataacatatgaataagcagttttgctatacctttttaccgaga

SEQ ID NO: 38261 - DNA, 670 bp, Oryza sativa
aagctgaaaaggagagagctactgtacgatttgatgcacatttctaatctagtgctctttttcatacactgtctttgtatatttgccgtttttagattacacatccttacttcaaatacaaaacaatatgaaatttcaaactgtaaaaaggaaggggaaaaagaaagggacaattacattcttacccctattttggattgtaattgtgattttaccccttctttttagggtttgtgattttgcccttacttttttcaaacgaagtttcaatttgcccttactctgttaagaccaactaacagtgtcaaatgagctgcaagaagacatatatacccttcacattttctctcaaatttgaccaaacttgacaaattttgatagagtttggatatcacttttacagaagttgcacagggcgcaaaaaattcaccaaggattcatcgcattcacaggaaaaaaaatatttaccaaacaaaattctcccaaatatatactctcaactatgagatggggaaaaaaaaagaaaatcaggaggcagcatcccttgcattggcctcgtggatgagcttgcttgtcgtgtgtccttgttgctgctcctactctgaacgatgttcgcagcaagctacagcgttgctgagccaagctaagccaccccttcccctgctacagc

SEQ ID NO: 38262 - DNA, 330 bp, Oryza sativa
aagaaaggatggaagtttgggctattttctggcgttgttcggcccccaactgtttcatttctagatcgagaaatagaatgaaaaaccatcgaatacccactgcaacatttcaaatataactaatcaaacatcatagtacatgcactgaaacatcaaaaaattcaagatgaaaacctagatctacctcttcctccactccagtggttagcaaccacttccgcgtcgatgtcgtgacgagctccaccgcatccacgtatccaccatcatcgatgctgcatgaatgtgacgccccacactttccgaggccgggccctctctacatctggtagc

SEQ ID NO: 38263 - DNA, 1501 bp, Oryza sativa
tgccatctacaccaactgtcttcgtcaactcttcattcatttgatcttgatgacgggtcaggaggtgcccagccatgtttaatccggctgtcgtctacaccgactgtcttcgtcaactcttcattactttgatctcatctagtcaagaggtgcccagctatgtttattcggctgttgtgtacaccaactgacttcaccaattcatcttacctttaaacaccattccgatgctgttgctatgacgtcgagccgtccaagctatgcgattccatgcatgtcttcttcaagcaatctacaccgacacgtcgctcaagagtgatgaggcggagcgacgagggcgggcggagtctatatgaaggctacgccaccaacaccagcgcacggaccgacgaggccgtggatcgctaccggcgccctcacatatatacacacacatctacaccatcatcacaaccatgcatggaaaacgtgaagcgaagacgatgagacgaccacaagcagcttaatcggaggtgctctgcaggcctagacctgcggaggtaattaactgggagtctttcgagaccataggaaccagaagaccacatcgctgatgtcaagatctgtccaacgacaggcaatggcacgcgtattttatatcatacatggaaactgtatcttgttaattcggttaataaagatcatgtgtttctgtgtctcttttatgtttgttttacattgtgtatctaggtacactggcacgcccgcatttattttctctctaaacatagagggatacattttcgtaattttctatcctaaacaactgtatgtgatttttttaacaaagataaaggtttttttaagtactaccacgataatctccaaagcaccatattattggatatattttgataaatatctatagttttgtgtccggtgattttcaacgctttattgaagtatactttatagtcacgtcaatagagtgtataacatacattcatcaaattatgcctgatatgttggaattcctcaactataagaaaatatatcatgaatagtgtattgcacaacttactcggtagttcatttgttttgaaaactatttgacaaagagaaaaacatacatttatgatcataagtctcacgatggactaaggggttgtattatagcaatatcattggcttgaaatatttttcatatttttttattctatgtaacatttatgtggcccacttatcatatactaatgaaatagttataaaaattcaaaaaatgtttgagaatcttaatcttaaacaaattaaaattaaatcatatatacttaaagatacacaactaaattgtggtgttttcatttattatgttgatttaaattagcattgtatagtcgtcaagtgatatttgacacttgaaatatgatggggaattatataaaataggaaaaggacgaattaccctaactattacagtagaccgaattaccccataaacccgaaaaccagatatgtttcaccc

SEQ ID NO: 38264 - DNA, 1501 bp, Oryza sativa
  unsure (1)..(1501): unsure at all n locations
agttcactttgacttccttaaaagtgatctgaatctaatccgtgactctcaaccgtaaaaccggatagcatgactccctgaattattcaaactagtgcaatttgactcccttagcggttttggatgtcggttttgctgacgtggcggtgttgacctggtcttcatcccacgtggagcttatgtggcattacaattaaaaatattttgtgggacccgtctgtcatttacacacaaaatatattgtgggacccacatgtcatcctttctctctccaacccttcctcctccccctctctctcccttctctctcttttctcctgcagccgcacccgctgaacatgccggtgcagttgaacccgtgcgccacctcgccggtgctggacaccgcgatgagcccgatgaacctcgtctagccgttccttgacgcagtagtcgatggcctcatgcagcccgacgcccctgtactccataacggcggcggcgtcgcgcgccagcgtggagcatatgatggccttgccttctcccaacccgatcaacggcgagtcgccgatgcgcccggtcatcttgttcatcaatccgctcgtggacatggccgccgcggtatggccgtttgagtgcaccactgtgcaacccactgtctccggcgcggcatacggcagtcaaacttcttgtaccaattaatcaaaaggatgtcacggttagatgttagcaattttcataggcgaattggtaacatgagtcaatgcgctgatcgacgaaccaagatgctgttggcctccttggcgagcttcagcatgccgacgttgtcctcggtgatgaagtagctattgtccacgacctcaagaccttgcaaacagtgaccagaaagaaaaaaatcagaccagtccatgacctcaagatctgcaggactcgggtggaccacgctggtaggacggattcgtcctacagctgctggtcctgccaaaattcgactggattccatggcggccgcgcattgctaccccacaccggcgctgcacttgcatctgctaggcaacgctgtgcacatgcatgttctccgagcagaaagaaacagaggcggcaccccctgccggtgcagaccgggaggcacggctggggccggcagcgtctcaggcctcgccgtctgcattagccctctcgttcgtcctagcctggcgcggcaccatcgtgggggaggccaccggccggacgcccccgccttctccggcaagctgtggccgtcgccactccaccggctctcctttggctctctgccgtcgccgccgctcaacccgctcaagttcctttctccgcgccggccctcaccctgccgccgncgttggcgctccagattccgcaccgaatctggtggaagagaaacatacagaggagggagagagagaggggggggggaaggaggatagatagaggatgacatgttggcgtcgcaattttttttcatgtgaatgacgaatggagtccatataattttttattttaa

SEQ ID NO: 38265 - DNA, 708 bp, Oryza sativa
cagtagttcatcatctgtactagtgtacgacgtcgccaagacgtcgggtgtccttactttgctggtcgcaacctatgcattgcgacaccatcaacatctactcaacctatgcaataccggagtgccactgctaggtgcccgcacgctgtcgtcaagtccaccggcccatgatgccttcacttcatcacgccggagcgccatggtttggtgcccgcacgccgtcttgctggagcgtgccacggatagtcggagcacccgcggatcgacgtcgccgagctgctctcgactatagcacttgagagctcgttataattatcaagcagccgagcactgccatgcagtgctcgttcatgccgatagaacactatcacgccgcccgccggagcatatcgtcatcatctcgtcaagtcgaagtcgtcatgacgtccatctgtgattctttctcttcatcaagccgaggttgtcgtgccgctcgccgctcgccgctcgtccgcgacgctttcacttcatcatgctggggtcgttcatgacgtcatgtgaccatcccgccggagcaccactgcttggtgcccgtaaaccatcgtcatgccggagtcgtcgtgccgtccggccatgaagacttccctccaccgggccaagatgatgagacgttgtttgtccgtgatgttctctcttctgtcacattgacattagcgccgttcgtccagg

SEQ ID NO: 38266 - DNA, 686 bp, Oryza sativa
gacgagggagcttaaataggggaggggagtcccggacgtggccggtaggagcgggattccgccggccaacgtggggagtgggggaggagagagaggcgggattccaatcccgcccatctcgggcgcgggcgcgagcgcgagagagggggaagtgggtgcgggggacgcggtgcatgcgcgggcgtggccgacgtgacccgggagaggcggaggcgtgggcgcggcggcggttgcgggcgcggctgcgccggctggaggaaggggacgggcctgacaggtggggcgtcccggggagagagggaagggcggcttgggccggcccacaaggaggagggcgcgcgcggcggccgggtggactgggccgacggcccaagaagaggaaaaggagggaaaagaaaaagaaaaggaggaaaagattttccctgggatttaaaatattgcatgctcaattttaattggttaaaattatttctagggctctgaaaattgcactaaaaatcttgttagtgaatttcgacatgtagaactcaagaaaaattccacatgccagattcgattattatttgcattgattccttagggttttctcttgatttgcaccggtattttcttagggtcatttattaattcgattttaggcttaggaggagaacttcagggtgtgacaataacatagatctgacaga

SEQ ID NO: 38267 - DNA, 236 bp, Oryza sativa
gggcgaattcgagctcggtacccgacagaggataaaagatacagccgatagaggtaatgcaatcgattccgatgaagatggtttcaaggccgtttctagaattgttcaaagtgctttacagggattgccatgatggagataaagctctcggtttaggcagttgtatctattaattaggatattttatgtaatttccttagagatatgtttgggcaaaagacttatgatatcttaga

SEQ ID NO: 38268 - DNA, 1501 bp, Oryza sativa
aataaactaattacagaatatgttagtaaactgcgagacaaatttattaagcctaattaatacattattagcaaatatttactgtagcaccaaattgtaaaatcatgaagcatttaatcgtaaaagattcgtctcacaaattagtcacaatctgtgtaattagttattattcaccctatatttaatacttcatacaggtgttcaaacgttcgatgtgactgtgtgtaaaatttttatgtgggaactaaacagggcctaaaacacattagccaaccatttctaacatcaaaacaatctcttttttagtttaacaatacctcctaacaattatctttcgagtccatgtagaagtaaaaaaaatataaaatgtaaattcagaatttaaaaaaataataaatattataagaggagtagatttatgctcccattttactatcttttaaaaataaaatatgaaattatatgacaataccctctatataatacaattcaaagcagtgcaccgttcccggatcataatcacccccttataaacaaggtaaggactccccagcgacccccgtgggcttatctccgccacttcacagtctggtgctctactatgaaccatacaatacagaaagtaaagccgttgcccacgctggcttgtggttggcacggtaaatgttttacaaccgaaaatcgtgaaccggtccttaattgtcatgagcacgaccatcaaaaccatgtgctcacaacccaccattatcaagttttagttgacaaattaattaattaaccattcatgattaaccttcatgagctatcattaagccatcattatataatagtgaggcataagttatcccaatagtgtgctaatgtttctaagcatggctaagcaattatgcctaatatctagttgaaccattatataaagctcaactagtcaagttataataacccaaggtatcaaggaataaagtaatcaagaacaaaagggccataacaaataataggttaattccacccaattacattcgaaaataaatgcagactttgaatagaaacaatagctttaaacgggatcaacatgctcaaagggttgtttgggatctgtgtgacttgccttgctggcctcggaaatcctcaaagtcttctcctgcaaattcggactctccgggaacgtcggaatctaaagagaaaagaacaaaatcaccaaacagtacataaacaagcatgaacagtacttgaaccaactaaatccgagctaagatgaattagttatgaattttcaaagattaaatcggattaaatcatttatatggattttaattgaattacgacgcaataatgaattatttttgaaaagaaaaagggatttattgcgtcagtaggtcgggtttacggtggaccgggtgcacggcgacggttcacggaaacggacggccgagatctatccatccaaaacggacggctgagatcggccggtccacgaccggaccacggcggatggcaacga

SEQ ID NO: 38269 - DNA, 216 bp, Oryza sativa
tgacatatcatttatctttgagccgatgtcatatatgtatcgatcggcaaccatgagtaaataagaaggaactaaatctactcgatcggctgtagatattaacaatatatactccttgtatcgatatatacttaaatcaagtgattgggatagatcggtcgccatgccgagacagtataaatcacttaaaaagatgcatcatccgcttgcctcagg

SEQ ID NO: 38270 - DNA, 435 bp, Oryza sativa
ttgagatgacctccattatctcaatcgggcgcgaataatgagcccgtcaccgatgagtgtcatcggtgatgggctccaagaaggcccgattgagatagttttaatgcccatcaccgatgactcttataggtgtcgggcttctatttgtgtccgttagagattaatgtgcgcccgttagagatgacatttttttggcccgattgagatatactttgcacactatatatactccagcagtccgttgtctgtagtttatcccactgttcactattttggtgggaggttgaagggggcgaatttttgtaatttttttgcaaacaaaaacaggaaaatcataaaagtaagtaaaaggatactaaacatttcctattaatttagtagtacttatgttatgagatgttaactaatattttgttcattgttcaacgatggatc

SEQ ID NO: 38271 - DNA, 173 bp, Oryza sativa
ctgtagtccacgtgtagccagcgcggggagaagtttggccagccagttagtcaggtgttggagtgtatttttgatccaaaattgccaaaatttaacttgaagagtgggataaggaggctgcctggacatgcagaacccgtagtccacgtgcctgtcgtattccttcgctgcca

SEQ ID NO: 38272 - DNA, 411 bp, Oryza sativa
tgcgcgggcaataactggaagatgttgtaggcgatgagcagcagcgcgcccacgatgcccaccatcatcagcgccgggccccagcgcgactcgcgcgccgagaaaccgatcagcatcagcgcacagctcgcggtgagcatgagcatggtggtgtgcagcaaggtcatggcgcaggagggaaagtgaagacgagaccattgtcgcgcgcacacccgaccgatggcgcaggcgggcgcgcacgcgccggcaaatcttgatgcacatcaatcgagccgacccacaggcggacgattcacgccggcgccatatccacagcgggaatatccatatcgcgacgccgctgaacgactcccccacaatggacgcctctcccgctttgccggattcccaccctctaccctggagacacca

SEQ ID NO: 38273 - DNA, 1501 bp, Oryza sativa
aaagagaaacaactgattctctactttgtttactcctaattaattattttggtgggaccaaagcatgcgaccatcatatattagggaggagagatgaaaatttaatctagtgagaattagcatccgtgaaaaattcatcaggccctggtaatcaaacagatacaggaaaattctgaaactaactactgagggcaatattcatgaatatgaaccctgtaaatagtttagaacagttagtgattttcaccttttttgatgcaaatgtgatattcacttaaaaagttttcgatggtacaatttttttttgaatgatggaagcacgcacccaggctcctgcattaaatccacaacgtcggttttctttccaagaattaattatgcggtgattttttaggagagaaacaactgattctatgcatttgattgctcctaattattattttggtgggaccaaagcaagcaaccatcgtcatatattagggtgaagagatgagaatttaatctgatggtaaaaactgatgggtctacctagttaaagtgaaaatcgatgattagatgtttatctaatttattagagtgccacttgatggcttggagtatttttaggagtgccatgtgtcaacttaggagtgtttttagctaggatgtttcatgaacttttagtatataatataatagatagataaactccctccatccgataatataagggatttgactttttgcttgcactatttgactattcgtcttattcaaaaaattttggaattattatttattttatttgtgacttactttattatccaaagtactttaaacatatttttttattttttatatttgtataaattttttaataagacaagtagttaaacattacaagtaaaaagtcgaaaatcccttatattatgcggacggagagagtacgtctgtacccgcccttgacgctaggcaattttctgacaaaaaccggcagcttggaagaaaagaatactcgtaggtcgctagtcagctagtcgcggagaaattttttatttttccacagatgagattaatttccaccagcgagcgagcacgtacgacatggaaattaatcagctcgcgattaaatttcggatactcgtgacacgctttacaaactattaaacggtacgtttcgtgtgaatactttgtatatcaaagttaatctaaaataccagattaatccatttttcaagtttgtaacaattaaaactcaattaatcacacgttattaccacctcgtattgcgtgaaacacttaatcgtttatcttcatgagattcaaacaccaccaattttatccactagacagactgtacgcacaggctcccgcagcgcagcttcgtctgatggtgggttaaaaagccatggactgtgttagtgagtacggtttcatgttctctaaaactggtcgatcgattcgatcaccggagatagctacaccatgagcctcctcactgccatgttcttgtcccttgcca

SEQ ID NO: 38274 - DNA, 158 bp, Oryza sativa
aggaactatctacctctgtaatgacattttattcgcttattaattagagtaataattgtactctattatcaatttgttattgtgtgcctcggctgattcctgatgagggttcacacacatgtaagcgtttggaattttagatagaaattccgggcgtg

SEQ ID NO: 38275 - DNA, 1215 bp, Oryza sativa
atgaaatgggttttataattaatgtatgtttaatactccaaattagtgtccaaatatccgatgtgacaggtacttggaataagtcctggaaaccaaacagccccctaattatcacccgtgggtgaacgggggcgagccgaccgcacccttcatctcccaccaatcgctattattgcctgtgagtgaggcacgctgtgcgggccccagtggtgcgggtcatcaaagaggccagggacgaggcccgggttcatctcttctagtaggatggggccgggtggactcgcagggggagcagggtggacccgcacctgtctcgcccccttgccatacctagttcttgcagctcatcgattgtgcgttttgatttgagctcagctgatgctgatggcagctaaggatcgattagacgtgtcatagtgactgctttgacactgcaggatcagcaaccagtggcgaatccatgatttacatcaagatggggctaaagcaaactagatatatcagcacgatcagcatttctctatgaaacccaaatacactacgataaacaaagagataatccatgaaatgctattgacaaacatctaagtcccagaaataccatcgacaagtgtgagttctaagacatgccatcgtacaaatgtttttgtcccaaaaatgccatcgccgttaggattccgtcatatagaatttaacggcgcgaaatggacggaaccctaacggcgatggcatttttgtgacaaaaaagtttgcacgatggcatttcttggaactcacacttatcgatggcatttccgggacttagacgcttgtcaatagcatttcatggattatctcataaacacaagacgttgtcttcttcatcgtaatttgcactgtattaacatctatccaaaaaatttatgaataaaatgatatggtatactccttccgttccataaaaactaacgtaatactggatgtgacacattctagtacagtactacaaatttgaacattcattgtactagaatatgtcacatctagcccgagcactacttaaaaaaggcaaatagatgtcgccactataggtgccggcacacaaaacaccgacacctttatgtccaaatatgtgccggtttttaaataaaaccgacaactaaaacctatgtcagagaaatgtgccggttctagacccaaaaccggcacctttaatcttctccctcccccactagc

SEQ ID NO: 38276 - DNA, 1157 bp, Oryza sativa
cataagaatagaccatatacacttgtgatttttgggttttttcaataagaacagaccatctacacttgttcattttattttggggggggggagtggcagtatgggatcattttatatggctgttgttttttttttttgcataaggacaaaccctctagacttgttcttatatggttctttgcaaaatttttgggatatttttggtccaatgggatggatgaattgatgtgggttgtgatggttgaattattatggctgtttcttttttgcataaggacagaccctctacacttgttcttaatttcttttgggggtgggggcagttgcaaatgatgataattgaagcataatttctgagcaaaactgaggccaaacttattatatgtcatgacttgtgttttttaggtacaaaaataatatatatgtgacttgtgtagtatgggctgttttgggttattttgagggaaatgggatggatatgcatagaaatctgttattaaatgaagttactgaaattatggcatttaggagaatacgaagtgtcctggttgccaaatctggtttggtcaggttactgcctgcacgataccgaccaagacaaattggtaaacagaacatttcgttcaaatacaacatttctaaaaatcttttatcgttaccaacatcctagattgctttcaaggtcatttctttatggaccccattcccataaattcagtatccaaagatggttgctgtatctatgggaataagggttccataacgaaatgatcttggacgcaatctaggagtttgctgatgataacgttagggatcttggataggaagggttttggttgcctgtgtgttctatctgcatccacctcgtcagcagatatgtagcatccatattcctcagcagacgggatctcgacctcgacattcatatcccactagaacttgctaccgttgccactttcttatgttagtgacattggtagcaagttcgagtgggacactgatgttgaggccgagttcccggctgctccggctctattgagcatggatgctatggttccgtcgacgaggcgaatgcaggtaggagatagaggtatatcaaaccataagagaatgtgtttaaaaagtactttctccccgtacaacagtgacataggaca

SEQ ID NO: 38277 - DNA, 1501 bp, Oryza sativa
tataattttgatgtaccttggatctaaaaccttgtaactgctcgattttgataaactacgtctaaccccgtaattcgatacgagaaatagcacaattaacaattataagaacatcaaaggtgttatactcagatgtaccattgtatctttatgcttctcttctgttgtacaccataatttgcaaagtaaactagtccttgtttttcagggctgactccatgatgactaattgacatgagagtagattcgatagctgccctgtgcttctttaatttgttgaatgttgttacaaacttacaattttccaaatgatcattattatgatgactgattgtcaatattttcattttttgtattcggtaacttggtattcttgctcagtgtgaattgtcagtacataaagtaaaccgtgaactactattgctgaggtaaccttgttaaatgagaaatacctgcatattgaggccattccatgagcaaaattgaattcctgcagaggtctgccgtcgtcttcctaaataaaaaaataaaaaaaaggaccattccatgaggatagtgtatgcatgccattgatattgtagcaatgatcatacttagtttactcggttgggaataatggagcactgcaatggatttctgcatcatcttgtaccttaagttgtgaatgctctagtagttaacttggtggcatcaaagaaagaacgcttgagcaatgcaagctagcaagttgcaaaatatgtcatccaagttattattcatagcctgatggatgtaattttattttatgaaactgttggttagatagatgccacgagaagaggaaattcaagtaattttgaatggatagtagtattataattgtagcaaagttttaacattatttttatgcactcaataatgtatcataatgtctccttagtttttgtacatttgttttatttttgtgataatttatttttatgatatttttattctctttttttattttacttgtctcaaatattttgaaatatatatatatattctttcaaacttttagcttactatcggtgtctgtatcatattattattattttttcataatttaggttgaaagttttaaaaattgagttgagggaaagagagtatagacatcaactcatcgatgaacaaaattttttgtttgaatttgactttgagtacaaaattctcgagacaaaaaaaaagcatgagagagagaaaacagacgcgagaaaaagaaaagggaaggcgggcaggcatgggtcgacgtgggctcaccgtgcgccggcaacatctagcgcacaaagcggcggtgaatgcctgtcaaaatgcccaagtatccaatgtgctctactaggcctattcaaggtggcagcaatggtgtgcccttgacgagtccgagcggcggcggcttctctgaggagctcacgctggcgtgacgtcctcccactcccagcccgttcaagtagccttaggggcccaacgcaggatgaatccaaat

SEQ ID NO: 38278 - DNA, 835 bp, Oryza sativa
aatgagataaaatactactttctccatttcacaatgtaagtcattctagcatttcccacatttatattgatgttaatggatctagatagatatatatgtcagattcattaacatcattatgaatgtgggaaatgctaaaatgacttacattgtgaaacggaggaaatattaagataaatataatcttatattttggcccatttcaccacatcatatggctagaccatacaccatgataactcatacaaatgctattaagtgatttttttcatgagtttaggagcctaagcctaattggcttccttagttgatgctaatttgttgcgtattttacttgttatgttatctgcacatgcacatattatccgataatttgatatgtttctagaccaagttcgctcatgccgtacctaacacctgatttttctaatcaaatatacaatgataataatccgtttaaatccgatcagtttgcattcctactctttatccttgagcgagtgcgatgcgcatgtacatctttatatgattggaaaagaaaaatatatgcaacgtatttcttctttggtacttgaagaggtaccgaacaccatagtacaacagacacccactgcattgcggacattataagccaaaatttaaattttcaacctaaaatttagtgttgattttgaggtttttttttctcgtaatttattttttaatctttgcttttaaatcgctaacaacacgtatataaaaatttcattcacaaattatttttcgttcacaaatatacatgcaaacgatagcaccatctcggataaggatggtgcccagttgactgtcatgtagc

SEQ ID NO: 38279 - DNA, 379 bp, Oryza sativa
taagagctgtacaagctagggcaagtcgtgagtactatggtatatctatgggctagctagaacaaaataatatatggtaagtgttgatgggttataccgtgatcataggatatgtacttacatgatatatttttaggtcatatggattggctcgtctgaggatgcaaacgaagttgtaaagagagtaaggaatacatggatttctatacaggttcggccccctattacggacaatagccctacacctattggccggatctgttgttgccattatatatgtatatcaatctagtatggtgataggcggctagttgttgtcaacttctttgggtgtttacatggtgagatcggaggtgtcttgtattgttttgtctctagt

SEQ ID NO: 38280 - DNA, 1501 bp, Oryza sativa
gatgtaaagccataagaaaaaaaagcaatgcgcctctagcccactttctcaaccaatatcaacgacatccttttcaggaacaagaagcaacaaattaaccaagtgagaaataatcctaatcgtatcaaacaggtgagtgatgcaagcaacttccatctttttattgtttgatctcttaacatagccttccacttctctgtttttttatgcatataatttcgcttttttacctacaattttatactactccgtggtgatgttgttcatattctgatctgttgctactagcttctacaacaaagtgatatatcaaagctgaaagctcttgccccttggacaatatattcactaatatcatgtatttgggtgctgtcagttaatttttgagcacttagtcaaggcgccttgacactgcgtgctttgccaccagaaatttgttaattgattttttagataatcattttggaagggtaatgcatgccgcttttttttaaagaaatatagtaccaacacaactgctcatatacacacacgtacacttatccatagaaatcatattcgagagactgaaccaatgatatatatatatatatatatatatatatatatatatatatatatatatatatatatatatatcttcaaattaacaaagtcaccacaagcgtcttgctatcgatgagaatatcgcctactgcaagaataattagccgtaaatatgatgcccacgtcaagtctaggtcttgaacctatgtaggtaagttccaccatatgtaacttagcagccacgctcactaattgcagataatgtggaccgcctcttccctatcctttaactccttttttccatatattatttgagataacatgtagtatataaataataaatatactactataacttttaaattatatatacaatttttatattcgaccacaattatattctttacaattaaatcaatccatatttactatattttcatttataaataataataaatattattttgatccatgatttgaccctttgcgttatatctaacataaaaaaggaaaaacataggttatagtgtcataaattactaaaactagatctaagatgtttgaaaataaagtttactatattatattatttaccattaacttaatttatgatatatattaactatactttaatgtgtaaaataaaattatattttaggacttttttattctttttctggaatccaaacggacatgaaaattataaaaaatatgacaatatggagtatatatcactatatattctttatcggttataaaaatatgtaccactaaattagatttacaatatcaacaagaaacatgtcatgtcttttccctttacatggcatttgataattataacaaatcgtgaaaaaaaattaatgatatatgtaatatcatcacataaatatgcttactatgtagggtgcactatatttggcccatatcatttcacaaatgtgcatgactaaat

SEQ ID NO: 38281 - DNA, 1501 bp, Oryza sativa
gagtttcggttgtgaaacattaaccgtgccaaccacaagccagcgtgggcaacggctttaccttttgtatagcatggtttattgcggagcaccagactgagaagtggcggagataagcccacgggggtcgctagggagtccatgctttgtttataagggggtgattatgattcaggaaaggtgcgctgtggtggattgtgttgtgcgaggggtactgtcatagctcctttccgaggtaccgtggtggtattgaggcacatggtgacatgttgtggggctgtgtcttgtgggtacagtggtacacctctggccagagtaaaactattcgaatagccgtgcccgcggttatgggcgggtctaacaatgtctttcgtgattagtttcacacttctcaccataataaaagatgctataactggtaataatttgattagctccttgtttggaatattcctggtttggagatagaattgtgcagccgggatggttgttcagaatggttgggcctaggcaacagggtatgttgtatagcgttggattaatattgtttaattattatttaaatattttattaaattatgaaatgtttattaaatgctgtttatgcaaatgaaaccctactatgccatcctttgttatcctgtgcacttgcatatttgctgcgtggcttgctgagtatgtcatatactcaccttgcaatcattcatcagaggaagagttctacagtgatgctgatggtgtggaggattaggtgtagccctggtcaagctgcctgtggagtggagtcgtttgcgccgtttatcttatttttccgctgcttagatttttattgattgagaggaactatctacctctgtaatgatattttattcgcttattaattagagtaataattgtactatattatcaatttgttattgtgtgcctcggctgattcctggacgagggttcacacacatgtaagcgtttggaattttggatagaaattctgggcgcgacaagttggtatcagagccccttgaccctaggttatgccaaatggttacccatagaagccctctaaaaatattgggaaaatagaactgttctcctccctttctcttttaattaaaccaaactaatagcacatgcacttcataatctcttttagtggttctcattcaaaatttattccagtgttgttagtactgtacatatattactgtactaatggctcatttaccagcaaaagttttacaacattgttttatttaatcttgctgcaatgaaataaatttagcatgttgattttataactttcttttatttcttttggaacctgttgttcaaaagtgcaaaatttgtgatcttgtttccaactgtttcaacttatcttgcaagcttggtttactttatttacttaccttttactttgattttctaactttattcaaattaatctaaaaacttgtgctattaattagataaatgtcttaactccctcctttcacttatctttaga

SEQ ID NO: 38282 - DNA, 166 bp, Oryza sativa
gtgaaacgaggaggagagcgcgcccaaggcagggataaaaggataaaaggcggggactttgcatcattcctttgccgactgctcacccgcacacacgctccataagccctaacactctcgccactccacagtactccacacaccaagcccctcgtcgtttcaccgc

SEQ ID NO: 38283 - DNA, 1501 bp, Oryza sativa
ctaatgagtcaagttagagatagcttggtctcggaatatggtttctttgtttatttcatatgtaggtgactcgatgcctcgagagagtatttgcggtgatggaccgggagtcggcttggggataagacgacgtccgtggtggtcaaaaatcatacgggatactaaggctagagttgatgcacgtggttgatggagattccatatggcatacgatggaggtattgtgtgcgtatggaatgcggagtcgaatttggaaggagtccaaatttggtatgattggttatgtaaagtttgtttcttgtactagagggtttcctaaggtgtttaggacttctagtatgagtttggttcgtggctttaggctgcctacctcgggtataaatagagggggagcgtgaggcttcccggtatcgcttttgagagcaattgagttgagttttgagttagggtttcgagtttagtcgaaatttttgtaaggagtgttgttggtgcactttgtaaacacagagaaaatcaataaagtcgtcatccactttaagagtttttcgatttgtgtttcaccgggtttcggcagtctaaccagtgatataccggcggtcaaaccggcggtaagcggcggtcagaccggctgcatacgggcggtcagaccggcggcggcgacagcgagcaacagctgatctcggcggtcagaccggagatctaatctcggtcagaccgacggcaaccaggcggtcaaaccggcaggacaacttcggtcagaccgcgatccgtcgatttcgagggtaacttttatttccgctaaaagttttcagtttttgggtatacaaaccattcacccctctctggttggcttagttattgtgatttgatcctacacgcaagaggtctcttctacgacaaccagagtgaactcgcaatggacgacaaattcaaacctctcagagagtgggagaaagaacatatgcaatgacatgtacactacttatacatatcatgaaaaaattgtggcacttgtattatatctttcgtatgtaaattacgattgaatttatggttatgtattagatgtttgttacagtaataataacaacccgactatctcgtatgcttacaattccgaaatacaataataaatcctcaataatttaatattaattatcagacacatctcaccaaaaggatagaataaatattattttagctatttggaaattgaacttcgcatacagtctacttaagacggccgcatgcgaaaatagatcttcgcatgcggtcttgttaagtcgaccgcacgggaaaatagatcttcgcatgtggctgcttaaacgggccgcatgcgaagatatattttcgcatgcggccgtcttaagtgaccgcatgcggctgggccggccgcatgcgcaaatggcgatctttgcagaccatttcgcgcatgcgggccggccgaccgcatgcgaagatcgtgttcacccgtatgcgaaaacccattctgtagtagtgc

SEQ ID NO: 38284 - DNA, 379 bp, Oryza sativa
tgttgcataggcccaaccattctgaacaaccatcccggctgcacagttctatctccaaaccaggaatataccattccaaaccaggagctaatcaaattattaccagttatagcatcttttattatggtgagaagtgtgaaactaatcacgaaagacattgttagaccggcccataaccgcgggcacggctattcgaatagttttactctggccagaggtgtaccactgtatccacaagacacagccccacaacatgtcaccatgtgcctcaataccaccatggtacctcggaaaagagttgtgacagtacccctcgcacaatacaatccaccacagcacacctttcctggatcataatcacccccttataaacaaagca

SEQ ID NO: 38285 - DNA, 1390 bp, Oryza sativa
tgttgcataggcccaaccattctgaacaaccatcccggctgcacagttctatctccaaaccaggaatataccattccaaaccaggagctaatcaaattattaccagttatagcatcttttattatggtgagaagtgtgaaactaatcacgaaagacattgttagaccggcccataaccgcgggcacggctattcgaatagttttactctggccagaggtgtaccactgtatccacaagacacagccccacaacatgtcaccatgtgcctcaataccaccatggtacctcggaaaagagttgtgacagtacccctcgcacaatacaatccaccacagcacacctttcctggatcataatcacccccttataaacaaagcatggactccccagcgacccccgtgggcttatctccgccacttctcagtctggtgctccgcaatgaaccatgctatacaaaaggtaaagccgttgcccacgctggcttgtggttggcacggttaatgtttcacaaccgaaactcgtgaaccggtccttatttgtcatgagcacgactctcaaaatcatgtgctcacaacccacctttaccaagttttagttggcaaattaattaattaaccaatcatgattaaccatcatgagctatcattaagccatcattaaataatagagagtcataagttatcccaataatatgctaatgtttctaagcatggctaagcaatcatatctaatatctagctgaaccaatatataaagctcaactagtcaagttataataacccaaggtatcaaggaatatagtaatcaagaacaaaagggctataacaaacaatagattaattccacccaatgacattcgaaaataaatgcaatagttgaatataaacaatagctttaaacggaatcaacatgctcaaagggttgtttgggatctgtgtgacttgccttgctggccttggaactcttcaaattcttctcctgcaaaaacagactctccggaaacgttggaatatagacagaaaggagcaaaatcaccaaacagcacataaacaagcatgaacagtacatgtggatatttttaacatgtagatctcaattttagaaaaatttagagacttgaaccaactaaatccgagctaagatgaattagttatgaattttcaaagattaaatcggattaaaacacttatatggattttaattgaattatgacgcaataatgaattatttttgaaaaggaaaaaggggtttattgcgtcagcggctagggtttgcggtggaccgggtgcacggcggcggctcacagaaacgaacggccgagatctttccatccaaaacgaacggccgagatcgaccggtccatggccggaccacgacggacggcaacga

SEQ ID NO: 38286 - DNA, 1264 bp, Oryza sativa
cagctccacaactatagtgcattttgtgagagagctccacccaactccactcccagttttggtggagctgaaactgtttggttaagctccagctccaggaggggtggagctagagctggagatgtgccaaacaggccccaacactgggctcacaccaccgccaccctctcgttggtcagacgtgccctgtttgtggctatgccgaaacctttatgccaccacctttaccatgatcgatgttggagttcggctagccatctccggatctgtctatcttacaccttggcaccctcagaatcaatacctcaagagtagccacctgatcgagttggcaggagcacaactgccactagatcaaatggtcctctatctccacatccctccatccacatggatctggcatttgccaacatgaccaacatcagatcgggcaacccaaggtaccaagtaccataagccttctggagacatgggaggggaaggagagggcatcaccatagcgatcgccggtgaggacagagaaggaaaatggtgccatcgacaaattgcagaagaaaaagtcttagaaagagagaaaaaggcaacacggcggactgatcgaggcacggagccgtccagcgagacaacttgaaattctcactcaattagggcaaacaagaccactcgaatgtatatcttttagaaatgttacaaaaatgtattatttttttttaaaaaatatcttataaaataaatatcgtttaaagagcttacgggtttaaagcatccagttggcacgtctagtttctagtttaaaatgaaatgcggaagctaaccaaaacagtgtcgggttgtccgataccgggttggccagtccgatgttgattggattgtccgaactgagatcggactatttgacttgtagagtagtagcacaagcaaacaacaacaactagattagcacagaacaaagcaatccaacaagaaggtaaagagatggaggatatcatcgagttttacgtgaaaatgtattttccgaagttcaaatccttgaggggattctagcctccgttgaggagctcacaaagagctgggtcttttctaaccctatcctcttgaggttacacaaatgcactccttccgctaaggatatctagggatggcaatcttttcaaatccatgcccgacccagcgcccgactttttccgcccgaaccctacccgatagggttagcacgcaaaactccatgctcgtacccatgcctgacgggtacgggtatgcccca

SEQ ID NO: 38287 - DNA, 1501 bp, Oryza sativa
atctatgacgggctatagttaacgcccgtcacagataaccgtcatctgtgacgggcgctagttgtcgcccgatagagataggtcatctgtgacgggctatagtttgactggtcgtctgggtcaaagctagcggtgacgggcttaacttagggcccgattgagatatattcattcgtgacggccgtttgcccgattgagataactcttcacatcagtgacttctagcctgtgacggacgctgtgcccgattgagatggggcttaccgcccgattgagatcagtattttacactgatataatatttgcctccacccatgacgtacggatgtggacatgcgaggatatatgaagtactaacttcttgctgaaccacgtttgatcctgttatcaatttgcatacatttcattattttaactagacacagaacaggtaaattaaagagacattcaaccttgcatattgttcttccatttgcaaaatttgtgtagtagaaatgtaatttgcaaaacaatagtgttcccctttaattttgttgtctaggcaagtatactccggactaatatgaaatataaatggacatatgttcacatatttttcagagtgacagctttatgtttacaatttttttcagtgcatcacatgcataaagagattaaaattaatattttttcactgtgcatgcatgcaatttctgtatgaagaaaaatattaactctaattaacacctttcacttatgcattatgcaaatacaacaataatctttagaagatcaaattaacatcaataacaaagtgttgtactgtaatcatcttgtcttgtctaagatcaaaagaaacaaaactcacataaaagtggtgtactgtaaagaattctccttgatttaatgttgtcaccattgaccttatcacacatacgaatgtaaccaacttgtctacgataaccaaaatataatgtccctaaatggtgcaagtcgatttatttccttttgtttaaagaaaactttagaattttcaatatgcaagtggtcatagctaacttatggtcagatttaattatcatgggccataaaacagatgttaggaaatgttatctacaacaagggaagagatatgtcttcttaagcactaaagaggtcagatagagaaaaaaacaaaaataaacagattatcatggcgaagttcccaattgttatatgtaacctgtcaatatggtacttatcatgttctacatctttttttccttcctttttagatataacatatcaatacagcttattgtattttacctttcttcttcctttctaggttttgtggtagagagatatactcaggccaccctggtcaggtgtgcaatcagactcgacaagaacctaatgtctgaggctgtgattcttctagttgtgaagaagattggtgttgccctagggaatgaggcaatcaaccaagccacttcatattttcagaagtacgtcacacaactgacagagcttcaaggtagca

SEQ ID NO: 38288 - DNA, 1501 bp, Oryza sativa
aatatcgtgcagcgtgcaacatcggccaagaacaggagatcgatgtcagggacgatctggccggtatatcgcagatggcgagtgatgatttaataatagcaattaattaaagtcgccatcatatatatccgcggcaaattaattaggcgccattcataagcggcttcttcatttcccacgctttcagatgtgaaatcttaatatccgcctccccattgttgaagacgtaaagatgggccttgtcacctatcgccatcgacgggtaaactctcgacaggatgcaggtcttgcccccggcgccgaagctctcaaccaccgaacggtcaatctgaaacgaagtcacaaacaatgatgcatatataagactaatcatggtcacagtcaataaagcattggtaagttatatacgagaggcactaataaaaaacgtggttaattaagctcgtagtatatgtgtgtactataccaagcttctcaaggagatcttcccggacgagatgtcggtgtcgacgaacccggcaaaagttggcttgtagagatccgggctaagagaagacctgctcaataaaaaaaggacagtaattaatcaacttcagagctttggatttagcattttaagttgtctactgtgtttgggtaattgcgaaaatgtgacaggagacgtatttgatagtgctgtgataaagggtgtgtgattccaactctaagatcatgtatttcttctctcattttttttttgaaaacgtggcagacattgatcagtgcatgcaggatgggtatatgcatgtgtgctgcttgcattgtaccgagacatcacaaggtagtagtatagatttggctggtagtggtatcgtacttggtagggtcggtgcacatgaggacgacgggcttggcgccgtgcccggccggcttgaagacgcggaagaagacggcggttttctcctccaggccggcggaggccagcacccacagcccgaacaccacgccgcccctcacgtccgcgcccttcgcgccgcacagcctctccgcgtcgtcgccgaacgccgggtccaacgcctccgccttctccagcccggacacctccaagctcacctccacgtcagcctgatcgacacacaaatatcaaagcaaaacttgtaagcgtcagcgtcacacctagaaggcgaatatgcgatgcgttgcaggttcctctccggccaaccggatgcgtccacgccgttgaaggtgaaacgggcgggagcggaagctgacgccgaccgagcggaaaaatcgccggtccggcgacttcgcgatcttcgcgtgcacgagcaggaattgggcacgcgatgatcgctgcccatacggaattggaccggagcgagcttagctagtactccgtataactaggaagctcctgcacatggggcccttgacggcagcaatatatatggccaatattctagtctcattttcttgtggatggaaatttcaagttactggtttttgattttgtagtgtagca

SEQ ID NO: 38289 - DNA, 303 bp, Oryza sativa
tgctattgttattattcctttgttcaccctaggataaccaaaccccaactagtgtgtactctattcatggttccactagtatgaatttaggtagatgcttcgctgattaattaggcaacattaggtggttttataactttagactttgggaattctcatatcatttggacactatggaatggttggcttatgttggaattggacacacacctccccctctattcaaaatccccaaaaatggttttaggctgggctcggggtgcatggttttgatagtagcacctcggccatataaggaccggt

SEQ ID NO: 38290 - DNA, 1501 bp, Oryza sativa
atcaacttcagagctttggatttagcattttaagttgtctactgtgtttgggtaattgcgaaaatgtgacaggagacgtatttgatagtgctgtgataaagggtgtgtgattccaactctaagatcatgtatttcttctctcattttttttttgaaaacgtggcagacattgatcagtgcatgcaggatgggtatatgcatgtgtgctgcttgcattgtaccgagacatcacaaggtagtagtatagatttggctggtagtggtatcgtacttggtagggtcggtgcacatgaggacgacgggcttggcgccgtgcccggccggcttgaagacgcggaagaagacggcggttttctcctccaggccggcggaggccagcacccacagcccgaacaccacgccgcccctcacgtccgcgcccttcgcgccgcacagcctctccgcgtcgtcgccgaacgccgggtccaacgcctccgccttctccagcccggacacctccaagctcacctccacgtcagcctgatcgacacacaaatatcaaagcaaaacttgtaagcgtcagcgtcacacctagaaggcgaatatgcgatgcgttgcaggttcctctccggccaaccggatgcgtccacgccgttgaaggtgaaacgggcgggagcggaagctgacgccgaccgagcggaaaaatcgccggtccggcgacttcgcgatcttcgcgtgcacgagcaggaattgggcacgcgatgatcgctgcccatacggaattggaccggagcgagcttagctagtactccgtataactaggaagctcctgcacatggggcccttgacggcagcaatatatatggccaatattctagtctcattttcttgtggatggaaatttcaagttactggtttttgattttgtagtgtagcaacctggtaggttccgaggcccgtgacttggaaatgttccccgggcttcaccaccttgtcaaagacgctgaccgatttgcccctcagcgtctccagctcctcgattggccactgcagaagctgcttcccgctcgggtccagccatacctttcttgggatcgcctgccaacgacacaagccaagccatcaatctccaaatcaattctaattaaacctctagtccctccaatttttcttttacgtttggttagctcttgaaattaagataactaataacatcaaacatttgtggaggtaggtagtacaagaaattaggattgcaaaattgtaactatgatttacatggatgccggcccagcccttcgccttgtcgtaggtgacgctgtcggactcgttagcccacccaagcaggatgcggcggtgcttcaccgggtcgaagaaggtctttgatgcgtagaagttgccgtagtcatagcggagccggtggtagtcgccagcagggttgtccggcacataccgctccgtcaccttgttgtagatgcccaccgtgtagtagtcataacgggtgagatcgaggctgtcttga

SEQ ID NO: 38291 - DNA, 1501 bp, Oryza sativa
aattaatgacctcccaaaaaattcattattgacttatacgtgaagatgcgttgctcggacatccgtttctccaatgctacaatcatcaggaccatgtgttagggacatcattcatattctgcacgcgtagagcggattaattgtcgaagcacaaatatgcatttgtgacatttgtgacaactatgaattatcgccggtatttatgatcatacttaggtgcttcagtaaatcattgaggtcaaatttcatccacctaaccattacccaatgttacccaatgtaatgcacaggtattttattctgtcgtccacgcgtgagtcctgacacgatccatctctacgtgagtatgtgttcgattttggaaatgatatcacagtttgtcacacaagggttgagggagagaatgagcgtatttttttatccgtcgtgattatcattagcctaatgaataatttatctatcttgaaacattactatatacatgttaactctagactttatagcatttaactgtttttacctgtaacgaagcacgcgcatttttctagcataacaataatataattaaaatagccttcacatgttgcaacgcacgggcattttttttagttatatactaaatataaaaatattagatgattagggtttagtttcacatgatatgagctctttaagaaaatatattcctaatgaaataaaaaaaagttcaacttaagggaccacaagtgtacttattccatgcggagcatacaggcccatgaggcggccaatagtggggggataactttagggacataaagtgaacttattctgtgagaagattacacgcggcccaatagtgtgggtggcatgggaacgtgtggacccccgtttttataacaggaatcaattgtgtaaacagtaccatttccctggatcaagtagtctggtacacacgaactcatagctgaaatatcaagtgcacatacacgagagtctagtacgaattattacatcataagcccgcaggcacagtcttaaatcatcggaccgagcggtccggaatacatccaaaagaagaaatagataaggcagcggaattcaggcagcggcatgccattgccacaggcaacgaccgtactaagacctactgagcgccatcgtcttcatctccctcctggtagtaggcatagggatcctccgaggcttcatctcccgcttctgattaattttatatttgtaagggtgagtaccaaccgtactcagcaagccaccacagcaatgatgcacatgacagaggaattcaaaggatggctatggttcttttgcgcaaagcaagttttgtaattcttttcacaagcctaagacctagcatagactgatcaagttttaataccagtgttcatattaaacaatgacggttctgtccaccatccattgtgatcccaaggatagcttcccgccattgagtcgttatggttttctgaggacgtccacattcccgcctctcaggaagtggctc

SEQ ID NO: 38292 - DNA, 983 bp, Oryza sativa
gggttagaggagagaaaacgaatccgaattgagctcgaatccaacaatttccaagcgaaattagatgtcgattctataggagaaaagatagaggagatcaaggggatcatttcccctctaccaatttgaccggatcgggaaaggggcgatgtaatttggaagggggcggcggcggctggcgcgctagggcgtggctgcggcgtgaggaggaagacgacggccctgacaggtgggcccacctgtcggtgggagagaggagggagagcgggcggcgcggctcggcgggctagatgggccaggcgctagcaggccgcggagagagagggagtgaattgggccgactttcggcccaaagccaaaagaggattttaaaacctttttctttttaaattattcatgaaatgcaattccatttattaaaaatacgtccttggctcaaataaatcccagaaaaatctagtaactatcgaattaagagaagtatttaataaaattttatctagcccacttttatattggaatttattatttaaaattagatcttttcttctaggcttttaaaatcatttctaataattccatttaaacaacaattcataaatttaggattttcagggtgtgacaaagtagcaaatcttgcaaagtagaggcaatagagtttgccaatgtcgaaaataatgaaggtgaagtcgctccacatggtgacaaagttgcatagccgtgatgacgtgaacacaagttggcagcaacagaagaaaaccggtggcgaagatgtgtagtcgtgaagatagatactccggtcagctccagaaaaaaaaatagtcgatgtcaaacaaggcggccagcaatgaagacgatgacatccctcagtagtggttgcggtataaaccagccgtagaggcgagggcactagtcagcagcagacgagacgactggcgatgaagacgataaggccaatcaacactagcagaaccatgcagcca

SEQ ID NO: 38293 - DNA, 387 bp, Oryza sativa
atccgtacacttttacatcttaccaatgatgtattcatctatcctataccaatgatctaaattttctccactccctctccgcgtcgcaccttcccgttccccgttccctgttcccctctgcccgcgtccctctcccgtctcgctctcctctctctctgaggtttttccttgcatttaaaaagatagtgtctgcctctgtgccactaaaaagttcgagcctccctctctgtcatcgtcgaactttatcgtgtcctccacaccattccgtatgtttttggtcgtaacggtgggtaacggcgtagccaaattacttagttgcccttaggcttgagaggccatttggtccaatatgctctctcctagcactctcctctctctcccctcaga

SEQ ID NO: 38294 - DNA, 770 bp, Oryza sativa
aatcttttgagcctaattacgccatgatttgataatgtgatgctatagtaaacatttgccaatgacggattgattaagcttaataaattcgtctcgcagtttacaggcggaatttgtaatttgttttgttattagtctacatttaatacttcaaatgtgtatccgtatacttcaaataaattttagcacacgaactatcacacagcctgcgtttgtattgtgttttaaaagaaaacgatatgagaaagcaaaccacagcaagacaagagcccaagacatcttgagaaaagctaaaggaataagtctattttacgtccccatacctttgatcgaatcatctccttgaaacgcaaaaccggtataatacctcctccatctttgaaaatggactaggcacagttttcaaagataaaggaatcaagatagactttttttgagaataaatcaagatagactcaattgcaaaactaaaaggaaaagacgtaccctagcatatactgggccgcgttacgacaaggagcccaaaggccgaagcccatatgcccccagctgaacactacttatataaagcgaattgctccagcagccgtcccttgagctagggttttatcgccgccgccgccgcttctccactctcccctgcccccgtcgccgtcgccaccgccgccgccatggtatgtttcctgtgacacacactatctctctctgctctcctcatgttaggccgaatgatgcgttgcgatgaccatggtgctgcgtttgcggttgac

SEQ ID NO: 38295 - DNA, 175 bp, Oryza sativa
cgtacatatatcatttgacgcatcaagcactcatggtgggttaacatcacattccactgagtatacaatccttccatcatgcattggttgctatgatggtctcgtgagggcaataactttttttatgcgcatgcatttacttggactgaaaaaatcaattcttttgttagagcaa

SEQ ID NO: 38296 - DNA, 285 bp, Oryza sativa
aagattaggactactttgtttgagttatgagaagagtaaattgtgcatatattaattgcgccgggtaatgcgtatattgttttactctgcaatgggtttactgatactttcactagtgaactctatattaaagaaaaatcgtgtgaaatatgattaaaaattataaaacctttttgaatttataccattgtttcatgaggatttattcaaaatttatgaaatatcatgaaaatcctatatatttgataaagtaccctgatgttgagtgaaacttaactaaaacaa

SEQ ID NO: 38297 - DNA, 1501 bp, Oryza sativa
cggccctcgatgcgaaccaccgagccgtcgccaaacctaacagtgccggtgaccgccgtgtcgagctcggcgaaagcggagcgggacccggtcatatggttggttgcgctagtatccaggatccacatcgccggatcatgttcgccaccgtcgtctagctgcacgaagaccttggcctcgaccacggcgagttcgcccatcggctacggcgccctcggcgcgctcggtggcgagacgacgtttgtcggtgcagcgacgcgaggacgcggcggatccagctgcaccttggccaggagcagagcaggctcttcgtcctcctcctgggctacgtaagcttgctgggccttgggctcgctgcgatagtctttggcccaatgtcccctcttgccgcaattcttgcaatttcccgggttacggcctcccgggttggctggcttgggctgggcctccttcggggctccatcgtccttcttcccatgccctcgaccccggcggtcgccgttgctgccggaggagtgagcggcgtcttgcagagaggccgccttgcggaatttcgccagccattcttcctcggtgaagaggagacggccattggcgtcgacccgactcgatgccgccgcagtcttgcgctgcttgcgttgctcgacggagcgcagacgcccagtaacctcctcgagagacagctcattgacgtcgagcaaggtctcaatcgagatggctatttgctggagatgttctgggacaacctgcaacaatttctgaacgacctcagcttcagtgatattatcacctaaggtgcgaaggttgttggcgaggccgccgatccgcatcgagaagttgtcgacggtttcaccgtcctcgaagaggatatcaccgaattctcggcgcagctgctgtgcattcgcctcacgcacgcactgcacaccgatacggcgagtcttgatcgcttcccacgcctcctgcgccgtctccttgacagcgagcgtggcgagcatctcggcgggcacggcgcgaagtatcgcggcgagcgcctgccggtcctgccggtagtcgacgagatcatcgccctccggctccaccgcgccccacagaccttgggcctgcatgttcacccgcattaccagcgcccagtcttggtaatttgtgcgggtgagtgtcgggtagacgacgctgctcatggtcgcctcgcggacgacgcgttccaccacgacttggccgcggccgccatgacggccacggcgcggagacggcgagcgccagcgacgacgcggtggtgtgtgggagacgtgcggcgttggtagcgacatcaggaatcccggcgatcaccgaaggctctgataccaattgttagcggcaaaacgaaaaactgtagcttgtctggcaaaacagaaacagagcaacacagagtattttggcgctgcattaactggcagcttttctggattagagcttaaccttaaatagcaaattacaagaaagttaaacgtggccatagtggcct

SEQ ID NO: 38298 - DNA, 929 bp, Oryza sativa
gcacctggtgtaaattttttcttgtactacctttttacccttgatgccacttgtttttttggaatttgatactgcagaaccaggtagctgcttccgctgatgcatctttcttgcttgagcagcatgaaggactctagtgaaaacagaactagagccaccaccacctgaaacattcgcacctgctgcaggactgcaaaggtgctgcaaatgcaaaaacataaccaaaacaaattagtaagagatacgatcaaaaaaagactcaaagattaggaaaaaaaaatccatcaatggctgccgcgagcttcgacggcgccggcgttggggcgctcggcgtgcacgcggcacattggggcgctcctctccggcagcctgcagcctgacactgctataccgtaccaatgtcgggttggtgctgttcatcgtcgccatggccggcaccacattcactgcaaaataacagatgaatatggcaacaaaccttggaactggagttctccatgctagacctttcaacgttatctgcaacgcagccgccggcgaggctactaatctgagtttagatgggttaagaactctcaaaacgcaaagaacggttttagatcgataatgttctgctcgacgggataatcatcctgctttctcgctttggataagcaaactgaagagcgaaaaaaccaccctgaaatatatctggtcagctgtctccgaacaaaattctatctacaacaaactcaggaatcttgattcaattttcgaatctgctacagaacagaaacaatcttgttgaccccgagggaaaaaaatacgggtaaaagaaaacgggtaaaagtattcgattcaataaacccgttaatagtcattaccattatctgggcaaacgaattgaattggtggcggacagggagggagtagctactcccggtagtagt

SEQ ID NO: 38299 - DNA, 1501 bp, Oryza sativa
ccaaacaacacttttggtcaatatacacactccgttatcacccggtgcaacgcacgcgcacggacacttttgctagtcaatatacaatttctgacacatcaccaccctttttagcgagttcttagttattcgagcaggatacatcgtcacaattttcagcgagaaggtaagtttcatcaactttgtttgtatcgacctagttatgactctcgcttcggtccgacattctaatcaatttattacaaacaccgtcttcccatatatccgctttttctttgattgttttgctatcttagcttgacttatatatccattactttgtatagaatctatcggcttaattagatctacctattgctatcaatcttgtactgggttgaatctgatctattagattgtagttaattaagtaaaattttgttattaattgtgtatactcagtagttaaatatcctcttatcaacttcaattttatattatctccgttaagtccgatatagtaagattgcttttgataaagaaatgtgctatcatcggctaagcttatataacgtataaacaatcgaagtatctttctttactgatcaaaacatacaggatcaacctagttgactataaatttgatccaacactcgaaggcctgagagatttactcgactctagtgtatatcctaaattccagtatgctttgaacctgaaatttagaatctacactagagtcaaataaatctctcaggccttcgagtgttagatcaaatttagagtcaactaaggtatgctttgaacctgaaatttaggatctacactagagtcaagtaaatctctcaggcattcgagtgttggatcaaatttagagtcaacaagcttttcttccatccatatgagtgattctccttaacataccatttctatatttctgcacgctccagtagactctttatattcaacactcgatatcccaatacaactagtttcctctccatatttctatagaggccttgtttagttccaaaaattttttcctaaaaacatcacatcgaatctttggacacatatatgaagcattaaatatagataaaaagaaaaactaattgcacagtttgcatgtaaatcgcgagacgaatcttttgagcctaattagtccatgattagccataagtgctacaataacccacatatgctaatgacggattaattaggctcaaaagatccgtcttgcggttttcaggcgagttatgaaattagttttttcatttgtgtccaaaaaccccttccgacatccggtcaaacgtccgatgtgacactcaaaaattttcatttcaccaactaaaccaggccaaagttcctgaatctcgaggcgcgtgagtggggatgatgcacctaagctagtagctagagacaggacaatcgattcaagctgaactggagatcttgccctgcgatgtcaatagcgatggtgtgtgggaggaaggggcgtaggcgtgtctaaggtatgtgagga

SEQ ID NO: 38300 - DNA, 229 bp, Oryza sativa
ataaacttggcatgttaattaagagatacggagtacagtacgcgtgtagaattagaatcaatctctagctaggacctttatatgcaaacggactcaaaagagttttgtccgatttcctaaaccaattaaccaaagttagagatgaattaggctataatatacatatataaataaagcagcgggcaacgaaccactgtagaaccgtaatttggatgcgtttttgttaata

SEQ ID NO: 38301 - DNA, 1501 bp, Oryza sativa
atggcggccggaaaggctagtggcctgtagttcagtaacgttggtccaatgggctgcagcacggtatcctgcgacaggctggattttttttttacattttaatccttttaaaaaacttgtctaaaaaaattatctcaggaatgaaacttttttaggagccaatgatactagtcctgagggcttatttttttaaaaaaattacattttaaccctttttagatttctatttacaaatgggtactcgacaccagtgtcattggcaccggaccccttcacatcagtgacttggcttctacaggagggcgagggtgtcggtgccgaccaaatagaccaaataagtttttacaaataaacttgttttacaaatagtcctttggaaaaacttattttaggaatagactcttttccaatggtctatttgtaaaataagttctttaaaaaggattaaaatataaaaaattagctccgggagacaaccagtcttcttaaaattttacaaactactcccatctataagatattttgattttctttcataataaaagttttttaggtttgaccaagtttgtataaaatttagaaatatccacaacaccaaattagtttcattaaatacattgattatattttgatagtatgtttcttttgtgttgacaacgttgctacatttttctataaacttaataagtttgactagaaaaaaaagtcaaagcttcttataacatgaaacggaaaaaaatacatagccaaaagcccatgtaagtaaaaaaaagaataaaactcttgggaaaaggggaaaaaacatcattaatatatcctgatgtgcgtttgatcaattttatatttctattgaatatcgtcttgttatatttgtggtatttaaaaaaatttatgtaagttggatcacccatatctataatcctcgatatgccagtggacttcattgcattttccctctgatttagtctcatttcagttactatttatttagtttgtaagcccagttcaacaggaagtaattagaatgtttagtctttcatggactagctgatttagaatttttttcagccaatcgtagttgcttattttgcacgcatattaggggagaatataagcccagaaaagctgatgaagtttgcagcgcaaaacctctgtcccagctctgcatgctctgttttcatttttcttcaggtactgtagctgttcgacaacattcagaacagagctctgatagaaagagtgagttcaggatttagtctgaaggatgatttctgacacactacacaactgtaccagtacaaacagatatatatacatcattgtagatctatgcatcatatgcatttatggcacttgctctaataagttccatacatgacaaatatacaacccaacaaatagtgtcgttcacctgcttcagccttttcatcttcattactattcataggattcgtcggagtcgatggatgaccatgcgacctgtgacatcagcagtctcgca

SEQ ID NO: 38302 - DNA, 1501 bp, Oryza sativa
accctctcacctccctcccgccctagatccggcagcgatagatccgacggcggtgtcggcgtcggcggcggtgcccccaccacccacggcggcgtcggcggcaccctcccccaccaccggcggaggatctagcgggaggggaggcaccccgtgagcgacggcgacggcgcccctcctcccgtgagcggcggcggccctctcccccaccaccggagagcgccctccgccgccgctgccggcggatctagcgggagggaccggcggaggcggcgctctcccctccaccagatccagcaggaggggagccgctggcggccagccgtccctgtggcggtgacagcgacggcggtggttcggcaacgacggcggcggcggcggcgacccccttgatctaatttttggttttgatttggatatatatgtgtacatgtatcatgatttgtgtgattgaactccgattgtgatttttttccggggtttgattgcatacggattgggatttttttttggagggggggggggcgacgaagcgggacgaaaaaccggtgtgacgaccggaaaaatccgaatatttatattacttatatatttgttgataatttacaaggcttgtgtgcacttatatttatgcccctaacctaactgagtttgattcgaatacaattcaatcgactaaaaacttatctcctaaaaagaaatgtaaatctaaaaaacctgcctaaacgtaagtacacgacatataatttcaaaagtaaatctaatactatcttaaacaacctgatacacttttcaacaaaaccaactcaattgatggcgtcaattacttccattgacccgtgttttaccaaagactatgtcaaattttaccgttaacagtttggtttggactcgtattaattggctctcaagctgagcccaagcctccttcatatacagccctagctgtgggtgtagagagaggagaggatgaagggatctgctagcacatggtggtagtgtggatggtgccggtagccgacttagatgaaactctcgccatctcatggtgtctcaacataacaccgcgggcaccgctttagccactactctcctcatctcccttccctcttctccttggctccacactcactccctcctgccgccgccgccgccacgctgcgccgttggccggtggcatgatgtgcgtgaaaatccaacctcatatagcatttagtctatacgatcggatgctgttgtataagtatgtgataaaataggcggtatatttaaggataaatttaaaatactattttagtaaaaagtaaattttaaatagtaaaattattttttggtcatgttctttttataggggtggaaaatacgagcagataaaacatatagtagggcgttaaaaagacgacgctaggagcagagccgattgaaaacgatacagggagagagagtgacacttttaaaccttttttatgttgcacgcatccagggaggatggcagcggagagag

SEQ ID NO: 38303 - DNA, 1501 bp, Oryza sativa
tgcacaagatataagagttcttaccgtgctcatctttgctactggtgcaaatgtttcatcataatcaattccatatgtttgactatatcccttagccaccaaccttgctttgtatctttccacctttccatcaggattttgctttactgtataaacccacttatagttgacaattttcttccctttaggaaatggtacaagatcccatgttttgttcttttcaagagcctctagttcatctagcatagcttgatgccaccttggatcttgctttgcttctctccaatcctttgggatttgcactgaatctagtgatgctacaaaggccttatatgtggatgacaaggagtcataggaaacaagttggatatattattttcatcatcactctcatcttgagcttcaaaaccataccttagtggaggtttacctgcattgcttctcacactctttctaatggcaattggtaagtcagattcttctctaacttcctcttcttctccccctgactccaaagatccttgctcacggcttacatcttcctctacctgattatcctcttcaacttgttggattactggacaccttgttctccttgtgtatacttgaagatttttctcttcatgtggcttcctccattcttgctcctgtgcaacaggaccacccatgggacatggaattgaaccaaccacaagcttttccttctttggttgttcatctccctttggacccaatatttcatctttcatttggtgaccatcatgaccattagttgaatcatcaagatcaatgaataaagaacttaaatctgtcttctcaccatagaatgggacagattatctaaaagtaacatccatacttacaaaggttcgtctttctgatggactccaacacttataccccttctggccagatgaatagcctacaaagatgcatttgacagcccgaggatcaagttttccaatggaaggtctatgatctctaacaaaacaagtgcaaccaaacacttttggtggaacaacaaattcattctttccaaatatcatctcacatggtgtcttcattccaagtattcttgatggtgtgcggttgataagataagttgctgtcattactgcctcactccataagaatttaggtatattcatagtatacatcaatgagcgggctgtttctaagagatgacggtttttcctctcagccaccccattttgtggaggagtatcaggacaagaagtttgatgcaatattccttctgatgaaagaaagatactaaattcattgtttatatactcccctccattatcagttctaataaactggacccgagcattaaaatgatttttaatgtatgcatagaaatttagaaaacatttaagcacctcatccttatgtctcataagatataaccatgtcatgcgagagtagcaatcaataaaggtaacaaaatacttcattccactcatagagaccacaggtaaagtccaaacatctgagtgaa

SEQ ID NO: 38304 - DNA, 601 bp, Oryza sativa
cttgtctctctacagaagcaaagaaaccaatgtaggagtactctatattggattgaaagctgcaagtcctaacaaaaaaaaattgcagcaaagtagatggcttcaaaagaatggatgggcactgcttaactccttggattaagaaaaagcagcaccgactttagcgtggtttagccctctctcccggagtcccaggtccagagtggcgtatgcatgcatcgcgcacgctgtagctagcttgaaacacttggagcgaagggtagaggaggggggcaataggggtgcatggcgacataaacaaatgtgtagcttgtcgtcactccttggataaacaaatggagctgtcagcttcatgatcaagtgcacgttctcatgcaggaacgggggctctctcctgatcctctacttgcattgcaacacattataattcgttgtgctatcaaaatcagagtgagtgatagataggataggatgaccatttttttagggaaagggctaaatggctggcgaatgatttttgaagccaaaatcatgcagattactgattttgggatttgcttcgcgattcgtgctctgacgaccttagctcttctcctacagc

SEQ ID NO: 38305 - DNA, 1501 bp, Oryza sativa
catcaggaccaaagtcctcttcgtcttcttcgttgccatcgtcctcggacacatttgtcccttgagacgacgaggcaccggctcgccgtcctcctccgaagactccaaagttgaaggcgggtggcccgctgtgcgacatggatgccccatgacctcggacgcctccttggccagacaatgagccaggaggaacaaatcctcgcattcccctgccagatccagcgccattggtcaacgacctgccacggcctcgtcctcctcctctccctccacgacttctgccacgtccccctcccgccgctggaggaggacgtgacggggggactgtggatctgctccctgcccgaatcggaggtaacacaaggctacccggttcaaggatctgttggtaggaggcgaaatcggggaaggcgtcggcctgggagttcagatcgaggccccccgatccccctcccccaaaatggatgccggtgccagatccaccatatcctgaagacccctgcgagaagccgtagtcggagccgtccatgtggcccgttggagcttcattgaacgactgggagaagaaatcgtgaggatttccacccgccattgctgatgcgcgattcgtgaggcttgcgcgagcggcgtcggcttgcacgacaccggcgaaccaagcggcgggcagaggactagttagcgcgtagttgcggtgggggctaacgcaggacggcggcgagggcgcggggttgtgagaagcgagagagagacggcggcgagggtgcggtgttgtgaggagcgggagagagacgacgcgaggaagagatgaggcgaggaaagagagtgggcgaggaaatggatagggatggctggcgtgaaggggcagtggctggaatagagccactttttcccaataagcacctccattcgggacttctggaaaatgcactattagggactttttagtccctcctgtttgtttctctagggacttaagtggggggacttcttcttaaagtccctcaaagaaacaggacctgagtaaacgaaacaatgtactcatcattcgaggtacatcgatctctcagctacaagtcttttgtcaaagcgacttatcaactgaacgcaagtgatacccccaaagagaagtcgtcgttgatctcgtctgctatatgacactagaataaagtgctatactaggtgaagtgagttggtgactcaagaatcaagataccctttaggagatttttccttcaaaattaaagtagaacacggaaaactcattgctgcgtttaaaatggaatggaaggaaggagtacataagttggtcactgttggagaggtacagtgactttgacctagctttcttgaaatggctttttaaccaccatggagagtcacttttgctgatggataataacacaagcatccatcaagccacttgctataccaaaacacacagtgaaccagcatctcacactgcagctaatcaatcacttagccatgctcatgcgtcatccga

SEQ ID NO: 38306 - DNA, 372 bp, Oryza sativa
tctcacaattcaaaccattcacccccgagtcggccgttttcaccctcgccgccgccgcgcgtcgcgcccggattggcgccaacacgtcgccagccgaattaatccacgccttgccaaaggttggcaagctgccggaattcatctaggtacctcgtaaatgctctagaacccctcctctagccatgtctaactcatatcatcttgatcaccatcacggtctaaacatgccaccgccgccctagccgataggccattcacatatcaaattaatccctctgccgtcgctcgccgtcgccggagaaccctagctccctcccctcctcggccgaaccactttccccctccatcaccgctgtaatcgtcaaccctagc

SEQ ID NO: 38307 - DNA, 1501 bp, Oryza sativa
ccgacgaatcctatgaatagtaatgaagatgaaaaggctgaagcaggtgaacgacactatttgttgggttgtatatttgtcatgtatggaacttattagagcaagtgccataaatgcatatgatgcatagatctacaatgatgtatatatatctgtttgtactggtacagttgtgtagtgtgtcagaaatcatccttcagactaaatcctgaactcactctttctatcagagctctgttctgaatgttgtcgaacagctacagtacctgaagaaaaatgaaaacagagcatgcagagctgggacagaggttttgcgctgcaaacttcatcagcttttctgggcttatattctcccctaatatgcgtgcaaaataagcaactacgattggctgaaaaaaattctaaatcagctagtccatgaaagactaaacattctaattacttcctgttgaactgggcttacaaactaaataaatagtaactgaaatgagactaaatcagagggaaaatgcaatgaagtccactggcatatcgaggattatagatatgggtgatccaacttacataaatttttttaaataccacaaatataacaagacgatattcaatagaaatataaaattgatcaaacgcacatcaggatatattaatgatgttttttccccttttcccaagagttttattcttttttttacttacatgggcttttggctatgtatttttttccgtttcatgttataagaagctttgacttttttttctagtcaaacttattaagtttatagaaaaatgtagcaacgttgtcaacacaaaagaaacatactatcaaaatataatcaatgtatttaatgaaactaatttggtgttgtggatatttctaaattttatacaaacttggtcaaacctaaaaaacttttattatgaaagaaaatcaaaatatcttatagatgggagtagtttgtaaaattttaagaagactggttgtctcccggagctaattttttatattttaatcctttttaaagaacttattttacaaatagaccattggaaaagagtctattcctaaaataagtttttccaaaggactatttgtaaaacaagtttatttgtaaaaacttatttggtctatttggtcggcaccgacaccctcgccctcctgtagaagccaagtcactgatgtgaaggggtccggtgccaatgacactggtgtcgagtacccatttgtaaatagaaatctaaaaagggttaaaatgtaatttttttaaaaaaataagccctcaggactagtatcattggctcctaaaaaagtttcattcctgagataatttttttagacaagttttttaaaaggattaaaatgtaaaaaaaaaatccagcctgtcgcaggataccgtgctgcagcccattggaccaacgttactgaactacaggccactagcctttccggccgccatctaggatttttaatggaaaaggcagtaacccgcacttgtatatg

SEQ ID NO: 38308 - DNA, 904 bp, Oryza sativa
tgcagagatgaaatctacatgagtctgcaaaatattttgtttggtaaccccataggaagaacataggacctctacacaagcaagagagaatatgaggtgtgatgatctcaatatgtttgttttcttctaaaaattccatgaaacaacccattctatatgaattttgaaggtatcttcagagctattccttcagaacaaggatcatataggattttttttccctggggattcatgttgtagggcacttttgaatcgtgcgaatgaaaaaaaaatagaggaataggaaaaacgtagaattctaataggaatacaagtacaaaatagatgattgcaaaacataacaaaaacacaggaatgaccgattgattgaaccataggaaaaatgcatgaatcagatgagagagatagactcaaaggaaagtttccaagaggttggagctcttgctaaattttctccacaatctctataagattgtctgttccattggaattttagatgataagatatgattcaatcatttgttttaaagggtttcataggaaattttcctataggattgaaatcatccaaaattcctatgtttttcctctaaatcgaaggggctcatattcttctaagggctccgttgaaacgcgggattcagaagacacgtgaataggaaaaacatagaaatagaaagtcatgtctttttgaatattacagaaaattgattcagacatgaatttgtaacagataacatgttataaaaccggcctcaaaatcacatcggaaaccaaacgcggaagaaacaccataggagatccaaacacggtgacgacaccgagacacgatatttgataacggagttcaaccgaagcctatatctccagggcactgattacgggcacttctccctaatctagc

SEQ ID NO: 38309 - DNA, 454 bp, Oryza sativa
ctatagggcgaattcgagctcggtaccccccttaagctataaaaggaggacccttcccactgagatgaggggacgactcccagaaaatctgaactcaagaagagaggaagcaagtgcgctctctggagtgaagaaacccttgtaaaactcatccataatcccaaacacaggagtagggtgttatgctccataacagcccgaacctgtataatccgactacgtgcaagcttgccggtaatcttagggacgagcgagtgatttccgagaggcaggcctccgcccccggccgaactcacgaaagggggggggggtcccatgactccccgctattgaggatcttccctcgacagctggcgcgccaggtagggggcggttgggcgttccgagaggaagtcgctttcttccgtcccaagtttctccaggccttagccgaccatggtcgaggtcctggaag

SEQ ID NO: 38310 - DNA, 258 bp, Oryza sativa
atgaccaagttggccacgtcgtccagccagcgctaaacaggagtctccggctccgggtttaccgggggatgccgtagaagggcgcctgctgcctgaagcgtgccttggggcgaaccgccgtctccatagtcgagacggcgtcgtgccccgacgcatcgcggcctccctccgccagggggcggagagagagccgaaccacccgaacgagtgggatcctccctcggcgaaggttcgcagcggggaggagttggagaacca

SEQ ID NO: 38311 - DNA, 189 bp, Oryza sativa
tggtcctcacccatcagactagtcttctggattgtgtaggcccagcatctaaagttgtggctctggttgggcttgtggtggagcaggcccaatttgacctgggtggtccacggttggtgggccaggctgcgcactctaacaagtagttcgtttgtttactttgcatatttacacgcttgattcgtccca

SEQ ID NO: 38312 - DNA, 252 bp, Oryza sativa
gatcaaatgcatcgattactattctctaagaaacctgtcattatctaagagagcactagcaattatatttgctgttgtctgaaagcgtacagtcccggaagaaactgaacagggtacgcctccgaaaacgttatctgaaaatctatccttgacccgagatgactctcagctggttttcaggtttcagcagctaacgacaagggcttgcacagttgcgggggatgtgtagtgtactctagctcattaatgaga

SEQ ID NO: 38313 - DNA, 215 bp, Oryza sativa
cccctaattaatcaaattatgcattccttgctagcttagtactgttgtttagcaattctttaggaggcgccacaagctatttttgaagtgtaacatcttaatgaccgtaaaatctctttttctgtaccgaacagcacatatacgtacagatacgtgatctcttccttttattttcccttctctctgtccttttctcttactatttcgttgtcaga

SEQ ID NO: 38314 - DNA, 1501 bp, Oryza sativa
tgcactggatctcaatcctatagagaggagattttgccaataaacagaggaaagcctggaagctttcctggacacttatgtcactagctgcatgctttgctgcaattcaaagatgctgtattgtcagcaatcagagtctggctggattttctgtcacgtgataatttgtctgcaaataattgatcattgctctcctctctctagtctatattggcacacatctgcaagcaatcaagaaagagagactactcttcaggttcacgacaactacttgcacattttattcaactactgcaccgtcgctttgcattacacagaaatggaaacgggaaagatctgacgagctgctaaacactattgaatcgcaaaaccacaaagcgaggtcgctatggatagacaaaaagatgcaaaagattagccctaaaagcaccgtgattaagcagtcggtctgatgaatgcctgcgtgaaatgggtttcagtacttgctggaaagcaaccgacgcacattgcagagtattgctgtctggtccaaacagagcgtacaaagcaaacggagcgtaagttgcaccctcttaatcttaacaaagctcacatgggtggtagtataataccctggcaatctaacttgttcctgacattacagtacctcacctttcctacactaaagtgactaactatgtcgagagaaaacttccaaacaattcagtagcaattgattagttggacgacagaatcaaatgaatgagaggaacaagctatcatcagatcttttcctcagatacgccgagctgagcttagttgagatgaaagctggaagaagccaagaaaagaccaccagggtttaaggcctgaatcatgaggaggaggacgaagaataatacacaccctgtcctaatgcaaaagagcttccttgtccttatcaagcaaggctgcaagtctttgctaatcttctcatccgatcgaaaagaaagcaagctaggggagaagagattgtagtagtagtagtagtaaagtggatgcatgggggtgatagaaaaggagccatgcattgtaccaccaacaagcaagtgccgttgcatcgatctgcagccttttgatggaccggccggggaaggaagcagaaaaaaagatagccgtcgattaaaacagtctgtattgcaccagcgatcgatgcgtatgggtgtggtacgtactacgtagatagctaagctaggtcgtctctcgatcgtcatctccctggccctccactgctcgcaaagtcttgtaataatgcacagccttttcggttgctaaagggaagagggaaaagagagacagagaagacagaagtgatcagattgtttttcttttagcgaaaagtgatcatgctatgtacaagtgagatgatgatgatgatgatgataacggtggtctttctttctctcttcatgcacaagggccggcggtctgaattcaaaccccatgggggtacatatccttttaaacttaaaaggcgtaaaag

SEQ ID NO: 38315 - DNA, 862 bp, Oryza sativa
ttcatcgcaatattaatctaatcaatcagatctcatctaatggtctacggctgcagtaactttcgttcttgtgtgcgtgtctcttaaatgccgaagtaattaggccacatgtgcatggacgacgcgacgcaaacacactgcacggaacctagaaaaaagtcaaccgtgcgcgcgtgtgcatgcgtgtgtatgacctgtatggattcgatgtcttgcatttagagcgagtacaatagcaggctataagtcagctgtaagcacatatgaagaagaaaagaaaaacgggctataaatttatagccagctgcagtacaaactttaatacgttttgtgtgtataagatgtaggaccatatattagtgatgtagtatatacttataggcaatgagctattagattggttatagatgaattgaagccggtagttggctagctcttatgcattactaggaggtttgacttctcaaagcgggtacaactataagtcagctgtaaacataatttaagggcatccacaatgtgagccactcctagagtgtcctcactaactgaggacactcgtagaggaacttagctcgcaataatagacacccttagatgagttcctcaaaatctgaagcaactagatgaaggtactcaagcccacaatgggtgtcctaacaaaaaaacccacattagatgttttcctatactacccctctcttctcccccctctctctctccactttttcttccgctctttcctctcctcttcttttttcttcgccggcatcactccctccgctcggcgacatcgccgtcctcccccctccctctctctcccgcgagcgccggcgccacctccctcctcgccctccccagc

SEQ ID NO: 38316 - DNA, 503 bp, Oryza sativa
gaggcagcggcgccagccatgctggcgccgccccagggaggagggcgccagcatggctggcgccgctgcctccattcctgtttctctgtatggagttgcaatgtgttatttttattttattttttcggatgttttttcacactcaggatcatgatacaaccaaccacaaaaaaaatttaaactcgaactaccacttagctaagtctgaaaatatctagtataccacttagtctactttgcaccttcactaaaattagaccataactcctttagtaaaaccctttgatcagcatgttaaacataatgcactctaccactatatgaaattacttaatctaattcaaaatataaccacatgaaatgacatatataagttaaacagtacatagagatgcaattttttttttattttatttttttgatatttttttcacacttaggagaacataggaaccaaccgtataaaaaataaactcaaacggataaaatatgtgacatgtaga

SEQ ID NO: 38317 - DNA, 194 bp, Oryza sativa
taagctaccagcataccaccacaagcccacgactatacatcctcatcttttctcttatgcttatcactcaaaatttatattttcaactttaaatttaaatttggagttgatttggaggattttttaatcaaagttttttttagactttgcttttagattgctaagaacacgtatgtaaaagttttattcacaga

SEQ ID NO: 38318 - DNA, 505 bp, Oryza sativa
ggagtatactatagcctccgttgatttgcagatggatagtggagattatggggctagcttatgcttgttactgtgcccctctgcgtaggatctcgtgttcgggtgatctacacgctcagctcgctctgatatcctgtcatattggtcttctgaattctgatcgctgaattcggttcgttcacgcggtgcggccaacggcgatcgagcaaatggtccgagcacaaggctgtcctatgtcagattcttcagatagaaggcccgtgcggtaaacttaaatgggcctcgcgttctcgtcgttcatgcatgtttgggccagaaaggacccatattcctccaactgttgacaggcccattatcctatgtcaaaacttcctttccttgggataaaggtccaaccggtgagtacctaaatggctaagggccccttgaatcgtagggtagaaaaaacagaggaataggaaaaatacaggattctgataagaattgatgtgtaaaatagagtagt

SEQ ID NO: 38319 - DNA, 495 bp, Oryza sativa
tttaaaaaataataagatagataaatcatattcaatttatacaagtaaaaaaaattgactgcacgtgaatagtgttcgtgtgagtactatttgcagtcactaatgagttatataccggccaaaaatatttcaagaatgtgatataccactaattagacgatttaggctgtgttcatgtgttatggttggaaacttctttcttctggacaagtagcaactcattccgtataattagttaagtattagtttaaaattaacttaaaactagattaacgtaatttttaaaaacaacttttctacagatgttttataaaaagaataatatttaacagtttagaaaggatgtgcgggaagatagacttaataatgcagccttaaaaccgtgggtaatacggactatggactatggtaattaaaagcaccttgtgttcttcacgcaacacgtgttcatacttacatatgcagtcatttccaaaggtcaaaagtccagaacta

SEQ ID NO: 38320 - DNA, 1501 bp, Oryza sativa
cttgtgggtgagcgaactgtttccttcgaggtgagagcagtacatccgcccaaatatgaaaaacaaatttggattggaacgaaacgtcgtctagtacaacgaatctccatacgtacaaacgaacactcatccttataaatacacagttacactttacctctgtaagtatattcgaaagattggatcggcgtatcttgagattgacgaaatcaccacagacgtcttgctgtcgataggtacatctcctatcactaaaaaaaatagccgtaaatgagagcacacatatcgtgtctagcacataaaatctgggtggactgattcgaccacaaggaacctaaccatgttaaaatttgataagacaacaaactaatggcttgttcactttgctaccattttcaacattaccaagttttggcattgccaaattttggtaaggttggcattgccaaattttggtaaggttatcaaaattttggcaaggttgtcaaattttgacaagatttcatatgtacttactgaaatttggcaataaattaaatatagccactttttggtaactttgccaaaaaaaaaaaggtatggttgaaaatagtagcaaagtgaaccagccgtaaacatgctattgtcgatacaaacttactaaattttggtaattctggaactttccactcttagggtatgtttggggggagtttctagcagctacagcttcttctagaatcttcagttgctagaagctcccccaaacaatccagctttttatccaaattctaagaatgtaaaatttagaaaataaactagaagctagaagctgagtttcccagcttctccagattctcaccggctagcttcttctcaaaatcttaagctactccaaaaagacccttaaatgttttaccaaacttttgtaagaacacaaactaaacattctcattcacatcttaccttattaaagattgataatgtcaaataaatagcattatcaaaatataattgttttttaataaagtgggtgtggagattatggataccccatacctacacggcatgtataggccgactgggcgtggggtgccatgtatagatagaatatctttagagagattcgggttaaattctaaacttgtatgtcaaggaaatacccgagatcctagtcggttacgattgtattttatgctgtcactacttattccgttaaggatatggactgtattttgtaatacggatcccatctcccatataaggaggggtccgggtgccttgaggggcacgattttcttcagatcatacgatcaataatcactcggcggatcaatccccggataggagtagggtattacttcttgattaagaaggcctgaacctgtataaaattccatgtctctaaacccatccacttttccagcttgatagccacccccttttagtattgccgaaatcttgtttcgacagttggcacgccaggtaggggtagcgtcaagttcttcgccgactagtgaga

SEQ ID NO: 38321 - DNA, 363 bp, Oryza sativa
tgtatgggttaggtgagcacagtggggctcacctaaccacatttattgcggtttggctgagcgtgttacgccgcatgtaacgcagtacagtgcactcatttatccggtctgtgaccagtcacagaccggtcagatcgcgggttaggtggcgacaggcgatctgacgcacgcctcgccccatcccgtcaggacgagggcttctaggcgctcgtccccagctggagctagcgtgttacctcccagagatggcacgttagtcctggtcagatatatgccaggtttcatcctaaccattacaggcaagatgttgtgtgaagaagggcgaacatgtagattgctaagctgacacgtggtggacaagaa

SEQ ID NO: 38322 - DNA, 1501 bp, Oryza sativa
cccatttctccctctctttctcgcattcaaacggacggatttgctcccgcaaatctcgccggcgccattgatggcggccggacctcccgcgccggtttcctcccccgccggccgccctctctccctcccaaccctatttaaaccctccccgcgcctccctcacccgtttccgccacttgccgcaccgtcttcccgccggaatcgagctcgcgccgtcgccctctctctcctccgtcgccgacgacctccggccggccctctccgctcgccgggaccgtctcccgcctcggcgtcgccttcttcggcttctccgcatcgccgccgaccccgtccaccacctcgccgagctcgccgaccgccagagcgccgtcgtccccatccacccgagccgcgccgccgccttcctccgctccggccgcctcctttgtcgtcgccgtcgactcggggtgagccgtggaccgccgcctcttttcccccttcccttcccctctctcggccgccgctccgccgtgcctatggccgccgccggcaaccataggggcgcgggcgccgcctcccgccggctgcaccgtcgtggccgccacgtggggcccagccgtcagccacccgcgccctcgggtgcggctgacgcgtggggcccacggcgccggccggtgtgagcccgggtgtgcccggtccaccgtggaccgtgaggctgccgcgtgggccccactcccgtggacccggtccacgcgccccctcccctcggctgacgcaataaatccattttaaattaaaatttaaatgaagaaattcgcaaatattcacttaaagagcatataaacttcaaatggccataacttggccatttgaactcggaattggaccgttcaagtctctaatttttcctcaagaagtcaagaacccatttttgtgctttgttcctgcttgttatatggagtttattagagtaaaagactttttcctttccattggtcgtgtagacgctgcagctccggaagatccgctatacgtggaggttgaagccgacgtttgggaaagcgagcaaggcaagtcacatcatccttgaacatattgaatcccagtttataaaattattttgatttaaattaatgcattatcgctttatttaaattctcgcgttatcactgttttatttagccatgcctatttacctttgttatgaccttattattattgttattgttattattaccttgttcaccctagaataaacaaaaccccaactagtgggtactctattcatggtaccactagtatgaatttaggtagatgcttcgctgtttaattaggcaacattaggtggttttataactctagactttgggaatattcatatcacttggacattgtggaatggttagattattgtggaattggattcacacctccccctctattcaaaaccatcaaaatggttttaggttgggctcggggtgcatggttttgatagtagcacctcgcccacataaggaccggt

SEQ ID NO: 38323 - DNA, 1501 bp, Oryza sativa
tatacagtgtaacggctggaatcaggtgacactgacgagttttggcaaaacctatagttaaactacttattcatatattatagcaccatgatctaagcataattagcatactatgacactagtagatacattatgacaccaacgaatcaattttctagatacgccactgcgttcaatctttatgtgtgttcgtgaaaaaacattcgctgctggtaacagatggagtccttgctagattttggcagcaggcaggcagggtgctgcaattacgatctgtcggattcgatcgagcagggatcgatcgtactcgtgtgtcggccttttcgcctgcatcttgtcgccttcttgctcatagctgcttactcctactacttgtactatttacaagtgcgtatatacagtaccagaatttctgcaacggtttggctaggtagaaaaaatagacctgaacatttttttttaataatgaaaatggattacatctctggctttctgtcataagacacacagccataagtacagccataagtttaatagtaataaaaaggtaaggtaaaagtaaatcaaaatgagaaataaggtgatgggacaaatctccaactcccctttattattgactagcgttaaaccacataaaatttttttagctagcaattctaatagaactacgccacccatagtggaacaagagacccttagctaccgattccaagagtatagcaccattgcgcatagtatcctgctcttcctgtggtagcatcgtaaaccaaaagtggagctagtaggaagatatgaagataacctgtataaggttagataattgtttaccattaaaaactttatcattacgacaacaccaaattaaccaacatatagcactagctccaattagaatcatctttttaatggacctagatatccctctaagccaattaccgaaaatgtttttggcgttacggggtgggggatattaaaagcaaaaaacacacatctccaaacaaactgagtgacatgacactcaaagaaaagatgttggattgtctcttgtgcatagcagaaagaacaatgtttgtccccctccccctctccccaaattttcttttagccaggttattatctttcgttagaattactttcttatgaagaaaccacataaagaccttgatctttagtggaattttcaagtcccacagaattctctttttgatccgaacattacagttcatgatcgtggcatacatagatttgatggaaaattgaccattcttatggagcgaccatacaaagctattcttttcatttgacagagttatattagcccgaggatcaaatcgttccactcgattagcttttggccaacaatagctctcctaaaagatatatttagcggcgttgtgtgtaaaatcaaaggtgctttttattattattctgtgatgaacaattggcatcggagattattggttttgatatttggaatttattcacgaagtggttttggaga

SEQ ID NO: 38324 - DNA, 1501 bp, Oryza sativa
ttggtgggccataatttaccaatacatctggacggacaacaaattaaggcaacctgggctatcgttttaagaattgtttaattgggccataatatgattacggcatataatatttatttttatatatgtccgttttgttttttaatctgaaacggatagatctataaagtttcactcaacatcatggttagtaacctcgaaatatttaaggcttagtttagaaagtctgaaattcccacaacttcaaaaaagaaccgccaacaaaccaaacaaaaagtggcaaaaattaagaaagaagctaggatctattttgtttccaacacaaatatttttctccacctcttgttcttctaacttttattcctatttatcaatacaattgttagatatcattccatatcttataaataaaggacaataaaaggaaacagccaaatatgatttcactctacgtaccaccaagagtgcaagacaatattcttaccatctccaatagatataacaataaattttcatgttataacgggaaacaagcgagttaaccgctaacataataatgtttttcgttaaataattagtatatattccctctattcttttatatgtgacattggtttggttcaaaatattgtactaaccaacactatatagaaaaatggagggggcacacacaatagcatatataatgtgaagctcagatcatttgatggcctaaaacataggacgatggtcagagttatatttttcatgtatacagtactccctccgtcccgttatatttgacgtttccgaccagatcgtgaaaattaaggaacgtgtgaaattacatatttgccctgggccttctcctctcaacgcgtgagtcgccgccgcgagcccgcgacggaagaaagaggcggaaacgccgccacccccaacgccggaaacgccggccgctacgcccagccgccggggctcacctccaagatgccgccgccacccgtactcgctggaaccgtcgccgccacccctctttgccggagccgccggcgctctctcccgacgccgctactcataattgggcaccccaggcctgagacccagcagaatctttggacaaaattttacaacacttgtagtaagatctcatgccctccttttcacctacaacggcatcgatcgatcacctgagccatttgccatttgccactgatctatgaacactgtaaaaccttatcatttatcaggttcaggcacgctgcaactgctgcatctgccaaattgtgcttatcctgtgcaagaaatagctatagattgactcggccgggcaggtgagcagtagaacattcaaatctccttttctaaagatgaataaggaagaatgaatcagttgtgtttacaatattcagattttactttaaaagtttgtgtttttacagtattttcagagctgctcttggattgccagtttttcggctgaaatttcatagcagttctgatgatttactcccttcattgccca

SEQ ID NO: 38325 - DNA, 932 bp, Oryza sativa
gtggcagaatacgaggcgcttcttcacggactaaggattgcaatctctttgggaattcggcgtttgatagttcgtggagattctcagttgattgttagtcaagttatgaaagagtggtcctaccttgattgtcacgactggaaataacccaacgggcgttccttacgtgcgtgtattattccttgtcccaggaggcaaggtacaccaaaagttgatacaatacagagtttaacaagcggaagcgtaaatagttaatttattacatgggcggcgaaggcccagcacacatgaagacaaacgaaaaacaacggaagactagggcgatgaccacaggcgcttgacggcaggcacgagctagacaccaaagccttcatcttccaggaactcctcttctgggtttgggaaaaattgagcaagactgagtacagccaccgtaatcaacaagacgcacccacaagtgcagaataaatgcaagggggtacaagggagttatattatagggggttagggtttgcagtaaacagcattaaaagacacttagttgctcaaagttacttttaaaaacacgatcctagagctatacaatattattaaataaggtcgtgaacccatacgaacctgccttacccaagccctacgatgattcagaccgaactggcaacccgaccctgggtcccagcttgtcccaagccaacccaggccaaccattccacattttagttgttaagcaggtttttaagaatttaaaacactaacttgggtacattgctaggcttgcctataaccgagggcgcggctattcgaataggttatactctaatcagaggtgtacatccttacccacaagacacatcttcctcacgtgtaaccacgtgccacataccaccacggtatacggacaaaagacgtgacatagttcccaacccatcata

SEQ ID NO: 38326 - DNA, 439 bp, Oryza sativa
gtcgttcttgctaggatgattatcgtatatacacatatatgtaatgctaaagcaagctagatatatgcatttttaaccttaatcatccagagacatttgcaacaacgatttgcatatatatgtatatatactactgctagctagctagctatttacatatctaggacatcaaacatgaacacacacatatatattctctcccttttgttcactttttcatactttaatttacattaggaccataagtgtgaaacaacagaacttacaaccacatgcatgttgacatgctgttacaccatttgatatatgtgttaatatattaattaatgccatgcattacatatagttaatttggacaatttagttcatcaacatgcatatatttttggacatatgtttctcagtattattctgaatcgctactttactgatctctaca

SEQ ID NO: 38327 - DNA, 1501 bp, Oryza sativa
ctacttaaccaaaatgttggtgggttcatgcttgactatgaacttataagggtatacaccaagatagaataagaacgcatggataaatcatagtgtaacctattcgactaagtctgtgagattctaaatggtggaccttggcgatatggtcggtggctgggctttgggattccttcgaatatcaaatcgatatatgtttttgtatggcttacagtagcgaagctacgtgtagtaatggcaatgctacgaggaaatagtttttgcaaaacaacccaaaaaactattgatatttgtgttgcaacaatataaaacttaaagaattttacaactttaaccccacaggttgtagtcgctggctacgccacctacggcttatcttgattgatatataacttgatgctctcccattcaaggatgtgatgtcattataccttagggttgcccccttcttcaagagttcaagtaaagtttgggagacaaggatacatactgagcagttgtggctgtaggccagtcgaaccatgtactttaccccaatatgccaccacttcttacccaatctctatttcgtggatttattttttatataatttggtgtgcggtattttccgtttgagatatgtgcaatgcagggtacatcatttacctaggacactaacacatgtgttattctacgacatcgttgttgtttattggtatatagcaatgtacactttagttacaaatcctatcttactataaatttgatgaccactaactcttaaaactcaacatacaaccatgccacatcatcacccactatcaataattacatatttaaccttaagcaagcacacaacatcatctataatttatttaattatacaaatcaacatgcaagtttatcaaattattacccctcacatcatttctacaatattttaacaaatatatatattatttttataatatttaacatatagttatcaatatgttctacattaaatcgtgggtatcatttgtttgttttatgataagtactgataaaccctcacgtttcattattttattttctattttctcctagcttgattgtcgaaaaatatatattgaaaactgcttagtaattctcatgcaaaagcgcggggaatcaccttgtataaataatatcgggaagcgacgatagaaattttctacgtaagacccaaaagataccttatgtaataatccgaagcatcaaagtaccatccaactgtataaaacattggtaagttctcagcttccacacttgtaggatcaagaaggccgactagaggggggtgaataggcggtttttcaaacttttggctaaaaccgagttttgtatgcggaagcgtaaatcaaaatggttttgcacaattcaaaacctaaatcaactagtctcaagtaagtgcacaaagaagctagcctatgttgaggtttgcaagcctagggtgataatagcacaaataaactctagtatgtaaacttgctcaaagtaaat

SEQ ID NO: 38328 - DNA, 1501 bp, Oryza sativa
gggtgatgatgtggcatggttgtatgttgagttttaagagttagtggtcatcaaatttatagtaagataggatttgtaactaaagtgtacattgctatataccaataaacaacaacgatgtcgtagaataacacatgtgttagtgtcctaggtaaatgatgtaccctgcattgcacatatctcaaacggaaaataccgcacaccaaattatataaaaaataaatccacgaaatagagattgggtaagaagtggtggcatattggggtaaagtacatggttcgactggcctacagccacaactgctcagtatgtatccttgtctcccaaactttacttgaactcttgaagaagggggcaaccctaaggtataatgacatcacatccttgaatgggagagcatcaagttatatatcaatcaagataagccgtaggtggcgtagccagcgactacaacctgtggggttaaagttgtaaaattctttaagttttatattgttgcaacacaaatatcaatagttttttgggttgttttgcaaaaactatttcctcgtagcattgccattactacacgtagcttcgctactgtaagccatacaaaaacatatatcgatttgatattcgaaggaatcccaaagcccagccaccgaccatatcgccaaggtccaccatttagaatctcacagacttagtcgaataggttacactatgatttatccatgcgttcttattctatcttggtgtatacccttataagttcatagtcaagcatgaacccaccaacattttggttaagtagtgggtcgaaaccacgctcattcgtggtagatcaatatgtttattttcatattgcttatagaattaatagcatgccttatgtatttccatggccgtattttttttggtagttatgcctgtcagggttacggataaggcataccctctatcctacgacttatggaatataccgatgaggtataccttcacgtatgcgggttgtttccgtatacgctttaggaatttatctcaagttatggaaaatatctctatgagtttaggaattgccgaagtcctactcggaaagggtaaaatctctagtatatcgtgtcagtttacatatctccaagttttacttgggggtgaaggtattccacggtataaaagggacccttagggagaggcaaagggcatcgcatctcatcgccaatacacccaccaaagtttacgaagccggagttcacggagccaactcgtcaggagatctcgtcgaatccctcgactacgatctcatcggtatcgcctgtttcggttactttctttgtaatatgttctcatcatcatcaatcccatataaactggactagggctataatctgataaggggcctgaaccagtataatctttttcttttgatgttttgatgtcgtactacgtagacccctgctccaacgtaccccaattctctattcatccggtccgcgagtatcactcgtcaacaatgca

SEQ ID NO: 38329 - DNA, 1501 bp, Oryza sativa
ttgctatatgtgcatatgggttcttaccaattgtgactattatctaggtctatctcttttgattggtattcttctatcaattggtgtggttcatatgcacaaaaccaaaaagagcttgatttggattggtgtttctttggactccaactctttctattggaatttcgatgagttcaattgctttattcggtgttggtgcacatgtttttcttgtatatcttcttgtgtgtacctcgaggctatttgtactttgctattttgaaactaacgcttttgatagagtttcatcttgttgtagcctctttggaacaccaaaggtatgttaaaccttttctccttcaagtgtataggacttgtgtagttcttatatacttgatatgatttctttttctttatgctcccacccaaacattcaatcttttggtgtttgatgccaaagggggagaagtataaagagagatagatagaggggaaagtgtatactcgtttcatatgttgatgaaaccaaccctctagtatatgtttcatgctcatggtaacatatactagagtattctctttaaattcctattttgtggtagtgttgtcatcaatcaccaaaaagggggagattgaaagatctatgcactagaattgccttgtaaggggagattggaatatctatgatcctaagagtgcggtgattgttttggtgattaatgacaacccattgttggaactaactatttccatgagttggtgagattaggttaagttccggcatcaagttaaaagattgaagctagaagatggacattataccttgatgaggagcaagtgaagacattgatgatgcggggtatgaaatggctatctatggcaaaccggtgaagagaaagcaaggctcggctagaagatggacattgtcacaaccagatttttgttttaggatttataaattatctaataaattattaatagaatttatattaaatgttcattaatttacaagtgaagttaaatgtgggaaataaaatttcctaaatttaaagcatggatggatttaatttttattaaattctccatgattaattatactctctgaaattttctcggatttttcggagctcaattcctaaatgatacaaagaacagttcagtaattatttaatcattaatgatctaattataattatgttaagtgcttttcttgtttaaaaatccttaatttataaattgttgtctaaaagggaattattagaaatgattttaaaagcctagaagagaagatctaattttaatttgttaaatctcaatataaaagtaggctagataaaattttgttaaatacttctcttgtttctatagttcctagatttttctgggatttatttgagccaaggaagtatttttaataaatggaattgcatttcatgaataatttaaagggaaaaaggtttttaaaagtcccttttggttttgggccaaaagccggcccaaaccgctctctctctccctcagc

SEQ ID NO: 38330 - DNA, 1501 bp, Oryza sativa
ccaaaccaggaatataccattccaaaccaggagctaaattaaattattaccagttatagcatcatttattatggtgagaagtgtgagactaatcacgaaagacattgttagacccgcccatgaccgcgggcacggctattcgaatagttttattctggccagaggtgtaccactgtacccacaagacacaacccaccagcatgttaccgtgtccgcgcagacacgtcaccatgttgagtgattgtgacaagacccctcgcataactcaactcaaagcagtgcaccgttcccggatcatagtcacccccttataaacaaggcatggactccccagcgacccccgtgggcttattttcgccacttctcagtctggtgctccgcaatgagtcttgttatacaaagtgtccagccgttgcccattatggcttgtggttggcacggttaatgtttcacaaccgaaaatcgtgaaccggtccttaattgtcatgagcacgaccatcaaaaccatgtgctcacaacccaccattatcaagttttagttggcacattaattaattaaccaatcacgattgaccatcatgagctatcattaaatatccatcattaagtaatagtgaaacattagttatcccaattgtgtgctaatgtttctaagcatggctaagcaattatgtctaacatctagctgaaccaatatatataaagctcaactagtcaaattataatatcccaaggtatcaaggaatagagtaatcaatgcaaacaggccataacaaaggaatagattcacaccacccagtgacattcgaaaataaatgcacagttgaaataaatagagaatttaaatataggatcaacatgctcaaaggaactgtgtttgggatctgtgtgacttgccttgcaataaagggtcttcaattaatcttcttaacacttccagcgcactcacgaaccttcgaaacgacggaaacgacaagctaacacacaaaacgaggaaaaagactaataaaaaccaaatagacaatacataaaaagtaaacaaacatgtagatcataattttagatgaattatgagacttgaacggcctcattcggacttcatatgaatttattacgaattttacaagattaaatctaattaaagcctatttaaaaaggattaaataaatttaattcaatttatggataattttaatatgtagatctttattttatacaacttttgcaacttgaaccacattaaactgagttacaaagaattagttatgaatttttaaagattaaaccggattaaagcatttttatggattttaattgaattatgacgaaataatgaattatttttaaaaaggaaaagggaattattgcgtcatcggctagggtttgcggaggaccgggtgcatggcgacggttcacgaaaacgaacgaccgagattcatccatccaaaagggatggccaagatccattggtccacgaccggaccacggcggacggcaacga

SEQ ID NO: 38331 - DNA, 1501 bp, Oryza sativa
ggatgattgctgaatcggtgcgcccagactctgcaacaatggcaagcatcctgccggcctatgcagaatctgcagacctgaaagaagggaagaacattcactgtttcttactgactctcggattcctcagaagcacagagatcgccactggtttgattgatgtctattctaaggctggtgacttggatgctgcgtgggctctcttccagtggctacctgagaaggacgttgttgcctggacaacgatcatcgccgggtacggtatacatggtcacgcccgaactgccatcctgctctacgacaggatggtggagtcaggagggaagccgaatactgtgaccatcgccactttgctgtatgcatgcagccacgccggcatgatagacgaaggcattaaggtgttcaaggacatgcgcaacgtccatggtttgatgccaaatggcgagcactactcgtgcctggttgacatgcttggccgtgctgggaggattgaggaggctcatcgtctcatccaagatatgccattcgagccgagcacctcggtatggggtgctctgcttggtgcctgtgttctacacaagaatgtcgagtttggggaggttgcggcaaagcgattatttcagcttgatccggagaacactgggagttacgtgctgcttggtaacatatatgctgcagctgacagatggagggatgttcaggatgtccggagaatgatggtggaaaggggcctcctaaaagaaccaggatctagtttggttgaggcaagatctgtacaatgccgaacagcaatgccatagaatgtaagttttgtacttatatgagatagatcaaagcacttcatcttttatgcagattctatcagttggaaaattgactaaaattttaagaaaaaaaactaattgttgccctggaattaataaatagtcttcccttacaatagagaagattacatgtggatcttactggtggaatcaaaccaaagaaactagagacgtggagtacctgagtacctgcaccattaaaaaaacgggaaacgtatcaaactcacgccatgttgttttgatgccacaaatgatttttctatgcaaggggagctgctatagcgatgggtggtggcgcgcatgttggttgcacacaacgcttctggttctcacacaccaaggaggggacgtgcttggtcaaatgctcctctccgaacgtggtggcatcatgcaagcctccatctccaccgccagcccttccctccctatattttgcctcctccttcctctctttcaggccttcaaatcttgctcctgctcgcgttttggcacattccctcctctctcctccttgcagggcctgtctgtttctcaccatagtaaggaaggaaagaaggaaggaagaggaaaaaaaaggatcatcaaccatggtgagtgcagttcaatctctttcgttcagaatgttgatcaagatctgtccattaacgaaatggtgtatgttgtggggatatgtaagt

SEQ ID NO: 38332 - DNA, 1501 bp, Oryza sativa
ggaaattttatttcccacatttaacttcacttgtaaattaatgaacatttaatataaattctattaataatttattagataatttataaatcctaaaacaaaaatctggttgtgacaatgtccatcttctagccgagccttgctttctcttcaccggtttgccatagatagccatttcataccccgcatcatcaatgtcttcacttgctcctcatcaaggtataatgtccatcttctagcttcaatcttttaacttgatgccggaacttaacctaatctcaccaactcatggaaatagttagttccaacaatgggttgtcattaatcaccaaaacaatcaccgcactcttaggatcatagatattccaatctccccttacaaggcaattctagtgcatagatctttcaatctccccctttttggtgattgatgacaacactaccacaaaataggaatttaaagagaatactctagtatatgttaccatgagcatgaaacatatactagagggttggtttcatcaacatatgaaacgagtatacactttcccctctatctatctctctttatacttctccccctttggcatcaaacaccaaaagattgaatgtttgggtgggagcataaagaaaaagaaatcatatcaagtatataagaactacacaagtcctatacacttgaaggagaaaaggtttaacatacctttggtgttccaaagaggctacaacaagatgaaactctatcaaaagcgttagtttcaaaatagcaaagtacaaatagcctcgaggtacacacaagaagatatacaagaaaaacatgtgcaccaacaccgaataaagcaattgaactcatcgaaattccaatagaaagagttggagtccaaagaaacaccaatccaaatcaagctctttttggttttgtgcatatgaaccacaccaattgatagaagaataccaatcaaaagagatagacctagataatagtcacaattggtaagaacccatatgcacatatagcaaatacattgattagttaaactcgcttaatttggagcaaggcacaaaagcatgattccaaaaaaaaaatattttatctttaatgcatctcccaaaactcacttaaaggagggcaaaaagtatgttgggcatatgatgctatagacaagtcatgtatgcccgaaagaaatgtctcataagccaaaacccaataagtagtgatgatgaagagacatatcaagacttatgaaacatcacaacataggatgaactccttctaaatacgtgcataccaaagagtgaaaagaaatcttatgcactttcacaaaagaaatgaaggaacacaagaatccatcctatattatgaaatcaaggttgcaaagaaaattcatagaagcaataatgaaatctaccttaggagtcgtccacttccgacatgagactaaaaggataaactcaatttaaaccattagtcttccaaggtatagaataaatttcccctcaa

SEQ ID NO: 38333 - DNA, 1043 bp, Oryza sativa
tcaagccactggaagtttcatagagtggtagatatcttatataatctgaatcaacgtcaaaatctaacctaatcggctgccctcttcgatagatgttagccgattgtagattagatagcgatattgccagagattatgtaagatatatgataactcgacgaattacataaacaagattagagtgtcataaagatagaagcactaatcccgagaatacaagccgtcataataagttttacctcttgctgaagatcgaaaccgatgcagctcaacccgaaagcaagaactcgtcgaaacaaaactaaagcaaaagggtggcgatgcaccgaaattgtattgaacgtgtgtgttaaaagttacatagggctcgggtctatttatacccgagaattacaagatatgtccataacggacacgactactatctctaacaaactctaagataccataagtctttgcggcagacttttgcccaagcgtatctctaaggagattacataaaacatcctaattaatagatacaattgccttctcaggactctatccatgtgcggcaatcaccttgaaatgcctcaattcaacccgatatcatacatcaagttgcattgtcggaatcggctacatcggcttacctagtccgactcagacccagccgatcctaatcgtagccgatctggactccagccgattcctgctctgttttcgaactcgatctccgcctccgacttcgcttcgatctaatcttctttcttgacgccgatgttaccaaatttggttgttaacacatggcccccaagtccggaatatttggtaatgtttcggatttgctgtaaatcgactccaagcaagtttcgcactttgctgttttccgaccgttactgccgtgctttaaatattaaccatcaccctcgagaaatctcacaccgtgacttccgttttcaccgctcaagcgaaactttgtcctctctctctccggcgactcctccgatgcaaaagcgaattccaggcgacttcatcttcggcgagatttccgcccgcagcga

SEQ ID NO: 38334 - DNA, 891 bp, Oryza sativa
cctgatcccgaactcattgttcggcggcagcatgccggcggggcgggcataagacctcggcagtacgtcgcccatgtcggcgaacactgccgccggtcgaacgagatatgctgggctggtctggtcacactagctggtcagtgagcaagttgcatttatatatgtgtgttcagcagtctggctggccaccaaccggccgcgcgcgtgacgtcgtgcgtggcgagcgaatgcgtggatttttgggatttggtgatcgacacagtcggggtgtgtgcttgctgacggacgattggtgatccaccagggttagttagagtaagtcccagagcaaacagacatgacatgttgatttacatgacttcagcagattagagaaccgtgtcacggcttcacaggcgtttataccgtttagggaagaaatcaactgatttgagctgatttgcatgaacctctaggttctgggccttgtgttctggcagaataggccatggcaggacaaatgctaacggaataagctcactttaggtccctcgagttgtcgtcgagtctaaagttcgtctctgaaccgcaattccagatagatatatatgacgcgtctcttaactcctaaaattagtgcaaataaggttctaaggtggtttggacatcgtttctcgatgacatgacgttaacgtggcacttaaagctaaaaataatgtaacacccatacatcagtgtttggttaaaaataaaaaaccgcgaccggacccacgtcatcaacccctatttattctcctcttctatctgttcttcatctctttgtccctttcctcaccatcgactcgtcgacagcgcacgcacaatcctgtcagaaaaccacaagtccgcaacgccgccgccgccattgtcatg

SEQ ID NO: 38335 - DNA, 186 bp, Oryza sativa
caggtcgactctagaggatccccgacgggcgtggagcatgagaaagaaaaaaatcatgtccttattccctcatgcgtccttatcttcatgcacatgtcgctcttctccccttcatattcgctcctatcctgaaccgtgcctatcattctcccttgcaaggccacatgcccctctctctctctgcca

SEQ ID NO: 38336 - DNA, 156 bp, Oryza sativa
tcattgataaggttggaagttgtgttgtagtatatcttagcctcgctcccatgctcgcattgaacgtgttacatgcccttagagaaaaggaccgacctagccctatcgctactcgtgatggctcaggctactacatcctcatcgtcattcgctagt

SEQ ID NO: 38337 - DNA, 305 bp, Oryza sativa
aagctttcaacctgcgtgcaaaatcagactcaagttaggacttggtttgaaaaaaaaaaactgtaaggcatcagtttatgagtagaaacgtgaaggaggtcacacggaatgaaccggcgatatgcaaaatctaggtttatatccatcaaaacagcccattttttttaagaaaaaaaatgagcgcatgatcaaggactgcaacgctggcaggctgccagcctgcgaaaatggtcgcgatgactaaactcaacaggccaagatttagggttcgatatggctctaccccttcttgaattccacctagg

SEQ ID NO: 38338 - DNA, 422 bp, Oryza sativa
ataactaggggcgtaaaaaagacgacgctacgctacagtacagagccgagattgaaaacgatagagggagagagagggggagggaccccccccttctttttaaaccttttttatgttgcacgcatccagggagaggattggcagtggagagagagagagagagagagagagagagagagagagaggtgtccatagcaagcagagcaggagcagagccaactgcacaaggcaaggcagggggcctctcctcgctgttctactgctgctatactctggcatcgcgtcgcgcgcgcaagcaaaagggtagttcctcaatcaaacgctccaagagaaatcaccccgccacgccacgccgcgccgggctgggctgctgctcccagatctcgccgagcggggcgctcgattatgtgggattaggtaga

SEQ ID NO: 38339 - DNA, 341 bp, Oryza sativa
acaatagcggatatctcgacccccgaactattggaaccggtgcaatttgactatctcgatagttttgaaagatggtttcgctaatgtggtggtgttgacctaatcttcgctaaggaaaaaaaaactataatgataacaaaatacgtatagtatcatctacgattctgaggaaacagacgcgttgatgatactatacgtattttgttatcattatatagtatcatctacgattctgaggaaacagacgcgttgatattcatttttgttctggaatccttctatttaccattcttgggagcacgattaacttcttattcttattagataatattttgtacaga

SEQ ID NO: 38340 - DNA, 269 bp, Oryza sativa
cccggttttcgtaagttgggggatgggtcatacccggttttgcggtaaagggacgaaaatcggactgggcgacaaattgagggacccaaagtgaacttattccccatgagaatgagagagcacggtcgcagcccagtgaatcctagtatcctaactggactgggccttggtcggcgtcggcctcgggacgaattctacgcccaggcctacatatcctagctagccagatgatcaatttcgccactgatcgatctcaatcttcctccagg

SEQ ID NO: 38341 - DNA, 948 bp, Oryza sativa
aaggtttgtcagttcttacatagtcctacaatgcaacattggatggcagtaaagagaattttgagatatgtaaagtcttctgtagatttgggtctgaagcttaatagttcatcttctactattataagcgctttttcagatgctgattgggctggatcagttgatgacagaagatcaactggtggtttcgctatctttcttgggtccaatttggtttcttggagtgcacgaagcagagtacgaagcagagtataagctacagtatcctgttctatacagaagcagagtacaaagcagtagctaatgctacagctgaggttatatggattcaaactttattgaaggaaatagatgttcaaacaccgcaagaagcatgtttgtggtgtgataatttggaagccatgtatctttcagttaatccggtttttcatgcaaggacaaagcacattgaagttgattatcattttgttagagaaagagtggctcaaaagcaattggttattaagtttattgcttctggagatcagattgcagatggatttactaagtctctttcagctcaacaattcaagaattttgtatacaatcttaacttagataagttatgattgaggggggctgttagagataaagtatggtttagatttgcataggcttagagataagtctagagtttgtttctcacatgaaacaatgttttatctcttgtaatcggatccaaactgattcaatcttgtaagccacgttgagggttcttctcaacaacatataaatattcatacgcggcctcgagacgaggtgagaacgcttacgcacttttacagtgttcgtgcgtgccggtcgacctcgcactgttggatatggagctcgaggagaagatggctgctagggcattgggcaagggcatcagcagcagcaacaatggctgcgaaggcggcggcgacgagc

SEQ ID NO: 38342 - DNA, 257 bp, Oryza sativa
ccgaatccgatcgagacgaatcgagagagagagaggcgccgcggatccgggtaagcatgctcgagcttccaccgcgcatggctggtcgcatccgccgcttctcctagtagatttctttttctctctcttgatgtggatgctggtgcatttttcctctgccatttcttttgattttttttttttttggggggggggggggagttttggcggtgaggcggaggtgctccactcatgattatctccatgtgtgctccaga

SEQ ID NO: 38343 - DNA, 525 bp, Oryza sativa
cttagtatgtaattattgactacggaattggtgcgacaagtagcaattgactattgtagtcttaattagacttagcatatacatgactattttagtcttagcatgtaatattatttgagttttaatataagattactttatttgtaattagacttagtatgtaattattgactacggaattggtgcgacaagtagcaattgactattgtagtcttaattagacttagcatatacgcacgaaacacttagcatatacatgactattgtagtcttagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacaga

SEQ ID NO: 38344 - DNA, 1501 bp, Oryza sativa
cttgctgagtactgtggttgtactcactcttgctcaatttttccccaacccagaagaggagttcctggaagatgaaggctttggtgtctagcttgtgcctgccgtcaagtgcctgtggtcgtcgccctagtcttccgttgttttccgtttatcttcgtgtgtgctgggccttcgtcgcccatgtaataaattaactatttacgcttccacttgttaaactctgaattgtatcaacttttggtgtaccttgcctcctgggacaaggaataatacacgcacaaatggaatgcctgttgggttaattccggtcgagaaaagttggtatcagagcctccttgaccctaggacgagccttagatcccaagccttagcagtattctgaaataaaaatcttctcttatttccgaaaatcctttagtctctccctgtcttgctgcttcatttatcatcaaaaagttgatctttaaaatttttcttttgcctttgtttatagatggccgacaacctcaaccgtcgtggtctggatctgactggcttcgctttgtaactgtggggcatgtgcattgtcctgggatatccgcatggagtggactaccagggcaagaagcttccccgcgccgcttgggaggtcactgcggtgatcctcaccggctctcccgagaggacttcgttggcagtcaccgcgggtggagactctttccccgccgcttgccagaacgccgcgctcctcgccatgcactattcaccaacgctatccgggcgagttgcagcactcgccctaccgctaccaccctcgtcgtggaggagcccgcgactacgccatgttcagggatgctggctcggaggatgacgctaccatcatgcacctggtgcgcatggtggaggcgtacgtcacggcccgcatcgacttccatcatatggtgcaccgtgggctggtcgagaacaacatgaagatcctgtagctgcgtcaggagaatttgcagctgaagaaggacttggacgccatggagcgtagctgtatcagctcaagattgctcaaggacaggcctgccgccccaagcgccgccgtgtctgccgcagccagaagatcaccgcccgcaagagtacctccaggcctgagcttgttcgtcagtccttggcgtggacttgcttcgtggagactccttgcgccaagcccgcgcccttggttcctcaggaggagggagcctctggcgttagtagcacggaggatgtgctgttactcaccttccgccccggcccgtcgcagaagtagacgagcagttagtaggcccgcgcgtgtgttcttttcgtttgttttcttgcagagtcgtgtggggcatggttataccggtgtgtggtataactatgtcggagcctgtctttattttatttgcataagcagcttgaaccttaatgaaccaatttaatagcagaaataaactcaagaattatggtagtcgtgggtggttatttttaatcatcagctcctagtgttttcaga

SEQ ID NO: 38345 - DNA, 1501 bp, Oryza sativa
cctggttcccctccacatccctttccacgtgcccctgctggttcccctccgcatctgtcacgaccggaaatcacccaacgggcgttccttacgtgcgtgcattaatccttgtcccaggaggcaaggtacaccaaaagttgatacaattcagagtttaacaagcggaagcgtaaatagttaatttattacatgggcagcgaaggccgagcacacacagagacaaacgagaaacagcggaagactagggcgacgaccacaggcacttgacggcaggcacgagctagacaccaaagccttcatcctccaggaactcctcttctgggtttgggaaaaattgagcaagactgagtacaaccaccgtactcaacaagacacacccacaagtgcaggataaatgcaagggagtacaaaggagttacactataaagggttagggttgcagtaaacagcatttaaagacattagttgctcaaagctattttgtaaacgcgattctagaactaaacaatattatttatcaaggccggtgaacccacacgaacctgccttaacccaaggcgtacgatgattcagaccgaactggcaacccgaccgtgggtcccagctcgtcccaagccaactcaggccaaccattccacattttagttgttaagcaggttttaagaattaaaacactacttgggtacattgctcggcttgcccataaccgagggcgcggctattcgaatagattatactctgatcagaggtgtacatctttacccacaagacacatcttcctcacgtgtaaccacgtgccacataccaccacggtatacagacggaagacgtgacatagtttccaacccatcctagccatagacaagagtaccaacccaatcccacctacggccggaacacccgggacaggcaggcaggactgagcccctagcagcaggacaccggccctgtgccatgacatctcgactaccgggccgcagctcgtgtagccttcatttgccctggagaatgtccatcgacccccgacttcatccacctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccatttttggggattttgaatagagggggcggtgtgaatccaattccacaataaccaaaccattccatggtgtccaggtgatatgaatattcccaaagtctagagttgtaaaaccgcctaatgttacctaattaaaagcgaagcatctacctaaaatcatactagtgggaccatgagtagagtgtccactagttggggttttgtttatgctagggtgaacaaggaaataataacaataacaataataaggtcataacaaaggtaaatgggcatggctaaataaaacagtgataacgcggg

SEQ ID NO: 38346 - DNA, 1501 bp, Oryza sativa
ctcttaaaaaagagcatcattcagtgtgaaggaaagtggagggataagattataagaacctggccgtgtcaagggcgatcttcatccggatgtgccagctcagagttgatccatgtgaagaccctgaagacaaccactacacatatcaaaagctcccaatctggaaggaagatctcatctcatggaagagctaagctgcagctagctgtgactgtgagtgagtgacaactgacaaggcagagcccaatcatacaggacaataaatactataccatgaagctgtgtttccagtgatcccttctccatcagctcataaacaatgtagtgattcccctcatggatacagaagcccaagagggacacaatgttggggtgcctgatcctgccaagcaaatccagctcattctgccaacaaccacaaccccaaagcaattcagctcaacaacactgaacaccatacttccccttatcaatgggaactgaacttttacggtacaatttactgatagtatatactgtcagtatataggttgcaagtttactgatgggctaatggcattgcgttgtttatactgacagtatatactactactagtaaattgtaccgtaaaagttctcaccaacaattgaccatgaccagcaacagagtcacctcgaattccttctcgcagtcgggcccgccgccgtcgagccgcttcaccgccgcggtaactccggcgtcgaacgccgccttgtagacgcggccaaacccgccgacaccgagcatgttgctctcgctgaacttctctgtcgctgcctccagcgacgggtactcgaacatcccaaccagcctcttcctgctcatcttcaccgagttgaacctgctcaagatcggcaccagcttgatccccttcgctgcgtctgaaccatgtggattaagccagaattgtaattacagatagctcaagaacccaaaattgggtgagcgattgaatgagcggggttaagatcgacctgagctcctggtgaccttgccgccggtgctccggcgagatcgccgccatagtgtccaagcgtagagcgtggaaaggaagatcgtgacggtggcgatgcaggcgaggacggcggcgatgaccagctcgcggtggaaatggtggtgcactacgatcactgcaagccagcacaggtagcttgagacccactaagtaggagtaaattaattggacatgaacagatgcgccatctttttttttttttggtttaatctttgaaacggccttgaatcctggaaagatttgatgacagtaaactctaacgaaagaacaggtacgattgcattaaaacacgcagcgagatttccgcaataacgttgatgccacgtttttccccctcaaatttgaacaaaacgtaacatcccaaaatgcagattttgagaactcaaaacaaagaagattttctttttgttcagctagaaataaagcagagttgttggttcgaatgcaggcaacacaatgtcgatccc

SEQ ID NO: 38347 - DNA, 224 bp, Oryza sativa
catactaattcattatgtatgtcattattagtatttctttgtggtatcgtttacacaaacagaacgaaagcagaagaaagctgctgtgagggggtcctgttacaaagacaagtggtaaatgtcatcttttgctcgagatttggacggagggtcaacatgaagcggctggagtagcagaagaggaagatctgatgcaatcatggcttaagttgcctcctttcagg

SEQ ID NO: 38348 - DNA, 1501 bp, Oryza sativa
gaattcggattcgtcgaaaatttaagagaccaaaagttaacttattccaaatggaaaatgaggcctgtgcttcggccctcctaggctgcgcggtgtgtgtgggtccatgatgtggtcagggccgatttggatatctatgcatctttcgaaagatttttataatcatatcacacagatttttaattcttggattaaaatccaatagacacagtaaaatacaaaaaacaactaagaaacaccataatggatactatattaccatatcttcagaaaaaaaagaccaaatccaatataaatttcaaaacttatatgcgaagattcaaaaattacactgtaacttacaaaagttacagtgcaaatttcataaattatattgtaacttacaagaaaacacactgtaaatttgagtgagaaaatcgagtaagagataagaaaaaatctttcgagtgagatatagcaaaatcgttctttgatcagtaaatgtttccgaatttccaagacaagatagctactcccttcgttccagaatatattaacctaaaaccggattggatgtactatgaatctggacatacctctgtctagattcgtagtactaggatatatcacatccggtggttttaggttgctatattctaagatgtagggagtagactatttggattgacctatcatttttagagtgggctcatggataggtagcctttggtgcctggtgtaagattttcacattttgatcataattgattggattgaccatattatttgtgacataaaacaagctttgaaagagactttcttggtcctgtaaacaagtatcgaggaccttttttttttaaaaaaaaaagaaacacagtggttcatacacgcaagtacactcatcctataaacacagcatacccttccccaacaaaaacttcgagagagtgagacggtatatcaagattgataaaatcatcaaaggtgctatgctatagacaggtacctcgcttatcactggaataataattaatcgtacgtacgagtgctgccatgtcaagtttttgagttgaatttgtgttggttaaaaaaaaatataaccagctgatttaccctcaatttacttgaaatatagtaggtctcaaaaattttacatttgttatccatgtacacaaatttcatgatcgtgttttcattttgaaggcgttgttgaatttcacacactttatagaaaaaaagtaaaaacttgtgttcaatccttataattagcctggtattaaatttgattaaaaatgattccgtagttggttatttcaatttaacgtggatgccttagcaatgtttgaatttggaaaattctaatttctattgttttttatgtactatgtgggatttttatttgcatcccaaactccacgaaagaataaaaactctagagaaaactaacatagtactccctttttcacagctgaacatgtgttttactttaaatatttaaatttgaggtatatcattgcaacga

SEQ ID NO: 38349 - DNA, 175 bp, Oryza sativa
gataagctaaaatcacacctacccagtacatccttgaaggcaggccagacaacttacggttaaaagactaattggagtactttttttatttttgaatagtctaactggagtacttcacccggaaacaaaaccccattgtggcattgtgcattcaacatacccttatccacttagt

SEQ ID NO: 38350 - DNA, 418 bp, Oryza sativa
gaggaccttgcccatagagaggggggggattcttttcgagatttagagcttagaacgggggatttttggtcctttcggaaggctgagaggaaaggaagtcgatcctttgtaacttgtccatacacaaatccacaaaaacacaggagtagggtattacgcttcgcagcggcccgaacctgtatacatcgtcgtgtctcgtgtgtcttgcgggcagacgatctttccagatacagagggagagcgagagcttgagatttcaccctaagcccccggccgaaccggcaaaggggggcctgcgcggtctcccggtgaggagccacgagctccgtcatctggcgcgccaggtagggggctcagcgtgtgttttctgagctctcagactcttccgtgtgcgccaagtttttcttgttcagcctaa

SEQ ID NO: 38351 - DNA, 315 bp, Oryza sativa
agggcctttttccaagctgccactattggtttttgagcgatggtgcttttttttttaggaaattttgttacaggacactgctattgtgtagttttagccttaggacactgccaaaactaacttttgagggaaacatccataatcgtggtattttgccaatggacaccgcgccgactaaaacaataatttacagttgaagaggagagagaaatcacgtgaaatgccaaaaatacccttgggctcacatgtcagctatcctatctcttgtatatgtggggtccacatggcagtgacttagtgcgaagctgactagca

SEQ ID NO: 38352 - DNA, 1501 bp, Oryza sativa
ttttaatgttttcaactactatttttaaatggctgctttatgcaaatgaacccctagcctcctttggttatatcctgcatcatatctcctcttccggtatgacttgctgagtacagtgggtagtactcagtcttgctctcttttcccccacaccagagctgaagatcttcctagttggagctgtcttgttgaagttggtttcgtcgttgccgtcaagggttgcctgtggagtggagtcgccccgctgcagaattcaagcgtccaagtctagctcgttttaccttttccgctgcatttgtaatcttttatatttttggtaagacgtggatctgtatgtcaacaattatcgtttgtgtaccctggctggtcctggacagggatttaatgtacattcagcttagaaattctggttagtaaatttctgggcgtgacaagttggtatcagagccgaccttgaccgtaggacaagccaactggaaacctaagagccctctcaaccccttttcatctgcatatgccttttgcacctggatttgttttgggaaaatttggggttttgcctctttggtttgtgggaaaaatcttggtcgttcattcagatcggatctttaaaattagctcagtctagggttttagtaagattttatttggagtttattcgacagtcactcgggaatctattgggtggtatgcactaagtcgtgtctaggttcgatggggcaattttacgcgtatcattatgactatgcatctattttatgcattaatttagtgtttagttagttacattagtatcctctgtttgggttcatcaaaagtgttatatgcataaaaatcagccatgctcagttatttgtttgagtaatttgttgctttgtttatttggatttgagcatgcgttgattccttatctctagcccgctgctacagatctatagcccgctgctcttctctctctttatttatctctttaaaatatgtttatagctggtttatagcctgctattgtacctgctcttaagctttattgtaattctaagggggggtgtttagatataggggtgtaaagttctatcgtctcacatcgggtattatatagagtgtcatatggagtgttcgggcactaataaaaaaactaattatagaatctgtcagtaaacagcgagaggaatttattaagcctaattaattcattattagcaaatgtttactgtagcaccacattgttaaattatggagtaattagacttgaaaattgttttagcttgtatttaatattttatgtaggtattcaaacatttgatgtgacaaaggtataaattttttttgttaggaactaaaaagggccatagcatggagaccgctttgcttccattccaccaatttcacttatggcaagtggtaactactcccatgatggaacggcctgcatttaccgggaatagcgtgcaatagcctttctgggtccgtaggcctggcctggaaggggcaagggcatagg

SEQ ID NO: 38353 - DNA, 1501 bp, Oryza sativa
acaacaagaaggcaaaacaactagaaaaaacaagaatgctcacttgatctctgcactatcaaacaacgaggcagcgttaccagttacctgccatttttgaactgatgcctacatagttttaaggatacacttcactacctcaacaatctggtgcttataagaagcatattcaatatgttgttattatttgtaagcaatagcagcacgatccatgtcttggtactaatgcatttcagtgactttcttgcaatcgtattttgtataagctcattgctcaatgaactttaacttaagctaatattcggagtactgttccattgataaatgtaggttttgatggagtccattgccttggaaagattaatgctcatggttttattattaccaatctatatctatactaatataaaaatgaggagttcacctcttccaatcctacaggccaaatcaacttatgaaatccctaccgttcatctgcatctacattgccctgagccctaatccctgccgtccacccacatcgcaggccccattctatctccaccgctattttcgctcgatgtgccatcctcctcgcgttaacaccgccgccgctcgcaataacactgtcgtttctccatcttccccagatgacgtgagccccctcgctcctgctaatagcctagcgctgcttctcgaggcgcggtgtgagccgcccacagatgcagcggcgaccgacgaggtgggcaacaagaagctagcgtcagtgtagggtgccctcgagatcatcacgcaggcacggaggtggagctagggtcacaggcagcaaatggcgtgcatcctatcgcttctcttctggaaacgatgttgatgagatgccgctgcgccttggtcaccatcgctccgttgggagaccacctccccaaatcagtaatggctggcacctcccccaagctcccatcgaatccaccagtctcctccaccaccagacccgtttggccttcttctccatcagatccatgtatatatccaacctctgaggcaccgtggggccactggatcaggcctactcagtgacgacggtgaggaggaagcttgtggcgccgcggagaggcaatgggggcggtttcaggctcgataggcttgtgagtggtcataagactcatgacctccgtgcgcggcggagctcggtgccatgaagcgcgtgttggaggacacggagtagtaattcagtggcgcatgctgcccttgtcggtgcgtccatccatccactctgtctctgtctctgtctctttctcttgatactcgatagcatttggtgaactgtctccctaattacagccagttttgcctgattcaactgggattgttttgttttgttgcgtgcagtgatgatcttgcttctccatgagtaaatatcaaagcctcgaaagtgggatctgatttggatgcacttaaggtcagtaatatccagtttccctgcagtatgtactgttgtttgctgttggaattcgttaattta

SEQ ID NO: 38354 - DNA, 1020 bp, Oryza sativa
tggagagttacgcattaaatccgagaaagtcattaagatgataggtggttagattgaaatatgcctatcaaaaataaattttcagatttagaaatatgtctatcaaaaatagatggagagagtatctgtataagttggaatcaataacatcgagatctaaaactgaatggaagctgcactgacctatactactactaccagcctgcagggccttaggagctcatggcagttgtcctgaccgcactgccttaggactggccctgtacaaaataagtaaaagaaatagtttacagggttaagtgttttaatgaaatagttcagatgactaaaataatttattttttcagaataagttcagtgtatcattttttttacaccagttcagtgaatcattttgaggggaagagagtgagccattatgagggggttacgtgcaagcaaaacccgaactgcacatcaaaatccagcccagcaaggcctgtttacgaaaagggcgtggcccaactaacgcacaaaagacagaagcacaaaggcccacattcccaacaagaacgcgtcgattttctcccgtgcagccacgtacgctttgcgttgccgcttccccagcaccgccaaatctaatccatgatccatcatctcaatctcttccctcccaaatcgacatcttaacgattccttttgcttaaaaccttaacctaaaacaagtgtatcagtctcagcaatgtccatgatagtaatagccaccaccatctatctgcatccatgatctctctctctctctctctctctctgttgcttccaagccaagacgaccctgtcttgctcactgactgtacgtacatggatctcatcaagctcagctcccatgcctccctccggtataaattgcagccatgtggagcttcaccaccggcggcggcggcggccatggagacgtcgtacagggaggaagaagcgaggaggaaggcatccctgctccactgcatcttcttcttcctcctcggagctctcgccatggcc

SEQ ID NO: 38355 - DNA, 162 bp, Oryza sativa
taacatttaatccattattatagtccaacattagttttgttggttgatctgctattacgcttaaacggtgttcttcatatttgaccctaggaggaggctagcggcctgaactctcagatctagaggctgcagtggccggtcgagatcgagctggtgccggca

SEQ ID NO: 38356 - DNA, 484 bp, Oryza sativa
tcatgggatctaaacaaaccctaattttagccagacgtgtcacgtatatgatatttccttggctaattaaatttaagcatttgaaacaatctgtcaaaaacataaacatgcgcatatttgaatcaatcacataaagaaaaaaatgagtaaaattaagtgaaaaatatgatgctatatttttaccaaataaactcatatggccatatatcacttaataaccaattaaccatgatgccatcagtcaaaaaaagaaaaaaaaaccatcctaactaaaacccaaactaaaccactgtcacggccaaatcctcttttcaaccatgcagcacattaatcaaacccccataaactccaagcctctccaatccaaccataaagcaacaagagagaaaagaaaaagaaaggaaaaaaaaaaccaagcctcagctcagctccccagttgcttcccctgctgcatttattaatccaaagcagcttccttttactc

SEQ ID NO: 38357 - DNA, 532 bp, Oryza sativa
cctatagataaccattgtgggtgcccttattggaaaaattgcttttggacatgcaggaaaccacatgtgtgttcttttccccttttgtcacaacactaacaagaaatgaaaggaaccaaatcatttcacttgtgtctgttttgatgagtttttctgctagttctcagtcctctctcacttgccatcaaacccgacggcaatgataaactatggatgtaaacagaaatggagtcgaattcctaagaggcagcggctgcggatgatgtatttttgtcaattctaggtgacatgtcatatatacaaggcgtcctcatgtgatagttagttgactaaatgactcagttgactcactaacgtgattcagatgtgcaatttaaaattagaagagtgacctatgtgacacgtctaaataagttagatgaccctctccaagcattttactctaacttttatatatcgtgcggatgatggagaacgacaaaatacatctatatgcacttgtatcagcccatgtacgtctctcttttctagg

SEQ ID NO: 38358 - DNA, 1501 bp, Oryza sativa
cgccgtgcgccaccgtcgctgccgccgtcgtcaccgctgctgccgccggtgagccgccctccttccccctcgtgtccaccgccgccgccgctctggtgggagagagccaagagagagagggagaggaaaagagaggccggcagagagaaaaagagagaaagagagaaaagaaagaaaaagagagagagagaaaagaaagaaaaagaaagaaaaagagaagagagaatggagaaaaagaaaaggaaaaataaatagaaaattaggaagaaattaaggaggttaatagtttaagaaaatctaaaataattagaatttaattatagattaattatggtcatagaattgcaaaatttaatataaattatagattattcttggtaatttctacaagaaatcaattcgcggtagtagtttaactgtaattaggaactaaacgattagatgaattcttatagactattatagattattttgggtaatctctataagtaatcgattcacggtagaaattcggatttatttactagggattttagccgtatattatatttaatcatttagtcatagactaaattaaatcatataatatttctaggatttcgtccgatatttagctcgcgatagaaatctctaacctattatatggatataatgctcgggtagattaaattaaaaacttatgacaacaaaacatttatacccgcaaaatagtttgaatcgaaattgggtttgccttagttcgcgaataataaagttaaaataaaggaatcgactttcgcgttcgacttccatttggatttatttggattttttatttgaattctaatcgaatccaaatcagttttcgcacgtaactatagagcccgagggagttgcggatccaagtgaaggccaagacccccaagaccttgagcaaggcaagtcatcactattccttgaacatgttgatcccaattgcgaaattattttgtttataaataaaattgcatgcaatgatgaacatcctacttgtgattatgccatgccttgattattgtttatcccttattccttcgtaaccatgtttacgtatgagtccctagtcaattatgacaattgcttagaaatgctattctaggatcatgcatactcatatttatcaaatgctaaatgcttgggcaattacctttgggaaggtaattgagatgcggtatgtggagacatgagcgccacattgccatgaaattgataacatgatttgtgaaaggaaaataaagcgaaaacaactgttttcgactggggcggacggatgatttgggtggtatctggaaaaggctagtaccgtccccagtcaattaaggaccgagccatgaagttaagcatgaaacgacccccgtacaactgtacttctcgaatgggtatagacctagcggattagatagccgagcggaggcagtatccctgcatagatggttcacccctgagtgaggcaggtgcgctacgatgggacagccgttgaggt

SEQ ID NO: 38359 - DNA, 209 bp, Oryza sativa
ctgttctttcgtctctgcgtttttacccaaaagaaaatcaaatttgactaaaacttgtaataattgagcaaatcacaattgcatgcaagaacatggtgtaccgtacccggacaatccggccggacgaacgtgctcccatgtgcttgtaaatgtatgattatttaattttgatttaattactgtattaatcaattttgattatgtgtgat

SEQ ID NO: 38360 - DNA, 984 bp, Oryza sativa
tactggacatacagcttgttagtataatgtgattatagcaaaacgtaaataaccaatacctgggcccataagtctgaatccaaagtcagatatagcagcttgccatggtaggagaaccatcgatatactcaaaacaaatctaaaaatatgcaagtacatgaatagcatccaaaaattcagttgaattctatactactccaaaaggtgtgaatctagaagtgcaagttagataaagtaggaaaagaccaaaatagctttgatttatcacttgtcaagttatcagttcatatctatttctaaaagctatcaaacaaaatagaaaatgcataagcaaaccatgcagtaaagctaagttaccatcaaattaatccatgggagaaaggatgcagcataatgggaacaaagaccatatatatcctagtttgatgagtataggtatactggattaaatatgaaaataacaaaaactccattaacaaactaactaaaaacacatgttgaacttgccaatttgaagctagctgctagcaaggtgcacctgaattgattttaaaattttaaaagtaaaaaggatacgattgagatccatattttcaagatgctcaaccaattgtatatgttcatgcagaaaaacattaggtaaccacaaaagaaaaaatgacatgcctcatgccatctctttgtaaaagcaattattcaatcaccaatattgtatgaaaaatcaattcttaagcttagtacaaaatgcatattgtaatcgttaccttctatctaaattaatttccatggtaggacaatgaagcaaatattttttttattctttctatctaagatcctgcatagaaaattatggttcggctaaatttggattatttcatttaaagatcactaaagctccaaaaagaatgattatcaataatggtaggtagtcctgggttagtttttggttcagaaagttaccacatccatcaaagaaagctaaga

SEQ ID NO: 38361 - DNA, 1352 bp, Oryza sativa
aggggtgaggatatcaaagagaggagagagagatggggagaggagaagagatgaaaatttttgaaagggtgaggagggaaagaattgttaatgtgaaaaactttgaatcaaattttatgatattaaatgaatttttatgaaaaagttgtcaaaataaagttgtagaactcgttaagatctaccaattttattttggtcatttctcgataactcatcaatatctataacttttgttttggtcattttgctatgactttatttcaataatttgaatttgaatttcaaattgtgacatcttcaaacaacattttcaaatattgaaacaaagtcatatagcaaaatgaccaaaacaaaagttatagatcttgataagttatacaactttgttattggtaatttttttatttgaaatcatttactactcgaaaaattatttgaattgagaggagagaggcaaaatagacttctcggtaagggaggaacaaaagggctgggccggcagcccgaagagggctgggccggcagcccgaagagggaggaggagggagagagaggttataggctgagagagggagaaagtaatacttgggccgaaaaaggcccaaggacagagagaggaattttaatttgctttctatttattttaacaggttaaatgaactttgtggtattaaaattagttattgagcttcgaaaatttacgaaaaattttagagaattatttagaccacgtagaatattacaaaaatatttccggccatgatttttaaaggaatattttagtttccccattaattcacttgattaaattgctttaacttttaatatatttttttagaaatgcattatataaatttatgacgtttgctttgtgccccttatgacaaattaatattcgtcacgatgtcccattgaaatactttatgacgatttctagttggtattaacgacgaacacctttttttcatcactaagccaccccatctcatacttatcatcataaaatggaatgtgctagtgacgaatagctccgtcgtcacgaggaattcgtcacagaaggtcatatttcttgtagtggttaattcttttttatttaatcaaccgatatataactttgtttgataacttagttgatcactaatggatttgaatatatgtggtctagtagagaagcacttgacagaagagataatatcattgaatcgactattcatagtattattattcaacgaccttattatataacctccatagcacatagtgatcagacccatctgatctcaaagctggcatccccagtgttgatagtaggcccaatgggcacattggaagcagagtgagccgagtattca

SEQ ID NO: 38362 - DNA, 1220 bp, Oryza sativa
acatacaaaacaaaactagtccacatcgaacatcacataatccacataatgcataagtccatcacatagtccaattcataggaaacatacaaaacaaaactaatccacatcaaacatcacatagtccataagtccatcacataatccacaactccatcacataatccataagttcacaagtccatcacataatccacaagtccatcgcatagtccataagttcacaagtccacatgtgcattaaacaagttaacacatatcagaaaaagttaaacttcctagaaatcacttcttgcgttgacgccaaagagcttgcgagcctggagtgtacctatatttgaaaaaccaatgttcacaacatttacaaatcgaagcgagggaaatcaaataacatatgagaatggtaagcccagtgtaactctttttccttgaccgagtggatcgtaagttgtaggtggtgggctgcgacgcctgagacacatcgggcagctgcaacatgcctatctcgtctgcgtctggtgtgatgtagtcgtcgtacaaaaataaaccaaacaacttttaaaattgttacggtataccccattcaccattcaccatacaggactgactttaccgggggcatcgtcaaaatatgtctacgtacagaccattcggggtcgctttgacttttctttttattagaaacgtttgaccatttgtattatttcaaaaattagtgcaaatataaaaaagattcatacttaaattgataataaagcaactcaaaaaagagtaaataataattccataattttttgaataagacgaatgataaaaccttacaaacaaaaactcaaagcgacaagtattttaggatggaggtagtactctcttcatccagaatataaatatctagataacttgccatgccgcatcctccttaaactcgatctcttctggataaatttccttaaatagattaatttctttaaccgaatcctccatgaatccgactgctggcgacttgataactcccatcggttgattccagaactctaaagctgatattgattttaggctgatgacatctttggggcttaccaaatttcactatcaacattggtggacagcatggtggcgacggcgaagcgggacggtgcggctgctgggtgacgacgattgagtgggggctcctcactctcacctccctcccgttgcccctgcctccattcatgacgaga

SEQ ID NO: 38363 - DNA, 1501 bp, Oryza sativa
cgaccttggcgacagcggcggcccaggacagcagcgaccttagctctggcgcaaggctcttagcgaggaacaggcggaggtcaacccaggcggcagcggcggtgggcctaggggcagcgggacaccgggacccgggacggcaatggcttgagcaccggcacgacgctcccagcgaggagcaaggctgaggttgactctagcggcggcaatggccctatgggcaacggtggcgccctgagaacgggcacaggactctcaatgaggagcaggtggaggtcggccccagcggcggcgggctgggagtacaaaaggcggacaaacatcctctgacgacaacgatggccctatgggcggcagaggccaaggaattttggcgaagtggaagtcgatcccgtcggctcgcggctagttctgactaaacaccgaacgatgatggatgaaagtcagatgaagatggcaccaacgaaggttgacaacgacggcacactaggggccgcggcgactagacgacttccactcgctagtatgtcgggaagaagagaaggaggggtgtgccgaggtcatttgtttttcttttcttttttgattgagtgttctcctccttgttgaggtgtgagtctaagtgttcttatatccttttggctctgtatatcctatccttcatgtatatagaggccggactaatgaaaatctattatctaaaaaaaatcttccactcacaccaaagccaaatataatccacacaaacaaaacgagctcctgccaaacttggtaaaggtgataggcaccgaaagccacctcacttccaatggacggcagaatcccagctatagctagctagcttaggttcttcgttccgggatcagttgacagtgtcccccatcacatctgcttcccctctgcatcgtctgtcaatacgatccgcggttcggctggtttccactttctccaggcagactggcgtttttccaagctgtcatttgctagtggttgctattagtgatttgattggaacctgtagtaccggctagtggatgtcgttcacatctgatgttccaagaagcaagagcagcgaattaaccaggtttgttcatacagcaacgagcagcaggaagcaattgcacattgtttgaacattcactgaaccgggaggtgagatagccgttccttgactcatgtcatcactcatcacatctgatcagggtcaatgaggaggaatatccaatattacctttgtttattaccaacctcttgaaattaagatacttgaacaatgctgaaaaattctggaaatacttcaagagtagggcactggtattatatacataccaataccatcctgaaaatgttagaggacggtcagggcaccaaggttcagtgttgtgcaatatgatctatgatgctgatctacttgtagtttaatacaggatgggatcaaacagctgaaagtacagaacttctcgtagttgtaaaagggagtatgtagtcaaaactcagaaag

SEQ ID NO: 38364 - DNA, 247 bp, Oryza sativa
ttcttgttattcatctttccaatctacaatttgcagaatttccgaacccttcgtttgctctgattgcaggtgaatctacaggattacagctatctggatgtgctttcttcagtaaacaagagtacaatcctccaaactctacattttccttgcctcaaatcccacccagagaaaaggcattatgcaagtgttcccaactcttatagcaaattgatgtgaacgaatcctcaaacttttgatcctgata

SEQ ID NO: 38365 - DNA, 359 bp, Oryza sativa
tgctaagtgtttcgggcgtatatgctaagtctaattaagactacaatagtcaattgctacttgtcgcaccacttcggtagtcaataattacatactaagtctaattacaaataaagtaatcttatattaaaactcaaataatattagaacacctacacaatcttatatgataagtctaattacaggtctaataatcttaattaattgcattacaaatataacaatcatttatattattacgtcacttgcctgcgccaattccttctagggctagctcttccactcaggcttgacggacgactcccacaacacgttttttctgcaagatacaaaaagatgtattaggataaatgcgaagt

SEQ ID NO: 38366 - DNA, 291 bp, Oryza sativa
acataggatacatattaaaattgaccaactctataaagtctgcatcctgccccaacccctttactggttctaggaaaactttaaaacgatggccatttaccttaaaaatactaccttcgttatcctgcagcttgaccgctccgtgtggcaaaatatgtagacataggatacatattaaaattgaccaactctataaaatctgcatcctgccccaacccctttactggttctaggaaaacttttaaacgatggccatttaccttaaaaatgctaccttcgttatcctgcagc

SEQ ID NO: 38367 - DNA, 264 bp, Oryza sativa
gacaaaggggaccccttcgctcgtgctggatatggaaatttaacgactacgccggtttatcttatatttgcattgattcatgcataatcatatatcgaatgagtggagggcacgtgggacaaaagaattctgctagagaacagagtatgttctgtcctgatgaatcccctaatgattttggtaaaaatcattaagttaaggtggatacacatcttgtcatatgatcaaatggtttcgcgaaaaatcaataatcagacaacaaga

SEQ ID NO: 38368 - DNA, 1501 bp, Oryza sativa
cgcgcacgtcgtcgatcgtttgccggccagcgattttcccccgggtttgaagtcaacaaaagcgatcggctggcggcttccgtttcgtcaggtcctaatcgcaaatctctttctccatgacgccgattaataaagtatatacaacttcagatgcaaattggaatctttgttcttgtttagtactctttccgtttcacaatataagtcattctaacatttcccacattcatattgatgttaatgaatctagatagatatatatgtcttagattcattaacatctatatctatctagattcattaacatctatatctatctagattcattaacatcaatatgaatatgggaaatactaaaataacttatattgtgaaatagagggagtatttttttagtgtgactttaattaaagtgagcgtgggacgattctgattcgcatcggcgaataatctgcgtgattttatgcaattatttgaaacgatttgagttcaaaaagaaaatcaaatgattatagcccaaaagaaacaaaggaatacaggctgatgatgagactgcgagagatcatcaaatcccacctatctaaagactaatgggccggaattctggcctgttaaatgggcctacatgggccgcatgattaataagcccaaatcttagggccgaaacataataggccgtacgtataacgggccgtaagttaaaacggcccgcagattaacaggccggatttttccacgttgacttgtcgcacgaaaaggtcatgtcaatgggcagcttaatgagctggcacttcgaagccccacaaatacttagcaggccgaaattttgtttgaaggttaacaggccgaaatttgacactcaaattttcaggtttttggaggaaaacacaaaataataatccctccgtttgttaataattgataattttgactttctcattaattatttttacattgttagataaatgttaatagatttcattgtgtatcatttcattaaaagaagagaacacgaaaggaaaagtgtccaccaacctaatccaaaacaggccaaagcctttacaacacaagcaaaaacctcaccttcaaagggctatccacttatcaacaaataaaacaagtgatcaaatttctaaagcgaatattacctagtgctagttattaagaaacgaagggagcagtcttcgacgatgcttatatgggtagagttggtgtgcgtacgttcatagagataagtgcacgtgcgctgtgagtggctgcgttgtactatgtaactctaaaaaaaaaaagaaacgaagggagcagtattaactaatccaaaattacgcccttttttggcacggctctaagctgtgagttctagagaaaatagtttgtagattaaactaaagtaccacagtttagtactttttatgtaaattctaaaacatgaaaaaaaatgcctcactctaataagcagttctaactcaaaaaatcattttggcaggtgaggctgcgacta

SEQ ID NO: 38369 - DNA, 301 bp, Oryza sativa
gcccccgtcagagctagctcgccccggatttcttctctgctagtgtggcgcgtttcttggaggctttggggcggcggcggcggcagtgagatgagcagggtcggagagtgcggcggcggcggcggctgcggggcacggcgagggaaggcggcgcacgccggtgccggggcggtggccgggttcctggggtgcttgctgctggtgtgggcgatgggtgggtgtgggagggggtgtggtggtggtggtggggagggtgtgagggacagggtggaggaggtggcggcgcagttcaacctcagca

SEQ ID NO: 38370 - DNA, 153 bp, Oryza sativa
aacagcgacacagttgtaggatcgaaacgacttgtgatgcagccagcgaggtcgaaacggaatcggactacatactccacttgtgtataataagatttcctcgatacaggctaggcgggcagggagtatcttcttcggaaagaaaaaaaaaga

SEQ ID NO: 38371 - DNA, 154 bp, Oryza sativa
ctcttcaggtctacacataaaaatagaaggatgatttttacatacgtgaccggttacggtccatctgcaatctaaaagagctccgaccatgtacaggaccgtttgtgtagtagtgatttttgacgattttatagatattcttcggttatcatca

SEQ ID NO: 38372 - DNA, 1501 bp, Oryza sativa
ccgctgcatatttaagacattatttatttgtaagacgtggatctgagtttcgactttgttgtttgtgtaccctggcttgtcctggataggggatttaatacacattcttcttgaaattctggttcatgaatttctaggcgtgacattccctttcacattgcatttataacctgaaaagaacattaaaatttgtaaaacataaaaagtcaaaaatatataggttagatttttatatgctatgtaagactactaaattttctatgttgaaatgatgaatacttgctatcttttatatctcctatgtattggttcatagttaagtactactctcttaagttttaagccggaaggccaaatattatctgggaacctgggagttgttaatagaacattgcatgatctaagtctaggttgttatgagatctgatttggtaaactatagttactatggtcttattctaagtttgactagaatttcagatgttttttttctcaaaatgataactttagaaagttcctcatttgatatgaagtcctaccagagacatatactcatttaaattacaaaaacctaatgttatggttgcttgtaattccattaaactttagtcaaatttccgtgacctttgttagatgcttctcatactttatgatcagacacacacttacacgcacatatgctaaacatctatactagaagctagcattcattttatccattttatccattttcttccacttcatccacaaaataaatactccatgttatttatggctctctttccaaaagtatcattcaaaatgaaagagaggtatggctatgcaaaaggaaaaaaagaaaaaaaaggagagaaaaataaaatcttgttcatacaaagtatggggcatgatgaaaaaacagaagaaaaaaacctagccagacaccctctcaatttttgaaaaaaaagagaaaggtgtatgcagaaggggtaatgtcattccatatccactatcataccagacacttgcacgatcttcatcaaaagtatgttttgttatcttatttggcccgactttttgacttagtaataaatatgaaagcaaatatgctgtcacacccagagtttccccttctctgtagtttctaattcaccaataaattgtctatagaaattactttggttaaccaagagaaagcccaaattaacaagacattttaataatcggaaatgtcagggagaattctttttcgaattctctttgctctaaaatcattaacagcacttaaagcggaatattcagaacatcggagttaatgttggtagattgaattgtcaagatttgaattaataataatctttctctcccgcatttggtcgtgaatcgtgcccgattcactgccctcttcgtccgtggttttgttttgcataacgagccaagtccgtttccgtttgtgagtccgtttccgttcttttcctaaaacggcacagcatttctttttcaatttgggaaagttcctttc

SEQ ID NO: 38373 - DNA, 165 bp, Oryza sativa
agagaagaaaaatcatcacgaaaagtcaagaagcacaatcatccgcgcggcggcgaggccactggtggtgaccgacgccgcggcgggaaccggggacgcctcccgccaccgagaacctgccgctgccgcaaagaacccggatctactccccctcctcctcgcagc

SEQ ID NO: 38374 - DNA, 377 bp, Oryza sativa
aggttcattatttcatgtgaccgatcagaccgggcaggtgttgccggtcagaccggcgtgtaatgcgcggtcagatcggcgcagcccgcggtctgaccggccgactctgtgtcggtttcggtttcgagttgttccgtgattatgtcatgattatgggcttctagatggatactatacgtatgtaatactgttgttcgctactaatgagtcaagtttgagataacttggtctcggaatatggtttctttgtttatttcatgtgtaggtgacttgatacctcgggagaatatttgcggtgatggaccggaagtcggcttggggataagacgacgtccatggtggtcaaagatcatgcgggatacttaggctagagttga

SEQ ID NO: 38375 - DNA, 1165 bp, Oryza sativa
tggacttatctttgtaagctagctgccagataggtatgaaaaagagtaacatagtcatttaaaaaaaataatggtcaactaacaaaatggttatataggggattaaaattaaaactcgaggcatgtaacgcctaacacaaaatttaaaggcataaaagagattgagtgaaaactcaattgcatgcaaggaatgttctccatacaaaatggttgtggcggaaacaagagcgtgacgcctgcacgaactgacccatcttttcattttggggcttggctcatttgcatttgaaaattctaaaaaatgtttagaggtaagttataatgcatctatcattcctaccaaattttagtggaaaatactacttatatagagaacaaataaaagagaaatatcgttaagcagtaaggtgaactgttttaaatagtttggcgtgtaaaatgagtaaaaaaaatgtttaggggtgatgtgctccggtgaaatagtttgagagagtaaaaaggacttattttcccttcacgtcttggccttagcctactttccttttccaataagttctatgtataatatatatttctagatatttttttatataatggaattaaactataaagtgcataaactttgttccaggccaacacgcttattgacaggtggtgccaatagacccatatccgggcaatcaagagaggatgacatagaggatgcgtggcaccaagtactcctgtactcttgtcaggtttgtgggcaatcaagagaggatggcatggaggatgcaaggcacaaagtactactcttgtcaagtttgcttgcgctcttcaacatgacatgatggatatccaatattagggccttcaaaccatgccacacaagttgaaacatgagttgtctttcatttatggagcaaatgcaccactaggttgccttggtacgtctgatggtttgcctccccactagtatgtgttcaacaacctcttccacttcagtctcaatctcaaggtgggtgatggtactactctctagtccagggaggttgatcccctctcctactcgagacccaaggaagcatatctcaatgtgatgaagtttatttgggatgagatctactttatagacattgatcctagatggacgtgtgcttacgcaccatatcttatataatcaaga

SEQ ID NO: 38376 - DNA, 182 bp, Oryza sativa
aataagttgtttaagcaattacttgttgccttcagtatggaaggcttctctggattgggtgaaacattcttaaacatagaacactaaagagtggcagggtgaaagatatgtgcgctgttgttggacattaaaagcattttttttcagggttcattcattaaaatgagcatttttttttcagg

SEQ ID NO: 38377 - DNA, 362 bp, Oryza sativa
cttttttataaccatgtttggtacacaacaaatttggtcatttatatacaataattaattaaatatttacattgtgatctccacaaggcaataggtatatactaaatcaagtctgaaaccaaatgaagttgctagattttttttagataatgaaatgaagttgctagatgtaatgcagcatctgtaatcaatagaacgcaataatttgtaaagaagtgcaggtagatttcattacatggcaacctccttatgctggtcggccttatggcttcatgcgcttcttgagcatttttcaccttcttgaagtattttctaatgccctctgaagcatattcctcaccataccttaaaaagaagaagaa

SEQ ID NO: 38378 - DNA, 406 bp, Oryza sativa
ctcttaaagtagatgacgactttattacttctctatgtgtttacaaagtgccccaacagcactccttataaaaatctcgactaaactcgaaaccctaactcaaaactcaactcaattgctctcgaaagcgataccgctaagcctcacgctccccctctattttatacatgaggtaggcagcctaaagccacgaaccaaactcatactaagagtcctaaacaccttaggaaaccctctagtacaagaaagaaactttatataaccaatcgtaccaaatttggactccttccaaattcgactccgcatcccatacgtacacaatacctccatcgtataccatatagaatctccatcaaccacgtgcatcaactctagcctaagtatcccgcatgatctttgaccacca

SEQ ID NO: 38379 - DNA, 723 bp, Oryza sativa
tttttttttgagattttatgatgtatttgatgtgtgatgtgaatctgtgaatttgtgatatatttgatccgtgatgtgaatctatgaatatatgatgttatcattgatctatgatgttatatgtgaatctgtgatttggggatgaagggagcaactcaattatgggaaatcaatatgcaagcagtaaaaacaaggaaaaaaagaaaataaaactttagtcccggttggtatatccatctttagtcttgaattgggcgtcccagtttacaatccaggactatagggggttacaaaccgggactaaagaccacttcaccaatagtgggaataggtccatctgtctatgttaccgtcctcaactatcatatttgtatgaaaaataatcctcaacatataaactatgtattattcatctcttaacataaaatattttttcactttatcccaaacctaatacgaactgagatgctttccaaaatcccttatattttaggacggagggagtagtacagtaaaataaaagatgggcatcacctgctaatcaaatactactcactttttcttccttccccttctctatcttttacatgaaccattatcatgatgcacaaggctcccacaattaatatattacataaataaacatatttatgtgtacatagcaaagaaaacataagcaacaaacttgaaagccaagcaattaaaagcactttctctttcagt

SEQ ID NO: 38380 - DNA, 189 bp, Oryza sativa
ttttcatagaattttaagaaccttttgatttataagagtgtcacgtgcggcttagaagcgtttttagaatgcgacgtagcagcttaaagcgtttgtaagaagtttaatggactctagtatataatagatagatagatagatatatgatctgtttggtacaggtctagctctagctccatgtctcctaga

SEQ ID NO: 38381 - DNA, 1501 bp, Oryza sativa
gtttctgtctgctggctggcctgacaagttttaacaatgctataggtcaattgttagttactcctgccttagatcgatacgatattggagttgccaatactcccagttgtttaccaaacaagcagtgtaatcttcacgcagaggtgcaaccagagagttgatcaagcatattgacaaagcacacttcagtgaacggaaaccctgtgaatttactgcaaattcagtcaacagcttaaacctctctctctaaaaaaagttttaaagctctgaaagtctgaattactgatcacgtgatcatgtgagatcatgtgaaaatatatttgtttcagaaatgaaggttgaaaaaccaactctcttttccgtgcctgtacaaaaacattttcagatttcaggaccctctcttcctcctttgttaaagcatgtattgtttatgtagttacaccatttatcttggaagtgatgtttacagcggccaaatatattccagttttgcatatgcttagattttaaagattcaaattgaaggaattattctcacaattgtgtcgattatatgttgatctcgggcaagtgaatactagtgtgatctccttatcagtcaattcgcctcctttttcaagaaaggtaagaacagattcttctcgtgcaagttgtgctgttgctttggttccaatacttgtatagctatgaccagtattcataccttttcgtacttgatacgtcctgctgatgaaacaccggtgtcactctatcagaacagtattcaggttatagaatttttttgatgtgtccaattgtccatcatgaatctaaagctccattcaaaacagactattggacggatcgttgctatgaattatctactcaattataagaataaattaaataatttaaaacatgtggtctaaataatatagttaaaggaatatattttttagaaaatgtgtttttcaaattatggagcaataatttgtttcaacaatcagatggataatctgaaaataagatgcatatgtacttaggggtgtgtttcccatttcctacttctcgtttttttacgcccatatgtttcccaactgataaatggtgtgtgcttttttaaaaaaaaatctataggaaagttgttttaaaaattatattaatctattttaaggttttttttctaatatttaattaatatgcgtaaatacatgtttcgttttgtgtacctgaaaggaggatttccaacccttactctcaaacacagccttaaaagcctacaaatgtatgagcatattggcactaaaatttgtttcgatcactttgcttactgctatagctctagctcttcagttgtcaccttttgttttctccttgtctttctctgcgatgtcgtggttgctccactctcttctcctcttctccttgcctgtctgatcgatcgcctcgccaccgccgccgccaccgccgccgtcgtcgtcgtcgtcgtcgtatcggcatggaggtgtcccacatggccaac

SEQ ID NO: 38382 - DNA, 1501 bp, Oryza sativa
gtcttgatcagaaaattaactaagagctagacataacattgtagttaccactaattcatcaggtccattagtgcttgacttgtagtgttggccatgcttacgagctaggagacgtgctcgtggaagcaatcacgcaaatgaaggtgaaagtgtaacatataatgtgcaacctttacaagatcgtgctttaatttgtcacagcttcagcttaaaacctaagctaattttgaagctcttgttaaagcttcatgaaaagaaagccaggcaacacagagtgacaaaaagggtccttaacactctaatcatctacacgtggacttatatataagcgattttgatttgttttcactataaatttatagtatgttattttaatcttggctttcaaattacgaataatacagattcaaaagttttgtctggttcattattttttctacgacttatcaacaaatcgatcggtcgaaagtaaattagaaacaggaagattcaacttttaaactcaagtgacatcagcaagcatgctccaagtctggtgaccatgctatagcaaaccatttttcatagatcattttaagcacatgataaatttcaaaaatagaaactgagcacatgataaacaatctttgtgccacccaattttatgatggtttttctcaacagttgcagtccgaagaggcgtactccattgtactacgatccaatagtggtcgtcgaatatatgcttgatataaccaaaacaggcatcccccataacttgattcgactgagggaattgctaaagatactgattttatatcatttttgttagcatttttttaaagtggtaaacgtcctactttgtacgggaactttttatataaaagttcttttaaatatcttataaagtcatttctaaatttaaaataatttaaacccaattaattagtaatatgagctaataatattctcgttttacgtgtccaagcttaatatcctcattagtgtaatcaaacggagagtgaacatcctcatttttttccttatatttatacttgtcagtcaaaattttaattttcaaccttaaatttagagttgagtttaagatttttgttcattatagttatttttcagtcttttcttttagataatttaaaacacatatatgaggaggagagctagggttaatatctctgcacgaatcttaaagcatattcgatggtccaaaatttaaaaaataagatgtgagattttatatcaatagatatatagacaatacaataaaagttagagttttatttacaaattatttttcgttagcaaatactccctccatttcgaaatgtttggcaccattgactttttagcacatgtttgaccgttcgtcttattcgaaaacttttatgaaatatgtaaaattatatgcctacataaaaatatatttaacaatgaatcaaatgaatcaaatgataggaaaagatgtaacaattacttaaatttttttaataagacgaacggtcaa

SEQ ID NO: 38383 - DNA, 450 bp, Oryza sativa
agagttcttcgaaaaacagtttggagctcaccattcctttagtttccgacgactccccttatgatgcttcatatgctaattcctatatagattcatttcaccatatatgggaccaaataggttatgagacagtgctattggttgacgaaggaaagaaaagagtttcatattctcacatcaatcatgaggagaaaattttggagatcatctccctatatgttttgtattgattatctagattcattagtggcaatattcaattctcacccatgactactactccaaaattggagtatgttccaaaatttggaccctacaaccgacacactgttttgctctgctatatgttcagtttcgatttctgttatgctttagtataccttatccttgtagtatacattttggtttgtcataagctcgttttgaacattccatgttggcatggttcag

SEQ ID NO: 38384 - DNA, 1501 bp, Oryza sativa
accaccgacggcggcgacaccgactgcacggtgaagaaccaccggaacaaccgaagagttgggcgcaccccaatgaacatctcgcacaggtgcgcgaagatggccaatgtcatcaccgcgttgggggtgaggtgcgccatctggagatcgtagaactccagaacgtccataaagaaagaagaaaatggcggaaccagccctgccattgcgaaggggaggaagaagacggaccgccccgggtagtctggtgccgggcgtccctcgcccagcatcactatctcccggccggtggcagattccggcatgaagcggcgcggcagcccggcatgcctctcgctcacgatgcgagaaggcggtagtacgctaccgtcgagcagagcggagccccgtgccatggcgccggaggaaaggatgattgagaacgagcgcgtgtggcgaaggtaaggcgtagcagagaaagagttagggctcaagcagcgaaggcaaggggaataatggcgaaaggaagggagcaaatcctttcctcggcatctttatacccttgccatcgctgtgcccggctcctcgtttctcgcgcccactatctcgctccctcgtttcccactatctcgctccctcgtttctcgtgcccacgcttctactaatcccattcgcccgcttgcggcgcatgaggtggatatgcggttgtggcagtcgagatagatcgtatcgtgcgcgcgttaattacgctcgccgaccgaagcgacgttaccatatctccaggcgaagcaaatcggctcacccagattcgtgcgctgctcaagtgatgtggcagtcttgaagagaccgcccattatggacagccaagttaccattaccgatgtgcatggtttgaaaccgttgggtttctgcccaaccatggagaccggtcccacctgtcaccaggctttaggagtggcgtcacgcccgaccgcttcccttgaggagggcgatcgccctggcataatgccgggggctactgtcggtgatatgggaccgggagtatcatgaccagaggcttgaggcagacacaatcgcccacgtggcctggcaccttcgttgacgtcgggcccgagggtgaggtgtccgccctcctcctgatttccccgagggggggtgacccctgccccggccccgagggccgaggcgccccgacccctcgtggagttagcaccacatgaaggggttaggtgaacacggtaagcctcacctaaccgcatttattgtggtctggtcgaacgtgtcacgccgcatgcagcgtagtgcagcgcgttcctttatccggtctgtgaccagtcacagaccggtcagatcacgggttaggtggcgactggcggtctgacgcacgccttgccccatcctgtcaagacgaaagcctctaggcactcgtctctagccggagttagcgtgttacctcttagagatggcacgttagccccggtcagatatatgccaggcttcatcccaaccattacagcctata

SEQ ID NO: 38385 - DNA, 373 bp, Oryza sativa
cctttcattctttgaactgcatgcagagcccatcagcccatcattgaagagtgaagagttcatagaacctgttgcctacccagaccaaaacttgcttttgtttcttctcagggatcatgaggtgttcctccatatctctccacaggacacatgcactcgcgcaatgtggtactactagtctactacactgcgagctggtgagctgtgactgtatctgccttgaggtcccaagtatctgatctgaggcagcaaccaagcaaccaaatcttcccaattctcgcttgctcctagatactattaaactccattctctgcagcgccattgcctccatttctctctctctccctccctttctctttctctctcgagcca

SEQ ID NO: 38386 - DNA, 1501 bp, Oryza sativa
catcaagcccaggccacgtcctaggctcgctcccaatttggtaagcaatgaagaggtaacacaatctatccaacaccaagtagcatctacaatagattcatctatgactatttttaaagatagattagatgcaacttttgaggataaatttgatgagtttttaagatttaaagtcggccctctcttggccgattttgtgggtaaaaataaagcctctagcactgctagccaagcccctatagatcaaacaaatagagaaccgatggagtggcgcacacagctggtctgaccgggcctgatggccggtctgatcgcgacttcaccgtcggtctgaccggccaaatggccggtccgactaggtattaccccggcggtcagaccgggactcaggctggtctgactgcgcctctggatatcggttagaccgggccctggaccggttagaccggcgcaataataccgattcaggggatagatccaatgactaatgctagttatttgtatcatcttagaacatttgatcctcctgtatctactactgcaactaatccccgagttcccccacgtccatacctatactaattggacactttctaggagctctcacgttaatcagaaagatctagccgttaattaatttgttgaattatcataaccgtagatgaaaatacaatctacgtgtgatgtgggccacttttaaagtctatctattgacccaacagatcataacttgagagataaatgcatctactaaaaagaagatcaccgatcctatctccttaatgagatatacgaattcggctgcacaaagaaaaaaaaagagatatatggagcagctaaataagaggtccaactcgcggcacgacggatttcgctagtgacgggggacgccctccaggagtccaggttgcccttcgttctgatcatcggcaactatttcgacttcattggcgttgacgagagacatgcgtgcacatcagaggtcaggacacactgcactgtcatctgatgtttgcttgcatgcgcacaagttctggccgggtttcagtgaggaaggcgaaaggatatccatttagtgatggctgctacctgatcaattaatcatggccacgatgcttcatctcggattaagctttgctacaggatccgggatgatgaagatttcttattagattttctgataaaaggaaaagataacatatatattgatctatgcttttccgaataaaaactggcaactaaataatatgactatagatttcaggtgttgcgatgttgttcctctaaccgaaagttcactctttcctgcatgcacggaagatttatacaccgtcatcgcttcaaggaattcaagtaggttacttacatattgtatgtgacctatttgaagtattcttgatttctaattttcgtagaataattaatgatcatgttataataagtgttaggtaatcaggtccctgaatatataattatgtttatcaataagtgtgtttacgta

SEQ ID NO: 38387 - DNA, 161 bp, Oryza sativa
gcgcatgacgtcacaaagcgctggtggtggcggttctcctccatcccgacgacaattctcttccatcttcgactcccacactatcaccaacactgccaccgcaccgtcgccaacaccactcctgggcccctcctcgttgttgccaccttacatgaagggaa

SEQ ID NO: 38388 - DNA, 472 bp, Oryza sativa
agagcagttttcgctgacgtggttcattgacctagtctaaccagctgagttagtacggcccatatgttagtgactcctcttctctcctctatcctcttcaactctgaggaggagctcgcccccaattttgccaccgcctgggtctaaggacgccgacaacggaagctggaagccgagccattgctaggtcgtcgccaccttgctacataacacggccacaaacgcgtcttctgcatttgtgatcgtgcgatgtagcggggcggcggcgacctaccctcgccctagctcaaccaagggcggagctagaacgaaatggagggtggtgccacttgcttaatttactttactttagaacaagtttaagcagatagaggtgcctaagtttgtatcgagggaggtgcatacatggtgaagatagatgatgtataactaaaaaattttctttgaccaggttcctgggcgccctcctagt

SEQ ID NO: 38389 - DNA, 1501 bp, Oryza sativa
aagtgacaaagtgtcaaccgccccccaatcgctctgggatcggatctggaaaaggcctcgagtcccaaaagtcctctccaaggaaaaagatcaaaaaatcctcctctccctcagtgggcaaggtcctccttttatatctcaaggggataccacatgcacctctccccttccaaactggactgttcttctcttcataaatggacggagaccggtacggttgctgtccgagtgcccttctgacgggacggctcatacctacccccacttccaccggaaacaagtgcgacgtgggattatggctgtctgttgatgatgcgaccagtgtcagaccggtcattcttgtcctccacgcgtcagttcaacaatctgcatgttcgcccttcttcatacaacatataggctgtaatggttgggatgaagcctggcatatatctgaccggggctaacgtgccatctctaagaggtaacacgctaactccggctagagacgagtgcctagaggctttcgtcttgacaggatggggcaaggcgtgcgtcagaccgccagtcgccacctaacccgtgatctgaccggtctgtgactggtcacagaccggataaaggaacgcgctgcactacgctgcatgcggcgtgacacgttcgaccagaccacaataaatgcggttaggtgaggcttaccgtgttcacctaaccccttcatgtggtgctaactccacgaggggtcggggcgcctcggccctcggggccggggcaggggtcaccccccctcggggaaatcaggaggagggcggacacctcaccctcgggcccgacgtcaacgaaggtgccaggccacgtgggcgattgtgtctgcctcaagcctctggtcatgatactcccggtcccatatcaccgacagtagcccccggcattatgccagggcgatcgccctcctcaagggaagcggtcgggcgtgacgccactcctaaagcctggtgacaggtgggaccggtctccatggttgggcagaaacccaacggtttcaaaccatgcacatcggtaatggtaacttggctgtccataatgggcggtctcttcaagactgccacatcacttgagcagcgcacgaatctgggtgagccgatttgcttcgcctggagatatggtaacgtcgcttcggtcggcgagcgtaattaacgcgcgcacgatacgatctatctcgactgccacaaccgcatatccacctcatgcgccgcaagcgggcgaatgggattagtagaagcgtgggcacgagaaacgagggagcgagatagtgggaaacgagggagcgagatagtgggcgcgagaaacgaggagccgggcacagcgatggcaagggtataaagatgccgaggaaaggatttgctcccttcctttcgccattattccccttgccttcgctgcttgagccctaactctttctctgctacgccttaccttcgccacacgcgctcgttctcaatcatcctttcctccggcgcca

SEQ ID NO: 38390 - DNA, 1501 bp, Oryza sativa
gcattcaaacggccggatttgctcccgcaaatctcgccggcgccattgatggcggccggacctcccggccggtttccttcctctcctggccgccctctcccccttccaaccctatttaaaccctctccgcacctccttcgcccgtttccaccctttgccgcgccgtctccccgccggaaacgagctcgcgccgtcgccctctctctcctccgtcgccgacgacctccggccggccctctccgcttgccgggactgtctcccgcctcggcgtcgccttctccggcttcgccgcaccgccgtcgaccccgtccaccccctcaccgagctcgccgaccgctggaacgccgccgaccccatcgacccgagccacgccgccgccttcctccgctccggccgcctttttcgtcgtcgccgtcgacctagggtgagccgtggaccgccgcctcttttcccccttcccttcccctctctcggccgccgcttcgccgtgcctatggccgccgccggcgaccatagggtcgcgggcgccgcctcccgccggctgcaccatcgtggccacctacgggcgcgccgtgtggccgccgcatggggcccagccgtcagcggtcgcgtcctcgtgtgtggctgacgcgtggggcccacggcgccggccggtgcgagccgggtgcgcccggtccaccgtggactgtgaggctgccgcgtgggcgccacccccccgtggacccgggccgcgcgccccctcccctgggttgacgcaataaatcttttttaaattaaaatttaaataaagaaattcgcaaatattcacttaaagagcatatatacttcaaatggccataacttggtcatttgaactcggaattggaccgttcaagtctctaatttttccttaagaagtcaagaaccatttttgtgctttgttcctgcttgttatatggagtttattagagtaaaagcctttttcctttccgttggtcgtgtagacgctgcagcttcggaagatccgctctacgtggaggttgaagccgacatttgggaaagcgagcaaggcaagtcacatcatccttgaacatattgaatcccagtttataaaattattttgatttaagttaatgcattatcgctttatttaaattcccgcgttatcactgttttatttagccatgcctatttacctttgttatgaccttattattattgttattgttattattagcttattcaccctaggataaacaaaaccccaactagtgggtactctattcatggttccactagtatgaacttaggtagatgcttcgctgattaattaggcaacattaggtggttttataaccttagactttgggaattctcatatcacttggacattgtggaatggttggactattgtggaattggattcacacctccccctctattcaaaaccctcaaaatagttttaggctgggctcggggtgcatggttttgatagtagcacctcggccacataaggaccggt

SEQ ID NO: 38391 - DNA, 316 bp, Oryza sativa
cccgctcgcaccaagcgccgccgccgccgccgaatccgccgcatcccgctgtccccgcgtgcaattaagtggggggaattactccccgtgatcccctccccctttcccccccatttttccctctctttctcgcattcaaacggccggatttgctcccgcaaatctcgccggcgccattgatggcggccggacctcccggccggtttccttcctctcctggccgccctctcccccttccaaccctatttaaaccctctccgcacctccttcgcccgtttccaccctttgccgcgccgtctccccgccggaaacgagc

SEQ ID NO: 38392 - DNA, 506 bp, Oryza sativa
taaacttgtaccgttgtgtcatcccggtccctaaactcgcaaatcgactgtttagatcctcaaacttattcgactgtgtcatcccagtacctaaacttgcatattactcgtttaatttctctaacttgtttagtgagaatagaagatgtcagaccccgatctgaataaggtaaggtcttttctgccaagttctatttgaacatgaagttatttacccgcataaatgcatagtttataaaaaaagttatttacccatataaatgcatagtagtagagaataagcaagttgtgcctacttttagagattttctgactccgcccatgcctattaattgcgatgtgttatatgtacacttgactccattgaccagttgctagaagatctccattgatattctacacgacaaaagtttcaggaaattattagccccgtatcgtggtcccatcagctggggcacatgctccctccctctctcctttttggataatattttcttcacgacaga

SEQ ID NO: 38393 - DNA, 1501 bp, Oryza sativa
agagaaaacctcaaaaagctatatattagatataacatatcagctcacaccttttcccgcctattataaatctgattatccacattgcttacaaaatttttaataaatcccttttattttatgattgggaataacttctatattagccatttttctggtctcttccatgtaagacgacctttttttaaaaaaaatgcactaatctatactttcttttgctttattataattttttattggatgtagcgtaatttgttcttctcttgatgggcccatggtgggcctgtggccttttttttttccaaacttccatttacccatgcttttaaaaataaacacatttttcaatttgtcgaaaaatttgtatgtttttggtaagaattttgtaaaaccttaaataattcataacttcaaaataagcagtactgcatatagaaaacgagtatatgtggttgcataacttttttgcataaaaaatcatcattaatatatattaaacatatcacaccaatgcaatgggtatactttatttcaagcattaaatggataaatacattaggtgtacctacaagcccatatcatttatattatcatacttgctagcccattgcacggcttttgccgcgtctattttctagtgcttcctttttttttctaaattacacagaaggcttttgccgcgtctattttctagtgcttcctttttttttctaaattacacagaacaacgcagataagtacgtcgtctaccactgaaagcacaacgccgttaaattaaatcctgaaaaattcgttcctatgggaagttgaacccaaaaccacaagtgctactgaggctcttgtaaccactaggttacaggccctttcgtattttctagtgcttcctaatcgcaggatctgagcagaatacttgtatgtaaacttaagcgcagtgcaatattgttatttcaatgtaaacatgtggtctgaggatacacacgttcttaactgattttttttctttttcattttcaaacattgattaagtgaatttttgtttttttttcattcaaagtaaaatatttgctttttctcgcaaatcatctcggccattactgttgttcctattgttgcttgggacattcctaacagcagtattagtattggctgttgattttggtggtggtgcttaatcatgatataaatttatgtcagctaatagtttctagattcgttgtatttggatatgtcacatccaaccaaaatcccttatatttagtgacgggggagtaagtccaagtatatataatactaaatatagaccatactaattaacctattaaaaaacaaattagggtactgaatacgtgtaacatatttgatttaatttatatttcattggcgcgcgttgcacgcgtatgattactatataaaaaaaattcgtttcatagcgtcatctacaaaatctcatccgtcgccgtctccgcgctcgcctggtaatccgtcgtcctcgccgggtccc

SEQ ID NO: 38394 - DNA, 695 bp, Oryza sativa
aacaagtggaagcgtaaatagttaatttattacatgggcggcgaaggaccagcacacatgaagacaaacaaaaaacagcggaagactagggcgacgaccacaggcgcttgacggcaggcacgagctagataccaaagcctacatcttataggaactcctcttctgggtttgggaaaaattgagcaagactgagtacaaccaccgtactcaacaagacacacccacgagtgcagaataaatgcaaaggagtacaatggagttataatataggggggttagggtttgcagtaaacagcattaaaagacacttagttgctcaaagctattttgttaatacgatcctagagctatacaatattattaatcaaggccgtggacccacacgaacctgccttaacccaaggcctgcgatgattcaaaccgaactagcaacccgacccagggtcccaactcgtcccaagtcaacccaggccatccattccatattttagttgttcaacaggtgttaagaatttaaaacactaacttaggtacattgctaggcttgcccataaccaaggacgcggctattcgaataggtgatactctgatcagaggtgtacatctttacccacaagacatgtcttcctcacatataaccacgtgccacataccaccacggcatacggacggaagacatgacatagtttccaacc

SEQ ID NO: 38395 - DNA, 437 bp, Oryza sativa
agttcatcaagcatatcactcgcctatttacactactacagaacaataataggtgtcagttgggaaccccacataagtaccaaattttccatcaacacctcttaggtggtactgatgaggtaaaattaaaggtgtcgattctgaaaccgatacatttaaggttccatgaataaaaagaaaaacttagcacccacagaccatgccacattgaagaacaccttcatgatttatccacatagcatcattgatccatccaacaacaatatccccgcacaaatcacacaacacaaatcaccatcaatccatccaacaagaacacccccaccaaaataaagaatcatacatcacaattcacataaattgattacaaattttggcacaaatgaatagttccatcactccaattagaagtctacctgatctccgccatggagtca

SEQ ID NO: 38396 - DNA, 707 bp, Oryza sativa
gatagatcccactattgccacgctacacatgtctcttgctatagttggaccctctattgccactcaaaatatttggttgctacaagtgggtacctatattgccactagaattgtttggttgctacaagtgtgcacctctattgccacttgaattttttcggttgctataggtgggcatcggtattgctacgcttattggtttggtggctataggtggccacttctatcgccactatattttttttgttattgctgcaagtgggcactgctattgccacgattaaagttttagtggctgttgacggtcattatcgatcagtttcgaccgtcaatattaccaaaataaaggagaactattgatacttgcaatacatatacatgttagaataataatattccactagtattaggtttactaacctttttacagagaataaccataaagtggaggagaatcgacatcaactcaaacgataaatcgatcggacgatgtcgagaaccagacttatatatgaatgggccaagaacttagaattgacacgacaaactaggccaaaattcacatgtctaacaacagaggaggccgccagccaaaccatgggctggttgggccgctggatgcagggtttcttctggacggtgtggattagctcccaatgacggttggagggtatttccgaccattccaaccatcacaaccgtcattg

SEQ ID NO: 38397 - DNA, 1501 bp, Oryza sativa
  unsure (1)..(1501): unsure at all n locations
aggaatacacatttacatggaaaggattaagtaaacttcttggttttcacgattcttgtaaaatcgatctccagaaaggaatttctgggttcgagaaaaataggttttgggaagatatttctggtgctccaatttgcaagaaacctaggacgaatgatatccataatcctgatcttaggctcatgcacaattgattgctatgactttgtttcctagaggtgatcttagacccattaggggggataaatttactatcatgtttgccatggttaggaagataaaaatttctcttgtgaaatgcatgataagacaatggttagaaagtatgaggttttctgctcctattgaatgcacttctccgattgctcggatagcgaaagggctgggggtcgttagtgaccagattgctttcatctctactgcttgtccatgtattgatgagaattatctagtgcaaggacatattatgaaacatggagtaggtggatctttgatatactttttcctcggttgtataaatgaaatcctattgccaaatgcggggtatcatttgtacaactgccatgaactaaccattccctgcagaccatagaagaatctcgtgcaggtggagcatacagggagacgcgcagcatggcaaggaacgaacgagaaagttcatcatcctcaacacccgtgcagatgtatgaggcaggttaggaaccaactgggcaagtgccagtgaggaacggtggcatgcgcctcatgacatagaatggggggacaaccaaccccccagatcaagtggtatgctcccatctccaagtgaatggcgctcaagttcctctcgttgggactagggtgaaatcaccaggagaatggatacccttgatgtgcagacgggagagatccaatataacctcacagaacacatagcccagacgcaagagtggcaacagactgctgatgctcaatttgccaacatcaacaacatgatccagcaacagcacgatgaccttcaagcgtacttccgcttccaggagttcaatccttatcaaggaccctaagcgtaagccaagcttggagggagacatctctccccctgctgagctaacttgtatcacattgcatatttccctttccaattgcatatttgcttcttacttgcctcctataaacctgaaaacaacataaaaatttgcaaaataaaaaataccaaaagatatgataggtntgagtcatgctaggtaagacaagctagctctctttgttgaaatgatgaatagttgctctgttttatatctcttatatatgggttcataggtaagtgctctctcaaagattaaatataagtagccaataaatctaggaacctaaggtaaatgagctgcacttgctgatcttagtctaagttgttgcaagatatgagatagtaaataagagttactatgatcctggtcctagtttgacttaaattccggatgttttgtttttcaaaatgataaatttggaagttcctcat

SEQ ID NO: 38398 - DNA, 372 bp, Oryza sativa
caggaaagagcaaaatcaccaaacagcacataaacaagctgaacagtacatgtggatatttttaacatgtagatctcaattttagaaaaatttagagacttgaaccaactaaatccgagctaagatgaattagttatgaatttttgaagtttaaatcggattaaaacacttatatggattttaattgaattatgacgcaataatgaattattcttgaaaaggaaaaaggggtttattgcgtcagcggctagggtttgcggtggaccgggcgcacggcagcggttcacgggaacgaacggccaagatctttccatccaaaacggacggccgagatcgaccggtccacggccggaccacgacgaacggcaacga

SEQ ID NO: 38399 - DNA, 1501 bp, Oryza sativa
tttagtcccggttagtattatcaaccgggactataaagatgatctttagtcccactaaagatcctcggccccctgacagactactgacacgggatgaaccgggagtaaagatgatctttaatcccggttggtgatcataaaatagctgtggtgtttttaaccgggactaaagatcatttttagttccagtttttattgcaaccgggactattaatagactaggcccatctcggaagtgtctccctccacctccacgaattaacactaaaccctagatctattttctctataagtgtctatgtgcaccctctagaacatttgggttttgtttagttgaattttgccaagtgccattcaccttttctctaatcctcgctcgattagtcggcgactatagattcagagctcctaatagttggtgtgttgatttgtcgggtcgattagatctaccacttcaatcagaactatttcttcgtgcttcatcacctattcgtaatttagattgcatcttatcttgttcctgcagtgttctctcatttgcattgctgagatcatcaaccacgtgtcatggttggtatgacatcgtttgtggtgtagcgattgcacgacgttctagacttgttctggttggtagccacattgcaaatgttgtactcgatcaaagcaagaattatcctctgaccagaagatcaggccacgagagagagcttcatcaaactacctccgtccctaagtaagtgttgttatgggttttcgtatcatgtttcactgttcatcttattttaaaaaataatatgattagtatttttattgttattacataatagaacataaatatattattttatgtatgactaaatattagaagaaatttataaattttttaaataaaacggacggttaaacattaggaaaatattttttttctatttcttttgttcgatccccgctcccaatgaaccccatcccttggcaggcagtcaggtcggccggcaggttaggtgcatcgcatcgtcccaagacctgaatagcggtggcggtggagagatatcgctcacatcaatcaccaccacctggccatgctgccggcaggcagtcctcccacgtggcacttgtatcgacgtgtgggccccaacccaacacccaacggagcctctcggaccatatcatcttcctaccggcttcctctcatgtgctccgctccgttcacaccagcagaaaagtctctctgcccacgtgtcaaagcaccggtggatgccaccgtttgcggcgaggccttatatcagaaggcgagcgatacctacacaccgcaggatccaatccacttgcatttcagctcaggaagcctctgctactttgcttggcctgtacagtaatacagataaagacctgcagttctttggtctctttagtgaggactgaggagtttggttggagattgttgaggagatgggcatcgtcgacgttgtctccgagttctgctccgtgccgaggactcgcc

SEQ ID NO: 38400 - DNA, 1098 bp, Oryza sativa
aggttgaggttttttgggacggaggagtagcttagaaagaattgttacaaaattcttggcaaataggctgctcccaaaactgacagacttggcatccccaaaccaaacagtgcttttatttgaaaaagagctattcatgataatttcatatatgtacaaaatctggttcaacgttgcataaaaccaataagccaaccatactcttcaaattagatatcccaaaagcattcgacttaggcaggggcagatccaacatgggtgcaagggggactcgagtcccccctacacccacaagacccatcgatacccccggagcatccccttcgattttttcaccataaatgataaattaaaggtctctagatgactagaggtgaagaaactgtgtaattgagcccccccacaattttttctttctggatccgcccctggactcaggccctctttatttaggcttaattataagccaacttataagtcgaaaagtctaagtctaaacaaataagcagcttttctgtttggcttttatgaagctataagccactctaacactattaagccaaaagctaggtttgagaagctttttttttttttgcttatgtgaggtagatgtatgacaccatcactaaacttaggacattaaatccactagcttataaatcatataagtcaataaactgatttaaaagtctagaccaataaacctaaccttcaataaagagggcctcagtgagttggacttatttattgacagatctcacaacttttggctttggcccatagatggagaaactggatctcatctctcttgctcacctgatcgtccaaaattactgatgaatggttctacaggacaggaatcttccatgcaagaggttcaagactgctatagggtgatccactttcacctatggttttaatcctcgcaatggaggccttgcgtaagatattacccgcaactgaaacagtgggcctcctgtcccaactcaattgcaactactgcaggtttaggtcttcgctttatgcggatgataacatgtgatcatgaagtatatacatacaaccaagcatgagaaatataaaacattgtcaaacaat

SEQ ID NO: 38401 - DNA, 1501 bp, Oryza sativa
gttggagaaaatgtgataaattgtgccaattctgtgataaggaggagtccatacagcatttattttttgaatgctctgttgctaaattgatctggaatgtgatgttgtgtgccttgaatataacacctgctagagataaaaaccatatgtttggataatggttatctaattttgacaaacactctaagcaacttgtgatggtggggggtggcagctgtattatgggccatttggaagtccagaaacaaagtgtgttttgataaaaaatggcccaatgatccaattgagctgatatatcttacatgtcattttattgaaaattgggctaacttgcagaaatcggaggcaagacaaagaagcttaatgttgggagccaagctggcaagacaagtggcaagtgaagtcttcagttcccgatttgggtggagaatctatgcaagacgtttggaataaagaagttcaggagtttagtgttgctgagttctttgctttgctatggtactactcggttaggtctgccctttacatcttgttgtctgtgatctggtgatctctgtaaagcttgccctgcagaaactgttagtctctcttgtcagggtgctgctccagtaagggggttgtgtttagccttttcctttgtttttttacttctgaaccctgttgtacttgtcgtttcatttttagtaatggaaatgggggctttccagccctagttaaaaaaaaattgtaacgtgtttttctttcctttttgctattacagttagttaacctctgtgttagttttttttcatttgtgctaattttttgacaaattttgttacaggagatcatgactttatggttttagctgtaggacactgtccgaagtgacttttagcggaagacactcttaaaaaatggatcgtggatatttgctgatgaacacatcattagttaaaataataattttcggttgaagaggagagagaaatcacattaaatatcaaaaatgctcttggacccacatttcaactctcctatctctcttctctctctatcctctcctccagcgccgcatcttgggggattttatgggcggtgcacggttgagttcatggacatggtggcagcaatagcggcgatggcggaggtgtcgacaccgccgagcctggttaagatgacggagaaggctctcgatgagatgccgcagtggtcgtggcagagcgtggtggacatagtcaggtagtgccagcggctagctgcacccgatggtggacgctacagggatgttcgaccaggtcatcggcgcgctggtgtcccacgtggccatcaccccaggggacgccaccctgacgagcttcctcgccggagagctcggtgttccggttctcgtgcgacaccaagagcagctgcctcagcgtgcggtgcaccagccgcacctagtggttcgaggacctcgccgtcgtcctcagccccggcatgttggagcgcgtcgccagggcgcgctaggggcagccattgt

SEQ ID NO: 38402 - DNA, 1501 bp, Oryza sativa
aactgttagtctctcttgtcagggtgctgctccagtaagggggttgtgtttagccttttcctttgtttttttacttctgaaccctgttgtacttgtcgtttcatttttagtaatggaaatgggggctttccagccctagttaaaaaaaaattgtaacgtgtttttctttcctttttgctattacagttagttaacctctgtgttagttttttttcatttgtgctaattttttgacaaattttgttacaggagatcatgactttatggttttagctgtaggacactgtccgaagtgacttttagcggaagacactcttaaaaaatggatcgtggatatttgctgatgaacacatcattagttaaaataataattttcggttgaagaggagagagaaatcacattaaatatcaaaaatgctcttggacccacatttcaactctcctatctctcttctctctctatcctctcctccagcgccgcatcttgggggattttatgggcggtgcacggttgagttcatggacatggtggcagcaatagcggcgatggcggaggtgtcgacaccgccgagcctggttaagatgacggagaaggctctcgatgagatgccgcagtggtcgtggcagagcgtggtggacatagtcaggtagtgccagcggctagctgcacccgatggtggacgctacagggatgttcgaccaggtcatcggcgcgctggtgtcccacgtggccatcaccccaggggacgccaccctgacgagcttcctcgccggagagctcggtgttccggttctcgtgcgacaccaagagcagctgcctcagcgtgcggtgcaccagccgcacctagtggttcgaggacctcgccgtcgtcctcagccccggcatgttggagcgcgtcgccagggcgcgctaggggcagccattgtaaacccgatttgcccgaccggtgacttgacgcgtcaggagctggctattgtcacgcccggaaattctgtagtaatttccgaactaatttgtgcataaaatcctcgtccaggaatcagccgaggtacacaaactgacaatttaatatacaaatccatcttaataataacgttacatacttacaaaagaaaagaaaacagcagcggaataacgatctagcgatgacttcagctccactcccacaggcagctcaactggggtataagccaaacgtcttctccttctggatcctttatcttcaactgaggtttgatgattattgcaagaatgagcatatgacatactcaacaaaccacacagcaaatatgcaagtgcacaaggataccaaatgatggcataatataggctcatttgcaaaagcagcatttagcaaaacatttaagagaagtaaaacagtggagtaattaatcagaaattttaatcaacactgagcaacacacccatgctgcacaggcccaaccatcctgaacaaccatacccggctgtacagttctaactccaaaccaggagctaagc

SEQ ID NO: 38403 - DNA, 1501 bp, Oryza sativa
agtgaaagcgacccacggggggactatatagccctagtcatgcgacggtttgccttccggccaatagcagcccaccacgtggcacccagggatggacacaatggtaactcttgttaggatgggccgaacagtaaaaggccacatgaacaggaaaaacgcgacccaaaacccgagtttaaagaaaagaagaagtgacctaactcacgtccgaaaaggatagaaggtcgaaaaacaacatggaaacgtttgagagaactcatgaaataacaagggttagcttctgcaggtgtacataggttttggcaggaacatcggccgaaagggggcacctcatgccataccacatatttgcacggtctcgcccaaagctccctactcgctcttgcccatgaggggcttgctggaggcatatcacgagggccttcgaccaaatctgccgaaaccaccagattagcaaagcgccgactaaaatcacaaggggtcgcttggaggtgaagccataggatgaagctgtaaggcgaagtcgaagaatggaagccataaggttcgtcatcaagtctctctgttgggtgaagccatggcgcgaagcagaaggggttcgcccaatggggctcgtcttcaacaaaagggctaggaggtgttgcggcccaagaaggctcacacaaaactttagggctatgtaataggggatccaaaaaaatttcatcattaatacattgcttttaccatccaatcatttcattgagagaagttattgtcatttcgacaacaatatagatactaatcctgatttttaaaactatagataaataaaattgttgtgtccttatgaattcaaaataaagtttacatataactttcgttaaaacaaagtttacttatattaatttaataaaattgaaaaacctatgtatttaatatatgtttaaaatttaaatatttaaaatattaatagcaatatatagcgcgtacttggcgtatagtacaccttggctgtgtttagttcagcgcaaagtttagattttggttaaaattaaagatgatataactaatatgtgtatatgacatattgatgtaatgaaaaataactaaactaaactttgattcaaagtttagaattatcggctgaccatccaaccaccaaaataatgccacaccagcatcgggctacagttcagaacgtcgcaatcagcgcctcggataaaaaaaaaaacctttcggcgctgccgaccttgtgagcccacccaaaactcgaatatacagtacgatattcacacgtctcccccacccaccccaatcaatcatgctaagctcaaacaaccgatctgcaactttgcagatttgaagattcatctcaccaaacaagaacatgatggagtattttacatctgaaaccaaaagcacaagcaaaagagagtccaatagtaacacaacaccctatctaaagcaaagaacattactacagctggaaaaattactacttcctcccttctataatact

SEQ ID NO: 38404 - DNA, 1099 bp, Oryza sativa
tgtcttattctgcctaacttaacactaatatttgacacactatcaattgttagctattgatatggcagtttgacatcgaccctgctccatcattattactgcatgcccgcccattcgatgattgacttgaccaaacccacaagtgcaaattggaaaattaattaattaattaattagcaagataaatatatccatcagggattcaggatcaggtcatggatgtaatcactctcaaacatagctaatcattgtgcttatggtccaagtgatcattccccctaatcaacaactcgcttgctagcaagacgtcccttcgaatggattatttgatagctagagcatatcaccttgcacttcaccactccccttatgcagagtgtacgtatgtctaaccagaatctagtggtgagcgtaaaagatcaaagtgcccttatcaataacaaaatactccgtaatacatttggtggatatataggtatataagtattaaaggaataaaactttcaaatttgtggattctaataaaaactaatattaattttgataaacctgaattgtagatactctaacttagggtagtagttgaagcatgcaaagctctaaaaatatatatgaatttcggcgtgtttatatatatttctccgtggatataaaagcttaaaatttataatcattttatgatgatcaggtgacggagttcagttgcggagggttcgtggtgggcctgatctcggtgcacacgatggcggacgggctaggggccgggcagttcatcaacgcggtgggcgactacgcccgcgggctggacaggccgagggtgagcccggtctgggcccgcgaggccatcccgagcccgccgaagctgcccccgggcccgccgccggagctgaagatgttccagctccgccacgtcaccgccgacctgagcctggacagcatcaacaaggccaagtccgcctacttcgccgccaccggccaccgctgctccaccttcgacgtcgccatcgcaagacgtggcaggcgcgcacccgcgcgctccgcctcccggaacccacctcccgcgtaaacctctgcttcttcgccaacacccgccacctca

SEQ ID NO: 38405 - DNA, 430 bp, Oryza sativa
taaaatagcttaatgaaaatttcgttaaatcaaacgggtttagggtgattaattaattaattatgttgttcgctttgtgattcttaattggagttagttggatttaatttgtatttcggaagtggagctcaatccctaattcaaattccatccaaatccaatattcctttcaaatcctaaatccttcccaaaaatttcaaatactttatatttggaattttccagagaagtccctgtctttttccctttttccttcctctctgtttctctattctgcccttattcttctttctttttctttttcccccaccttcttctacctccagctctctctctccttcttgagctgcaggcccggggaggccaagccccgagcccacgtgccgccgcggcccggcctcctcctcctctctatgtcgccggcccaagc

SEQ ID NO: 38406 - DNA, 1501 bp, Oryza sativa
ccacctcattatatcaataatgacccataaaaatccaaacaatgttcgcgattttcaattggcgattcggttcagcctcaactgcatttccatttgacccgatttgagcactgtatgctcatgccatggacttgtttcggatctgggttctctcagagagaatcattagcaagaggcgacatagtgtcgacacatttattcccacttacacatttaaccagatattcgtcatttcccaaaacgatcgatccatggttgttccgtattcctagcaccataatatgcgcgcattgctaggaatgtcgtctccacgacgaaaaccattatgaggtatatcaccttccaaaggtgaattttccaccaggagaatcagaggagtatgctcacatccagtgagaactcttatgctctgactaaggcctacgaaccgtgttagcaggcgtccccgcacaacatgatctaatgccataagtcttacctggatacgatattattcccgagtctatccacatttaccacaattgggagcattactcttttttaacaactatctagttgttcctcatatgattttgttggcaaaaactcgtgcaccaagcaaccaggagtatgaattaaacatacaagttcagctcatttagtgcgttcactcaaagaaatctccaagcattccaaaatgggcatttctctccccctaatgccgagatgtcttgcaatagcatactaccaatccccatatcgtcgcataggattaaggaatttcacctcgatcacaaatgttctcccacgaatgtatgcttcggtggtgatatatttgggaaatattacgcactttaattggagagatttttcccttatatgcagtgagcctggacatataccgatacaatggcatgaatattgtatccttccttcctccgaagggttatcctcaacctcctagttaggatatacaattctgcaaaaaccaccattgctaccaaatgtatatgcaaccaacatgcaaatactttagccaaatgcactctccatgaattaatgctcacctagtgccattcaaactcacaatcgattccggatcgacgtgcattagacatcccatgtcatatgcttaagtaggcaacctatggtggcaaaacgcattccgatgcgctcaacaaggagtatgatagcaaagtgcgcggccactagcctgcgctgccaagcagatttttgtggtgcagagttatgttaaagtccagctcgtctaatgcccaagtttgacttcaattacttataccaaactctagaattgggtcatagttaagcagcatgtttttaggtacgatccacgagcgaattatcaaaccacatttgctaatgtcccctggacatagccatcagaagataatcaatacctccgacaatggtaatattcacaataaaaccattatattcagacatccacaaaaatagtggaatatgtcggtgcaaccgtcgttggcataacgagctcaacgca

SEQ ID NO: 38407 - DNA, 245 bp, Oryza sativa
aatatccaacctgtttacattccttgcactattggtgaaagctatataggagtacatgtaagtggctagacgcactaaggatattgacgtcgaatttggtatcaaatccagttactttgcacacgtccatatgcatcaacaaattagctactagcattttccactagacaatctatgggcgtggaaatgtggaatcgatcagcatgatcaagactagacaggacagacgaaaacgacctgcacga

SEQ ID NO: 38408 - DNA, 1501 bp, Oryza sativa
ttagtcctttatgcaacctccagtatttaatactcccatttgcatttgattataacaaataaattctgcaggtgcaaggacaacatgaattatctactactatatataatctatattacagtgtaatcatctattaatttgccaatgattcaatgccgctgtcgatgtcaatttacgcagttaaaattggctagcatccatgaatcttttacctgagattgtatcttatcctttacaaatcttaaagactggattacaaaacacagaccaacgagcaatgatagcaaattacctagagcagcagccaaagtagcctgagatgcaatccaaaatgcaaacctgaggggtttttttttttagaaaaaggaaaacaatcatagtattttatatgacttttagagccttactttatatgatttgatctgaaccttggtcaccgaaatagcactgcatatgtacttctcttacaaacatcatccatcagggttaaaagaacaaaaagtacaaaggcattcacaattagagttcagcacctcagtaatttatctccaaaattcagtctaactgcacttcacatggtgttgcatcccaaacactgctatgctgagaaaggtaaatattttagagttcagttcatcagtaatttagaagctttaatcatttactgtaggagatgcagtggaaactctaaccagttactgtaactttaatcagttcatcagcaaaaggtggaaactctaatccactattagattggaaaaatggcatcaacatgttctacaaatatttttctctagcttccaaatcttcttaacaactaatttcacaaaaaataagaaagtaacatttgtcttggttcagagcaaaatgatgaaattacatcaccatcaaggtcgggagctcggatgtagagtagtatttaataatatgagcctggtgcttagattattagatatcattgaccagaattattagatatcattaattgggcatatatggtgcgggacagtaggcggatcgctgatggtgacagctcagtatgagtattcctccacgttagtatatactcctaagacacttttctggggagggtactcctccgtatttagccccggttggacaaccataacaggttgtcataaggaactcggcaatcaggggtggtcatctcgaaacaccaggagagcactgttaaggggtattggttgcacgactatatactagctagtatagactaaagatgtttgtatactagaagtatatgaatggatttttttcttattctttctccacttagcttagattatattttagtgagagtatcttagttctttcttttgtatgtcacctttatcctacccttggaatttccaaaattagattgaattttggatagaagcctttggcctttccatgatcacaatgtgatcgttcacctctagaccttcctggttcaagacggcagtctctctgtcagcccgactggcaaagcgaagagcca

SEQ ID NO: 38409 - DNA, 764 bp, Oryza sativa
taataaggcatacgtatctattcatataataaagatagatcaaattaaattggcttaatacaaacctgtgcctgaataaaactgggctataggtaggattatcagaaaaatggtcttggtataatctcaattgacgtgcttcttcttttgcatcaaccacttcatgtcccatcatagacacacagtgttttggtgcatcatcaaagtgtcaatagcgatgcaggtttagtgttgcgccccccaaagaaaatcatcatcgtcggacgatgattcatccacaagccgttgatacgaggagcgaggacgactcatcacggatcaaatcaactggccaaccattaaacatcacaactaaataagttctcacctagcgatattgtcagatcaaaatataaaaaaaaaacgtgattgatagaagaaaatcctaacatgatggtcgtctataattttaacctgcagattgatgacactgccatgtagaggatcagctagacttttcgtttttttccaaatatttattcatcatatcaaattaagtttttttccataaaaacattgtcagatcagaaacataaaaaaatgaaatacaacaaagcattgttagcaaaattttgctacctgtgctagaatggttcaaacgcacaagggcttgtgcctgtcaccaatccttgctgctcgctgccgtaccctgcttgactatctcactcgctgttgctgactggttaatttgtacttgctaactcgtgatctcccgcgcgactagg

SEQ ID NO: 38410 - DNA, 397 bp, Oryza sativa
ctctctcttctctctctctctctcagatttcaacacctttccacatcgaattaagaaggataatgtaaagtaagcagcgtgtggcagatcaagtacgtgtgtttcatacatggagatagctagcaatcgatccccatgtttggtttgtcgttttagtaccatgcaacgtgcgccctcgggtgttgggaacgtcaaacgagtacatatttgccttcgatgggaaagggggagacaagttgttaacatagcactgtcgataaaacggctgctagcttttgtaaaagaacaaatattagctagataacctctccgggttagggcccaatgtaacaggcaaaaccatagcttatatttttcggaattgctaaataattgtcgacaattttttgtttgcaga

SEQ ID NO: 38411 - DNA, 1501 bp, Oryza sativa
tgccgaggaagccggtgcagtcttcgccaatcttgcaggggtccggtccggtcgctgcggctggagcaggcttgcgcggagccatgatggaatggcgaaaaatgaaagtcagagctagcgaagactacaaggccgaaaaagaaaaggtgaaagcgagagcaagaacgcagccgggggaagtaaaaatagatggggtaaaagtgaaagcgacccacggggggactatatagccctagtcatgcgacggtttgccttccggccaatagcagcccaccacgtggcacccagggatggacacaatggtaactcttgttaggatgggccgaacagtaaaaggccacatgaacaggaaaaacgcgacccaaaacccgagtttaaagaaaagaagaagtgacctaactcacgtccgaaaaggatagaaggtcgaaaaacaacatggaaacgtttgagagaactcatgaaataacaagggttagcttctgcaggtgtacataggttttggcaggaacatcggccgaaagggggcacctcatgccataccacatatttgcacggtctcgcccaaagctccctactcgctcttgcccatgaggggcttgctggaggcatatcacgagggccttcgaccaaatctgccgaaaccaccagattagcaaagcgccgactaaaatcacaaggggtcgcttggaggtgaagccataggatgaagctgtaaggcgaagtcgaagaatggaagccataaggttcgtcatcaagtctctctgttgggtgaagccatggcgcgaagcagaaggggttcgcccaatggggctcgtcttcaacaaaagggctaggaggtgttgcggcccaagaaggctcacacaaaactttagggctatgtaataggggatccaaaaaaatttcatcattaatacattgcttttaccatccaatcatttcattgagagaagttattgtcatttcgacaacaatatagatactaatcctgatttttaaaactatagataaataaaattgttgtgtccttatgaattcaaaataaagtttacatataactttcgttaaaacaaagtttacttatattaatttaataaaattgaaaaacctatgtatttaatatatgtttaaaatttaaatatttaaaatattaatagcaatatatagcgcgtacttggcgtatagtacaccttggctgtgtttagttcagcgcaaagtttagattttggttaaaattaaagatgatataactaatatgtgtatatgacatattgatgtaatgaaaaataactaaactaaactttgattcaaagtttagaattatcggctgaccatccaaccaccaaaataatgccacaccagcatcgggctacagttcagaacgtcgcaatcagcgcctcggataaaaaaaaaaacctttcggcgctgccgaccttgtgagcccacccaaaactcgaatatacagtacgatattcacacgtctcccccacccaccccaatcaat

SEQ ID NO: 38412 - DNA, 426 bp, Oryza sativa
cccaaattttatgcagaacctttttttacgataaatcttttttattttaatgaaataatgttttatttttaaaaattcataacaaatatttagtaatttattccttattggttttcacaactcaaataatttacacataaaacatttctagcttttaacaatataccaaggacaataaaataatttctacaataactaacggtcaaactaatggtcaactaacggagtgggtatgtaagggatccaaataaaaaactcaggggtatataagagatcaaacaaatttcaggggcgtagaagggattaggtgaaattacatgggcatatagggaattggcccaaaaacttacgattaacgcctcctggcaaaacaaggcgaggcaagtcgagaacccgttcatcctcatttacggtgatctgccaaca

SEQ ID NO: 38413 - DNA, 1501 bp, Oryza sativa; identical to SEQ ID NO: 38399

SEQ ID NO: 38414 - DNA, 1501 bp, Oryza sativa
tttagtcccggttagtattatcaaccgggactataaagatgatctttagtcccactaaagatcctcggccccctgacagactactgacacgggatgaaccgggagtaaagatgatctttaatcccggttggtgatcataaaatagctgtggtgtttttaaccgggactaaagatcatttttagttccagtttttattgcaaccgggactattaatagactaggcccatctcggaagtgtctccctccacctccacgaattaacactaaaccctagatctattttctctataagtgtctatgtgcaccctctagaacatttgggttttgtttagttgaattttgccaagtgccattcaccttttctctaatcctcgctcgattagtcggcgactatagattcagagctcccaatagttggtgtgttgatttgtcgggtcgattagatctaccacttcaatcagaactatttcttcgtgcttcatcacctattcgtaatttagattgcatcttatcttgttcctgcagtgttctctcatttgcattgctgagatcatcaaccacgtgtcatggttggtatgacatcgtttgtggtgtagcgattgcacgacgttctagacttgttctggttggtagccacattgcaaatgttgtactcgatcaaagcaagaattatcctctgaccagaagatcaggccacgagagagagcttcatcaaactacctccgtccctaagtaagtgttgttatgggttttcgtatcatgtttcactgttcatcttattttaaaaaataatatgattagtatttttattgttattacataatagaacataaatatattattttatgtatgactaaatattagaagaaatttataaattttttaaataaaacggacggttaaacattaggaaaatattttttttctatttcttttgttcgatccccgctcccaatgaaccccatcccttggcaggcagtcaggtcggccggcaggttaggtgcatcgcatcgtcccaagacctgaatagcggtggcggtggagagatatcgctcacatcaatcaccaccacctggccatgctgccggcaggcagtcctcccacgtggcacttgtatcgacgtgtgggccccaacccaacacccaacggagcctctcggaccatatcatcttcctaccggcttcctctcatgtgctccgctccgttcacaccagcagaaaagtctctctgcccacgtgtcaaagcaccggtggatgccaccgtttgcggcgaggccttatatcagaaggcgagcgatacctacacaccgcaggatccaatccacttgcatttcagctcaggaagcctctgctactttgcttggcctgtacagtaatacagataaagacctgcagttctttggtctctttagtgaggactgaggagtttggttggagattgttgaggagatgggcatcgtcgacgttgtctccgagttctgctccgtgccgaggactcgcc

SEQ ID NO: 38415 - DNA, 580 bp, Oryza sativa
tgcgtagatgttcatgttccttttgatattttttgccctcgtttacaactgcagcttggttgtatcaatgaaatttatgatgtgtggccatacctgtctaataaatatggtgaaatcaagcttactaatactattagtattctggtttaagttaatttgctagtgccttttcaaacctgttgtgcacccatttctatcgtctattcatgccagtgcatacagcaattcctaaacatgttctgtgttctgctaaaactgagagcttaatactgtacttctcatttgtaaacttcaggtatatacacatcaatattgtcaaactatttcctttgatgttataccaaattggttctactaaacattacatttagctgatttatcttgttttgcaacaaatttgatgtatgatagagttcttcctagaattgtatcgcgtggaacaatttggatttctgtagcacataaaacatcttactatttaattttaatgtgagccagccaaactttgaaccttgatgtgctctggagttagttttcactatttctcaatttggttccggcttcctagctttgtaatctt

SEQ ID NO: 38416 - DNA, 1501 bp, Oryza sativa
catactatacatttgtacagcccagtttctccaaatcagcagattaccttcttgtatgttattatatattttccagttcactacacaaacactgcctttatttattaaaaaacagaactacaaatagagctccttacatccgcattgcctgcttatgttatgatcttccctttctaacctacagtacgaggatttaagacagctatgcgctgatacaagggcaagagctgctgtcctggctgacatggactctattggaaaggaggcacaggtttaattttcacttcttagttcttaccttacatgctctcttaataagtaaaagttctgtatgatgtgtatgatccttatctatctctctgtgcttacttactgtaccagctaagaggttttgaatttgccaaagctgttacccttgttgctgagcctttcacactagaaaatggtctcctcaccccaacattcaaggtaggcccgttaattctgttgcaggagatctcgatacctaaggtgctaattctctatctcaatgatgttgcagatcaaaagaccgcaagctaaggcatactttgcaaaagaaatcgcagatatgtacgcacaactgcgtgaagcagaatcaacaaagtccaagttgtaattacccgagtaacaaacagaataaaggttcaaccaacacaggagatttagttcgccaattgtatattcaacaggatgaaataagcgccttctatttactggccaagcaaacaatgacagcagtatttcacgagcccttccatctgacgacgaaatgaaacttcaccgatcaacagcagggaacagttggatgtagaggccggtttcttaatccattatctaaaaaacagcagggaacagtgcttgatgcataattcatatttgtttcttatttgagtgaagtaatactactgtttagtgggatatggactactcatttgtttgggacagtatttggtgcggaattaatatttgtttgttgctagcaatgatactatgtttcctgctctctctcatcgaaagtttgaagtggtttgtcccttaaaaattacaaattccagcatagggcttaatgcactcgacaagaaacaagattgatgaaaacatacaagatgattattatatctaacttaagactagtgatgcgcgcgcttaataatgcactcaacaggaaacaagattgatggaactatggaagcacacaagatcattaacttatatctaaattaagattaatgatgcgattttaagacatacttgtgtcccgagtcggagatccgatcgatatcggcggcaaaggctaagggcagccgcaacaggtgccgttaagcactctacaaaaatccatgtcatcaatctctcctaggtgaaagacaataaattaggaaagagaacacagctctctacagacctggcgagagccgatatacacaaatcgagactcgcaacgacaccgtatcgacacaagctgccgctattcaacgcg

SEQ ID NO: 38417 - DNA, 1501 bp, Oryza sativa
catgaagcaattataaccttgcactgctgaaactaaaaacgttaagacaaatggaaatcaaaacataggcagtctgttagtatattctatgagaacttttacggtgtttgcattccaaaaagggtaaagatccaacagttctcaatcacagatactatgtaaaaggtatttaagtattagtatatatacttaggtactaaggataaaaatataattttgttaatagagcaaaaagggtaaaattgtcccctcccccaaattataataggtactaagtaggtacgactgtacgagttaacatctacctggtaccagcgttacatgttcttatttgtgtcacttttgcgtggttttcctgtagatttacgctgtgttcgagttaggtcatttacacggcactagcgtaacaggttcttaattcattttctctagatttactttgtattgtttgatgttctcttttacgtgattttctttagatttacattgtgttcttataacatgtttttggccttgggctagcaattggtgacaaatgtactcgaaatccatataattttcatttttgtcatctatgaaagcctcattttcatcaccaatcccagcttcagtagtatccatgtcatcatcatttaggtcatttgcttgctcatgaactagttctcgcaagaccaacgaagcagatggagttgcaaagagaggacctttccgtagatctatagcacatgcgtgaattgcactcgcagatttggtctccatgtccatgtctagcggcaagccggtgagtgccattaatctggtcgttagcgccatgtccaacctggggaagaggaagatggcaacgtacgggccttcactggcactagtgatgggagagacgcaggttgcactgccgcaccggcaccggtgtgggtgatgggaggaactttaggtggcagcagaggtggctccgctgctggccacaacgtcggagatgaactggttcaaaccctagagcacgaacaaaccaaagggagagaagaaaggagacacgatttactttttgatataatcgaatcaatccctaaatcaacggagtatccttgatttacttttttctctacaacgataccaatagctactacgatacaccgaccaatggaaggaggtattcaattcaaatgtattgcctatgttttactagttaattactcaaatgccatcatgttacaataattttgttccgtaccttgcccctctcttgatcaacggtgcacattattccacctctaaatacctcgcaaacaccgtaaaagatctcatattctattgcctgaactactaaattaagttcatactgtccatttttagagctgacatatatggaggacaaacagaaaaaaaaatccatactacccacatcgtggggaaaataatacaaggcccattgcaagcacaatttcagagagtaatttcgtaagcattgcaaatccaagaacaaaaacattgatatttgaatggc

SEQ ID NO: 38418 - DNA, 447 bp, Oryza sativa
atcttaagccatgccaaagaatggatatagtaggtcgtttagttagttaaatcagatccatccttattgtgaatcattttataacttttgtcttttccacttctcttctatgcatgtttgcctttacctaacaaaatactttgagctaccagctttgtcgtcttatcatagatgtaaagtcactcacatttgaaatcagcgagtatttaacttggtacatccacgtgagatgtcgacatagtcgacctgccaagcaatatagggcaatcacactgagctcgatcgttggcaaaactaaaattaatatttacatatactatccaataagtaaaacatagagtaggtgaagactaattgtaccttctcgaagaaacaagtcatcatggaataaaaacacacaccaagaaagaatcaagacgctacctagctagcttctctctttgcaga

SEQ ID NO: 38419 - DNA, 750 bp, Oryza sativa
actaaaaaacaacctcacccaagcgacctattaggaaactccctaagaagccctgggcatgatccaacattcattggtcactgtttggataactgtagttacactgagattaatgctgttaaacacacaattttttctatgcttcaaatcttccaaagagagggtgtacatcttaggacttacttttagcttccttgcagtttcctaatgatatccagatcagtgattgctaaattaagttgttaaatattaatgcatacttgaaatcttcattcagcttctactattttcttctcaccattatattgtttgttatatgagatttgcatggttggtgatgaaactctaatatgtgaaagctcactgctattctaaattatagaatttgctgtattttgtagttctgtgaatacataccatatactaagatggtagggacttgataaggttaaaactagtgtgctaaaagactaaagtaaaagcaagatattaactcctcatctactgatcgaagagcaaaccttaactatcctctactgttattgtagcagacagctttcaattgcgaaatgttgtaatgcatggatgttttttgagaaataaccacaactctattctgaaatctttttgtctgtaattatttatcctctttccacacaattttttaggctatctattttaatttattcccctggaactctgtttcgtctgattacttttcttattaaattttaattgatgcaattttct

SEQ ID NO: 38420 - DNA, 1088 bp, Oryza sativa
gtcgctctattttacatgcaatacagattagttcccatcagtagcaacgaacgcagaaggggacggccattcgctgccagtgtaagataactataattttgtgttaacgaaaaataccagcgaagatagaaaaccccggtaattttgattgtttgggagatgcatggattaccggtgaaaatatgtattttccaaaaaaaaacagagagagagatcatgatagctacctagcaggaaaagagaactcaaaattgatcaatttgtcaaagcgtcagaaataataatcaaaatagatcaacaagtggaagggcgaacgaacaccagtagacgccgtggaagtgggaagagtggagtgctcattgatcggccttgttggctgaggactcctgggtgtgggctcaatgggagtttctccctcggttttaattttttttaataagacgtatggtcaaacgttgtgcgaaaagttaaaatggaggggtactatttttctacgcctaatgggccttctccaatagatttttatctaaaaactggctcatccaagcacatattgtgttggttcatcttgaaatattacatggtggtatttttcacctgttttgtgcaaaatattgagctttagtgcagaccctaaagttttttttttcttaaaaaagtatcatgcaggttccaagtcggtagacagttagattaatttttatttagataaagcccatgtttgactcttagcctctaaactagagtataatgcgcgttgggatagtatttctgataaaccttttttgtccccctaaagcacaagagaattgcgcttcatttcttttagaagagaagaagaataaagaggggaaaatgatcccaccctaagagcatctccaacagatgtacaaaattaaaaccccacatatcctatattggggacagaaaaaaaaatatttgacccaaaatacactcctttaaaagatgcctaaaatattggttcccaaaattttaaaatttaccacatcatcattagtgggccttctcaactaattttctaggcgctcgctaaaatcgcgcgcgagcgcgtggtgaggagatcgcaa

SEQ ID NO: 38421 - DNA, 845 bp, Oryza sativa
tggtggttgtggttgccctcgtaggtggtgatcagcacggtcttgtcctcggcgcaccgttgcacctgcacacagatgatatatgcatttaatatataaatagtagcgtactattcgtatctcaatttatctttttttttctcgatgtgtaggtctaatttaaatttgatttttggattagtacatatcactatactctaatttatcaatttttttcacaatttttcacaactaattgcatgcatcgaatttaaaagaaaatcccctggaggattagagcaaggtcaatagtaaatagctagctaaaggctacaaaaataaccacatcagcaaattatagttagtgctaatagctagtgcatacaatagatatctactatcttctattgctacacagttcccatcaaccatgaacaaatgcatgcggtagaatgaggtgaccccacccagcttcttgcgttgccatagcatgcagccaacagcagttaaatactttgccttggatagtgtgagcagctagcgactaagggcaagtactataatatctcatatgttgcccctaagaatgccacaatggattgggtgatgagtggaggagagaagtggagagagagaagatgaaccacccctaaatcaagaggcaacctccacacaaattttaagaagtgtgtgagagtattagagatattggtatttgtgtgttagaggtgatacattgtatgggttgcctcttagttcatgagtgaataaaatagataaatttggaggtggtagtcacatctaccatagcacttgccctaattagtcgcccgttaatctctctcaccacctttttcacctctagc

SEQ ID NO: 38422 - DNA, 1216 bp, Oryza sativa
acaataactgaatgttttgtcttgatacctgttcagtgttcagtcacgaagtctcaaccatgtgcataattttttttccctttctaaactacatgatttaaaaattgatcatagcaattgatagtcgataggaattactatcgattttttttggcagaatagtctaggtcatttgtactgattgctctattttatccacatttactagactattgttctgttagcatgcaagttgagcattgaatttttgctactgacaggaaagaactcaggttaaatgtttgatttcacataaccaaaaaaaaaagcaatggagaggcagatgatctggtaagaacaactgatgggtgcagcactgcacaagatagtaatctttttatgacttcatccattcaggtatatacgcatatatccattcaggtatatatgcgtaagaacaactgatgaggcagatttctctactattattgatagcgtacactatgcacacattaatttaatggtggaatagtcattgtcgttaaaacaattaacaacggcgcaatatcaccatcgttaaataaataacaaggacactatcgtggattctatattttgaagaaagtttcactcaaaagtgaatcagatatgaatcagtactgcaagaaataagtatgtcttgtcatatcaattttttttaccacgcaaagaaatattttatttaccgctctaatggatcgttggatgtattttgactgccttggccatctggtggtgttggtacggcacccatccaagctccatatggggaaacaaatgaattaatctgcagtggaggtgctgtccaccaacctacgtcagaagcacaccatcattagttttctgttgatgacctattcactagaggctggaccaacggagacgacggcggaaagtgcgattttacttggaacagccatggcttcaccagacaaagggaaggcgacgccgggcttcactacaccaccccaccaaggaacgccgggaggcaaagcttgaggcgttggaggagcaatctcccgcttggatctatggctcatcacttgaggtttgaggagatatgaggattagggatgagtttcaggaagactgagcgacaagcggtggatttatggattaggggcaaacttggcttgggtctaccgcgggaataagagggtgatttggcgcataaactacgcgggaagattagcagcca

SEQ ID NO: 38423 - DNA, 466 bp, Oryza sativa
cgagctccaccacctcgagctcactgttggattacttgtgctcagccaccaccttgggctatcagtgcttgcccccacctcaacctccaagtgcttccgccacgggctccaccttgagggtccatccctcctctccgccggcttctccctccgttgtcactactgcaacttcatttgccacaagagcgatcttcgatccgagcatgcgagagagggagagaaaagggacagctcggggatctaggggaggaaatgagagaggtgggtgacaagtgggtctaggggtggacaggaagcttgtggctcgttagctcgctcggctcgtgacaagcttgactcggctcgtttgattttcctaacgagctgagagataacgagccagctcaagctggatcgcgagccgctcgcaagccttaatgagccagggcacatgagctgtgggcctttggaattggattttggcaga

SEQ ID NO: 38424 - DNA, 1404 bp, Oryza sativa
cgtatccttggcaaggacaatggcggcttcctcgacaccctcgcctccgtcctccttctgaaggcgatgacatcggcgatgccgccggagcggataggctgccgcccccgacgtcgcagcatccggagccgaacccccttacgctgatatggcgagcgttcctgaagaagcaggtgagccgacgacgaggcatccgcggccgcagccgccgccggcgaggagcaggaggatgacgccgttgcgtccatctcgcggcagcgactggcacgtgagatttgggggagaagaccccgtgatctggcatgctagctgcggccacgccattcgggcggtccggcatcctgccgatgcaggcgctcagccaccggcacaccgtcctccaccgtcatcgtcgccgccgaacccgcggatgctccgggaagccagctacttctcgggctccgtctcgacggctcgccgagacagctcgtctcgtcccttgagcgaaccggtagcagtagcagctacatagccacgacgccaagaaccaccaaatcccctgccgctacgatggagacgaccaccacgacgccgcgtccagcgtctgctccgtggacgctggcccatggccgccgcctcctcgtccaactctttttgctcgaggcggcgcgagctcaagacataggtctccgaccgcctcgcagccaatgacttggtcgagctcgtcggccacctgggggaagctcgcgagaacgaggaaggagagaaacagagaaagagaaagagagagagagggggaggaagagagaggtgctaagtggacacctgacatgtggggcctttgtggggctcaccctgactcagctgccacgtaggacaaaatcggtgtcaaaaccaccagaggatctaaagtgaccggttttgattagttaagggacgccggatatctggttttgcggtttgaggatgtttctgtaactcggtgtcaagttgagggaccttcggtgtactttttccagatccgaatgcgctgcttcagcccgcgagatggacgggccatccacaaactcgaagacctatttcaggcccagtaactcaaacggcccaatacaacttttaacccatcgatcgagtgggctctctccatctcctcctccggcggaggccgcagcctatacacaccgacaccggcgggcagcggcacccacccatacacatgcatggctgcggcgcgcgtgggcctcgtctccgtctccgtctcgcacgcgctccacgcctccagctcttccccctcggggcgcccacctcgcctccgcctccccccttattttccccgccaccaccaccgtctcctccccacctttccccccaactacacgggcccctcctccgccgctgccgcgagactccgcgccagcgccacca

SEQ ID NO: 38425 - DNA, 280 bp, Oryza sativa
tgcccctcccagcccacgtcatgcagagctcggcccggcccacctgtcatgctgacgtagcacctgacgaggcctggcccacccctcctccggctctcccgattggtccacgcgctcacacgagtttacacttatgcccctgggtttattttatttttattttcacggtgcagtccaaagtccaagtcctcggatcagccttgggcgaaactttgacccctaaactgataaagcccatagcaattcttgccattttggagcggtgcaactttttgccata

SEQ ID NO: 38426 - DNA, 1501 bp, Oryza sativa
gagtagtaggtaatcttatccggtctgtttgttttttttttcttttgcttgcgtcgtgcggctggcctgcagacgtggtgggtgtgaagcggatcggaccggaaaccggcgcgttgcggccggcggcgttgcgtgttgggatggacggcaacgtcgtcttccatcttccgcgaacgggtcagccagcctgctgttctattctcatgaaaagcttgctaagctttcaaaaactttcaatacattattttttaaaaaagtataatagttaaccaattcgttcctaccattagataatcatcacaaatcatctagtcatccaaaacaaagtaaaacagtggtacttcgtgtaaggatgtgtttagttcatgtcaaaattggaagtttgattaaaattggaacgattgacggaaaagttgaaagtttatttgtgtaaatgtaatgaaaaagttggaagtttaaagaaaaagtttagaactaaatttagcctaagactgcaaggatattttgacgcgccagcacagggcttgtagaacagaaaaataggagaggagaggacgaactgagacaaacacacgtgatttctgttttgcggataattgaggaggaaacgttcatagaatatggttccattcgagtggcaacaacgacttttaatagcgacagcttcagaatgctattatcgtgtgactgatactagtagatcttttgttatgcgctatcgttggggatccattcatgtagcagctcaaagcctcaaacaaagcttcgtattgcttggcttcagaaatgacagtcgtataggctgggttcgagttcgaccgagcagttcagcttgtatgtttgttgggaactgaaactaagacataataggtttatttgaatttttctaaaggaatcttttatatataaggtttttacataaaacgtatcgctgatgtttaacggttttaaagcgcgtgtttatagagaatgagaaagctgtagttgtaaattgttcataagaactcaccccaagtgttatgaacttaagacattattatttctatatacttggtaggattatactcttacaatagaaaaaacataattggattcaaggtacatacgagcaaccaaacacaatctcttgcgtataaattttcttatccaaccaactaaacaacatctcagataaaccaggctcatctaatgcatacaaccaaacaccctctattgcattttattgcattttaccaaccaaggccaaactcaacctggataagacatacgagccaggctaagtacattcgagcaatcaaacacaggtcgagtttgacaccaagaaacacccacgcacgtgactcgtgagacccaaagaatcggtgtctcactagagaagatgatccatgagaccagcaatcagcaggatttaaagagaggtggtttaagagatcaggcagggacgtgattaatgtacatttaactatttgccatttgtaaatttgatattaaattatttgtc

SEQ ID NO: 38427 - DNA, 1501 bp, Oryza sativa
attatttatatagtttttgagtagattacaatactttggtagtattgctcctttcattttgagatgtttaaggggtgctcggctgcactggctgcaattgtagccgcaactgcgcagctgccacagccaaggcctcgcagcaggccccttggatgcagaaagcaataatggttatacaaaggacaatcatctagtacgtcacagatgattagtgtacgagtatctgaagaaagatgaattcatttcatgctatcctctactttgtaacaaaaatagtctatttctaccttcctaccgcctattctcgctcacaaattgacaaattttatcctttaaataccccttaatttccctttatttaccactgcggtattgctgacattttggtcttttaccctcactcttattttgtttaccaatggcaaaaaaattacgctttatgcgatagagggagaactaaatttgtaccatcaaaactcagagtgggacaagtgaacataactgtctcatagtagtttcattctattttaagttttagactacaaacagtcacagggtggatctagcataggagcgacgggagctcgagcctccactactactgacaataggatcatggaagctcctatgaaattctcactaaaactttttgtcatacatacatgtaaatgggattatatctttatctagtttattcagaccactaattcttcttgatacgctactgagcagtcaagtcagattatatgattttaacagtttacttcacagcaaaagaatggtaagaccttaaatcactaatatgtcaaacaatattgttatattaagaatcgatatgagtaaataacattggtatatttttaatgaaaaaaatactttcatatagctaatatttttaatgattatatacatatatgaacagaaaagatttcaaaagaaacgtgtggatgaccgtgttaatgccataaatgacaagtaaaacaaaagtagtacactgtagcagcttatactgttttacttttaatataaagtcacagtaggacatgtggacgtactatgctttgttgtgtgcttggcagagtcgatggactgatggcaacctttgcagaaatgatggtacacaaacaggaatacgaaaaaaaatataacaacataccacaaaataaatatcacatgaaagatgtgtccgctgactatctatttgttctgtcacaaaatataatttttagcaataaacatagacaagcatatatctaaatatatggttaagttactatagtttgggatggggtagtacgaagtttctacacacaattgcaacatcgtcaatgtatcatcacccgacctgaatttcatcagctgtcctcttcaccagttcttacagacctgcagcaccaccttacaaggtcgctggcctccacaggattagctttcaagcaagctacccaaccataaatatcctgcatccatccatcccatctcttctccaagctgccactca

SEQ ID NO: 38428 - DNA, 1021 bp, Oryza sativa
tttatatagctgcgccgctgactttttatatagtcaaggtgctgtttgggtttatcaagcaattgattggatccaatatcattgctttttgccacgtcagtgtgcattttaattgacaatattatggcttaggctgattatatattatggtcatttttcaggcggttggtaaatcctttatgagtttacttgctcggatgttatcccatatatgccatatatttccagaagtggtgaaaccatgtgtcttttagggacttaagcacatctgttaaagcagtgtgcgcatggcgtatgcccaatactttggaaatttctttattcccagcattcaagcttctttatagttgttttgctatgtgatctttcaaagatgttgtcacctttaggttgtacgcatcatattttgccaagcagtcggtatatcacttggttcatattattcggggattcacgccgcatatgctatatattggtatcaagtcacttggttgactataattatcaaaaaccactcggttaattagataatttattccttgcctatatgtttagtttgttcagctaatcacatagttgggggctacacctattaggtgcatctattcgatgcacctgactttatttttcagccctccacagtcttcagatttggtaaaagtactcgggagcccatggcgaagatgattgaagcactcggctttagagtaatctagttcgagagaagattatattttcgcctgtgaagatctcaggggctactgtaagattatgggtaccccatacccacacggcatggttatccgactagttataggggataacttatatatatgaaatatgtaacagatcatgacttgggtattacgtttccctgtatattatggaacggcctaaagtcctggtttgataagattgtaaagtagatttaggaaaccgataccgtcttggttaaggtttctatcttgtaaccctgccccctaacctatataaggagggcagggagccccctttaggggca

SEQ ID NO: 38429 - DNA, 1501 bp, Oryza sativa
agctagctcacctggccggcgaggagcgacgtggcgagccagacctgggcgcagatcaggaacgccgccatggccgtcgcgccgtggcgcgccaccagcgtcacgcagaacgtcacggccaccactctcgtaaggatattaggagattacttacctgtcctttaaaatatacgatccagattaattctgctcggagtagaatacttcaagtatattgcatcggagcatcactcttcaaactcaggtactcatattagcttaaacttgatctaaaatagagtaaagcaagcgaatgataccccttccctttttgttccagctgcacccctggtaataggaaccaacaagttcagcttgggcaagccgtatcacggatagcaaaaaagatacaaagtgctggctatggcagctaggggaagacgatgggagttctaagatccctactttgcccttcttgctggagtatttcctgttagtagatcgaaaggttgcaacacagatctccagccacgacatgaaggtccaattcttctggttgagagggacaacacgatgggaaggagggtaggtaatccgttcttgctggctccgactcagaccaccggttgtcaccatctttggttaccatttgcagcagggaagaaataacagccccaaaaacttaacgaaggggttaaaagacattaatgctcgcaagcgacaggtttgcttgtatacaaagcaagatgtagatggaaaggcaaaaaaataaaaaaataaaaaaaattgactggtactatactagtggtggccctgtcagttacttccaagttgctgtcctttaggtctcttctactaaaatgatgacaacaaatctacgcagctgcctgcttttgtcattgtaatctaatactgatgcctaattgaatgttcgtcgcaatcagtttctagggaggaaaaaaggttcctggtcaattcggttgctaaaaacttaatttattagggcagcgtagtgtgtcagctgtcttgtggaagtcctggactttttacagtcctctgcttttaactgacaaaaatccattactatccttctgctgttatctttcaataaaccaagggaattttagtttgttctaaaaatcaattttccctaggctacccagtcatcactcagctcatgatgtatcaaaaaaaatctctattatatttggaattactttcgtgattatgatattatattagagtcgtttagaataccaaactttttcctactaattttgtaggcttctaacataagttaacttcaaatataatcactctgtgaatataggtattgtgcatatgaaaatgatcacatttgaagtaacaaaaattttacaattttaaacttatgcaacaatttttcgatttatgctaagaatgaagtcatcaaagttacatcttattgactttttacagtctaaaatgatacatatttgtgactcgagggagtatatcatcattgcttaggactgtaaaacca

SEQ ID NO: 38430 - DNA, 1501 bp, Oryza sativa
tttggagaattttgcgcctctcaaaaaaaaaagggaaaaaatgccgttgttttcgctagaaaagaacacgagaagatagcgaaagcttgggggtgaaatcctgtggtgtttcatggaccaagctactcgttgaagagataatttcccttgttttgtattttctttttccgattaagaggaaagaaccaagcaaagaggtggtagaggagaggggattcagtgaggaagggagagagagatagatccctggaggtttgcaggaggggatggaacagctgtgggtgccatcgcttccgattcttggaggtaggtgaaactacctcgttcttgggtacatcacttgccgattcatatttcttgagctgccaatggtgtctttattagatttcagccgtgtccaccatctgtttgtggaaatgcctaggtgcactgaatgacttcttttttccttctttatttgaacaatcgactaatccaagttaatcagtacggtatgcatggatataggtcagggacgtacatgcacatttactgaattgctcgaacgaaagaaatcgccaactgccaaggtggtatgtgtgtatctacttgagagatgccttggtttcgttttgtggcatcgtaattcgtcactttgtttgcagtcagcattccacttgcttatgattagtcccacactcatataaactagattccagtgggttatgttgtttgattagtcttttgggccaaacatattacagtaaacaaatggtttgaacaatatcttgtttttttagataagacaagatatggcttatttcccacaaacgtgaaatttgaggttgaaattacactcaaacttaggtggtggattcacaatcttatgtcgtcgctattgcagcctaaaagagttctcatgctttattgctctgattgcataagttgcttattgacattttacttgcaaaagtgatttgagtatgtccttggctaccactataatgattctgtccttttagtttcatttaattttccttaatgagcacggaccattttaataatagaacaaatgccattttgtcagtatttctgaattggtttccttctcaatctactatttttgacataacataattgttgcagaaagtccttttttcttgtttcagggtataatatttttgttccacttagtttaggtattttactgctctatgctcatgtgttactgatttatctaatctgcttttactcaataaatgcagtaggtataatttgtgtttaacatattttgggcactgactctttttattttaggaaggatattgcctatgctcaggcactactgtggctttggaagtcatcatcccttaacctggagaagcttacaaattactggaagaaaacagaagcataatgggtgttggattgcatactgcttaccaagccataatggaacttctatttcagacacaaatggtgttcgaaaagacttagctttgcctgacaatttgcttcgtga

SEQ ID NO: 38431 - DNA, 188 bp, Oryza sativa
aaactaaatagtttaaaatttattgattgtcaaaattttaattgttttatcttgatcttgtataagatatcatgaattatgaacggagaaaaataggagtagttatcgcggagtactatttcttaggtacggggagagaggaatcaagtcggataatgaactattttggctatatttttgtcgaaaca

SEQ ID NO: 38432 - DNA, 1501 bp, Oryza sativa
ttggacttagcgtagtacattgtcccactatatgaaagactgttgggtggctctatgagcggttttggggtgaacttgcgtaaggagtttgggcggcagtgtttcacaacagtgggattcatgaaagtgtgacgatatagataccttgcctaggcctggcaagagttcgaccactatgatgaaccaagaccccactgtgtagtaactagtagtaagtgggaccttcgaacggctctggtgtccttagccttgcaaattgttgacatcgtgtgggtaaagctggacagtctctgcagaggtgaattaaatcattcgaatgtgccatactcccggttctgcagttgtgtcatcagggtgattcctactcctgaagtataagtagttttaaaattaaagagttgaggataaagatgatttatggtttttattattcctttactttatttttgtttatttattcatatctactcacctttaattatttataatatgtcttgttgagtacataagtactcacccttgcataatttgacatatagaggaaacgtgctaacaaggagatcggaaggaagcgagattttacggcaacgacaagtttatctaggctagtctacactcgagcttttgcctgtggagttatttgaattctttggagtttattagctgtagttttagtagttgaagagcttaggagtttagtagtttagcactttagatttttcttgtattttcaaataaggatattttagtttggatcttttcaacctttaacaattgtataattagcttgtataaccaaatttgtataattaattgaaagctgatctgtatatcaatctgtgatcgaaatcctggacgatcacgagatcgaaatcctggacgatcacgaatgaattttcggggcaccaagcctaaattgggtgtccccacagtgtgtatatatgtctaaattcattaacatcaatatgaatgtgggaaatgttaaaatgacttacattgtgaaacggagagagtatataagaaacactgccaaaactccaaaactgggcaatactgtcaaataaccaaaattttgacattaaatttggtaagattcattttggatacaatctaaatattcccgttcttttggtgaagcgtcctccctcccctctcatgcttcaagaagcatctccgtcggatttgaccatgctaaaaaagtcttgattttgtgagctcgacctgctgtcaggaatagaattgtcacacataaaaaaatgagttattttaggtaatggtcaatttagcaatcgttatgggcagtagctaatgatggagatgcctatttggacggacattgtctcctgaacagacttgttccatgccctttcttgtgctagttgtagggaccaatgacatgtcattccatgatccagcaggcaatagagcccagaaactcacaaacctggcaatttcaaccaatacagacagacaaggcatgcagatttaacaccaggatttg

SEQ ID NO: 38433 - DNA, 1214 bp, Oryza sativa
ggcaatgggtgctgagctcactgacctagtgcaaagttctagcttgagtgaggatccaatccgatccgctccgaatcagtccgaagtgaggatatgaaaagggtttgtagatatccgacggatatggattcggttgtgaatatgtagccggatgtggtattggtaatatccggtagatgtggattatccgatagactgttttgtagataatccggtttttatttgactatgcgaccactctattggcactacttaacatcagctagcaaattgtgacttattagttctagtattttatttgtctatacaattggacattatttatggacctgcaatagggctatgtgtcatatgatattatgatatgtgatgtcctgtgtgaattaagtgcttcttttggacaataaacatgataatcagttaatgtgatattgtgatttgtgctgtcatttgtcccatgttgtagatgtgtcatgtgattttattattaagggcttgtgaaatattatatcattattgtcttgatgcatgttgaattgatgactgaatgttatattggtttaatatacatgccaaatctaatgatttgaatctgtttcccagccaagtccgcaccggcttcacaccctttccgacatgcagaacaatccatttcgcatccgcacccgctccgaatctgctttaataatatggtttaggatatagtatgataactatccatccaaattctatccatttcgatgaaacagagaggagaggaggaagaagtggcattgactgccgcacaaacgaaaccacttcgatactgtgaaaaccacctgtttcttcgttgagaggggttgaataccctgttttggagttgaagggtgttagcagagagatacaataattgaggagggtaaaatgtacctattcctattcccatgtaaaatgctgcattgtcactaccatgcctcctcatgccaccacccatgttataaagaaaaacctttaattataaaacttttcaagattatttttacaatgataaactaaaggactctttcggactaaatcctgcgcacacttgttggtttggcaactccacatctcagagggaatttcatgaggtaccaagaggtaccgaaatttccaaagtgaatttcggtaacttctaatacatacaaggatccaaattttagactagaaatagaaaatgtgatatgcctcttagg

SEQ ID NO: 38434 - DNA, 1501 bp, Oryza sativa
aaatcatattgtaattattaatttccacttgcattcacatagcatgtgagtgcatacatcaaaagtttcacagaaatgccaaatgccgacaaattagaactcaaccacctcatttctgactgataacatgtcgtaacacaaaatcaggtcacccttgtttatggctgaagcctgagcagtagaagagtagaactgcttccttttcattaagaagataactgtactaaaaattgtagagacagagatgcaagagcaaacaggatgtcgtttaaaaagcttaggtaccccaatggtttatactttgtaatagaaagccaagagacagatgcatgtttatatggttgcgaaggaatattctagatcttagatgtatgtaaagaaatctgagaccctcaaaagtggcaatcattttagatctagatgttctttagatggtccaaactggtgtaacaagatagatattctaatgcaattgaacactagaaacaaaaactccaaggaccctaatttgcaccagattgtttgttaaaagacatctcatttgttcctggagaatagtgcttaaacttttatagttgtaatcattgatcacaataaaaatccatcaacactactagaagtagataacacaggaggatatactgtcagtttttataacataaatatcatttgatcctttaaaactacaaaaccagaaagatgcaatctgatgcagcaaaccaaaaactctcaaaagcaaacaaatgttagcaactgttgtgacaaacagaaacacaaaaaggttaattcaatgagatagaaagccatacttcgtatatttcaagaagatctgggaggaaatttctctttatggcttctcttgtttgacgatctatatgatgccaagaattgagagcaaccaattcatctctgtccaaatggttcttctgttttgtagaagactgtttcatctgttgcaccaatcgtgcctacagatgaaaagcacagtaagtaaaatggatccataaaaaagtgcacatgatacctaatgctatgcagctcttatttctcattgcacagagtagcaacacactagtatacctcaacatccatgtcaatactcctgaaggcatcccattcaccgacacttgtcctgcagaatgcagaaacgggcagttcctcacctacatgcagaacatagatcggtgtaatatagaaatgaaatgttccctatctctataatagtacatgaaaaatgtaacctgactataatgcctgcattaaatgtcaatgcaattaaagtgcacaactgatcataagtgtttaaggaaaaaagtgacaaacagggaaactggatagcatacagcattctcacgaatccgtacatttttagttaatgacataattcttgttaaagttaacgtgtgcatgctgtaaggaaaaaaaattgtttctcattctaatgtcaacacatagtaaagagtatgcataacatggattttatcttcttcataacttatta

SEQ ID NO: 38435 - DNA, 1501 bp, Oryza sativa
tccaccctgtgactgtttgtagtctaaaacttaaaatagaatgaaactactatgagacagttatgttcacttgtcccactctgagttttgatggtacaaatttagttctccctctatcgcataaagcgtaatttttttgccattggtaaacaaaataagagtgagggtaaaagaccaaaatgtcagcaataccgcagtggtaaataaagggaaattaaggggtatttaaaggataaaatttgtcaatttgtgagcgagaataggcggtaggaaggtagaaatagactatttttgttacaaagtagaggatagcatgaaatgaattcatctttcttcagatactcgtacactaatcatctgtgacgtactagatgattgtcctttgtataaccattattgctttctgcatccaaggggcctgctgcgaggccttggctgtggcagctgcgcagttgcggctacaattgcagccagtgcagccgagcaccccttaaacatctcaaaatgaaaggagcaatactaccaaagtattgtaatctactcaaaaactatataaataattaaaaataaaatatatggacaagaaagggcgaacagcatagcaagaataaaagaaaagcgtcatgcgaaaagtctgcaagatgcaacaaagagagaactgtgaagttcaattagtacttgtatagaagagaagagcactggttacatcaaacatggaacaaaacagaaatttttgaattaggcaataagatgcaaccctataaatgaactaaacaacactaaactttgagtaacagttctcagagtccacagcacacttagcagtgtagtacaaggagtagaatggcaacactgccttgcacagcaacactctttcatagctggttgcttttgctaagctgagctcactgctatgagtggctagaggggcagagctaggacatggcaagcacagaccctgcagcctagccaactctgtctcagaggacaatgagttcttggagacgaagacctccttcacggataggcgacttggcagcaaaatttccactaaatcagcaatgtagccaagtccatcacccaacaatgacagccccccaatatctctctgaagaaccgtacaccagaatttaggatctggattttctttcagaatcgccccgatgatctttgcgccgaagaatgatccgttcagcttcgcggcgatcgattttcctgctgccaccagcctagggttctcctggacatctgtgccggcgaaggcatgcgctttgaagaagaaccagtactctgggcagggcaaaaacttcagtttgataggctgcactgttccaattgtagtgacatgcttgttgctggttgtgactatgatcttgctaccttgtttgccacaactcaggcttttcaggagctcctcaagcatgttcttcttgtgtatgtcaacatcctcgaaaacaatcaagaacctcttgttgaagaaactctgctccagttcatgtag

SEQ ID NO: 38436 - DNA, 1501 bp, Oryza sativa
ttagctataatctcgatgagctcaccctgttcgagctctgtgaaagagtattaatataataacttttctcaaagcaagcagagcagtgctgattacatgcttctatttataagtacatgtagtagtactgaaacaagaacgttttctgtctctcttgcaggactttagctagatggcatcatcacggaagcttgccgaattaagatttcttaatttgctagtgtgattagctaatccactggtttggagctaagtgtaagtgtttttaaattgcagtgacgaatggttagatgaatgcccacgatatacgaatttcatattgtcagtattgaacagtggatgcacatgagtaaaaaatactgagaaatttgtcagagtaaacacaacaatttgaaaagattatataattatattgatgggtgtcagtttatctgagtcatgatccttataaaaacgaatatccaggcaactaactcagtaactgaattgtcttaaattggtcattttctgcagttgattgatctttatttgccttttctagttacagtgtacagatgaactgatcggacacttactactaaccgatcaaaataatttcagttttagactcagccaatgcaatatgaaaacgcgaattacagccgatttgcattcccatgtgattcagactaagactatttttatagtaactatgaaattccgtccagcccttcttgaattcagatttcagaatcaaacaagggtaataaagaaacctaggaaccaacaatggtggcaagggatcgaaatatcgaattgactaacctcctcgaagaaactgcaagcctgcaactcctccaaacttgatacgtgctcctacactgcatccgccgtggggggctgggggccgccggagttcgtcgcctcagcctcgaatctgccgcgtgctaaccgccaccgccgccgcggcgacggcgacggcgagctcccggccgccctcgagtccgccagtacaaagaggaagaggggaagacgaggcaggagtgaaatgggccatgaattttgggcccggaaaggttgcggcccatatgtagtggcgtaagtgcggcccaggccatacatagtgggccaaaactatacagcggcttacgagcggccacactgtatattgggccggaaaaggtagtgcagagtacgtgcggcccataaatgttggcccggatcgggtcgtaacgttcggcccataaatgttggggccggaattgggctacgtcgaacgtgcattctgggccgaaaaggcccagccagtttttctctgtcacagttcttcgccaacgatttggttggttgattaccagttggatggatttgtctgtctgatttggttggtgttatctcttactctctcctgtttcataatttgttatactttaaacaatgatacaatatccaaaatatattttgaccatattttttctattatataataaatatatattatattatctccgtttcaggttat

SEQ ID NO: 38437 - DNA, 1501 bp, Oryza sativa
cctattatgtcttagtttcagttcccaacaaacatacaagctgaactgctcggtcgaactcgaacccagcctatacgactgtcatttctgaagccaagcaatacgaagctttgtttgaggctttgagctgctacatgaatggatccccaacgatagcgcataacaaaagatctactagtatcagtcacacgataatagcattctgaagctgtcgctattaaaagtcgttgttgccactcgaatggaaccatattctatgaacgtttcctcctcaattatccgcaaaacagaaatcacgtgtgtttgtctcagttcgtcctctcctctcctatttttctgttctacaagccctgtgctggcgcgtcaaaatatccttgcagtcttaggctaaatttagttctaaactttttctttaaacttccaactttttcattacatttacacaaataaactttcaacttttccgtcaatcgttccaattttaatcaaacttccaattttgacatgaactaaacacatccttacacgaagtaccactgttttactttgttttggatgactagatgatttgtgatgattatctaatggtaggaacgaattggttaactattatacttttttaaaaaataatgtattgaaagtttttgaaagcttagcaagcttttcatgagaatagaacagcaggctggctgacccgttcgcggaagatggaagacgacgttgccgtccatcccaacacgcaacgccgccggccgcaacgcgccggtttccggtccgatccgcttcacacccaccacgtctgcaggccagccgcacgacgcaagcaaaagaaaaaaaaaacaaacagaccggataagattacctactactctcttagaaatacgaatctaaactataaaccttatttttttcttataaaaatataatattttacattaatttccgttagcacgttttcaaactatataagttttgtgtgaaaaatttctatataagctttaaaatacatccattcgtcaagtttgtcataattaaaatttaattaattatactacatgtcaatagttttttcgttttacgtgcactaacttaatctgcgtctttactagttttaaacatcatttatttgttccactaatatcgtttagatttataattttaagaatgcaaactagttataagtaagacgaagggagtaagagttatatgtctttcccaaacagctaaaaaaaggccgaaaaacagcggagatttctatggaattcgtctagaaagctgcgaatcttcccttaggattcgcttatccttgccaaatcctctccaaattcaaagcatcacttatttttttttttaaaaaaaacggcaaacacgagtccatgagaccacgagtgacgacgagtagtcctccacccctacgcctcgccttctcctctcttcttttcccacgcaaacgccggagacagaggaggagacaagagtccaagaccaatgcgaggcaacg

SEQ ID NO: 38438 - DNA, 443 bp, Oryza sativa
tttccgcgtcaagcacatgcttttacctcgccccgaaaccaaagaacctgagccagattaccccttcgatgacctcaaggagaatacaccctgcagattgcacgttcccattggacgctccgggaatactcttgaggccgctacagccattgctatccctgggagaacatataatgaagagttcatacctgctgcatatgccaaagtgcagacgcaagtggtccacgaagggtttgagtcctatgacattgacttccctactgcagatggtgtatccgtacttggggatgcgatcgatcttgtaattctctagcacaagaataacatatcctttagattgggcaccgacgccacgcgaaaacatgaggtgccaaaaccagggttgggaaaaccttcaagacctcctaagaagaaggtgactgataaggtggaggaaccttaga

SEQ ID NO: 38439 - DNA, 432 bp, Oryza sativa
ttggttttgatatttgaagattattagcgaagtggttttggagatgattgatttgtaggtgatgaacaggaactgctgcgactgtttggaccggtcagatcggagctatgcgtgcagtcagaccggccagcccacggtctgaccagccaactctgtgtcggtttcggtttcggattgtttcgctggatatccgtggataattcatgtttatcacttctagatgggtactatgaatatgcaatactgttgtttgctaacaatgagtcaggttggtgagaacttgtgctcgaatatggtttcttggttgatgcatgtataggtggttttgatgcctcgggtgagtgttgccggtgatggatcgggagtcaacttgggagaagatgacgtccggacgatcaggatatcatgcaggatgcttagactaaagatcaa

SEQ ID NO: 38440 - DNA, 1501 bp, Oryza sativa
aatttacaaagcagagcatgatatttacagaaaccttcatagacatgcggctgcttgaattataaacttaaaatttcacactataataaatcataaaaggactaaacatagcaggcccaccagagctcagcccacacatcattgccaccaagaattcagcttccggtgatgtggctgttcattcggtagatatgtttttattgataaatacagtattacttagaaaacaattgagtatgagtagacaccaaatcatttcagtagttaaagagaactatggaaaaaatatggtgactgaacatagacaaacaagttaaggattaattatggagtgtagatgaacagtaagatttgtggccactaataatcagcctagctgatgactaccgagactgcagctacagcctacagcagggaacatgccaacaaggatcatatttaatagttcaaattttattcggacacagtactacaaattacagtaccaatcagaattatccatctaatctattgcacattttgaaactgagttgctccaagattccagttcacacagcaaacccaagttgtaaagatctgttcaacctattcagatgcatcaatgaccaatacatggcgcatgtgtgacataccaaacaccatgaactcatcgtaaacaactgcagctcccatgaacaaggatcaactaaaaaaaaatacactaaatgctactaccacatgatgagtaagggttacttcccaaggatcaactgaagaacactaaatgctccatgcgggttacctcccgaacccacctcggaagttggcaaggatggaaggatggaggatcgccggatcgacagcgacgggggaaaccgccggaccggggtggccggcgcctgcctcctcccgcttagaggctggagcagcggggagacagcgcggggcagagtgactgcaggggaggcggcggcgctgcgcggcggccggcggcgaggcgcgtcacgggaggggaagggggcggcggcggcgagagcgtgtggactccccggagaaggaaaatcgagaggggactgcttcgctcaggcaggaatgggctgggccaacagtgggccgtcgccttcttatgggccaaaatctctttttcttttcccactactgatcacattttccaaaaaaaaaaaacgagaccaaaaatctagtttcttctctctatttatcaaacacttttcgactaaatcaacagtcaaaatcacatgtttatggggttggaacatttttttttgcaatgaaaacaaagcaatatccttataattgaaaaaaaaaaagtacttttagcacaaatactctataatatgaaacaagagaattatactaaggttaaggatacaaacacatgtagtcagaaaaaaaaaagatcaaactaaaaattgtgtggtgggtttatactaaaggtgtagcctttttgtattatgcaattttagactaaacgttatacaaattaaggtgactaataaatatg

SEQ ID NO: 38441 - DNA, 186 bp, Oryza sativa
cctattctatcgtcgatggtagaataaaactatacccgaattatcgtatataaaaccaaacagtctactacaaaatatcggccttaattacccactggacaatacttgaacaagcagaaggttagaataaattcttcccgacttttctccgttgggaggaaaaaaaaattgtaatatccttttacc

SEQ ID NO: 38442 - DNA, 857 bp, Oryza sativa
ataaaatggaggagaatcgacaataatttgacgatcattcaatcggacgttatcgagaatcaaacatatggatggatgggccaagaactcagaaatgacatgaccaactgagccaaaattcacgagtctgaagtgaggaacagaaaaggaggccatcgaccaaattgtgggccggttgggccacccctgggttcggccgaacctaaccagccgtagcgccaatcgattcaggttttgactagacggctcagatggactccctatgacggttggagggtattaacgacctttccaaccgtcataactcagctataaaaggcattcacctcacttcctccaacacacacctcaagcaagaagaatcaagctctctctctagtttactagtgttctaaagttagtggagtaggaatagaataagagtcttagtcctagaagtcttcggaaggattcaggtatggttctagtagctctactctcttttgtaagacttgtacttttaatagaatattcttctttataatactttggtattgtatatgaataccaactttattatatatccaaattatattgattatgatgctagcttatctgggaaatgcaatggtgtgggtataatgatcgtgtatacgattattctatgtcatgacgatgatattatagtagtatttggtaagttaagcgtggtgtttagattgctggatattattatttggggttatataatgcgaatttgtcgaggtgggctgctaatggtgacagctcagtatgagtattcctccacgtgtatatataatcctaagttactttcctgcggagggtactcctccgtgtttagccccggttggatgatt

SEQ ID NO: 38443 - DNA, 1501 bp, Oryza sativa
aggggagaaatccgagccgtccacgtgaagccagatggcgggaggtgccaggattggttcaagaactagaaaaacgtcctcccggcccctccttcggccggtaggttgcttaatgggcccccaacatccttcactatgttttggcccaatcctagatggtttttattgacttattttgcctccaattcgtgtaaacgcgtcctgaatgttcagaggtgcattatgtcgcatgacggatgtgttttctcctcaaaatatctgcacacacatatttcatcaatactggtagaaatgattagttataaaccctaccactaagttggataccatattttatttcattatatgtaagtattgatggtcaaatattatgatttaaggaccgtcaacattgactaaccaggagatttctaaagactatgctgattttgagagacttgtggacaggaccattcgttaggaagatcaacgtaacaagatagatcgcaagaggaaagctatgcagttcaggtttcagcaaggtggacagcagaagcatcgctgtggttatggacagcacagtggttctactattatgattgttcgatagcacaggccatatcagctaggaaatttcagccgaggcaacagtggaaatcagaacaaccataatccagttccgcgcccgcccagtctcaagctttgcagccccaccagccaaagaagaagtcagaacaaaagccccttatgtgtttcaactacggagataccggacattttgcaaataagtgccctaaaacaatgcgcaatggacccaaggtcgttcaagctcgtgtttatcatgtgtctacaaaggaagctcaagcagcgtcagaagtggttttgggtacgttccctgtgaactcaattccttctacagttttattcgattctggtgctacgcattcatttatatccaagagatttgtttgggtacacgggttaagaaaagtgtaacttagtactcccatgaaagttaatacaccaagtaatagcttaacattagttagtttttgttcctctttgatgatagaaatccaagggtcaccttttctagccaatcttatccttctggagtgcaaagacctagatgtcatactaggaatggattggttgacaagacataaaggagttattgattgtgcaagccgcacaattacgttggttaattgaaatggagaagtggtagtaattcaatctccatttattcagaagaaagaagtaagcttgaattaagtggaaagtgaacaacaggatgaagtcatgaaagatgtcccaaagttagaagacattcctgtggtttgtgagtattctgaagtttttttggaggagtcgacagctatgctgccaaagaaagacattgagttccgtatcaatttggtcctaggtacagctcccatctacaagagaccgtacaggatggcagccgaagaaatggcagaagttaagaagcaagtggatgagcagttgcagaaaggataca

SEQ ID NO: 38444 - DNA, 1501 bp, Oryza sativa
tcaatgaaatcggctatcttctgtccgatccatttcagccaatgcagacttcagccgatgcctccgcaaccgatacgcactctgttctgcgaatacaaagatcagcccgaggagcagaaagattttgaattgtgggttgctccatcaaggaaaggaataaaagaagaaaaaaataaaaaataaagatacgaggatgaccaaaaaattaacaacagttctccggcaacggcgccagaaatgcttgttggtatttcttatgaccacagataaatccgcaagcatacggaataccgttgtagcacttcaccttagggtgaccccaaaaggatatcgaacagggagcgtgtgtaatctacctaaggctaagattatccaaggacaacaactgatggttggtaggctaggctagagaggacttactatgtgttttaaatatctaagctaagtaaaggtaattttctatctattgcttcgagcagcgacccctgctggtctactagcgtggttccggctatagctctatgatgtatccgaacgtggaggattactaggatgggattcagggctgtcaccacctgctgcctacctctaacaaatccgtgggatacacaacaaacaaaggtaatctctaacctagacaccacgcctatgttattaattactactctaatatttgtgcagaaacttccttctctatccggagtcctagtactagagcacttagtacgaatactaaacaatgaacccgcaaagctgtaaatatatcttactcagactaagtaattaaataacataagaaaggaacacaaatgcttacttaatagaagaagttctccgaacctggagcagagtgtaccgatagctccggtactcctccataatttctcctaggaagctgcactcgtcgaggtagaagtcggatgagtgccaaacttccgggcactcctccagagcttctcctcactctctaccttattctaatgtacaaaagatacaatagagcctcttgtaattcagctcaaagttgtgtgttcttgaagtgagaaggagacctccttatataggttccaaatgacggttaggggcatgggaaatgaccaaaacaccctgcaaccgccataggggagaaatccgagccgtccacgtgaagccagatggcgggaggtgccaggattggttcaagaactagaaaaacgtcctcccggcccctccttcggccggtaggttgcttaatgggcccccaacatccttcactatgttttggcccaatcctagatggtttttattgacttattttgcctccaattcgtgtaaacgcgtcctgaatgttcagaggtgcattatgtcgcatgacggatgtgttttctcctcaaaatatctgcacacacatatttcatcaatactggtagaaatgattagttataaaccctaccactaagttggataccatattttatttcattatatgtaagtattgatggtcaaatattatgatttaagg

SEQ ID NO: 38445 - DNA, 1501 bp, Oryza sativa
gtgccaacccttgtagccactgacgtctggggcccacatgtcggcgccggcctccccttcgatgacgtgagcgactaccttttccctttgaaaaataaatagtaattgcgtcataattcgataataattctagaaatccatttaaatggctcaaaacttctaaaatttatatctaattcattcgaactccaaattgggccattcaacttgcaaaattcatctaaaattaagatctacatgtttgtttactttttatgtactgttttcttggtttttattagagtttttccttgttttgcgtgccaacgtgtagaatccgtcgttttggaagtccacggtcgcgaggaaaagagttcggaagattgttttgaagaagcaaggtaagtcacacattccccttgagcatgttgatcccaatttataaatgttttaccgtttacaaataaacatgcatgtcttgctaattacatgggatccgggtactacctatctgcttgcttgtgctatgtttacttgatatctgtcttttgtcaaccttgggtaataaatcgactagctcatgttacttatgtgacctagctagaactatatgcttagccatgcttaattaccactagctcagttgatgggataattacagtattagacctttatagtatcagaatgagctgcgtgcttgagacatctggccatgctttatggtcgtaattatccaactaaaatgcgactgaatggtgggctgcgggtgcatggttttgctagttgcacccatggaaattaaggaccagttcgcgggaaaccctggaagaatttatcatgcttaccacaagccagcgtgggcaacggctgggcttgtagtgtagctttcgtctagccaatgtacccaggcgagggtgggcgtgatggagttgggtcggccggggtgtctggctgatcggcttccggattcaccgcggcacgagaggggggctacccgttgcttgctgtggacgggggcgaaccctaaggtgtggtgcaatcggttagagggggttatgcgaagggtcctgtcacggcctctttccggtatttcgtggtggcatgtcagcgcacagaaacgtgtcgtggggctgtgtcttttgggtacagttgtacacctctagtcagagtaaaactattcgaatagccgtgcctgcggttatgggcggtcgaccagattcaccgtgattagttccaccttaataaatcaacccaatgcactgtagttcaggtgggttggttgggcctgttcaacgtggtgtagcgttgatcagtggagatttaatattaccttaattactcaacagttttactgttttgctcaataaaatgttttacaaccgcctttatacaaatagccacaaaccgtccttgtgttccccttgcacgtctgcatcattggtgtggcttgctgagtacggtggttgtactcagccttgctattattccccctttttcagaagtgtagtgcttctgagctgaa

SEQ ID NO: 38446 - DNA, 1110 bp, Oryza sativa
atgagcacgaccttcaaaaccatgtgctcacaacccaccattgtcaagttttaattatcaattaattatcataacacgattaaccatcgtgagctaccattaaatataaccataaataataatgtagtttgattcatcccattagtgagctaatgtttctaagcatggctaagcaattatgtatatagcaattagctgaaccaatccaatatataaggtccaagctaatcaatttattacccatatgaaaataaagtcatcttcggccataattaattgagaaaggctcaccacccgatgacattcgaaaataatgcataagttgaaataaaacaatagctttaagtaggttcaacatgctcaaagggttgtttgggatctgtgtgacttgccttgcaataatcggtcttcaattaatcttcttgaacacttccgacgcactcacgaaccttcgcaatgacggaaacgataagctaacacgtaaaacgaagaaaaagactaataaaaaaacaaataaacagtgcataaaaagtagacaaacatgtagatcatgattttagatgaatttagagacttgaaccacttaattccgacttcatatgaattagttatgaattttacaagattaattccaattaaacctattaaagaaaagactattccaaattaattaaacaatttacatataatttataactgagacataagcctaaaccatcctccggaaattattggaatgaatttagtagacgacatatagtaaaaagaactaatatgccattgaaaagggataacaggatttatattgattttggacggctgagatcaactttgacctagtcgaccaaaattggatggctcggattgatctgatctaaggttttagatggctgtcacgtgggatctgagagacggcgtgacacttagatggtagggacggcagctaacaaggcgatgacatggcaaccatgcgggatcgacgccggcggctctattcggtggtgaggacggcaaacggcggcacaacggcggaaaccgagagcacggggatgaagaggaggacacgacgatccttactaacacttacgcagcgatgaacagcaaaggaga

SEQ ID NO: 38447 - DNA, 1501 bp, Oryza sativa
gttcttaggatatttcactggtgctcaacagaaatatttggaccaactgattttttttaagaaaattagggacatgattcatttgttttttttttgcgcattggtaatcctcacggtgtttgaggtcgcagccatggaacacaaggccataagtgaggaggagtaactactacggaaccggtcatccgttacggggcaaaaccctcatctgtgtcagaaaagttcatggtcagtgatgtgaaactatcatctgtatcgggccatgctccgacaccaatgatgcatgtctctgtcgggccccaaataaaacccttcatggataggttctccagcccgacacggatgactcatccgtgacagcctcaaattgagctccaataaagacgttgccctcacattgatggtaggtgtttagagcccgtcaaggatgaatcatccatgatgggctccaaatggaacccgacagaggtgttgcccccacctttgtcggcatgtcttagggcctatcacggatgataatccatgacgggctagtagtgcaacccgacaatgtagtacattctggtgacggttttgcttttgcggcccgatagggatgaggtttttcacaaaaaaattaaatttgttttattggcttgcctcaggcaaatgatagccaagcccactacatatcccaataacccagcaatataatccagcatatccttgctcacattcacggtcacattcacacaagtttcgcattcacaatcaaattcacaagtctcacacattcacaagtttcacattcacattcacatacaaatatatacatttcacattcacatattgaacccacattattatcacattcaaattcaacaatttattacctttctttccttgccaaaatgtgaagcatcttcaagggacaaccatgcatatttattgcaacatgtgaaataagtatgcaatttgaaagaagtgataaatatattacttctaacataaatgtttacaagtgtacatagataaattaaacataatcaaatagtaattgttttccaacataaaaagtcatgacttaatcatatttttcactcaaatctgattaactgatcacgataaatcatctagtatggtaggtgcccttcgaagatataacttcatgtatgatgaagacagccaattcttctctgatacggcgaaattgtgctctggaatgttggaaataacattctgaaagaggcatcaagttagtacatatcatacgcaaacctaattttatgtaatatactaatggccgattttataaacccatgaacctcaggatccaaggaggtcacctttctagcgagaatcttcatctgatgacatacatgaaatacacaggtttcgccggtttgtttcttgcatttgtagttatcatggtgatagaggtcgggtatatcttctcggtgccgaccccctttgttgacatatttctcccaagccgcattaaagtcctccttcatagatgtaa

SEQ ID NO: 38448 - DNA, 1501 bp, Oryza sativa
gcagtattgactcagtttttgcccggttttgctgacatgtcgcgctgtgggacccactagtcagtccgccgttggggagttaatagacggggttaacggaggggagcgcagctagccagacctccattctctctcctttgctcgaactctagctgagctgcgaccaggaggcgacttgaaggcgacggcgggtttgtcggcggcggcgagctggccatggcgctggcgacgagcatcgttttcgtccaaacgcgtggcggattccaccccggttagtaccttgttggctcggcattgcgtgctattgtagctggtactgtgttgattttgggggaagatttaaaatgtggtagattcgttttttgtttgggattcggtgtagaggtcaagtagtatattgtcccatatgctttaggtgtagtaatgcttttgtatacccatgtgaatctgggtgggttagtgttggggtggtccttttttaatcggtgttaggtgttaactaggtattagggatctggatgtagtgtagttttaatagtagagtagtaaagtgcttctttttttaatttttcagagctggcagcatggatcccttcggcactctagcagttaggttccatttcaatggggaatttgttaatagagggagacagaagttgtattgtggggggagagaagcaatgtcatacatagacagggataaagtgtcattacctgaactttttggacacctaaaagatcactgcaaatttgtggatgataaggtgtgtgggttcatgtctgactgtataagtgagggtagtgtggttgaggtgtatgctgacgaacccattgtaattgatgttgatgaagaggaacacagtgattatgaggctgaaatggagttggatttggatgaagaatcagaggaagagggagatgaggataaggatggggatagaaatgtgaaagtgaaagataagggcaaagctattgtggacaaagggaagggcaaagctgttgtgggtgctggtaaaggtaaagcaatagaagtggatgaaagtgctagtgataggaggattgtcatttatagggaaaggtcacctttgagggaaaatgcacctataagggagtactcaccttctagggatacctcacccataaacactatcctaccttctgacagtgaggatgatagtgattatgtaggaggagatgattgcccttctgaggatgatgaagaggctagggagatagaaggacactacaaagagttgaagaggaagatgagagctggaaaggttcatgagctagatgaggttgtgtttgagggggtttaaaagtcagtcagctagaacagctggaggtccaaaagatggcaatgacaccccatatgcagatagtgatgatgaagactcatatgatgaggttggcagtgatggtgagcttgttagaagaaagggcaagtttccaaggtttcagaagcagccaggggttcctgtttttgagctaggaatgaagt

SEQ ID NO: 38449 - DNA, 1501 bp, Oryza sativa
ttcgtttttagctatgcgaggaaggcgcgcctttttgacagccattgccgttgttaccggtaccggcgcaagtgcagtgccgcacgttggcccacgttgtttggcagctcgtgccgtccccgcgccactgctccaggaatgggcagccttgcgccagcagtttgcaacgcagcgctagctttgaatcgcgcagctgagtgcgtaacgctgaggaaagaaatgaaagcgaaggggattgtggtgggtgatggcatttgtctccaagcaagcccgcaggctcccactgcgcggggcaaggcaagcaggcagcggcaggcaaggcactcggcaagcaagccccttcccttccccgggctttgctctgccagccggtttgtgcagaaaagttagcgcgcacacatgaagaaagcactgtctttaccctgcatgcaactgacaaaatgtggcagaagcattactactgtcccatcgtaccagagaaaaaaaaatgattagcccgttcacaatgcacttgtttgagatatgagaaaaaattgaaatgagagtaccggacatcaaacgagataagccattaacataatattaatcattttaaattttaaaataaattcatataatttttaaagtaaattttaatagattttttccgttcatgaagcgtgtgcgtttcttccctccggcttctctcgaacacttcaaatggcattcaatcccaacctgttggctataagatttctctccacatctgcacctcgtgtgcccctaggaagcccctcgcactaccgcataagagcaagtttaggccatatttagttcgcaccaaactttccacaaactctcaacttttcatcacattacatcacatctaaaactttcctactcacataaactctcaactttccccaaacttctccccaatttcagaaactaaacacggcctaaggcttacatactacactattaataactggtctcacatgtcatacacacacttcgttttggagttcgtgctacagctggctacaaatctatagcccgctgcttctctctctcctcatttatcttattaaaatatgtttgcagctaggttataacctgctattgtacctgctctaaatacgacttccccaaccgcccctcaagccatgtgacgtgttccctcctcccatacacgagtgtatggccgggtttagttcccaactttttcttcaaattttcaactttttcatcacatcaaaactttcatacacacataaatttccaacttttttctttaaacttctaaatttagcgtggaactaaacacaccctttatctctctccgccgagtcgtttcgttcctcacgcatagcccatccatccctcgcaggtgatgacttagggcacccacaatgtggatgaaaagtgggtagtaagaccccttactacctactttaccattgtgaatatggatagtagagcagataataactataccaggcaatagcactactacctggta

SEQ ID NO: 38450 - DNA, 827 bp, Oryza sativa
gcgcaaggacaagggagagccgagaggaagaagaggaagagccaagagtagagagggagaggggaggggagccggcgttgtcagcgtcgttccgcccaccgccgcccacccctccgcccacagccgctcccgccgcccaccgccggccgccgctcccaccgcccaccacccgccacccgccatcgctccacccaccgcccgcaatcgctccgtccaccgcccgccgccgctgcgcccttgtcgctccgcccaccacccgctgccgcttcatttcacgctgctgctgctccgcttcctcccgccgcccgccgtcgctccgtccaccgcccactgccgcgccgcttcgctccgtcgccgctcgcccttctctcctggcaatgtatgggatagagagaagagggaggctgacatgtgggaccacacgggccacaccttttttattaattttttgtgtagctgacatatgggtcccattatttttattattttttcgagataaaattgccacgtaatcgctacgtcaatgccacgtgggacggagacctagtcaaaggctccacgtagacgccatgtcaaccaaaactgccctccatactgccgagggatcttgtttgcccaattttcgtaagttgggggatgggtcgtacccggttttgcggttaagggacgaaaatcagactgaccgacaaatagagggatctaaagtgaacttattccagacgcaaaattgtcggtgctggcccatggaactaaaaccagctcttgggccaaaccaggccaggccgattgtccctcacgccaaaccatcacgtgtgcgcttcgacctt

SEQ ID NO: 38451 - DNA, 1501 bp, Oryza sativa
agcataggcaatatccttcctaaaataaaaagagtcagtgcccaaaatatgttaaacacaaattatacctactgcatttattgagtaaaagcagattagataaatcagtaacacatgagcatagagcagtaaaatacctaaactaagtggaacaaaaatattataccctgaaacaagaaaaaaggactttctgcaacaattatgttatgtcaaaaatagtagattgagaaggaaaccaattcagaaatactgacaaaatggcatttgttctattattaaaatggtccgtgctcattaaggaaaattaaatgaaactaaaaggacagaatcattatagtggtagccaaggacatactcaaatcacttttgcaagtaaaatgtcaataagcaacttatgcaatcagagcaataaagcatgagaactcttttaggctgcaatagcgacgacataagattgtgaatccaccacctaagtttgagtgtaatttcaacctcaaatttcacgtttgtgggaaataagccatatcttgtcttatctaaaaaaacaagatattgttcaaaccatttgtttactgtaatatgtttggcccaaaagactaatcaaacaacataacccactggaatctagtttatatgagtgtgggactaatcataagcaagtggaatgctgactgcaaacaaagtgacgaattacgatgccacaaaacgaaaccaaggcatctctcaagtagatacacacataccaccttggcagttggcgatttctttcgttcgagcaattcagtaaatgtgcatgtacgtccctgacctatatccatgcataccgtactgattaacttggattagtcgattgttcaaataaagaaggaaaaaagaagtcattcagtgcacctaggcatttccacaaacagatggtggacacggctgaaatctaataaagacaccattggcagctcaagaaatatgaatcggcaagtgatgtacccaagaacgaggtagtttcacctacctccaagaatcggaagcgatggcacccacagctgttccatcccctcctgcaaacctccagggatctatctctctctcccttcctcactgaatcccctctcctctaccacctctttgcttggttctttcctcttaatcggaaaaagaaaatacaaaacaagggaaattatctcttcaacgagtagcttggtccatgaaacaccacaggatttcacccccaagctttcgctatcttctcgtgttcttttctagcgaaaacaacggcattttttcccttttttttttgagaggcgcaaaattctccaaatgagcagccactacattgggccggatcggtcatcccaagcccactgcggcccatatggaccgattggagaaatgggccgaatcatccggcccgtttgcgacgaatccctcctcttctagaaggaaagaagccgacgccgccatgggcgtcctcttcttgttggctcgccgcgtgcgtgtcaactcc

SEQ ID NO: 38452 - DNA, 611 bp, Oryza sativa
atggcatttttgggacaaaatggtttgtaaaatggcatttcttgaaagtcacacttgtcgatggcatttctgggacttggacgcttgtcaatggtatttcttagattatctcttgttttgtggaaacggtattagtacggacaagaaattttttgtactattttcacccttagtttgagtaaaggggtacactgaaaagttttgacagttgaggtgggttaaaggctttgttttaaagttgagtagtgtagtttagacaaacgcaatagtcactactaaacaatcgatttttcatagcatcaccctataattttctctagcagccatacgcaaaaatcgctagcaaaaatacaacaggtggttccgagttagtaaccgccattgaaaatctattttcgcaagcgatcgtcttaagagcaccaccattaaaaataacacgatttttacaagcggtgctcttaagacgctgcttgcaaaaatctaatttttacaggcgggtcttaaaaccaccgcaagcaagaatccagcgggtcttaaattctaattcactctttcctctctctctctctctcccaatccagagctccccctctttctttctttttttcttc

SEQ ID NO: 38453 - DNA, 1501 bp, Oryza sativa
acaatataaaatatgcaacaatgtcgaatttctatggttgaaacatatatatatatatatatatatatatgtatatatataatgtatgtatatatatgtatatatatatatatatgtatgtatataatgtatgtatatatatgtatatatatatatatatatatatatatatatatatatatatatatagaaaataatcctaagtataataattctagattcattactactagtttatgtcatatcctattttaatttgatttattttaggacggataaagtaggggtgctcacgggataaatgaagattgatattcctaagcataaattattcaactgcacatgccaatacttgcattttgctgcataaaaatcatgtgcccataatttgacaagcatccataataagattcagataacttccttcggtcatcccgataaaaaaataaaataaaattaacaatcacaaccatagtgcttatcaaaacaaaaacaaaggcctatttgaatagcatgaatagaaaaatagaggaaaaatagaagaatatgaaaaagacatgattcataaaatagatgattagaaaacatagaaaaaacaaatgaataaccgtttggttggaccgaaagaaatacatatgaatttgaagagggataaagacttaaagaaaactttctcaggttctacattatgttaaattttctataaaacttgcatggaatgaaatattacataggaattacataggactatatgattcattcctttaactttaagggctatatagaaaaaatcctataaaaatataaatactccaagattcatatgattttcgttcgaatcaaggggtcatcagcagttgcaacacaaattagatccaactcgatttaatagtacgagtacttgacatgtactcactcctcctctccccaccacgcccgaatttattgctactctactactcctacgcggccaaaccgcaccactaaccacagccgttatggcaaatgactactcctactcctagtagacgcatcgctttccaatcaaaaatcgccgaactaaaacagaaagcaaatactcatctccctctcaaatcctcctcttcctcttggagacctccacttcgcctttaatggcggccacgcacaacctcccgtctcagtgacgtcgcgcccgtagtcccgtacgctacctcgctgctgccaggaagcgaggcgcgctgggtggaggagcagatcgagatggcggtggtggtggcggcggcggcggcgaagcggctggcggggcgggtcacgaagaggccggtgctggagaaggccaggatggcggggctcgccgtggcggtggccgccgccgccgcgctggtgctgctcctctgcgccgcctcgctccgctgctcggcggccgtcggcctcgcgctgtcggcggcccccgggaagctctggagcggcggggtctccatcgcggccgaggcggcggcggtggaggcgcgcgccgagg

SEQ ID NO: 38454 - DNA, 1501 bp, Oryza sativa
actacatggcagttctaaggaaaaagtaaaaaatatatagctagacccatgtaaggcccatatgtcagtgaccaccatctgtctcccattcccccctctcctattaattactggactaatgcggtggtgaattgaggaagggaggaggttgctcgtccaagggttgtgtcacatccctttttcaaatttgcctaattttgaaaattcacattcatatttattcgcttaaatttttttaatggaaacttcataaatgaaatatggtttaatttgactaaatcaatcctcctctatcttttctcctaataaatctccaaaaatctcaaagggaatcccactgattttgtcgctgttccatcttggtcaactcgagataaaccctagtttcttcgctgcctctagctatcaaatccccaccggtcacttcctccttggctaataaatagcatccccttgtccgagctcgtcccataccccagccgccttcccgcatgctcattctctctcctccaccatcggcgccgctccggccgagcagtatcattgccccggtaatcgtcagtcaatgccacctcctccttcggcactgcagcagccgtgcgaccggcctccacttcccggaagactaagaccaccgaaagttccaagtgctcctactgcccgtcgtctctagccgagctgcgccgatgatccccgccgaagccgccatcggcatctgaaggacacagggaaactcggtcaccacctcttctttctcaagtcttgttagagcactgtcattgtcgttgacccttgaagcccgtcgctggccaccgttcatcctcatcagtggttgccaaagtgttgttaagtgtcgcctcaccattccttgtccattggtgtcctcagtgtctcgctcctttgttcgccgtgtgccgctgctcctgggtctgcctttgttgatccaacatggttgccacatcagcattttatcagctaatccgtcctctgtggctgccacccaggctccacgtggcacctctctgcatcactagatcagaattgatctgaatagtcagattatttcggtcaacagtggccaatttatcttaggcatccatctctatggaccatagtggacctcctctatggactagatccatggtagacccattgcatcctctctatgacatgcgggtccctcttgtcagtgaccttagcctatcctctctatatggcatgcaataaacagtttaattgttttctatctcttcttcttcttcttcttcttcacaaacatgatacattcctcattcctcattcatcatatccaacgatcaatattcatctataacagatcgaatgggtgagattgtgtcacacccagaaattctcgaaccagaatttctaagctgaatgtgcattaaatccttgtccaggaccagccagggtacacaaacgacaattgttgacatacagacccacgtcttacaaaaatataaaagattataaatgcagcggg

SEQ ID NO: 38455 - DNA, 255 bp, Oryza sativa
atcgtggccagaaggatgaggcaatcaggaagaatcaatggtgtccttttggtattttcacaaagaatcagaaaaggacggtccagagattgaggagccgggagcgttttcaggaggttgaagaagaaatcaaccatcggctgaggaaaccaaagccaagacgggagtggcgtgtcaagaatcaggttcctgtagccgatgatgctgcagccgatgaggtaaagaggttggcaaaagggaagagtgttatagcgg

SEQ ID NO: 38456 - DNA, 1501 bp, Oryza sativa
  unsure (1)..(1501): unsure at all n locations
taaattatattaaatgaaaaaagtttcggccataatttcactgagggaaataatttttatataaaaattaatgtattttttcttgaaatagggttatgtacatttttaaaatcggcttcttaagggtacgtttagttgggtggatggggttggatgggagatggtcgtccagactttcgtagtatttggttcacgggcgagggatggattgggctgccaccctgaaaatattctccaacgatgttggataagtgtatccggcaaaattgattagatgagctcatccaccttcgctaccattaatcattaggaactaattagtgatgattagcatgttttgttgttaattagtgattatcattgcaatattagtgctcattagggatagttagtatattttgttgttgattagtgttgattatgaaaatattagtgatagttaacatattttgttattaattatcaatttactaatctcatcccatccaaccaaacaaaaaaatggcttatcctatccgcgtaaccaaacaaataacttggatcttcctatccaactaaacatgtatggtcatatcttatccaacctcgcccttgaaccaaatgcacgccataagagaagctcctataaaaattggtgcaaaaatacacattttcatgtgaaaatcatgattttcacaaatagtttgaaccgcctgtgaatatacacctattacacaggtggttctctcaagggatcatttgtgaacattgattttcattgactgtttaaaccattccatctccactatcacaagtggattgcatattttcttacaactcacctttataaatgaaattgaggtgtctaggaacatcgttttcaaagtagtgctatggagccagcgtgaacgagagctactcctatgttggttcttttctttctttggaataagtcaatttgcccccccccccccctcaattattacatttctttgaaaagcatcactcaactttgaaacttggatatagaaacccccattaaaacattaaatttaccccacttggaccaaatcgaggagtttttttattggaccgctgttcagagagcaatgttccttcttgctccctccccttcttactcactcgcaacctgtcctcctcaagcagcaacattgatttggtgatgattcacggtcttgtaggtggtgcaagactagggaagggacattcttctcctcctcaccatgcgactcctcaaagttctaaaaaaaaagaagtgcaagaataagttccacttcacctgtctccgaggacgaggggccatctccatctcgagcagttgtgacacgtgtggcatgaggaaagggtttcacccttgttgacagtcgttatagaccaatttcgactgtcagtataaccaaaataaagagaactagctatgcttgcaatgcatattntgtntagtataatctatttccacttgtacatggatcctatttgattgcaaagattgctacataga

SEQ ID NO: 38457 - DNA, 418 bp, Oryza sativa
ggtggtgagtatgcttttctcatcttccaattcctacatgggaacttttgtgcgagagttttgccattctcaagctatatccttcataatcattgtgtgcgactgtgaagtctttgtatcgactggactttgtcgtgtgtctctcgagattatactttgtggtgcttctatccacaatgtttctcttcactttaagctatgcatattatctatgtaaataaattaaaacattattatttccagacaaggagtaaaacttcatcatagagcaaaatgaaagataatattggattgagaaaaatggccgattggccaaaaccctagccctaaaacccatttcctttcttccaatcccctttcttctactcctaatggcgacaacagcggcgaatcgggtgaggcatcggagtgccggcga

SEQ ID NO: 38458 - DNA, 1349 bp, Oryza sativa
ctgggcttgggatcgttcaaaatcaaagatggatcgcaaacgagattttggtgcgatacgtggctgggtaataaacctttaaaggacagatttccatcattgtttaatattgttagaaggaaaaatgactctgtggccaaagtacttagttcgtcccctctgaatatttcgtttaggcggaatttggtgggagcgaatcttagtagatggaatagagtgcttgcttccatacaggaagtattattacaggatgggggtgactcgtttgtgtggtctttgcaggcctcaggaaattttactgtcaaatcgatgtatgctgcactaatcagtaatggtattagagtttcacaggatatttggcaaattaaggtcccttcaaaaataaaaatttttttgtggtacttaaagaaaggtgtcattcttactaaagataatttagctaggaggaattggcatggtgatttaaaatgcgctttctgtcatcagcctgagtcaattcaacacctgttttttgattgctatattgccaagttcttgtggcgagcggttcatattttgtttggtataagtaccccatcaaacttagttgagttattccaacagtggtctaaggggggtaataaaaaacaaaatactttactgttaactgcagcagcagcgcttttctggacagtttggttaacaacaaacgagttagtgtttgacaattacggaccgaaatcttttttgcaggtactattcaggggtacgcattggttacgccaatgggcgaagctgcaacggcatgaggatctgcgttcacagttgatcgcggcatcgcaacatcttgagtcatcagctttgcaattttttagttccaatggatggttatcagctagacacatcggtctttagtcgtctgaacttttatctcggttttgtttccaagtgttactctgtaagaacgtttgttataattggcatgagtctatcttttgatagatgaagccgggtataaaatatccattatctaaaaaaacacgaatgtccaaatatttttaaaaaatcaacggcgtcgaacattttagaatggaggaagtataaaggtaacgtgcgactagctaggcaaagggtggccagcgcaaaggcgcagagaaaggctggaaatgcacgcgatggaatgatctgaaataatccattttcacgggctatgattcactgtcatggatgtcctttttgacttgaacaggatactgattttggtgaaccggtgaggagcggttttaaatctcgaaacaaataggtcctcactggtgcggtggggattgctgatgcagtagcataaattgatgtatggatctggatccaca

SEQ ID NO: 38459 - DNA, 1212 bp, Oryza sativa
  unsure (1)..(1212): unsure at all n locations
atacttcggggcatggcnacatgtgtgttatcgtgtcttgtgggtacaattgtacactctggccagagtaaaactattcgaatagccgtgcccgcggttatgggcgatcaaccagattcaccgtgattagtctcacccctagtttagcttaatgaactggtgtagttcaagtggttggttgggcctgttgcaacgtggtgtagcgttggacaatgattggttaatattgattaattactacagctgttttactgcttcaactactgctttgaaatgcctgctttatgcaaaagaacccctagcttcctttggttatatcctgcatcatacctcctcttccggtatgacttgctgagtacagtgggtagtactcagtcttgctctcttttcccccacactagagttgaagttcttctcagttggagccgtctcagagaggttggtttcgtcgctgccgtcaaggtttgcctgtggagtggagtcgcccgctgctgaagtcaagcttcctggtttagctcacttttatctttcccgctgcatttataatcttttatatttttgtaagacgtgggtctgtatgtcaacaattgtcgtttgtgtaccctggctggtcctggacaaggatttaatgcacattcagcttagaaattctggttcgagaatttctgggtgtgacacaatctcacccattcgatctgttatagatgaatattgatcgttggatatgatgaatgaggaatgaggaatgtatcatgtttgtgaagaagaagaagaagaagaagagatagaaaacaattaaactgtttattgcatgccatatagagaggataggctaaggtcactgacaagagggacccgcatgtcatagagaggatgcaatgggtctaccatggatctagtccatagaggaggtccactatggtccatagagatggatgcctaagataaattggccactgttgaccgaaataatctgactattcagatcaattctgatctagtgatgcagagaggtgccacgtggagcctgggtggcagccacagaggacggattagctgataaaatgctgatgtggcaaccatgttggatcaacaaaggcagacccaggagcagcggcacacggcgaacaaaggagcgagacactgaggacaccaatggacaaggaatggtgaggcgacacttaacaacactttggcaaccactgatgagga

SEQ ID NO: 38460 - DNA, 151 bp, Oryza sativa
aactaagtactttggccacagagtcatttttccttctaacaatattaaacaatgatggaaatctgtcctttaaaggtttattacccagccacgtatcgcaccaaaatctcgtttgcgatccatctttgattttgaacgatcccaagcccag

SEQ ID NO: 38461 - DNA, 1501 bp, Oryza sativa
ctaagcaatttttttcttgtttcttcctactgcttaacgcaacaacacaccttggtccaaaataaacagctaaatatcctactagtgcataagacaagatgacgaatgcaggcggcggcggcggcggaggaggaggaagggggctcagttgtcgtcgtcgtcggcgtgggacgccttggatgacccggccttcttggggaggaggtgctggtggatgttgggcatgacgccgccgctggcgatggtggcgccgccgagcagcttggtgagctcctcgtcgttgcgcaccgcgagctggatgtggcgcggcacaatgcgggtcttcttgttgtccctcgccgcgttcccggcgagctccagcacctgacgaacaccaccacaaggccaaatttaatctagtgtatcacaaattcgatccccacaagagacccaatccccacggattcgcggcaatatcgcatatcgaacggatccaagaacacggagacaatggcgacctagatccccaaatcaatcgccatcaaatcagatccaatccgagaacgggtgggtacaggagcgaatacctcggcggcgaggtactcgaggacggcggcgaggtagacgggagcgccggcgccgacgcgctcggcgtacttgccggccttgaggaacctggcgatcctcccgacggggaactgcagcccggccttggagctcctcgacgtcgccttcttcgcggccccggcgccgatcgccttcccgcgtcccgccatcctataccccacccaccgacgagagaagaaaccggctgcgcgagcgagatcgacgcggcggcggaggcggaggaagcgcgcggcgaggcgaggggaggcggcggatgagacgatgttagtggtcgggggcgagagagagatatatatatagggttggttttgggtggtgggtgcgggtggctagccaatgggaggcgatcacgcggatcgtggacgtgggccgtcggatgcgatgggacggacggcggaggatgcgcgtcggggatttcggtggatccggaagcggcgggaagacgggcggagttttcggtttgggagggagggagggaggtgcgcgcgaagacggagacggcggatcggtgacgtggctctctggttttcgtgtcggacccactggtcgatctctcgtcgtggttcgagttttgtatgctgtggcaaattggcaaatagggagacagggagggacgtgaaggagagtatgcaacggcgcaaacgcgtagtagaaagcaatgagggagtagctattttcggcgtagatttattttttttcacgtaccgtttgtcttaaataagtacaactattatccatttaatttaataatttcatctatttttttcttttttcaacatattatataaccccatgctacagagtagtccaacaaggttgtataattcagtgtataaagtggagatacaaagtctagaggtgagactctcttgtcttattcaatccattcaccaag

SEQ ID NO: 38462 - DNA, 1501 bp, Oryza sativa
tatcatggttgttttacctctaccctaggtgtgagcaacatttccatccaccaaataaatattccatcatgtccttaaaatgtctctcatattagtagcttgcaataaaatatggctaaaaaaagaaagaaagaaaggacatggaaggtagaaaatattctcaatcattaagagaagaaagaaaatgagaaatacaggaaaaggagtgctcattaatatttttgggcaatcataaaaaatagttggagaaaaaccagtcatatctcaagatattatctgatatgactgaaagttaggaataaagcttagaagtgtcgacgggggatacccatagaccggatatagagagtattgggatccgttggtacgaggatctatgtagtacgacatcaagcaaacaaaagataaggattatactggttcaggtcccttagcaggtaatagccctaatccagttggtatgggattatatgatggaaaccacagattacaaagggaataacagaactcggtgataccgacgagaacgcagtcgagttggcacgactagatctcccggcctggcgacttggctcctgtaggctccagctccgtaggctgtggggatgtgttggcagtaatattcgatgccttaggtcctgcctagggggtcccttatataccgcgggtcagttgatctccaagtaggactcggagatatcggacccctcacgatatagtaaagacccagtattgtccgagtagaactctttccgtccatagattctatttctatcacgggttagatttcctttatgtatacggaaactatccgtacacgcgcgggtataccgtatcagtatacaacgtacatccaagggtagatggtataccttatccgtaaccctgacagtagcccctgacttctgcttaaatgaactcatgtcattgatcgcgacttctgatgtcggaattgtcgttctcatctagtcgatctcagtgcaaaaaccatagagacaaagagctatcgacaaaaaccgcatgaagttcaacggtcatgagtgaatttaaattgaagtctgaaaactaccgcgcgcaacggacccagaattttccggcagcaatctctctcctttccttggaatacgcgtcgtcggtagtgcgcttatttaaagggattttgggagtccatttgaagtccatttgccagaaaactctcctgccttctagcgcccttcgtcttctccgctctccgcaaagaaaaccctagcttgcttcttccctcttgttctccggcgatcctccgacggcgatggatcttgagaagtctacctcaaccaccgcgtccttgaggaagctgcaagacgacggtgccctcccttgtcgcgggaccatgcaaagggaggcaggtggtatataacctaaacccatcttaggccgcatggttgtcgttgaagattacatttcttgcggttttcttcctccgccttctcaatttcttcttcttgtcttgaatttctat

SEQ ID NO: 38463 - DNA, 1501 bp, Oryza sativa
taaattattcatgaaatgcaattccatttattaaaaatacttccttagctcaaataaatcccagaaaaatctaggaattatagaattaagcaaagtatttaatgaaattttatctggcctcattttatattggaatttattaattaaaactagatcttctcttctaggctttttaaaataaattctaataattccaattaaacaacaatttatatatttaggatttttagggtgtgacaagttttcctctagtttcttattaagggttttaatgaggcaattcgtgcgacatactcccttcgtactcgtaaaggaaatcgttttagacagcgacatggtgtatagaacacaactttgacttcttgtttctataaaaatatttattgaaaagtgatatatgtatacttttatgaaggtatttttcaagataaatctatcgatataatttttacattttcaaactcaataacttgagagttattcatgatttatattcttaaggtttgacttaaacattgtactaaacgacttcctttacgagtacggagggagtatatgcgtacgctatgtactatttctccaatttatccgactgggtttttttgaagctttaatagggcatagacatcacacggtgagtgtcaagggggagtccatgaaggcctagtctaaatacactaattggacccatcaccgaaccttgcatatttgcgaatgcattatataaaaagaggaggggccagtcatttgtacacttggtgaatggattgaataagacaagagagtctcacctctagactttgtatctccactttatacactgaattatacaaccttgttggactactctgtagcatggggttatataatatgttgaaaaaagaaaaaaatagatgaaattattaaattaaatggataatagttgtacttatttaagacaaacggtacgtgaaaaaaaataaatctacgccgaaaatagctactccctcattgctttctactacgcgtttgcgccgttgcatactctccttcacgtccctccctgtctccctatttgccaatttgccacagcatacaaaactcgaaccacgacgagagatcgaccagtgggtccgacacgaaaaccagagagccacgtcaccgatccgccgtctccgtcttcgcgcgcacctccctccctccctcccaaaccgaaaactccgcccgtcttcccgccgcttccggatccaccgaaatccccgacgcgcatcctccgccgtccgtcccatcgcatccgacggcccacgtccacgatccgcgtgatcgcctcccattggctagccacccgcacccaccacccaaaaccaaccctatatatatatctctctctcgcccccgaccactaacatcgtctcatccgccgcctcccctcgcctcgccgcgcgcttcctccgcctccgccgccgcgtcgatctcgctcgcgcagccggtttcttctctcgtcggtgggtggggtatagga

SEQ ID NO: 38464 - DNA, 1077 bp, Oryza sativa
caatatttgtctatatttatttagattggagatggtgaagatgatgttgagtctattgaattcccaaaatgcgtggtggcaagcaattagtgtctagtgggtatatgtgcttattgtcctttttttgttatttgttggcttgttgttgttgcttatcatcttgttaacacagtgctgtttgttgtactattattgaccctataggaaagggaggaggactgaaggagagacattttgccatggatgagaagtgttaactgaccatgccttttgtgtgtttgcatggaaatacagaatgatggaacttaaacaatgtatcattctgctatgttaacttatgtagttatatttatgcgcccttcctgtctagctgatgtagtcgtactttgcaatttgcatggatgatagttgatggatgaatatgtgatggagacatggacgatggacctaatttgtactctattgcgtgtatgcgcatgatgcttgctgctagcctgcatgatggataaatatgtgttatatgactcattgaaatgtatggtagtttacattttacatttttttgtccctggctcacgagccaaacgagctagctcgagctttttgccgagccgagccgagctagctttttagctcgttagggttaacgagccgagccgagccagctcgttatcttaccgagcctgaccgagccgagccgagccgagccgagccagctcgatatccagccctactcccaagcgatcaaagcccatcgtttccgccagccccagtcactgcccaggcgggcccacccccgtccacgtaagcagcagcgccggaaccacacgttaaaacaacaagcgcgcccgcgcgcggcggaggtgagagcgaccggcccgaccgagaccggtccggtcctcgcctcggccggcgcggttcgaactcgaactcgacacggctcgcgacgcgagaagcccccattcccaatccgcaaattcacttctctcctctccccaaatctccacctccaccacctctccaatccaatccaaccaaaccaaccaaccaaccctaacgcggcggcgcggcgagcga

SEQ ID NO: 38465 - DNA, 1378 bp, Oryza sativa
cggcgcatcatgcatcggtgccgtaacggggagatgggggcggcagatggtgcggcggcggcagaggaagggcggcgcccccctcggtggcgtcgttggcgccccacggcggcggaggaagggcagcgccccctcggcgtcccctcgtcggcgtcggtggcgcccaacggcggcatcggtagcagcgaaatggcggcggtgtgcggcgaaaagggtggcggtttgagcggcgaaaacggcggcagcagcgaaatcgtgggggcggttagggttaaccctaaccccccgacggcttcccctgcctttttgctgagggccggatgggccggcccaccgccccccttgcctgccagcctagtgccacacggtggtaggccgaatcctttagatttcggcccaccacccaatttaccatttaattttagtttttaattttattttcagcagcaattacattttagtccctaatgttttatgtaatttagtcgaagcagttcatcagttgtacaaacaattatgtaatggtcctatagaccactgatgttatgtgtttattaacataggtgtttatttaaataccctgtttcactaaatttatttgttgtcttaataacatgccttttgcatattatttcaagacacgctctactttctcgctttattaatttacaaaattctataaattctgtattttgatttagcaaattctcttaattatgtacaacataattaatggaggatttaatacatgttccacttcacactttgacttggaaattaatcacatgtcgatggagtcctatactttggtcatatcgaccataacttaggcaacgagtatctcgcccatcatcaagtggtctacattttgagatgattacccgatggagtcctacaaattgaccgcactggtcataacctaggcagcgagcatttcgcccatctcacagaggtctacatctcacgatgattacccacatgtgttattttccgagaatatgttttgaaaaatgagattatttgaaatttggttgaacacaaggtagtggagtcctaaacattggctgcggtatattcaccagaatatatttgcctggagaccgtgttttaggcagcaagtataacttgcccaccattaagagatctactccactgtttaattacttggatattatccacattgtgccacctaacattacagaatatgaagtcttacatttcgcattgagattacaaccacaatatcatgtttttattaatttacctctgtaaattaataatgttaaccatgattgtagggacatggcaacaaaagagttcgacgaactcgccctcgatgggactaactatcccatctgggcttctgatatcaaaatca

SEQ ID NO: 38466 - DNA, 1501 bp, Oryza sativa
  unsure (1)..(1501): unsure at all n locations
agataggtagaaaaatagctttattttaagacaaagtattgtgctagaaataactatattttaggacggaaggtagtacctaattgatctaatgggctgatgtcgggtcggtggctatacgctatactagggcatgtttctggaggtgttggtgtcacaggtcgtggttggtctagtcatctcaccctacgtaatggatgtgtctgttcctacctatcagaaataataatgttttggtatttctatggtaattggttgtaaaaactaatgcactgttttgtttcaaattaccttttcaaactatgactattaataatttctcgatttattttggagggtattatcgtaatgttataaacctattagattttacaaagttattttaacacgaatttgatgaacaaattcatcaaaaactatactccctctattccaaaatataaggcacaaccactcttaacataaagaccaaaaaataattattatcatcttgtagtttgaatcatcctaataaatataatgcatacatccaatatgatcagataatatgagagtggaagatttaaaaaagtaataatttaatggagaagatgccatagttaattgcatgcttgcatgcatgccttatattatataacatctactaaaagtggttgtgccttattatggaacgtagggagtatcaaatattgcgaaaaacatcaaagatttgtaaacagaggaagtacaaaaattaagacgaatgttcctcacattttcttgaatttcccgttcactagtatttcgtgagacatatatcgatctagtatcnattttctataatatgatactactacatttaattccatgaatggaaccctagatgagctggaacttggattcttggaacattggaagcactggtaaccaaaaaaaatagcgcaatcctctaaaaacaggggaaaaagaaaggaaagagaagcgcaactactccgcttaatggcggtccagtttagctttaagagccccagcgcgcccagtgtatgtgagctcgagaaagaagctgtccccaactatcttcccgcagcacgttgtaaagcgccccccttgtgttgttgggatttttacccccctttgggcccggttaaacaaagtcctgcccgccgaaagccgcgcatgcacgcccccctcccggattcaaaccgtcgacgccgtcgccgcgtgactctcctccgcggcggcctgagcctgaccacccccaccctcactcgcctcgtcgccggaaaattgcattcgcgccgctcgccgctccccccccctcttggaggccccggagctagctgcttggggggatcctcctccgctcggcgggcggcgatctcgcggcggtcccgaggaggtggcgaggtcctggctgcgacgagatgccgtgatcccagcagtgatgcgcggatcggagcatgggtgtgagccctccagggtgtacctgtaggcggcgggcgaggagcgggagttgcggcca

SEQ ID NO: 38467 - DNA, 309 bp, Oryza sativa
aaaaaaaattatccaccgctgcctccgccgcctgcccatctcctcgcttccatcgccgcctccccattgccgtcgcctcctccacctccacttccaccctcctcctccaccgcgcccactcgccccctccatatccacgtcgttggcgcaagttcctcatccgcctctgcctgccaccacttcctcctcctcttcccctctaccaatgccgcctctgtctccactacctcgtccccgtcctccacccacagatcggtctagccaccgaatcccgctgcggcaggaggccgcccggcccgctcgccgcca

SEQ ID NO: 38468 - DNA, 1501 bp, Oryza sativa
tacttgtaattagtgtccaaatatccgatgtaacagggactaaaaatctttagtcccatccaaacagcccctgatgttcaagcttcagccttcgttgttcaattacccaattccaacattgtttattatcacgcgtgtattgttgtttgattggggtggctatgagatgggaagaaataatccctttgattgcgaatataaccattttagaataaaaattattgcacacaaccattacaatattgtttggaaagggaaatatatttattactatctccattctaaaatcacaactaccaaaatgatttgttaccataaaaaaatcgtggcatcaatgctaaaatcatggtgatagataaatgttgctgtcattttaaaattattgatagccgatgtaataaatatagcggtaataagttatgcaacgatttttatttagtggcaacaaatttcgatattgccacaaattagatatgacaaaaaaatcatattacaacacttcacatcgttgtaatatataattattgctaccacttcatgtgcagcattagttatacaaataccaaattaaaagtttaaatattaaactatcatcctaactagttctttttatatcttgtcatggttaggatttaaacccaagacacgctcgcgtttactaacttatccatgcatcaattatattacaaaaatacatatattttcatttgagcctacctaactgagatttgaatcatgctttgagtatctaaaatatttaaataaaaagttgtcacatgtaaaattatagatctcgttgagagctatagtttccatataatttttttcaaaattcgtgttcatatgaaaaaattaagttcaattatgaaacgatgtttttattgtaataaatttgttgatcgtggtaataaaaaatagtgaaaagtaacttactatagccatgtaaaacaatagaagataaacatgcgacatagccatgcaaaacaatactccctccatttcatgttacaagacgttttgactttagtcaaaatcaaactactctaagtttgactaactctgtagaaaaaaatagtaatatttacaacaccgacatagtttcattaaatttataattaaataaatttttataatatatttatcttgggttaaaaatagtactacttttttctttaaaaaatagtcaaacttagagtaagtcaaaacgtttgtaacctgaaacggagcgagtagaagataaacatgcgataacatagaaataggcccctttggctcgtcgacacaggatcatggcccgacatgagctctgaactaactatactgtagatcgtagaacactctgccaagaacagaagtgcatggaccaaggcagccaaagtgccaaagactccgtccgaaaaaacaaaccgaaccaagaaacctctcataattcaacgacgatctctcccttttccaaggtgaattgttctgtattttctttttgtttgtaaactttgtgaag

SEQ ID NO: 38469 - DNA, 576 bp, Oryza sativa
ctcctttcttttcttcagacccacaggattagtagtagccacaatggtgccaataagttatgtcatgttcttcatgaccttaataactgataggcagttgctgctttgactcgcagcaattttttttcttttttatgaggcgtggattgtgcactaaactagtcgaaattgttaattagttttcgagccatgtgatttacaccgatcctctgagtaggtttgatgtttttttaatcatataggttctttaatatatatgtgtgtgtatgaaaattgcttacttaggcttccataatcgccgaactgtcccgtttgtttatggcctctgaactaccgaaatcgcggtgattgagataaacgcgtgaatatgcagcgttcggtgtcatgcaattacggctggaatacgaccataaacgaactcgagctggcatttaatatagtcaattacaaaggggtttgcagttggaaccgatgaatacaggtcacatacgaagggcctttgttcacaatccaagccgaaattcgtacagaatggtgaatgccgctttcaccttttttttaataattattttcagg

SEQ ID NO: 38470 - DNA, 1501 bp, Oryza sativa
ttctggctccgccactgagtcgaaatatatactaaagtactgattatatagacgtttgtagcatagccgatcagatagatctagtatgtatcggctaatactccgataccactctatactaagatattgaaacaagcaagatatgtcaaacaagaatgcttaatatacttttgatgcaataagatcttaatataaagggcagatttagcataatagacgagcatacgagataatgatagctaaattagataagatcgattgaaactccgatactatctctattgataatcataaaatagggtagacatcataattaaggatattacttaatagatcgaactcaaccgatgcagcattaagcataaagataagtatgagatctaaacaagatgattagaatctctaagagatgatagatacatgatataatctagattaataatgagatctaactctatcggctactttctaacagtaaaaaccagccgatggaaagttatataacgaaactaacaaagattataaagtatatatgataactcgacgaattacataaacaagattagagtcataaggatggaagcactaatcctgagaacgcaaaccgccatgacaagtttacctctagttgaagatcgaatcgatgcagctcaacccgaaagcaagaactcgtcgaaatagaacgaaagtaaaaagggtggcgatgcgccgaaagtgttgttgaactgatgttaatgattacattgggtacgggccatatttatacccgagatacaaaatatgtccttaccggacacgacttttatctctaacaaactttaagataccataagtctttacgacagacttttgcccaaacatatctctaaggaaattacacaaaacatcctaattattagatacaattgcctttctgagagctttatctccatcgtggcaatccttgtgaagcacgttgatcaattctagaaacaacctcggagccatcctcatcggaatcggctataccagctctatcggctgtattagccatcctctgtccgatccatcttagccgatgcatactccaggcgataccttcgcagccgatgcatactctgttcttcgaatctaactttttgccgaatccgcttcgattccaatgccgaacctggttcatatcttaccaaatttggtcgttaacaatcagccgaccaatcgccgccaccacatcatcagactagaacagactgttgatggggttcaagatatggatcggaatgactaagcaacacactcatgcaaaaatacagtattgcccctttcacctctctcacaattgcccgtaccaccacatcagcaaagaaaaaggtactaggaggtgctgtatcttgcaaaccgtccgatcgggtagaatcaagggcccagatatgatattgggcccttgatgaaaatggtccgcgtaaagaaaatctctagcctctgccaaaaatacacacaactaatgagttgtaaaagttaa

SEQ ID NO: 38471 - DNA, 1501 bp, Oryza sativa
ccgcgtgttacatgattgaccgggcgtgatcagcacagggaaccccctcctcgtcttcttttgcgcattagtcccttcgtaagagggtaattatggttgagtccttttgcccagagtaaaaaaaaaagtcatgtaatggagttctcctatttttgctctgcatttccatgttaattccttatttgagttgaagtagtaggatgataaacgggagcaaacggggtgtgcctatttcatcggtttctggcaacacggatttgtcgagtttatgaagtcggccagttgttgtcgtatataaccgaaaatggtttctttaattatgtaacgtctatgccgacaaataatgtggcgtgcgacaaaactaaaatgtaatatatctttttgtacgggcattgcaatgacgttggcgaatcataacgactacacgtttcacaattggatcatttaaagctaccttattcgtcagtggtacgaaatatgttacgagttacgaccgaataggacaagcgctcgtgcatcaaccaatggtttgaatggttgcatggatttttcacgtaaaatattaatatctgcatggatcatatttgtgtacgtcgttgttctcctacgtacaatttgctaaattttcacaagtccctctagaactattcagaaaaatctttttgacctgatgaacaggtgaacacaagaaacccaggaccaaaatgctacataatactacagaggctagaggggctaatatgaaattatcaggagagcaacatttcctggacacttttacaaaaaagcaaaaaaaaaaaaaccgacatcgcaagcttgggtgtaacatctgagtacctcacatgttgaacatctccctgtacttactgacatgtgacaaagtggtatttaatctctcttctcttcaagtcttttgcaagagccccaggcttcccttccttcacaatctgtgtggagggtgcaaaagagaaaggccttcttccaggcaggctgcactgccgaaggcgaaagcaaaataaaagggtaaggaggaggagatggtgttgcctgtgtgtttatattaagctttgcaggagtagtgtggagtagagagaagaggctctcttcttgctcctccttctcttccttcttctgctctggaccaccgggttaataggagcccccccatccctcttggttttctgcaaacacgcaaaactctaataatcctgtctatgtttctctctctccatagcacttactctttgtgtgagtgtgtgaaggagagatattatattggaggccattaacttatcttcagcaagaaggcatttttcttctctgtttttgctcatcatagagttttttttttcttgagagaaggcaatgtttgctggttgctgctgtcttcttcatgttgttgttatgtccctgatttgaggactcttatgtgccagatctgtgaggaggcctctcttgtgcttgtgttggtggggggagccgcacttgaggtggtcaggga

SEQ ID NO: 38472 - DNA, 1501 bp, Oryza sativa
cgaggtgatgggtggcagtgacatggggcgaggcagcggacggtagcgagacaggcgagccgggtacaggaagcgacggacgacaacgggatagacgagttgcagagggaaagcaacaatattatatcggcgtgggttaggcgagccagacgatggcagacatagggcaatgacggtaggggcaaggcagatggcggcggaggcagcaacggcgaggcagcgagcgacagcaggggtgaggttgccggagagaagaaggggcttgtgggagagaaatttggtgtggggtccaccatttggcaagtgggtatggatggccagatttggctagttaggagagggatttggccatccaaatagcttggtaaatcgaatagagagtctgttggagtatgttgttttgctagatttgccaaaattcggcttggagagcaatttggaaaggctattggagacttggagttgctctaacgaatggaacaatggattaacatacatgcttcctaagctctcaaactatgtgatttttaaagccttttatgtacttctgtaataaatttatttttagtttcttctatttatcccaagttcatttttagagaaattattacatcggagtttgtgaaagtagtgaataattatatttaaagtagatatagtcagaaatagttgcattaggatttgataaagtaggggtattctattttttggttttgtattggtatatgtgggatatgtgaaaaatgatcttattttggtacagaggtactccgtccgctaatataaacatttttatagttgaacacaaatattaagaaaataggtataatcaaatgggcgaaggttgtgattggtttagtggtgaaggtaggtgaggaaattgaatgttagagtgttgtgattgattggaaagataatgttggtgaagaaattgttatattttagggcaaatatttaatgctagaagttgctaaatcttgggacgaagggaatattaagtttataataacgaatactccctctgtcaaaaagaattcaatcatggggatgaatctgaacatagggcttgtttggttcaataccctaccaaaatatagtttttgcactaccaatttattggtagggtagagttgtatatggttcgaggccaatttagaaccaagctttgagtagaatatagaaaatatcaaattggatattggcaatgcccatgatttggtttcaaaccaaaactgtcatatacactgttcaaactaccaaaatattggtagggcacgttttggcactaatccaaaacggcccatagtgcatgttaggtttatttgcaagattaattttttccttctgaaaaaggagggaatacgctatttgtgccgttgaatagggattataaattatttaatcatttagcgcaaaagaacaaacctcccaactgccatttagtgaaagagaagggattgtactatatatttcacacaaaacaatccctaatactttgaaa

SEQ ID NO: 38473 - DNA, 1501 bp, Oryza sativa
cgcctggtggtccatgagtggcccgattacgtccgtcagagggagagcctgcacaacgtgaagtcacgacacgatctcgaggagaaagatgtaaaggaatcatcgagtacactgacattgatcgcagcggcgcgttcggccgttcccttctcgcaaagggggatcgagatctcgcccgtcgctgagggggcgctgatgatcacctgactgacgcggcgccccccggtgtcactgtctagacctgtgaatcgaaaacgagaactcgataagttaggagaaacagatggactcggaacaagattagaaatgcgagcaaaaatacaccgaggagagatccgggtcgtgtcctctggcccagagtaatcaaaggccggatgggcacgggcctgcagcggttgaatccgcctacctacgaagtcggcagcgacttcgtaccccgacaacccccaatttcggagatcatcgatgatctcgataaaagattggagggagggagtcagggcgggtttggcggtccactcagggattttgtttggttgttctttagggacaacaaggacgggatccgagttttctatctgaagatagaaccatctcgcccgccacttgctgtgagaagaggggcattggaaggggatgtaacgcgacttcagccgatcccgaagttggaatgcaacgcatccagataccctgttgggttccatccatcgcagctcatagtaaaagcggaatagatcaaggaagggctctaccccaatgtaggcctcgcaaagatgagaaaagatgctaaggaatgcgatggagttggggttcaagtgaagcaaagaaaggccatagaaattcaagacaagaagaagaaattgagaaggcggaggaagaaaaccgcaagaaatgtaatcttcaacgacaaccatgcggcctaagatgggtttaggttatataccacctgcctccctttgcatggtcccgcgacaagggagggcaccgtcgtcttgcagcttcctcaaggacgcggtggttgaggtagacttctcaagatccatcgccgtcggaggatcgccggagaacaagagggaagaagcaagctagggttttctttgcggagagcggagaagacgaagggcgctagaaggcaggagagttttctggcaaatggacttcaaatggactcccaaaatccctttaaataagcgcactaccgacgacgcgtattccaaggaaaggagagagattgctgccggaaaattctgggtccgttgcgcgcggtagttttcagacttcaatttaaattcactcatgaccgttgaacttcatgcggtttttgtcgatagctctttgtctctatggtttttgcactgagatcgactagatgagaacgacaattccgacatcagaagtcgcgatcaatgacatgagttcatttaagcagaagtcaggggctactgtcagggttacggataaggtataccatctacccttggatgtacgttgtatactgata

SEQ ID NO: 38474 - DNA, 477 bp, Oryza sativa
atccccctttttatcaaatcgagctgtaagattgccttttcaaaggaagggttgagatgtaaggtatcaaaataatttttcttttcggtgcatcggaatcagacattttccaagaaaggtaagatgacgtcaaaaattgtttgaatgttttcacagatctttttttagcatttaaaaatagctttgaaaaatatagagtccttaaactaacgaccattctatctaggttctcgaactacagtcgatatgctctgataccagctctgtcgacccccgattttggaactcggaaatcttctgtgtttatcagtaccaatccctggatcagtagttggtacacacatacatagccaaatcacaacatatcacgaatgaattcaggctaagagagttaaatgcttacattagggccaggcaggccaacaactaacagagaacaacagcggaagacaaaataatacaagggcccggttgaca

SEQ ID NO: 38475 - DNA, 742 bp, Oryza sativa
acttgtgctgaccatgttggagatgcaaaggccagccacttttaatcagaattttaactaaagttgacaagtccccatttgatccctttacaatgtatccataccacaaattaaactcttggaacacaatttggaagaactaaagaagaatcccattagcactgaatcacatggctagattctctctgcagtccacaggtcgtgcagaaaaatcagcaaatccgtgggtcttaagtcttatctaatcctgtgggcgcccattggttttgcaacaattaaacaaggatattttggtcagtacttcactactcggaacggattcaactaagccacacacaactatatataaaaaaaagatcaaaacaaaaggtaagggtttgcaacaagaccgaagagataaatagaatgcaaaagaatgacttattttttcatattttacagatgaaccttatccgggaccatgataattaagccgttccattcaattcaaagatgaggttgaagttgcagccacccagcttgctactgcagaagctgactgcacaactaatgtgcatttacatagactaatactgactcactgagaccctgtttagatgggactaaaacttttaagtccttatcacatcggatatttgtcactaattataaatattaaacgtagactattaataaaacccataaataatcttggactaattcacgagacgaatctattgagcctaattaatccatgattagc

SEQ ID NO: 38476 - DNA, 232 bp, Oryza sativa
tatatatatatatatatatatatatatatatatatatatatatatatatatatatatatatatatatacacacacacactctctctctctctctctctctctctatatatatatatatatatatatatatatatatatatatatatatatatatatatatatatatatatatatataactcgctctccgcctctacttcgcgccatttccaaatccatttccctcgcctcac

SEQ ID NO: 38477 - DNA, 372 bp, Oryza sativa
tgattgtatgccaggtgggcccttccattaataatgtagcatatgtttataggtaactatttatatataaattggctactaaattgattatacatgatttagagttagtagttagctatactattaaccttgctttttattactatgattactataatgtaccctcaaagcgtgtagattcacggaggatatttagttagcctgtcctctcacccaaaaaaataaaaataaaaatcgaccccaaatttaaaagtcgtttggtaaaatttattaagatggtaattaaattagttgcgtccccaccgataaattttgccataataaaactgacccccctcgagccgcggtgagggaagcagcagcggcggaagg

SEQ ID NO: 38478 - DNA, 1501 bp, Oryza sativa
aatatatttatttgacatctactctactgtacaatatcaattttatttattagcacatttttaagttgaccataatctaatcatttgatattaatatattttattaaatagtgagttatataccattggaaagcttatgaatttagatgaatttaggttcaagtttcactcgaatcggagctaaaatgaataatttatactaatttaaagattcaaatttgagttaatccgagaaattgtaaaaatgcactgttcataaatgatttatttttaatcggaaacattatccaaaacccaccgtggttgacatgtgggaccggccctggttgacttagggtcaaacctgcttgtttaattaccattgggtcccgcctgtcataggaacaaaatatataattgtgttttcttagattttaactatagggaccccacctgccattgagtgggataatcaccgttagggataggattactgtgcgctaatcacatgtgggtcccacacggtttctctctctcctcatcttcttcttcctctcgcccgttaccgagcgaggcagaggcgcggctcggcgcagccggcgttgccggcccgagccgggacggcggcgggcggctcggcgacggccagggtgaggcgcggaggagctccggtgatctcccgccgatggcagccggcgcgcgaggagacgggggcgcgcggcgccatcaggcgacgccatgcccgagctcggctacaaggggcttcggtgctagggacatccttcggccgaattgaagggtgcgggagcatctacgaggtatggggattcgatttcacgaactatatggagaggggagctcccgggatagcctacccacggagagctcgccggcgatgaaacggcggctggggcggcacggccatgggcgctaatcgtcgattttgaagccggcgctagcaattagatgtatggaggacgctacgggcgcgagggtgtaccgcgagatggcgagatggcgaaacgcagcgaagtggagctcgacgcggtgcaggacaggggcaaacggcagcgacgtaaggtgctcgacggcgtttcttgatgtccagcggctacccggcttcccccatggcgacggcggcagcacggctcttcctccactccctctaacctcctgctccggccggggagcctcacaatggtgatctctagcggtggtgagagggtgatcgcaaggtgttcgatgaaatgcatacgagaagaaggctgagagggatggggattttgttgagggcttcgcttaggatgcaagcaaactatggggataagatcaccagcacatgcctaggcgagctagagtactaatggtgatcggataagagcaatgaggtggatgacgcggctgagattcatctccttctccattaaggttctgtggcttaatcatcacacctataacctatagactgcaggtctgggcgctagctggaggagagggctccgttttatccattgggcgtgga

SEQ ID NO: 38479 - DNA, 192 bp, Oryza sativa
ccgatgtcgtgtacaagtcgtattgtcggaatcggctgtatcggcttacttagcccgactcagacccagccgatcctaaccgtagccgatctggactccggccgattcctgctctgtttccgaactcgatctccgcttccgacttcgttttgatccaatcctctttcctgacatagatgttaccaaatttgg

SEQ ID NO: 38480 - DNA, 160 bp, Oryza sativa
ccgatcaatctctctcggcttctccttcgccgccactgcctaggacatccccgcgccgacgccgccgtcgtatctagccgttgtctcgcgcgcgtcgtcgtcgccgcctccgccgcctcctccgccgccgcatctctggggtgagagacgccgccgccaa

SEQ ID NO: 38481 - DNA, 1501 bp, Oryza sativa
accacaaaaccacaaaaccagatcaattaacctcactcggttgtttaggctgtgattccgtcctacgtgacattacagtagttctgtctaacctgacacgttgacttggtccacccatactaatattgctcttaaatggcaattatagccacatgaaaaaaaaagagaatagtggatcagccagtgagttctacctcgagacggccatcgctggcgagctccaagatatcgcccacatgaaactcgagcttagtgaaggtgggcatcgggatgtgccgacaacggcacacatggaacgggccttcctcacgcaggggaagcatgtaggtggccataattcctttctcgcatcagcaaggttaacgaaggagggggcggtggagccagaggtgggggcaatatgatagcggcagtggtatcccctcaaatcctcatatttgcttccaaggcgattagcaaagaagccttggcgtcgaacaaagacaaggagagagatgaggcactgagttgcagagaaggcgacaacctcggattcagctgccgattggctacggtgacaacccacggtgcagatctagctcatcgcctggaggggaactgtcgggtctcaaaactaatgattcggtaaccgacatgtttagactgtatcaagccctggatcagtagattgatacaggttcaacaatctgaatcttcattgcatacatttgaacaaggttccaaaggagatattattataaaatacatgggtatttacaaacttgtagctatctaatacaacagaagctatagaataaatcaactctaatgttttgctatagagttaaaccatctaacaatactagacttcaagactaggtttaaagtgaactaacttatgtgattgaactcccggcttcgataagaactccaaatggactctgaaaaaggtgaggttgaagcaagggtgagtacaacgtactcagcaagctattatattcaatatgaatgtatgaaatagcagtatttgagtagggctagatttacttgcagaaagcagagaatgtagaagaagaaagcttgtaatgactttaatgcaacaatatttagtaaaatctcgaattaggtttctaaccaaataccatatgaatctcggtactcaattccgtgagcacggctattcgaatagtttgatgaatatcctactgcagtagatgtacgctttacccgcagtccacgacttgccaatattcattagcttagtcatggcccagtattaggttattaacaattgtggtacctgttccatgaacttatatcctcatgcgctctgaacgtgacgttaactgcagcgagaggagttctggcgttaccggggtctttagagaggactgattgtatgacaccatgtcatcgcaatcagggttcacaaacgtgatcacaatatatctcaaatacatatttacctgtgcctcggtaaatatcacaattgccctactcggcgtaaatttgcctcctacac

SEQ ID NO: 38482 - DNA, 1501 bp, Oryza sativa
aggaagaatttggatcaagaatcaaaggatgggtttaagatcaaaggatgggttaataattaattccaataaaattggaattactttggttaatttaggttcaagggaaaattgggaaggtttcttagaccataatccataaaaaaaatagaaagggttttcaaactaattttgaataaagaaattttagtcaaaggaaggttttaaattaaaaccaaatcaagaaacaccttaatttaaccaactatatttttaaatgaaaaacacaaaagagattaaataccagagaggttttgtgtgagttagttttaggagaccccactaattatattgtttaggaagttattaagaacataagactcagcatgatgcagaattagaaaatggttagttttcggtatgttacaggaacggtggggatcggaaccaatcttcgtctatggtgtcctgtatctagcacaaaagcgtcgttttaaactttcgatgtcacttacatataggcttactagttatttaattatttttatttgctgactataaatgtcacataatcaccacataaataccacgcgtgatgaatatcatgtcaatgtaccatctagttggcatgtaggatgaaaacaaccatctaaagcaccaagggaagtaattgactcgattttgacagttggaaggcctatatatgtgattttgtggttgagggatgtgaattagacgatgaaatagttgaggagaacagatggacatcgttccataatttggtgctattatataaaggagcaaatggcttgcgtgaagtccgttgcaattggtgagatgcataatgatggggaatttttttcggttttagattttttttaatatttacagaaataatctatcgaccaaaaaaattgcaaaaatagcccctgccgcccacctctggggtggcaagctgacgtggcaaacatgggaggaacgggcggtgatggagggagggttttttgcaggaaaacccttgccgccctctggtggggcggcaaggggcccgaatgcaaaaaagtcagtcggggccggctattttgcaggcggccccttgccgccctctggccgggcggcaggcctcgctgcctataaaaggcctgctgcccagcccccagccctcattcttctctcctcaattccagtgaaaaaaaaagaagagaggggaggagaagagaagaaggggcgaagccctgccggattcagacgccgatttcaggtaatattcatagatcctatatgtgactattgagttaaatagtgtgtattctttaaaaatttgtttgaataaatgcattatatttttagggttttagttgtactaatctagaagtgcgtattgtagatatcggtaactacgtagatctgctagtttggaattaatacattaccgttgcattggcttacacaagaagatattacgttgtagatgtttattgcatgaaagagtaatatgatctagttatttcgttgacagata

SEQ ID NO: 38483 - DNA, 1501 bp, Oryza sativa
attactactaattacgtatcatcttgataattgaatatttaataattaattttaatagatactaaattaaaaaaactacttccttttacatttattctactccctctgtcccataatataaagaattttaggtggatgtgatacatcccaatacaataaatcttaacaaacggtctatcctggatttattgcatgtgtcacatccacctaaaatttcttatattataacggagggagtatataacgataatgtaaaagaaagttccttttacatttcaacatcataatgtcgaagcaagaaaaaaaagaaactggtttacttcctctatctcataaaataaccaatacttagatgtggcacattctattactatgaatctggacagagaatctatcactgtccagattcattgtactaaaatgtgtcacattcaatatggaacggaaggagtaccgcgaggtactgtagaacttgggagtatgtttgaatgacacttcgacagcatccgtgccaacgtatacgatgatgcgtatacacgaggtttttgcccttttggacatccatgatatactacgcgcctcgtagtccgcaagaaatgagtgcggagtagatcgctgatcgcgtcttcccgtcgaaattttttctcatcatacggccactcgacgaccagctgcagtaccaggtaccgaatcactctactcctactagcaacgacagtaaggtcaattcagagaagcctgcatgccaccgtttctttccctctctctatcttttctgactgatggatgcttgtcgttgtacgtatctgttcggttccttctctcttcaaagacgttggctaatcacgccctgcttaggggtgttttagatccacgggcgtaaagtggatactattaggatattgcatgaggtgttcggtactagaaaaaaactaattatataatccattagtaaatcatgagatgaatttattaagtctaattaatttatcattagcaaatatttactgtagcaccaaattgcctaaccatgaagcaattaggcttaaaagattcgtctcgaaaattagtcgcagtctatgcaattagttattttttagtatttatttaatactttatgcaggtgtttaaacattcgatgtgatatggtgtaaaattttagggtgggatctaaatacccctttaccacattccatcaaaaactttacaccctgtcacatcgaacgtttgaatacctgcattaagtattaaatataggctaaaaaaagaaattacataaattgtgactgtcgacgtttgatgtcgcgattgcggtatttgtatagtatgtggatcgttggtactaggatatacgcgagactgaggtaaaagagacggagacgaggattttatacaggttcgggcccttgaatcgtcaggtaataaccctacatcatgttggtcgaagccggtcgttacttttattcatcataatcacaccagtacaatatttggggtagcc

SEQ ID NO: 38484 - DNA, 1501 bp, Oryza sativa
agttttgcagttacattcaatgagaaagtcacaaggacagtcagacaattttcaccacatttagcagcaaagatgaggccacccttaaggtggggatcctctccccctatttcttctataacattcttctttttttaaagagtctcagaagaacgggctaacaacattgctgatatttgcagacctgtcattcgtggccgaccaagctcaaaaagatcaattcatatttgtggccggcctcgatgggtttttgttgtattattttctgtcggttagtataaagcactgacctccatacatactattctagaccatagttttttttttataaaaaaaacaactaaataaataatgaactcaacatataatttattttatttttgcagtaagctgcttcctctggatgacctcatgtagtctccttacggttctgtgggcactaattgttggtctgcttggtaaggccaaacttgaggtttaaaattttaaaattgtgcatgtgtgcctaatatataagtttgtgccttgcagcaaccttgcttcacgccagtttcagaacacctaatctgaaagcacgcctgaacacattcagggaggaatttcgagcagtatggcggaattatagcgagttttaaacgccctttttgtctaccccatgtgagtgccttcatcgctgtcttatggtcgaaaattgaatctagcgaagggcttaaagtgctacctgttctgtcagtgcatcattgtggagctgcttattggatgtctctgcggtggtgcaatgtagaaggacctacttcagtgtgctttcgaatttcttgattttctctgcagatttatgtggtaaaaatgttaccaagttccatatctctgctgcctcttgcgactctttaattgtgggagattaaaaataggcatgctattttctccagtttatggatttggctttagattgtggattattctagtcccccaccacatggatctccatagttttagcttctggtccaaaacttctactgtattttgatacattggggaaggaacagcatgtaaaagagacagctatcctgaagagaagaaaaaagatattgttgtgaaatgcctgttatttttcatcgttcttttacagtaatggcacattttgtttcacataggtgatttccattcttttagatttctccatcaaaaagctcctcgtaggttttgtagacactctcggggtgagcaaatccatctcctctgatttgcttaacctgtccaacatgaacaatgcattttcagttattacaattccaatacaaggcctacaactacaagaaacccttggcgtatccactatacttgcattttgttcaatagtacttttttctgtactggttactaacttatcggaagttcagaactgtatgaagtttattcatccggaattgcataagatatgaagacagaagtgaaactgttttctgcacttgagacagctgaaaggttggatgcacttgcc

SEQ ID NO: 38485 - DNA, 1501 bp, Oryza sativa
attttataaaattagaaccgtgccactaccgtcacatttttcatcttttttttctttcctataagtgggacccacccgttagattaatcttctttctcccctcttttcttggggtctgtttagattgatgtcattttcaaccataccatttttttttgtcaaagttacttaaaaaatgtctacatttagtttgctgctaaatttaacaaatactttgtccataagaaatcctgctaaaattgacaatgccaaaatttggtaagatttattttggctacaatctgaacatgtccttattttcctatctcccttcaccgctggtaagggaggtggcgatagctcctcactcatcggcgccatgggcaccgctgccaagaacagctgcattgacgtcgtcatcctcctcattatggcgttggccctgtccgcgcagctcgcacctgttaggcccgatcgaaatcacagcaccggctgttgctttctcctactgcccgacgcctaagcctccgatgccgcctaatccttaaaatataagtatttagcaagatactaagtacaatgacttagtaaagtggaaaaaaatatatcttgatcgtgtaaagttgtcaaggataatgacagcataattcatgctttcatctgcctctccaaaaaattgagacacgtacatgacttgtgtaaaagacaaatacaacagctggcgtaagtgaacatgctgaacgggctggtgcacacggtagtcggcaccaaggccagcgacacatgctgcccgctgctgtccggcgtcgcctccctcgcaggcgccctccttgccatccgccgaatttggctcaacaagtggtggagattgatgaaaaaaaaaagaagagaaagagatgatgaagaaaaaaatgtatttgacgggtgggtctcacttatagagaaagaagatagaaaacataacggcagtggcacgattataattttgtaaaatttcagtgacacggctacaaatagacgcactgtaataatatttatctaaaatgttatattttcaatgacatggattgaattaaacccttacatctaaacttgcgtgtcagtgtctcacaatacatcagtagtgctacagacaatctccagttccccgctgccaggaaccaatgctggattgcgggaatcaaccaaaaaatggctatcatctcgggtgatcatattactcgatctgacccgttgatctatagaatgggcggtcaaaaaacgggtccagtactccagtcatgtaccaacccttcgtcccaagtgccaactgcgcctgtccgatcggttccgatccgaccaagccacacgtcgccgaatccgaacagctcttccacgaaccacttgcccctcctcacgccctctcctcgtcggtttcgaaccatctagaagcgtcgccgccgactcgccatctcctctctaggtcaccggatttcctagccggcggcgagctcgtcggctcaggcggcggcggcggcggcga

SEQ ID NO: 38486 - DNA, 1501 bp, Oryza sativa
aaaaagaaggtgtagcaggtactgcaagcactgttcatgttttgaaaagaggcactgctgcttcttttcttgggcgtcaggcggtggatgaggcgcataattgttctttcgatatgtcatgcaatgaccactgtaactacacatgtgtggcgtgtgaggcatggagtaactcaaagctaccagtattcgtactagtatccctccaattaacttttgatatttttggacaatatataatacggttttagaagtatgtccttgattatgttttttttacctttttgttacaatatatatataacaaaaaaaattacattttttttaaagacagatctatctacgatgttatagtgcttttaaactaaatatttttaaagatattgatgatcaaataaaagttttatcttaatctcatctaaaacgtcaaaatttatgaaacaggagagagtattacacttctcatctcgcaacgaaatcaaagcaagccggaaaagcccggaatgtgtgtgcgtgtcaactttagatcagcacaagtcaatttcggaatatatgttttggacaaagaatgcattacggaatagtaatatctactttgttcctcctgttatgctgcaactttgctcctgctaatttactcactgttactacttcatgacaaaaatacaactatatagtactactggtttatttttttttataaaattagctatggtatcccaattcaataagctctgcagatagtatggcctcttctgagttctcaccctggcactgtagaaagcttcggtacacaggccttctgcttgcttccttctccaggtacatgcctgttgaaagcaaagcttcaattttgtttctaactttacttttttcttgtgaggatgggcacagggggcacatgagcaaaagttgaggcagtggactactagagacctttccttaatctaatctgtgatgatggattctcgttaagcatatgttctttccactctaagatacggctgatttgatccctcattggatttggaacgcttttcaaaatgcttgtttggttttgtcgatatctcgcccaatccggtggctctctctcagctgcagctgctcccaccactatccaacaattgcagtggcagtggcagtggcacatctgctgcttttgtctcggaaatgacatgtacatactgtttgctgcatagaataattgcttttctcggaaatgacacacagcgcagtgcgagagcatcaaagggggattggtcatgggaagcggcaccctggctttcccgtcaggcacaaccctttttatcaattcatgctgctctatgcccatgttcagtacagtttctgttactactagcattgacatggcactaaaaaaaaaaaatccgtagacagtacctcttgtacaagagacagccagccaccaaaactagaacctgtaaataggaataatgattaatcgatgacagtggcaaaagctatcggcatcgttatagtactt

SEQ ID NO: 38487 - DNA, 1501 bp, Oryza sativa
ctggatggcctcgtactgagactgcaatgcctgctcgcgcacttctcaaacatgatccacaccgacgctcatcgtcttgatcgcgtcccatacttccttggcattgtccttctttgatagggggcacaacatttccttgggaacggcttggagaagggccgccattgtttgccggtccttcctgaacttggcataccccgggtcgatggcagctcacaggccttgtgcctgcaaaattcacccgcatcagtagcgcccaatctgcatagtttgttctcgtgagggtagggtagcatagtggcacgccagcctcccgtggcaccggctgcataacgatctacccttcaccctcattgccacttccgcctccaatcttccacgccgccgcagtggggtgtttcgactatgatcgtcggtcgacatagcctcagaatcaatgatgaaccgctcggataccacttgttgtaatttgatttggtttggctaacctaacactcaaaattctcatgcgcagcctcactttgttttctgacacttataggtttcacaacagtaaactggagaactgaagaataacagagatagagtatttggcgctgcgtaaaacttgcagcattttctcggttccttctattataatactccatactccaggattttgttacaattgaaaaagatccacaaaacccgcccagatcctactgaattgcgtcatcccacgattgacctgagcgatcttgcagctatgacttaattgatgcaagaactgaaaatacagttagatactccttctacgatccgaactcctcgtgaacacaacacaagtcaagccttatttttttatgaaaaatggaaattagattataccagctacaagattacatgcatcagtgtcgtgctgagcgctgcgatcataggcgactccccacaacacaagggatcaaaatactctacagtcgaagcccacatgtcagtgataaagacaccgtacatttgactgcagaggatctcaatcccaatatgagagggctgcagccgccttgcccctctcccaccggcccgcatccccttcccactcctcggtgacgctgcaaccacctttctcctctcccgccggccgccgctcctccctgccgctcggtgacactcccatctcttgcgtgatggatgaagagaaaaggaaagagagagactgagaggaaggagagagaagatgggagaaaagtaaggatgacatgacatgtaggacccatttttgtttttgccatgtaagcacctagtcgacctactcgatacgagcggaccgggtcaacttgccacatcagtgaatccagacatctacactgctgctggaggagcaaatttaatctggctttgcaacttggaggtctaagattttctggtatttcggtttagtgcggattttaaaacttgacgggatgagggacctaaagtgaacttattccccgtactttacgtctcactcgagtttattcttcca

SEQ ID NO: 38488 - DNA, 1501 bp, Oryza sativa
tatggacaaatcatgtgacaaaggagacaaaaatcctcaatggttccatagtttagcttgttttgaagcatttgttataaaaaaaattctcgatgaatcttatattttaaaaataggccgtaatcacaaatatctactccctccgtcccataaaaatgaatctaggaccgaatataacatattcttttttcactcctgatgattgggttaggtaaatgtggaatcatgtaggctgccatatgctgttttgtagaatctaataggtttatgtaccatcaaaccttgcaacttacctagttcaagtcatgcatcccatacaataaacttatgacaacattataaatctatttaacaaaagacattgttgataaaatagctagtaatattaaaaaaactctctcagttatctccttttgtatcattacaatagttgcatatacacgatcgagcttaagtattgcaaaataaaatcctcgttatttgcttgctagctcatataagccataaaaaaattaaattctcaaagttaattttaatttatttaggcacttttcaccattttcttttttttcagctattaaccacacatatcctagtctcgtttgttttttatgatttatcagccaaaactattcagcagcacaacggtatcattgtttcgctcatgtttatgcaaaacacttattattagcaatttcttttaaaaaaatatgagtaaagcttttaaattagtgttttaacaattcaaaagagaatacggtaaaatatactacaatgaggaaacataaaaatcaactttaaaatttaattttaaactttaaaatttgacttataaatataagcaaaagcgaaacaataaccaattatccaaacgatatgacggagtaacacgatgaacacacgaagtacacgacacatggtgggcacagcagagagaggggcacagaggatccaggccacggccatcaccgcccccacctgctccgggctctcgccgattccacggcccccaccaccaccaccaccacaccaccaccccccacgccggcgaagagaacccaagcgaaaaaaccgtacgaatctttcccattttcacacgaatttcaaaccaaagtctcctccgacgacgccgcgacatttcaaatctcaaccaaatcctcccccaattcgttcgaatctctcccccccttccccccacccgcttgcttccgtgttctacccccctttcttcccaattcgatctgcgaatatcgctgcctcgattcccaggctagggctcgcgcggcggccccggatcgagctgccccggtgagttctccccccccctcgccggcgaggctagggtttgggcggcggcggcggcggtggagcgcgtgctgttccgtttctctggatcctagggtttgctgcgctggatcgagcttgttcgttgtgatggtggtgaggggaggaggaggaggtgagtgacggtttgattggcgtgttgaggggtcgccggcca

SEQ ID NO: 38489 - DNA, 522 bp, Oryza sativa
ttaaagcaagaataatgtatcaaacaaaggcctaacatatttagatacagcaatatcttgatataaagggcagatttaacatatcaatgaggcatatagaataaatatagttaaatcagatacgatcggctgaaactccgatgctattctaatcagcaactagaaggcaggctagagatcgatattctaagcacgacttaatagatcaaactcaactgatgcagcattaagtatgaaaaaaagaacgatatctagacaatcaagccgctagaagtttcatagaatggtagatatctcatataatctagatcaacattaatatttaacctaatcggctaccctctattaacagatattaaccgatggcaggttagatgatgatattgctagtgattatataagacatatgataactcgacgaattacataaacgggattagagtatcataaagatggaagcactaatcctaagaacgcaatccgtcataacgaattttacctcttgttgaagatcgaaatcga

SEQ ID NO: 38490 - DNA, 1501 bp, Oryza sativa
ccggaggcattccgtcgaacaggcggcgtgcgtcgaggctgcagcgcgagcagcaaatagcttggaactcacaatggaggatgcgagcaagaagagatggaggcctcgcagactcgcagtcggcagcctcggccgccgcaccggaggaggagagtcgatcgacgccaagttctccaaaccctactgctgtggggattggggagtgaagcaccatcgacccccgcagctggctggagctgtggagcatggaagaataaactcgagtgagacgtaaagtacggggaataagttcactttaggtccctcatcccgtcaagttttaaaatccgcactaaaccgaaataccagaaaatcttagacctccaagttgcaaagccagattaaatttgctcctccagcagcagtgtagatgtctggattcactgatgtggcaagttgacccggtccgctcgtatcgagtaggtcgactaggtgcttacatggcaaaaacaaaaatgggtcctacatgtcatgtcatccttacttttctcccatcttctctctccttcctctcagtctctctctttccttttctcttcatccatcacgcaagagatgggagtgtcaccgagcggcagggaggagcggcggccggcgggagaggagaaaggtggttgcagcgtcaccgaggagtgggaaggggatgcgggccggtgggagaggggcaaggcggctgcagccctctcatattgggattgagatcctctgcagtcaaatgtacggtgtctttatcactgacatgtgggcttcgactgtagagtattttgatcccttgtgttgtggggagtcgcctatgatcgcagcgctcagcacgacactgatgcatgtaatcttgtagctggtataatctaatttccatttttcataaaaaaataaggcttgacttgtgttgtgttcacgaggagttcggatcgtagaaggagtatctaactgtattttcagttcttgcatcaattaagtcatagctgcaagatcgctcaggtcaatcgtgggatgacgcaattcagtaggatctgggcgggttttgtggatctttttcaattgtaacaaaatcctggagtatggagtattataatagaaggaaccgagaaaatgctgcaagttttacgcagcgccaaatactctatctctgttattcttcagttctccagtttactgttgtgaaacctataagtgtcagaaaacaaagtgaggctgcgcatgagaattttgagtgttaggttagccaaaccaaatcaaattacaacaagtggtatccgagcggttcatcattgattctgaggctatgtcgaccgacgatcatagtcgaaacaccccactgcggcggcgtggaagattggaggcggaagtggcaatgagggtgaagggtagatcgttatgcagccggtgccacgggaggctggcgtgccactatgctaccctaccctcacgagaacaaactatgcagattgggcgctactga

SEQ ID NO: 38491 - DNA, 1501 bp, Oryza sativa
tgtttttaaatttttaactttttcatcacatcagaactttcttacccacaaacttctaacttttccatcacaacattctaatttcaattaaactttcaattttaacgtgaactaaacacaccattaaaaagccacaattcgtccactagtactatttctgtttgttctcgccaaaggttgttgattttcgatcgctggctaactgcaagatgcacaccagctagctctgcgatgatcattgactgcatatcgccgtatatgtatgtatatttatatcaacttgatgaatcaatttgacagtaatgtgatcgacggacagaccatttttcgtgcgtattctttgtggtccattatttttttctaaaaaaaaaagtactactccctctcgcattggataataattctcgacgttataagatattagaatttgattatcaatttattttattatcaataactttataagattcaataactttataagatatttagtttgaataccctaagagattagtcttaaatatactacaataaaactaaatatatgtttatttattaatagagaaatgcccaggggtcttctgggtagcttcacaaggtagggctagaagatttggttccgaatcctcacactttctaattatttgatactaggcacttccctaatattcgtgtctttttttatttaataatatattataataataaagcatagtcaaatgtatgtttcgaagactatatagttgttcaaaacgttaagaattatggaattggagtttgatattaggccctctctaatatttgcgtcttttttatttattaatatattataataataaattatagtcaaatgtatgtttcaaacactgtatagttgttcaaaacgttaagaattatggaattggagagaaataattcacatgatttatgagggcacgtttaattatttgatattaggtcattccctaatattcacgtcttttttttatttattaatatataataataataaatcatagttaaatgtatgtttcgaagactatatagttgttcaaaacattaagaattatggaattggagagaagtaattcacataattagggggtgtttagatcaggggtgtaaagttttagcatgtcacatcgggtattatatagggtgtcgcatgggttgttcgggcactaataaaaaaactaattacaaaatacgtcagtaaaccgcgagacgaatttattaagcctaattaatccgtcattagcaaatgtttactgtagcaccatattgtcagatcgtggagtaattaggcttaaaagattcgtctcgcaaattagtcgcaatctgtgcaattagttatttttttagcctatatttaatatttcatgcatgtgttcaaacgttcgatgtgacagtgtaaaaaattttggagtgtgatctaaatagggccttatgaggacacgtaccgtatggattgatgcatgcatcctctaaggaattaataggg

SEQ ID NO: 38492 - DNA, 406 bp, Oryza sativa
ttgtaccactgcataacaatactattgatgcttcacatatgttcatttaacactcataattcaaccattactgcatagatcgcctgcacagtgccgaaattaatactaaatcatctgggaattgggaatctgtccaagatcaatccacataggagtacataggtaaccaattggatgcgatccgcaattaaaagttttgacatcaagaacatctacttcatctccccataataattgggctgtagctcttgggagtaaaggccaggatgctatttcattccattatctaaaaaaaatctccccccacaaattaccggtccactgttcccgcatcgggcatgacttcacgcatttatatagggaaaaaaacgcagaaacgagaagagctcatcgaagaagaacaaga

SEQ ID NO: 38493 - DNA, 162 bp, Oryza sativa
ctaatgaggcgttcatgctagttttcatctgtaatgtcatgatttatttatggaataaattaaatcattatatacccataatctcaacattaactgtgacgagaagtacagccgtggccataacaaaatctgcaagcacttgttcctcttggactgcgctat

SEQ ID NO: 38494 - DNA, 357 bp, Oryza sativa
caaaatgcaactcagtgtaagctaaaatgaagggttgattacctaatggattttggattttcatttgcacatttcccaagttcctaaatgatgtgtttcagaaaaagaattatgtatatattgtttcctaaagcactttttccagaacaggggtgaaactagaacgaaaattaccaagtgtgccacacttgtataatattatgtaattaatgttctagttacatgtgttaatgaagaacatgctttgggcaaatcattttagagtctacgaccatgcatgagaaaggagcaatgtggtgttgccctttaggtaaactaaacaaatagacaaatattgtctatatgattatcacaaga

SEQ ID NO: 38495 - DNA, 1501 bp, Oryza sativa
  unsure (1)..(1501): unsure at all n locations
tactagttagatacgattaattaagtttcagttattccaaacttgagaaaaatagttttatctgatattttaaaataatttttatacagaaagttttcgcacaaaatatatcgtttagcattttgaaaactaagctaacgaaaactgaggcaaatctacatcttaatcataaaagaacatgtgtaaggccctgtttagattttctgcaaattttttcatcctatcacatcgaatgtttgaacatatgtatggagtattaaatataaacgaaaaaaataactaataagacatattgcgtgtaaattgcgagacgaatcttttaagtctaattgctccagatctgacaatgtggtgctacagtaaacatttgctaatgacggattaattaggcttataaatttgtcttgcagtttacatgcggattatgtaatttgtttttgttacatgcggggttacagacatattatgtaatttgttttgttattagtctacgtttaatacttaaaatatgtatccgtatatttgatgtgacacgtcaaaactttacacccatgaatctaaacacagcctaagataacaatttgatcatacgaatagagtaattttgtacgaatttgtactacaaggtgaaaatataaaagacaaaagaaaagcgtggcggcgtgccatccaaaaagcatttggccatttgcaccaccacaccagtcacaccggcacaactcgactggagtccttcaagttacaggtcaacgacccctctggcaagggcagtttggtaactgcaccccaaaacgcacgacatcccggcatcccgccaccgctccaccttcccaaaaataccctcaccgagatgcccctccgtctcccgtctcagctgctgatttctcccacccatcnnnnnnnnnnnnnnnnnnnnngagggcatatatggaaaccggcacgccatttcgaaatatttcgccaagtggcgcacggctggtagtttcccacataccaccctaccctattcacaaatcccacaaaaactccctatacacagagtctctctctccccaacgccccagattatatgtaataataatatcattattatctgaggggttaagtgaaaaagcgcactttttcctatatcatcctagctagccctttcgtgggagtaaagaaaggaagagaagaggaaaaaaaaaatctcgctttcgtccgcgtcgcgtcagggggtaggagaggaggaagccgaggctccgcgagctcgcgaaaggtaagggtttccgccttatccgaatcccgaatccgcccccaaattcctccgcttcccgcgcggatttcgccgccgggcggcgagatccgcacgattcgcgccccgatctgctctgacccggcgctcgcctcgccggattcggcccccgttttgcagggtttccgccgccggggtcgcgcgggcgttcgagcggagcggaaggggaggagacaggagagggagagggagagggagagagagcga

SEQ ID NO: 38496 - DNA, 1501 bp, Oryza sativa
attatcaatgatgacgtcatgttttaaacaatttgattagcatctgcaactttttatataatgcaaatgatttaatttctcttatgatcaggatgtttatgtctgtaattcagatgaagcgctttaattagtagcgtgcatatacaaccttcaagtattatatcgttcaactgctgcaacaatggaattaatccaactttcagagtggcttctggtacttttaggttatatccaagttctgctttgtgcagtgataattttttcccttgaaaatgtaacatgacaatgagatggtatgatgtcatgatgatgggattcgttctttccttgagctaattccagccacataaaatttacatgagctaaactatgtactttctgaaaattccataatgcttttgtctatttgtttaaagaaatatccagggtgggtctattatccgtgtggcagtggattcaatgagttacgtcataatattgcttttcaaataatgacacctgaatatgtaaaatgtgctgcattggttatgtgcaagcactgatgtattgcctaaactgattttattgactactatacattgttatgttactctattgagaagatggttctataggtgccatcactctcatccggcctctcagccgctgccgcattccctgattcctgtcgcggtatcgagcaaagcctcatcgccgtccagtcagggacgcagcctcatcgtggccaacctccccttccattggaagcgccgttgccggttcaaactcattcgtcaggttacataggccggctccaatcaggtacaatatacatgctccaaagaaataaatgtctttgatattgtccaattgattgacacatgtatatttacaaataaaatttattgtgtactatatcagtgaaatgtatatttagacccttgtatatttggagtacatgcacccgtgattgatggcgtgcatgtgtgatatgtttccttggattcaaatccaatgtgttctttattatagtcaattatgctaggaggatttgatctgtcagtaagcggattcgtggctatagttccacatgtcaaatactaaaatatatatggcacttaactgcaagagatcaggccaataaactgaaaataatctatgcgtcttatcttatgaaaatagtttatgtccacttccttgtatccgacgttaacagttttgcatgaatcaggaaaaatctgctctgctgttgactacttcactccagttattcaagctatcaaagttactctagagatactccggttactcaattgtatacatctctgtttcacacatgatctatttctgcatgtgtgtcacatttactctaaaaagatgctgtcaaattttaaaagaacactgctttactaaattgtggtgtatgtagcgttagcatgccacccatatggcaaataactgaagagtgatgtatttgagttaacccttttatacgagcctaacctacggtactttcatagcc

SEQ ID NO: 38497 - DNA, 1501 bp, Oryza sativa
tgatcaaaagaaacttgatatcaaaatctaccagatctatgagataatcccataatcccattgagtcttttgatttcaaatgttattatgattctaccagacactgagactgcaaagtacaaaggtaaaagtatggaagaaattccacacaatgtttaacacgaatataatgtatagccatgatatccaagctttctctgataaaatctcttaactctttgaactgtagctagccaattggcccagaataaattcgataggaagccccatatctttgttagatgctgatcaagtacggcaacaaagaaagtatactcgtaaaccttattttgagaaactgcaaacggaattttctaaatgcccgaaggttcggaactggaaacaaaatcttgtagatgcctgagggggttgtcttaagtgggaatcttcctcagcagtgcaaaattgaagataccgaactagaagattcaggaattttctcttcttgcatagtaaaataaactaatgatgtttttactacaaacaaaccttgcaacttatgtaacgtgtaaatgcatcttttggcaggtgcagtttcatgaacgttgacaagattgggggtgattgggtgacaatggccggcaacaataccacattcttatcaagctacaatcagcaagattactagtcccagtgcagcaatggataatgtgctggtaactgtccatcaggtttcaggtagtgtttatttgttccagtatttttttttcagaacaagaattccatacaagcaaatttattccagctctcatagatgattttttttcctgctgctattttattatatttaagcagaattgtcaatggtcaccaatttcccctatttttcatcaccacctgagcatattaaatgcatttctgctctcaccatctgtaagtatagtttcaccattcgctaatattatgaataacaatatttaattgttacctcatttcctccttgagccatgccatcccttctcgttcaccacgcttcaccatatggcatatgaaaggagtgcctgcacggctgcaccccatagtcaatggtttccccgattcaagcatttacacacaatccttgtttcggattatccatttttaaccacaggtccactgcaccaactgtgcacattcttgtgccatgacaactagtgcacactcatccccagccttgctgagctcacacatgtacagtaggcaccacaaacatcaatgccagattattaacagtgcatgtaagctgcattttgagggtggaattacttcacagtatgctgttgcttgggtggggtagctgatttatgttccaacatgttcctctgtctgttgcaggtatcatcatgctggcatcgcctcttgggaaatgcatccgtgcagttgaaaaaacggatgtcctgctgaattttcattctttgcataccactccctccatcctcgacaaatacaagcactcctgaaagttttaagataaattatggtt

SEQ ID NO: 38498 - DNA, 834 bp, Oryza sativa
gtaataaataagagtgattttacttcgggccatccattatcctttgtttttcagtttggattaggtatctttacccttattgctcttagatcaccctaatactgttctgtagtcacatccaatcacttatccatcaaaagcatgacatatatgtaaattaggaagatcgtcgacatgagcatgtcgatgttcttgaggctgttgatgtgctaagagagttgggctggtccaaaatgaaatagggccaaaatacgtagttcaaagaaaaatattatgtgaaaggtggtccaaagtaaaacttcctgacaaattctgcccaaagtacaattcactctaaataaaatttaaaaaatcagcaaaaaatttaaatggaagatataggaaagaattttgaatctagggcaaaggatatttcgaagacatctcaactatatctacttcaaaaccatctatccatcctaaacccctggccactgcaggtttatctaaaatgggtagaatggttattattatcaaatcatattaaaaactagtccctctagatagataatacttgccatttaaacaatgatacagtttaaagaaacaactttgaccaatactttttattaaaatatagatacaaatatcaacaaatgtatgattttattaaagtactttttgagactaatctatatatatgataaagtaatatatatattttaagaaaatatttatagtcaaatattttaatatttgatatcactcttatccaaaatgtcaagtattatttacacggaggagcagtagaatagagaaccaataagaagataggctgaaagattattagaggca

SEQ ID NO: 38499 - DNA, 366 bp, Oryza sativa
cctctattcacaatcaccagcgaatggatgaatccattgtcgagacggattcatagaaatagtaaaataaaaactatcaacgaatatatccaagtgtgtcccacttgatatcttcatgatcagaatggaactcgttagctcagctgcacggaaagacaccaccaaacccttcattagctaggccaaatctcccttcctagatctcaatctaataaaacttgctttcggtagatcgatctataaacccatctgaaatatttcgatcgagaaataggaatgcacatcacattgtcgcattggctggattttcaccttttaaaaaacttattctacaaatagatccctaaaaaaaacttattctaggaa

SEQ ID NO: 38500 - DNA, 1501 bp, Oryza sativa
tgaaacgaataatgtatatataaaaaaaatcctatggttttaattagtacaataatcttttagaaatcctttaaaccaaatgagtactaagctaaattgtgtaaactaaagtgtgtgcgcatgtacccatatagtgaaatccgtttatgctcaagcaagatcgaaatcagacgagaatcatacggtgctagctcagtttgttctagggataccatatttaccatggtcgattcacgtcacatgaaaaacaagggtctttctaatccatccaggaaagcttgtccagttctaatcactttcagtcagtgtcccctgataaaagtttagtataaaaaagagagcaagatataggcccctttgaattgcatgattaaaaaaaaagagaaatagggaaaacacttgattctgataatagtgcaagtgtaaaacagatgattgcaaaacacaggaataaccatttgattggacagtagaaaaaacgcaggaatcaaataagagagataaattcaaagaaaattttcaagagattagagacttagagtggatgttaaatttcatacatttttcaactagaatcgtagaaataagaaagttttctttcctatacgaattaaagacataaataattaaagacatgaatagtgtaggatttcaattcctcttttttttttgaacatttttcctccaattcaaaaggggccataaagttttgtaccttcacctgctcatcatatgtcgtcacctccatccccccatctcatcaaatcaaacaagacaatgaaaactgatcacattcccctggttaagtatgccattggcaaaccattatcgctcgatcacaaccaacatgatcttcagtttaccagatcaaaacccaattgctcccgaggaatattaccagcagtgtagtactagtagcagatacatgtcatctgcttttcgatatgagccgttcagtcccgtccatgtctgccatcaacttgcttcgtcagagttcatcagactaataccgaccaaccatcatgcatgtgcagagcgatcgatttctctctcgtctataccgaacactcgaatcgatcgatcgacaaaagcgtaatccggatcttcgatctgtcaggaaccttggcgacgaggagttaatcaacgggtgatgagatcgatcgatcgatcgatggatccctcctctcatgtcggttaggcgacaggaaagattgcgtaccagcgatccctgctcctcatcgacacaccagtctgtacattcctcgatcgatacggcgatatatatctcgatcgagcgaattcaaaagaaaaattgtctggtttatcaactctgcatgcagcgtttgatgtgattcgagtggcactttggtggtattttttttctcccgaaaatgaagatgaagttctttacgcaaaatgagacggtattaacatatgattgattgagttttaattattacgaacttgaaaaatagattaatatgatattttagcgcaactt

SEQ ID NO: 38501 - DNA, 1501 bp, Oryza sativa
ggctattgtaatttgtaatatctcagcaatgctattattcacctttgatctctggttattatgttgcctgtctcatttctcattacatgtgctataattatattcatctattgtcacgtgatcttgtttggtttttatgtcgcaaccactggccttatcaggacaattttgtacatcttatgccatgagctattttatttgccatcaaggcatcaatcaagtatctcattatcttgaaccccttctactaactcataacagtgcaccagttatttctgatgttcttgttttatgatgttcaggttaggcttctcaggggcgacgtcattgttaatccccacagcgtttataagacccatgaggagctctgggacggcgaaatttagatgcagtcagcttacgttagtgccagtcactctcactgaacattattttttcacgaatttacgcttatctaatgtatggtgtttgagtctcttgagctcctattcaatgtaatgaacctgcttgatcagcagcatcatgttcccttagaattcgtattagcgctcctctgaataatactggatcatgtcatttgtatgcttcgcctctggcatcatttatcccatgctacttgtttgtctatttgtcctttggcatcatcattttttcttgtaccgaggcgttagtttgatactcatgttcctcactgaaattagtcaaattacttagcaggctaacagacatttgatagtcaccctgaattattgttggtagtaggtattcagccatgccttttgctttgatttgcaccttattcacgaaagatttcttgcaacattttttctctgtgagaaacaggtcaattctagctttgttcaggaatactatttttttccatagcaccaaaggcgtgccacaggcatagtatgattgtgctatttccttatcttttgagccatgatatggatgtccgtatgctctacaaacatggcgagaatcgttacccatcgcttgtgtttgtgttgcggggcattcctgcagaaattgataccagcaactaattaatggtactcctgtggagtcctggttcagtaagtgtttaactggcactcctgttaagtcctggttcagtaagtgtttaactgctaagggtatgactttaagtacacagggagattaagtgattaacaccgactagtttcagctgaggtgatggtggaggtaggatctatccaatgggatcaattatgacttgttatttacttgacgctatttttctattttgtttatagtttcccataaaattgaagatctatagattgtttgtcccttcagataagcgatgatgctactggaattctacatttgcctcgacgccggtgactctcgaactctggcagagaacccatgaattaatgttttaggggttggaggggatgggaggctgtgggtggcggtaagagcaactttagaagaatgactggagtgacgaaagaccgacgttgagcgacagaga

SEQ ID NO: 38502 - DNA, 1501 bp, Oryza sativa
ttttctcctttaggccggagattcccccggccgaatccggcgaatcggcaaaagcggccacatgcggccaacagttggtgcacgttattgtcaaaaaccagtccttacgcaagacgccacgaggtcaacccggagaggaactacatgaatgaataacaaagacgtgattgaaacaaatacggagtagtacgtggttaggacctctattatcgagtaatgatactcgttaggacaagagacaattgaagcaagtagacgcaaaaacgtactcctcctagaggtcacgctagtactccctccattccataatataaggcaccctttgattcaaagaaaattcataggaattttaaagaattttatttctatagaaatttttactatatagccctgtgaatcaaatgaatgaatgaatcctatagaatcctatgaaattcctatggaatgcctcttcccatgcaagttttggagaaaatttagcatgaggtaaaacctcatgttaagaattctttgagtctttatatctcctcaaattcctgtgttttttctacagctcaatcaaatggtcattcctatgttttttaaatggttattcctatgtttttcctgtgttttgtaattctctgttttacacttgtattcctatgagaatcctatgtttttcctattcctccgtttttttcattcctatgattcaaagggggcacaaccactttttttaaagatgtttctaatataagacatgcatgtaagcatgcaattaactatgacatctaatcctattggatgcatacattatatttattaggataatccaaattacaagatgataataattatttcttggtctttgggttaagggtggttgtgccttatattttgtaatggaggaagtatctactacctccgtcccaaaataaacacaaccatgagtttctgcgctcaactttgatcgtccgtcttatttaaattttttttatgattagtatttttattgttatgagatgataaaacataaatagtactttactcgtggcatattttttttagttttttttaaaaaattaaataaaacaaacgattaaaattggacacgaaaagtcatggctgttagacggagggagtactaataatgcgcccataatgggctgtccttgtcacgggctaagctatccacacgatggcacatctaagccaaagcccccgctattaatttgccaaaccacgtccacctggcgcagacaccacaccaccaccgcaacggaaacacggtgaacgcctcgtcccgaaaccccggaaagccggcgagagctcgagaagtcgagaccaacctcgccgagcggatcactcgcactactcccacctcgccgcccgccgccgccgccgccgggttcccgtgctgcgcgcgcttcgatctccttctccttctccttctcgcggccgttcttgtgcgtgagtgagagacagtgaggtggtgggagacccgtgggaagggagaggg

SEQ ID NO: 38503 - DNA, 1501 bp, Oryza sativa
attcagtgcttgcttatatgcatctatctttcttccatatttctatagtagctcgtgcctctgttctttatgctttccctctccattatatattcatccatatgtttttccgaatgtgtctatattttgctcctttcgtttcttggtgtatagaaatgacatggagccatccagattcgttcgcatctgcccgcggaagcgtccacatggtacttggtgatatcattatagtttcgtatgcaagcctcggagttagcaaggccattagcgatcctttttttccctgattcacacttttgctcaccaatagatgggtcctccatatcatctgctgccaataagcacttagagctcacgggtggtgtgtcatgtgccataggtatgtacgctcaatagtctgagagttagcgaggtcattaggataattgttgtttttttgtttcctgattcgcaattctgccttctgatagatgagccgtcatcatcccacggtgccactgggttctcaatgctcacgggtagttcatcatgcactataggtatgtacgcttgctgtagtcgctgctgtctcaatgtttagtgtcatctcttatcccttgcacatccattttctcatatttttgtacagttgtccacttgctgtgatatgatatactcaaaatgtatgttcatattgataagttcatctatttgctcattggttctttctagcttagctttgttttctctccgatccctcattctatctcctcgcatcacttccacagggagttgtggagctggccacattcagtcttctcgacccaacagttagctctggactactatttgttgtgttgcttagcttgctaaggcattttcccttcttccgattgattgtttttcctgtttaaatttttcataggagatcatttttgcccaatagtgccagcacgtgttgctcgagtgaaccgggaaaaaagacaggccgctaggaaaatgcgtcttattttgcgacaaggttcttgacctgcttatgtacatgatcctttcttgtcgcttatggcgatgttctttcttgcttttgtttacctttatttcttatttgctatttctcttcttccgttcttcttctatttgcacagaacatgtgccgcgttcactgtcgatgagattcacatattccataccaaaggagcacatgcaaattcttaaaggtaatatcttagtaccaaccttgctttgcttcgcctttgtcccttttttttgcctctctatctatttctggacaaacatatgcatgcttctctacttataggtttcctttccgctcttatagctacgtacccagatcgctcctattatggtggccctgactatgaatgcaatcattgtggtgcattattttggtaccaagaaagggttgttagccagagctcgcacagagccaagaggattgcatacaatctgtgttgtcgtggtggaaagatctccttacccgcacccaagccttttcctccta

SEQ ID NO: 38504 - DNA, 1501 bp, Oryza sativa
tcagtcggcagaacacagaaacagcaagcatcctatgcggatacgcctatcgtcaatcagatcatgcacgattggagccctggagctggactggccgttgcttccccgcccttcctctgatgtcagtatgccaccgacgttggattgcagccggatcacgattcgccgctgctcccgtgctccgtaacctgtcccgtcgtcctcatctcccatcgcacaaaaaaacgcatggcgtcccatcgcgatcgcggcacgcctttcgtctgttgcctcccccgcccttgccgccgatggatcgcgccatatcttcctttgctggatccgcgacggcgacgcgccctcccgtgtgtcaactctacgcggggcgaggtgtcgtgccgggcacatcgggggaaacacgcacacgcctcatcgtcccgtcgtccccagcgcgcggcgtgagtgacacacaccccacctctcggcgcgcgttgcgccacgttgccccccgacgcctatttttaggaggggttggccgggaatccagtcgaacgattcggcacgcacggtcgagtcagcacggagtcaccaccacgacgctgccttaaaatttggtggtcgctactcctcccacctgctgtatcgcgacagctggttcccttttgctcccggtcgcgtcgtgtcatgttctgttgcggaaacgccccggggtgcgtcgagagcgtgcagcccccaataatgttgcggcgcctaactcgcggcgaagggagtgctctcccgcctctcggtggctcggtgctccgtcgccaacgcaaaggggcatcgaggacggggagaaagggaaaagggggacgaggctggacacgcggaccccagctatttgctcgtgggtcgcatcattggggctcaaaactttatcacaagaaacaccatacatttccacacagaaagcggtggagcaggagaatctcgtccgagttcagctcaccaccatgggggcggcccccacgcatggatcagcatcaatttctatgctctgctgtctgtcctcatcctaggatggccaccgaaatagcctcacacgatgggacgtttttttttttgggtttccctatttttttcctctcctttttctccttttctaggatgcacgatggacgtgttgctagcactcacacgagtggtgagctttttcatgcttccttcatgaagatgctctaattttggtagtgtcaacggaacctagcatcccatggatccaattttacccatatggatgcagacttgcagagacattaggatcgaataacgattaactacggcaggattaaagatgtgcgcattgattcttgattccgaaatcttacgcctacgatcactctcctgttatatctgtctggttcgtgtttgtgcgaaaaaaaaggctattatattcatttatcttggtaggagctagtagtaaaactaaaactaaacagagaaataaggaagaaatttgaagggaaaaattaacttagaataa

SEQ ID NO: 38505 - DNA, 1501 bp, Oryza sativa
aacataggtcggtttgttaagaaacattagcaaatagcaatgactacaggaatttggcaataccatagtaacataccaaaatccggtatcctttgaatattgccaacatttggtatcctatatgggggcaccaaactaaacatatccaaattaactttaccctatcaaaacatggcgatgttgtctcttataaaaaatttgggtatgctaaattatgaaaaagttgttttggcaatagtctaaacatgcccgtaatcataaacccatagattgacatgagcaaacgaaaccaattgcgatcgcgttagacttgtttgtttggttttaccaatctaatgtacgtcactctgctttattttattttattatttgagaaacacaatacaaaagcatatgcttatcacatacacgctccaaaaaaggtacattcaactttggtgttattctactttattataaaagatatctattggagaccacattcagaacctggcgagcattatgccagtataagagtaaggtggtgtttgggtgggagggactaaacaccacctaagtattaaggacacctaagccagatcccatgatgccatatactaagactaaattatgaggtgaattgaaggagaggacaaagaaaaaagagaaaaggccactcctcatacaaaaggtaacctcttaacaaactctaagggagaaaattgagactcgagagaccagtgtaaattggatgcaaataaaaaattatattatactggagctagtgtattagaggtaatctattttatatactatcgcttaattaattagttgatgatgtgaacaaaactaaaggctagcaagcacccctccataaaacttgctctaataatacagtgcatcgttgattgcaatcatattagactatgcgttactctcgagtatgttcattgcatattggtcatgacatctcttgcaggggagactaagaaaggtgagacctttttttagcgaaagaaagaagagactctcaaacagtcagatccaaggcagatctcccggcccagtcagatcatgggtgtcccaagccctttttgtagtgcgcaggccacacaatagattttcctctttggtggacccagaaaaatagccccatcgtagtacaatgttcgcgaaagtatttggtgaaggcccagttagagactttggtggaaacaaaagcagggcttgaagggtgaaggactgaaggcctttctaggacaagacaggatggaagacggaaaacgactcgacgagccattgcctatttctgtgatagcgactagcgagcgccacaaacaactggaatttatgttaccctccagaaaaacttaattttatgctaccttctccagagagaataaaagactgtattttatagcacagttactatattacatcatacgtggaatgcgtttgttcgaccgacttgtttcgaccatcatcacaacaactgtgcgcggaagattgatagtgttaaact

SEQ ID NO: 38506 - DNA, 1501 bp, Oryza sativa
ttttgcgcttattaactatatttcggtcaattcggttaaccaaggcctataaccaaattaaattcggttagttagaaactctgacataagtatttggtctcagttagtttggattggttctttggtttcaggtaattatgcccacccttaattctagcaacacaagcttatcgtgattgtcatttgtcaggcatgatatgacaaattgttggttaacggttactgtgtactgtgaactgtcataggtcaacagttgcctgctagcaacctcatgggtctgccgtagagttcccattgccatacagcaatcgcagcatgaagaccattttctagcatcgatcacaaaacaaacacatcacttttaagtactatggattgcataaatatgtcactcattgtattttcaaactattgcccagacaaagtgtgatgataactttaaaacttaaggttccttatgaatataacaagaaatacgataggcaccgcagaggcaccttacacctataagactgggtcttttctttcagagatctatcagaaatccatgcccaagctagcattcacagcaataaagtggaaaacacattttctcttcaagatcatagataagtctaaccaagcttgatgtagaaacatcacaacaccataccgtcaataaatacaaggaacccaacggaagattttcaaataatacaggggttatgtggtaactttaggtgtgagttacctctcaaggccccagctgaatagattgtatctgccagctcctgaattgcatatattcgtttgtttcggtcaccctccactggtttgattagagagaggatatcttctgtacacttctccaacacatcataattagggacacgccaaatcgacatcctgaaatcctgggcaacaaatgatatagacgtatgatcaaaagagattatatgggtacacagtggcgtcgctaagcaccataaccagatataaccgcattcaaacccattacagttacaagaataatggttgtcctggttttctaatgtaaattgtaaaatatttgctccataagtccaaaccaacagtgcaacgacctacgtacaccctacaattgtttcttaactttgctctagtttaatgtacaccctgcaatttaatatattttcatccctccaccagtttccagcgcagaatacacccaaagaggttactagaggtgttggccattgggtcatgtggctaccacatcatcaatttctttaacacatggcagtactcccacccataccacaccccatctaggaaagagaaaaaggcccacataattttctttccctaaatcatcatgcccccacgttcacctgcatgccacatcaaccaaaacacccgcaataccacccctaggatgtgatttgcatgcatgatatttgggtgtgtagtttacaaggtattgaagttttgtgtaaattaaaccccagacgaagtcggcaggccaaaagtatacttcatcact

SEQ ID NO: 38507 - DNA, 1501 bp, Oryza sativa
gtcgcaaaataagacgcattttcctagcggcctgtcttttttcccggttcactcgagcaacacgtgctggcactattgggcaaaaatgatctcctatgaaaaatttaaacaggaaaaacaatcaatcggaagaagggaaaatgccttagcaagctaagcaacacaacaaatagtagtccagagctaactgttgggtcgagaagactgaatgtggccagctccacaactccctgtggaagtgatgcgaggagatagaatgagggatcggagagaaaacaaagctaagctagaaagaaccaatgagcaaatagatgaacttatcaatatgaacatacattttgagtatatcatatcacagcaagtggacaactgtacaaaaatatgagaaaatggatgtgcaagggataagagatgacactaaacattgagacagcagcgactacagcaagcgtacatacctatagtgcatgatgaactacccgtgagcattgagaacccagtggcaccgtgggatgatgacggctcatctatcagaaggcagaattgcgaatcaggaaacaaaaaaacaacaattatcctaatgacctcgctaactctcagactattgagcgtacatacctatggcacatgacacaccacccgtgagctctaagtgcttattggcagcagatgatatggaggacccatctattggtgagcaaaagtgtgaatcagggaaaaaaaggatcgctaatggccttgctaactccgaggcttgcatacgaaactataatgatatcaccaagtaccatgtggacgcttccgcgggcagatgcgaacgaatctggatggctccatgtcatttctatacaccaagaaacgaaaggagcaaaatatagacacattcggaaaaacatatggatgaatatataatggagagggaaagcataaagaacagaggcacgagctactatagaaatatggaagaaagatagatgcatataagcaagcactgaataactggacataatatgacatatctaacagcaacaaagtgggaaatcatcaagagctgaaccaggagctctcggatgcttagactggaacatacaaatatttgaaaatgcgtttacgaaaatggtaaaacaccaaagacataaccacattgaaaggctaacccaaacatataactgtataaggtccagcaaagaaagaaacagatggacgccgaacgaaatcaactggcaacaacacaagcgttcgaaaaacaaccaagaatatatatcacagcggaacaatgtaaaacaaagtaatcagtaattgaaggagggaaaaaaagaggagcgaatatatatcatagcggaacaatgtaaaacaaagcaattggtaactgaaggagggaaaaaagaggagcaccatatatacgaaatccaccgaacagctatactggagacaaaagcatctcggtttatacatatcgcagcatcgcatatgtgaaatgaactaaacatgtatcccacat

SEQ ID NO: 38508 - DNA, 1501 bp, Oryza sativa
ctttgtaagcacagtaaaacatctcaatgatatgatctgttttttttgcaaggtaaataattgctcaagctacctaataatatttacagataatgaaaatgatatttaattggaaccaatcctttactaatacgaactggttgcacatacttctttttcttccaatgccaaaaaaaaaaagaagcgaagttcaggatattaattggcctttttagtcaatagtcagaagttgtattgccttatatacaagcttaatgttttcactgaattaccttttcagtatataaactgaatgttctattgggtcattctaggtatcgattcataattatatgagtcgtgttttctttgttaaatctgtgcgctggttattgttgccataaagttcccttttcaaatgaatactagacatgtcacctaaaaatatcttgtatgtacacaaataaggcctctctggtttcctgtagatgcgtatatgctgaacttttcatgtaaatgcttatgctgatttttttaatacaaaagtatatgttggttttacacttgataaggtatatatgctaccatgtttgtacacactgcaattatttctcatatttttacctccaatcgtatggcaccaggttcatggtagcacatgggtttggtaaatctatcccaatgaaaaatggtggtatttgatcattcccttcgttccttttctatagctttggttaaccttctgggtgaggtgcactacaattccttgtatgacattgaaggtgagttcttttgcttttctgtgatctgggagtgaaggaaaggtttcctacaattcctcggtttttccaatttgcatgatttcttgtatagctgctcatcttcctgtaacctgcagtgaagacttatgtccttatcccccggtcttataaatcctgcagaatttgcacattagaggtgaccttttaatggattttctattttaaatataatttgcagcagaccgtagttgtctgaaaatccttaatttttctcctctgtttctgtgaaactgtaattgaattgcctatatatggaatgataaatagctgatgatatgttttagtcatcattttattttaagttcaggctaaactaaattcatgatctatctttagcttttctattgaattttctagcgcttaagctaaagagttagtcaccagtaacaaaatttactaatatcatgaagaccaatgaatgtttggtgcgtggtcggaatccaccaaccttgaaactccctgccatccatatgtagctttttgagatttcatatatagcttcataatgtaggatgttgtgaaataactatatgactttccatcagaagttagtacttttagcttgctttcatatttggtttactgtctgcatactcaaatacacctgaaactaaaatgcatgttttcttttgcacatcagtgcaatgttgtttcccttgaggtgatgatgatatgaccatgggaacactttacttcacagc

SEQ ID NO: 38509 - DNA, 1501 bp, Oryza sativa
tggtgatcctccaaaacacacaaaaataaatcccccatcggcttgctaaaaccttaaacaaaatcaaatcagaataactatatagttaatatcgtaattccctcatttacaagaataaatagcagctaaatagttttttgttttattttactgatgtgctgactactgaatgaacatatactaaacagtggttgtttccaagagaaagatcaattattctatataatatagtagtttgcaaacttgcagttgcacctatgttctttccacagtcagaacaaggacacttcaggtatcgcaaataaatatttatttgttgttatgaaaagatgatttaatacaaaataatggcaaacgcaattgaaacaaatcttctgcaaagaagtgtagccacaccttgtgttgtcttgacttcatgtagacagtagttattgatccagctggtgatgaagcagcctaactaatctgctgaagtcatggcatcttcatttcaagctccatccagttacagatatctgaggagactactatattaaacagaatggttgagtgcacacaaggtttattgaattcatctgcatgtgaaccttcatcagtaatatcttctatcctcctcttgtgacaaaaaataatcaattaagcgaagcataggcatgccttttataaattgagaaactgaaggttcattcataactagtagttctcatttttctcatctcttccgtttcctacaaatgaaccaggttggcaaaaaataaactgaggttagcaataccagttattcaacaaaaataaatactaatcaattgatacagttaaaacaattatacagagagcacccattccacgagtgtctaaaacacaaaataaaattgctaatctttttaaaactgtaaaataatacctaaaatagagacgtagcagcttgcatataactatgaatttgcttgcatttctatcaacataaacacatctaacattttttgtcttcttgcactgctcctttagttctgcactgcaactgctcacgtagagctcgtgtaaggaagctgggaggccattttctggcaatgatttaattcctggacaagccttgattgacaactgcttcagggaagaaaggcaatgcaacattttaggcagtgataggagattagggcaataacaaaaatcaagtacatggagagatgtgaggtgacaaagtgctttttcttcttcttctgtgaaggatctcacattctttgcctgcaaaaaatgaagtgatgagaaaccactgtatattgagcaagtttatctgttccaacgaaattattgactaattgtgttaatagttaccatgaaaaacactaaatgtcgaagagatggaagcttcttgcaaacttctgtgttaaataacacagtggtatcaatttcaagcttgtctagatataaagagaaacctggcctgtccactgaggaagggccccatgttttagccaaactagggcattgaaaaatccgt

SEQ ID NO: 38510 - DNA, 1501 bp, Oryza sativa
aagtcattagccctggacatggtcgtgcatgcccagcgacacctgacacagccaaatgggcaagaatggatccgtggcaccgtttcggacaggttgggtctcgccaggcccaccactcaccacatggtgagcatgttggcacccccagttggcccaaacgggagcccaaggcattgtaatcttattttttggggtaggtttctcaggacgtttaaagagaaccaactgccatcgacaagacggctgaaggcatattagaggccgttacacatagaaggttctgtactagtgatgataaggataaattaatggcctggttttaaaggtgagattaactaatactccagcgcaaagcaaccaaactatatatgcatgtatagctgtgtatagccaggacgatcgcactgtaacgctgccccaggccagcccgccatattgcaaaagcacactatcacggccggccctgtcttggagcagcatagttcaactgattgcaatatctatcgtaaatgtatgcaagtataagtattagactagtacaagccgaatgcaaaaaaataagcgtctactaagatggccatgattattagaacaagtatgtgctgctaaacattttggcccttccatctaatatattatttatgagaaaatgtcgtgtatgtacggacttgaagatatttaagaaatggaggcacaataaagtagttatgtcagcacacaagtaggtctgcagaaataaacaacagaataaaggattcgaatgggacatggaaagtggaaaggtaggatgtcgaacaggattgaaataagtaactcatcagtcaatttgaaggaaaaaaagatcactaattcaagaatcaaaggagatatatagcactgtccagcattcctatgcatgctatcagagttcagagatgactagtccagttctgaaaacaactgtagtggcgatagtaaataggactctgaagaaattaaacgatatattattatgtgcagagacaaataagttctgcagaaagggcatgggctcccagtcccactctcggagtgcagacttccccattatcacctaaccaaaatgctcaaggggaaaagagaagggcaatggtgatcgatttgtctgttaaaaaattcctagctattcacagccatgaagatcggtaatgcagaaccagaatagagcaatactaccacagtaaaacagtgcagctgccagctgcttacttggttaggaccatgagctcattgcttcccccagttcttgattgcagccatagtgatcgctgccatgctcccagcttggtgatcctccaaaacacacaaaaataaatcccccatcggcttgctaaaaccttaaacaaaatcaaatcagaataactatatagttaatatcgtaattccctcatttacaagaataaatagcagctaaatagttttttgttttattttactgatgtgctgactactgaatgaacatatactaaacagtggttgtttc

SEQ ID NO: 38511 - DNA, 198 bp, Oryza sativa
catcctgcgcccactcatcacgtcgcccgttgtatccgctcccgcctttagtgcgtctgtcagtggcacactcgaggtggagtgcacaccggttatgagcgcaagttgaccaaaccgtcaccactaccgccgcaggagtagcgagcgggagaatcgaggcgtggtctgactgaccccccgggttatcgcgcctcaagc

SEQ ID NO: 38512 - DNA, 1501 bp, Oryza sativa
ggtaaagccgttgcccatgctggctagtggttggcacgattaatgttttacaaccgaaactcgtgaaacggtgcttaattgtcatgagcacgaccatcaaaaccatgtgctcacaacccaccattagcaagttttaattcgcaattaattaattaaccaatcatgattgaccaccgtgagctacaattaaatatccatcattaggtaatagtgagaaggtgctcgcggggagggcgtttccggcgacggcgaaggacaggacttgaggggaaaggtagaggacgactagggggtactttatataggcacgggagggagctcgggtccgggcccagatcgacgagaaaaactcgggaaagtttaggatcttcgccggagaaaggaaagattgatccgcgaaattggaaaggatttatatagaaactattggggattttttggtgaaattgtagaggagattgagaggattccattcccgcaactaatttagaaagaggagcaacgggaaggtcggaattgggaaggagatcggcacggctgcacaggcttgggacggctcgggctctgtctggaggttgaagatagagtactgtagcgccagggaggcaaagaagacttcggctgggcttccttttcctcggcccgattgaaggagggaacgaaactggacttggggaaagagagggagagggctgcaggccgagaggaagtgagaggacttttcctaattcggcccgaaaaggaaaagttgatttcaattacttttctaattaaattaatcactgaaatgatctttcaattgttaaaaataattccaatgctcaaataatttgaagaaaaatcctgaaaataactgggcactcaaagtatttaaaaaaattgaatccagctcatttaacgattaatttaatatgtgaataattactgaaatattctttgtattattaaaattaggaattgatctctgaaaaatccgagaaaatttcggagagtataattaatcatggagaatttaatattgtcatgattacggataaggtataccctatactcttggatatacgtcgtacactgatatagcatacctgcgcgtatacagacgttctgtgtacacgctaaggaaatccatcacggagtccacagatggaaggagtcctactcagatagaactgggtcgtcattatattgtgtagggtccgatgtctctgagtcctacttggagaccaactaacctgcggtataaaagggaccccgggaggacctaagggatcgaatcttaccgccaacacaaccaccacagcctacgaagtggagccttcaggagctaagtcgccggggtgatctagtcgagccaacttgactacggtctcatcggtatcatcgagttctgctattccctttgtaatctgtggtttccactatataatcccatatcaactagattagggctattacctatcaaggggcctggaccagtataatccttgtttcctgtttgctt

SEQ ID NO: 38513 - DNA, 510 bp, Oryza sativa
tttatattcccaaggtttgacttaaacattatcttaaacgacttactttatgagtacggagtaagtatgttctaaaatgtctgaaacaacatagtttcgttacttgagagagtactacacaacactctcatgagagatctcgtattataaggcgaaaaatagtactaaccatgaaccaatcattcccatatttttaagagtaatgacagtgtaatgtattgattgatactcctacatccttggtaccccaacttatcacatgatggctgatccaacaaccccaataaaaattactactaattgaacctgtaaaataatttgaatattttttttgacacgaattatttgaataaattgttagtgaagtacagtatcccagttgaacagcatctatcagtcttatcacttcagtgtttgagctcaaccaattcggcgcggatcgtctgtataaattcctaccagaagaagccaagagctcatcgaccaaacttacacttggctaggaagcca

SEQ ID NO: 38514 - DNA, 1501 bp, Oryza sativa
gttataacaaccgggaccaagattaaaaaaatctctacccgagccgcgcgcctcctcatctcactcctcctctcccagcctcgatcttatctctcccagcgtgcctcctcctctcccagtctcgatcttatctcctccccctcccctcccctcccctcctctccctcttcctctccccattttctctcctccccttcctccacttcccctcacctgcgggtggcggctcccaccctctcccctccgacgcaggtgggcggcgcacgagggaaaggtgggccggcagaagcagccgcggtggcagccgggcgccggctaggcagcggtccgatggaagtcgatcgggaggccgcgcacggccggtggatctgtggacttccggtggatctgtggacttttttttattttgtgaatgatgatttgtagatgctgtaaaaatttttatatttgtgaatgatttgtggatttgtggatgggcatgtattgtggattattttgtgaatgatttgcagatttgtggatgggaatatattgtggatgattttgttgtgtatgatctatggggatttggggtgatggtactgaaatcaatagatgcaagcaacaaaaaaaacaataagataaaagaaaaaactaacaatgaaaaaaagaaaaactctagtccctgtttgtaactccaactaggactaaatattatagtctcggttggtgttatacacctggactaaaaataaatctttagtcccggttattttaaccagagttggacgtcccggtttacaacctgcgattgaaggggttgtaaactgggagtagagagcctttttccagcggcaagaatttctaaattatcatgctacaacgcgtagggtgtccactggttttaattacaacttcgccacagcttttaggtacatgcatgcactgtaactgaactttacagcatccaaccagaaacaaatcctaccttgggcccgtggtttaaactagctggttcgcaatagttacaccttcagagaaacgataacattgatttatcttcgtatggtctatggaagggtttgtacaagtgctcaggctattggtatgtccaaaattaacctaaaattgtgcccatggttaacttctcgttaccagtggcttcacccgatggaataattaaccactcacaagctagaaaaaacattttcatgcttgcctactcatgcaccacaaagcttggtgaccgaactagttatctataattttatctagaggaatcaaaatcagcacgtatgcactaacacaagcatcacaaaaaggtagcaagcttacgggtataaatggagccatgaagcctgctactttgcatgcacattcagatagatcatatcagacaagtaaatctagcttgctgtaaacacagttagttcgtaattatcgcatagggccatggggaagtacagtgtgggtctcgtggttttagggttgctggcccttgcgttttcgaccactgtgctgg

SEQ ID NO: 38515 - DNA, 1189 bp, Oryza sativa
caccaatctccttgggacacgtttgtgtcggtgaccactgtagtacatggcgaacagcaaactactagtactagcgatctagaaaatcctaaatcatgtggttcctgtacagtttattggtgagaaagcacgataaggataatgacgaatccgtgatgaatcctgagacgtagactttgaccattaagctttgaaatgatggctttctttgatttcctttgctagcttacttagctggcaaagcttaatctaggccaatctgccggatattcgcagccatttacgctttccacgtcagtgcatgatggagtattctacgcacgggatgtattaaaattggataagcataactgataatttgtttgttctccgaaattaccaaactgtcctttttaacgcaatttgataaacaccctagtgccgtataagcgcccatatatctaatttttgaacaaatcacagttttttcacttcttatttctgaatatatttcactctgtatttcttcctcaaaaatcatgatgtgcacatgttttttcataaataatatttttagtacatataaaagtgaactcccacttgcatttgcatctagaaagcatgacaaaaaccatcggcggcacaacaaaaatcaacccaatttatctgaccggaaaaataaaaaagcttccaaaaaaaaatctgaccaaaccgaccaaagggcaaaatgggaacccaaaaaaactctctataaatgttgactccaggcaatcagcgtggccgcgtcacagcacacagacatcggcgaagcaaagcgcaccacgcacacggaaagagaggagaggtcacatcgcggcggcggcggcgaggatgttggcggtgtttgatccgacggtggccaagtgcccggagggcctccggagcccgccggtggccggcggcgccgtggcggccggcggcgcgggcgcgctgatgaagggcttcgccggagcgcacgccgacgcggtcaccgtcagcctgggccccgccggcgccctcgcctactcggcggccaaccagagccccctcgtccccaggtgtttgctctgttcttggctcctctcgctgattagctggggtaagccgatgctttgtagcgcgttcttgggatgcaaaaaaaaagcgtgctcttttttggctgttcggcacttaagcccgagatttggtgatg

SEQ ID NO: 38516 - DNA, 953 bp, Oryza sativa
tgcgttgcaacgggtgaaggattttttcttacaaaatcataagctgcaattagaaatctgatcgtctcaagttagcatgtgagtatgtctatttaaagagatttgtaaaaaaaagcgaaagaacttaaaaatgaatcaaatagggatatgtattttaaaaaaacgaatggacttaaataccgactcaaaaaggattacgtactgaagtactggcaaaaacatcttcaatttttatatcttttaataattagttaagaataaatagattagattagagataaatagatatatagggatgatgcgttttttctgccccttttaccatataatttttgcgttgcctaccaatgagatttttttcgctgctttttattttctgacgttgttttattggcttttttgtcgccacttttttttcattgattacgaatcagccttctttttcgctattttgttggacggcgttttttccggtctttttttccggctcgtttttatatggcattttttttgcacgaatcggacctctttttggctattgtttttggacgggacttttttttcgcacgaatcggacttctttttcgctattattttttacggcgttttttttgggcttttttttcagatggcgttttctttttcgcgtgacttttttttcacacggaggatggaaacattttagactttttaagtagtactagcaatagtgcccgtgcgttgcaacgggaaaaacaccgtttgatagtgtgacaccttaaaaacctcaaatcggtaaaaatcaagtctaaattgatatattaacaaataggtagaaccgagtctaatttgatgaattagcataggatttaggatttagttttagatttatttttcgagcctagttaggagtttatccgacgaaatttaatttaaaaaatctgagctttgatcaaatttactttcggcccagg

SEQ ID NO: 38517 - DNA, 1501 bp, Oryza sativa
gtagtgagggccagagaaggtgaggccgagctagatgaggtggagcatatcgacgttggccttgagcgtgtggagtggggcatcggcagcggaggcgaggagccggtggagatccgtgaggtgtggacggacaaccttgaggtggagctcgcgttgatccgcgacgtcgtcgacgagttccccttcgtcgccatggacacagagttccctggcatcgtgtgctacccacgccgccgctccgctctgtgcgccgctgttgacagaaaacacgaggcctgggagatctgcttaactccagtgcaggtccaaagcttgccttcgggtgtgctagcgtgccagttgatttgatcctgtaaccaacaagaagtagaagcaaagaaatcgcggttaaatctataaatgatagccgattggctaagtgccgatgacatatcatttatctttgagccgatgtcatatgtgtatcgatcggcaatcttgaataagtaagaaagaactaaatctacttgatcggctatagatgttaacgatatatactccttatatcgatatatacttaaatcaagtgattggaatagatcgatcgccatgccgagacagtataaatcacttagaccgaaatatatattaataacaggactatatatgtttacagcatagccgatcagatagatctagcatgtattggctaatactccgatactactttatatcaggatattaaaacagcaatatcttggcataaagagcagatttaacatgtcaataaagcatatagagcaaatatagttaaatcagataagatcggctgaaactccgatgctaccctaatcggcaaccagaagacaggctagaggttgatattctaagcacgacttaatagatcaaacttaactgatgcagcattaagtatgaaaagaagaacaatatctagacaatcaaaccactggaagtttcataaagtggtaaatatcttatataatttaggtcaacttcgctatttaacctggtcggctgccttctaccgaccggtgttagctgattgtagattagatagcggtattgccggagattatgtaagatatatgatagctcggcgaattatataaacgagatcagagtatcataaagatggaagcactaatcccgaaaacacaagtcgtcataataagttttacctctcgttgaagatcaaaaccgatgcagctcaacccgaaagcaagaactagtcgaaacaaaattaaagtaaaagggtggcgatgcgccgagattgtattgaatgtgtgttaaaagttacatagggctcaggtctatttatacccgagaattataagatatgtccataacggacacgactactatctctaataaactctaagatactatatgtctttgcggcagacttttgcccaatcatatctctaaggataaaacataaaacatcctaattaatagatataattgcctcctcaggactctatccatgtgcggcaatcacctt

SEQ ID NO: 38518 - DNA, 1501 bp, Oryza sativa
agctacaaaacactctacagaaaattatgctcatatacattgtaattaaagttgataattctcatggccaaaaaaagtgcagttaatgaaatgaccaaaggttgaaatcccaaaatttcactaaacgcaacacattggttgtcattgaatcactggagcatccaagatagaaatcacaaaatacatcaacctaccagcctcccaggtgtttgcagcaggaacacagggggacagggcactacctagtggttaccccaataacccactaaattttgcacaaacactcatgttcttaggttacagttcttgaagagtagttttgctgttgatcgcgacggagattggggatccgcagtaccggtggcgggataacacgacggcggcggcgcgggcaagatgcagggcgacgggacggtcggcggttgaagagggcgaggcggggcggcacggcgcgacggtcagcggtagaagctggtgggggcgcgggcgagattagggttaggggagggagcaagggtgagagcccctctggaaagaggatggtggaattgcaaagaggagggagggaggaatctgtggcggaggggaggagaccggcggtgagtcggggcgaggggagtcgatcgcgaggagggcgagaccgcaagagtgcggaggaggggggcgacggaattcagggagccgaagatccggaccattacacgaggaatgaaagaataagcgatgagtgaaaccatttgttaaactatagggttagagaagatagtaattataggcaaattttgctacagggcactttgactttgtggttttagctgtgggacatcgtccgaactcacttttggagaaaaacactccataacgtggtaatttgccaatcgacattgcgctgattagaataataatttccggttggagaggagagagaaatcgcatgaaatggccaatgcgaagagaccagctcttgcacgccggacgtcaaacgacacgtttttcgccgacggcgctggtcttgatgatcgtcgcggcaggcatggcggcgtcgtcgtcgcggcgatcggggcttctcggcgagctgccgccgggaggaggactgtgtctttttgcgcctcgagtgctggtgatgatgctgatgcttgtgcctgatgcctctccaatggctgtggtggctgtcagccttcctctccggcggcgtcgatgtcgtcgctgcggctcgtggcgtcgccgtcgagttcagtggtggggccagggcgtcgatggtgccgtttctgttgctctctcgtttgctcgggagcgtcgatgatgccgtgttggatggagttcttctcgccaccccttctccgccactgcgtattggtgttacggtttcctcctgctgttcctgtgatcgtgtgacctcctcggcagcaccgtcaccgacgtcgagtcgacgacagccacgacaggagtgccgccgccgccgctgccgacactcccgtcggggaagggaatgaggcgtccg

SEQ ID NO: 38519 - DNA, 1501 bp, Oryza sativa
attttagtatataatagtagatagattattatataatttatattaaaggttcattaatttacaagtgaagttaaatgtggaaaataaaatttcctaagcataaagcatggttggatttaattgatatttgtcgacgggggatacccgtagaccggatatagagggtattgggatacgctggtacgaggatctacgtagtacgacatcaagcaaacaggaaacaaggattatactggttcagaccccttgataggtaatagccctaatccatttgatatgggattatatagtggaaaccacagactacaaagagaatagcagaacttgatgataccgacgagaccgtagttgagttggctcgactagatcaccctggcgacttggttcctaaagactccgacttcgtaggctatggtggttgtgttggcggtaagattcgatcccttaggtcctctcgggggtcccttttataccgcaggtcagttggtctccaagtaggattcggagacatcggaccctacatgatacagtgacgacccagttctgtccaagtaggactccttccatctgtggactccgtgatggatttccttagcgtgtacagagaacgtccgtatacgcacaggtatgccatatcagtgtatgacgtatatccaagagtagagggtataccttatccgtaaccctgacagtagcccccgacttctgcttaaatgaactcatgtaactgattgcgacttcagatgtcggagtcgttgtcattctcgactggtcgatctcggtgtgagaacaccatgtgaagttcaacggtcataagtgaatttaaattgaagtccaaaaactgctgcgcgtaacggacccagaaatttccggcggccatctctctccttttcttggaattcgcaccgtcaatagtgcgcctatttaagggagttttgtggatccattttgaagtccgcctggtgcgaaaaactttccagcctccaagctttcctcgtcttctccgctcccgcaaaaagaaaaccctagcttggtcatcttggtcccttctccggcgatctccggcggcaacggatctcgacaagtccacttccaccagttcgtccctgaagaagctgcaggaagacggcgctctccttggtcgtgggactatggagagagaaccaggaggtactgaacccaaacccgtcctaggccgcatggttgcggttgaggactatattctttatggttttcttcctccaccttccgagtttcttctcctcgtcttgaatttctacggtctttctttgctccacctgaaccccaattctatcgccttcctcagtattttctcctatctttgtgaggcctacattggggtagagccctttcttgatctcttccgtttctactatgagttgcgctggatggaacctaaaaaggtgtccggatgtgtcggtttcaggcttcgggatggcatgaagtcgcgatacatccccttccagtgcccctcttctcg

SEQ ID NO: 38520 - DNA, 391 bp, Oryza sativa
caacactctcatgagagatctcgtattataaggcgaaaaatagtactaaccatgaaccaatcattcccatatttttaagagtaatgacagtgtaatgtattgattgatactcctacatccttggtaccccaacttatcacatgatggctgatccaacaaccccaataaaaattactactaattgaacctgtaaaataatttgaatattttttttgacacgaattatttgaataaattgttagtgaagtacagtatcccagttgaacagcatctatcagtcttatcacttcagtgtttgagctcaaccaattcggcgcggatcgtctgtataaattcctaccagaagaagccaagagctcatcgaccaaacttacactgcgctaggaagcca

SEQ ID NO: 38521 - DNA, 164 bp, Oryza sativa
ttggttcgaggaagccaagcagcggccaagactgagcagtagtgacagcgaagattcgcggaggtggatggcctcacgaccaccgtcgggcggcattgtcatttgaaggagttgatggtggaggcggctatagtcctcggcaagtctgctaccgctccacatca

SEQ ID NO: 38522 - DNA, 1501 bp, Oryza sativa
aaaaaaagttaaaaagggtaccgcatagtgccagatagtacagtagccaccaaaaagcccacatatccgactaggagtacgtttttacttgcttcccccatcggtctccctctggcgcgccgctttggcttttccgaaaggaagccagtcatccatctcccccgatttaacccgacgccgtgccgctagtctgatccgccaccgccacggtctcctcctcgcccccgtgcctccgcctcctcctcctcccgtccagcccgtatcgacgagaccagcaaggcgccgccgcgcgcggagctctcgacgcccgccgacgacccgcccgccgtcagatccgcctgctgcatgcttcctccaggtttagatcgtttccaaaaatcctctgcttctcttcagtaattccacccgcgtacggggtttctcgatcagagcgggggttccgtttatgatcgggtcagggtttacctattccttgtgatttgggcggcatgcgatttttggattataggtgacgtttggaggatatgtaatattatgggttttcaggaaatcgtttggatgctgtagttaccaaccaccgcagcatgcctagcaatttgtgcaattactcgttactcttaacagcactcacgctgtcacgcgcggtgtggcacactgtcaaaatttgagatacgttgacacttcatcattggtggaatctcgtgaaggaattatttcagcggatgtgcatatgctatagtatgagaacatctatggtattatgtagatacaacaatcactaaccagtcacgagaagaaggtttttagttgtgattctataatatatttgagaatcaaaactaactttacaagcttatgtgggtttgacccttcaaaatttcttggagttttttatagttcaacaagcgtcaatgattgcgattcatatatatacattgtttactagtaatggtttgtgtgagttcttgagacaaaaatatgtggttgaccacgcaccaaatgcattgttccaccactgcttttggttgtgatcattttcgcatagatagcgtcatgtcatgctgcattttgatggtgatgttgtgattcgtgaatgcaagcaaaataaacgcaatggaaacattttttttgcaagtcatattttttgtttgtttctagttctcatcgttatcttcttttaataaatgtgtccctttgttctcttagagcattttcccctctcagaaaattggaaacatttaataagcatcagagtgatcaatcttagtgaatacttaatagagaacataattccatcaatgttctgttcagagcaaatttgtagaaaagaaaaccaggcaagcattgaccttctgacttgtggttagaaaaattatctggttgaatctccattctctttgtttttaacagtatttttatttgtacccatgtaacatcttgtttttcctttttggtccattatatttcgttgttgaactgcaggatttcagtatgactgaac

SEQ ID NO: 38523 - DNA, 1501 bp, Oryza sativa
gccgtcccgtccccgctcccgaagcgaaaccaacgcaacgcacgactccctcccactctaccctcgtctcgtgcgcgtggacgactccctttgcctagcttgactcgtgcgccgcctactttcgccaatcgccatggtgcaagccgcctcaacctcctcgcgctttctccgcacaacccgtctccacggctcctccacctccaccacgccagcggagcccgcagcctccgcgtagccggcggcggctcctcctcctctcatcgcgctatctctctctctcggtaaacccctggcctcggttagtatctgaagtggatttctcgcttggtctactggcggggttcgctcgatactcctcctcgagttagggtttggcgaatacgaccaaccccgcggatcgcggttggatggcgactagagcggccgcgctgctctgagaatgcaatgtacctttcaagggttcggtattttagttccttgcttgataattgctactactgcgacaatctcgcggttcgtttgcgaagaaatataaagagggtgccttgctgtggctgtgcacttctctctccttctttgttttcacccgaaagttgtgattttggtgtggggttttgatgtagagaaattgatgagtaccacgggtattgccagccaaatattaattgcggaatgtggggaatggggaaagggtgttgccttcgacgtggattcgcctgctgcgacacataagcatgcatatattcgtagagtggagcggaattctgctagcattctgtagttacccagttacgttaactactgtagtgctaatgttagagttaaatgatttatatgatgaagtgatgaagtatacttttggcctgccgacttcgtctggggtttaatttacacaaaacttcaataccttgtaaactacacacccaaatatcatgcatgcaaatcacatcctaggggtggtattgcgggtgttttggttgatgtggcatgcaggtgaacgtgggggcatgatgatttagggaaagaaaattatgtgggcctttttctctttcctagatggggtgtggtatgggtgggagtactgccatgtgttaaagaaattgatgatgtggtagccacatgacccaatggccaacacctctagtaacctctttgggtgtattctgcgctggaaactggtggagggatgaaaatatattaaattgcagggtgtacattaaactagagcaaagttaagaaacaattgtagggtgtacgtaggtcgttgcactgttggtttggacttatggagcaaatattttacaatttacattagaaaaccaggacaaccattattcttgtaactgtaatgggtttgaatgcggttatatctggttatggtgcttagcgacgccactgtgtacccatataatctcttttgatcatacgtctatatcatttgttgcccaggatttcaggatgtcgatttggcgtgtccctaattatgatgtgttggagaagt

SEQ ID NO: 38524 - DNA, 1501 bp, Oryza sativa
aaaaagaaaaaaagaaaaggatacgtcacgtccatatggcatgccacatcagcgccacgtagatcttagaggggatgtgtcgatttgggacactttgacaagttctgggatctagatatgcatttcgagagtttagggacctatatgaccaaccctacaagtttaaggaccaccaatgcactttactcaatagaatttgtacctcagcttgatcagaaccagtgcccagctgcccaaactggtttcctccgaaggaatagacatcgccatctacagatgtgcatacagtgtgccacagccctgcaccaatgtcttgcatcttgactcccaggatagacgatacacacgttggacttaaaacatcatctgtgtttccttgtccacactgaagaataaattatacaataattaagagcactagtgcaacagaacttttgttgctcctactcataggtttcaaaatgggggaaaaatctaatatataccatgccaaaatagtgtcaagtgagtgagcaagaactgtcatcaccattgttatggaagatgtcaaagttgaaaacagagagagagagagagagagagagagagagactttcaatgaaactacatatcacatgtaaaccaaattaaattgtagcataagtttgctgtgtacttgttcagtcggaaagcaagtacaaacaactcttcaatgcctaatcttgttgaatacatagatggattacccaaaacaaatcatacacttctccatcccttgaatacatatttcttttcctagctacttggatgtgtttagtcatgcaaatgatgctttgaaatctcacacaagcttggtccaactgatatgctatggtagaagcactaacctgtccgtacagtccccatccaaatgtaagtagtgctcctgaatctgcaaaagaactagctgttaaaagtgcagggccaaaatttttactagaatttagggttccatgtgttgtaaaagcaggttggaattcactagaagatatgaacagagctgaacagttgctaatattttggtttgaattgaaattcctcctagatgtaactcgtctagatctgcagttttgattattagacttttgtgcacatccttggatttaaagtaacttctttggaacatgttctttggtgattttacacagaaaatctcatatacataatatcgtagttacttaaaagttaactacaatatatggtccaatcaagcaatgcaccttgttgcctctaatcaccaactattttctatgtgaaaacaaacatgaaaaaaagcatgttgtccattcttgtaaattcgtaatactacatcacaaaacattactttatactgtaccaaagcaaactgaactaccaatttgaaagtatgtattgtcatccacaagaaaaaaaccgacccaactgaggtattcacacataccaccttaagatcatatatgatcgacatcaactttaaataagtaggataaaaggttcccagagt

SEQ ID NO: 38525 - DNA, 1501 bp, Oryza sativa
ttaactgtattaggttgaaatggcaatcttgatcggctttactctgacgtggatgtatcatataccggcagctagccccgtggtttttctcttcagccaacggattaatttttggataattaatccagtgtaatccatgaagacttggagggaatgaggggttagccagtcttacaaggcgcgttcccgattggacggcaatcatatcaggatgcaaacctgtggatgaccttttcagctcttgaagttgatgatgctataatctagcgtacctgctacgggaggagaaataagacagcgtttttaaaccttgatcttgacaatgccggtacgccgttgtcccgttgaaactttcagcttcgttcactgtagtattattgcactaatccactggaaaatataaagcaatcaacctgatcgatcagcgctatgtagataccccacacactcccgcagcctaaccctgttgatcagcacaggaatggacgtttcttctctgcgtctgcgtgcctaggtgccattcgtccactggaactgaaagtctgaaactgatcatgtgcttttgaacttgacagcagcgtaggaatataggtgtatagcagcaagaactgaccgcggaaagcatagagagatatcccgcgtgcgggcgcgggtaattcgtaggcagaagggtgttctctgttggcgtatgtgcggacgagtttggccagcgggagtggaatggagaaaggcgtagtcgcaggttgcagactcgcagccactggaacgcgaaatatttcggctcctcgcgacccataggataagcgcgcggcgactgcgaacgccaagacgcgcgcgcgcgcgagcgagacggttgccccgtcgagtcggagccgggcggtgtttggcttgtctcccacggccacgcgcaatcgcgcatgcgcgttgccccccgctgctgttgatgtcagcgcgagccgcgagagtttcggcgagcgggcgtcgctgcctcggcaaagagcaagaaagacggcaagcgctagctgggcggagcgcgtcgactcggagccggtcgggtcacggaaaggatcaaagagaaatcgaaggcgagactgccggtctccaggaggtaagctgctgagacacggccatgcgagcgtgccgtgctttgctcgttggcagcggccagcaggcacgtgtaacggcgagtgattaccgtctcttgttaatttagtctccaatcgcccagacagcattggtttctcctgcgtctgggcttattttttcgacggtcactgcacctgaatatgattgttttttttttttttgcagggaacctgaatatgattgttacacctcaaatgcctcgaacatgttcctagatcaacccaggagagtacaagcaagcatagtgatggcaacgagaagcaaactctgagcggattcttcttatccgctaaatgatcccgtggggccaacctggcagtgaccctaaagacagcaaccacccccctcctgactc

SEQ ID NO: 38526 - DNA, 1501 bp, Oryza sativa
caataaaaaaaagcagagggtgtttcattaagcaattctaaatataatacagatattcgaacaattgtggttgcgcctgcaaagattccaacaacagaaggcttcttatcagagcttatatttgattctaaaagaaatcacaaatattttaccaatggaacatagtacgagaaatgtagatttctagtttttctttcttgtggtatgcaccatcacacccaaggagttatctccactacttaaataccatgatgctacaagaaaaaaaagtcaaaactgtttaagaaatttcaagattctggatccacgattcatttccttttgattcacaatcaactggtaaatgcaaagtttcagccggacctggcattctgatcaaattgatctaattttgtgtgcgtaccctcctaaaaatattcagcatagatatttgagtcaccaattcactaagccatgttacaaaactgttaccatatacgatacgctaccctgttaagctgatagaaaaactctaaccacaagtaaacaagtctacaattaaaagagtctgtgtttcccacttccgttaaaagtggaattcatgatgattagatgcaaaattcagctaactcaaagcgtgcctgagaccccaaatttacctgcgccatcatctgtgactggagaccatagtgcgccgcagatgctgcgttcccctgcccttgcagcatcccaatctggccttgactaagcatggccgcgcgagcagccagctgctgctgctgctgctgctgttgtcccacctgtcctccacctcccgagaagttcacctgactgccgtacatcctggccgcagcagcagcgtactgtggaagctggccgacagcggcgaggcgggagcccgagcccgagcggtggatctggccgaagcctccagccccggccgccgcctggccgggcgaaggagcctgcatctgcggcggccgcggggggtagtccatggccccgccgcccgccgcggacgggtcgagctgcggggacgagatggcggacaggtcggagacggtgggcgacggtgggatttggggggagaggagggggttagggttggggttttgcggggtggagacggcggcggcggcgagctgatcgggctgcggcgaggcggtggcggccgcggacggcggatccgccatggcgggctgggggcggcggggctccggcggcggtgggcggcggccggagacgacgcggggtggacgattgcgtcggggggtgcgggggcaggtacgggtcctgtggggtagtttgacgtgtgcgcgtagtcttttcgtggttgagtcaggaggggggtggttgctgtctttagggtcactgccaggttggccccacgggatcatttagcggataagaagaatccgctcagagtttgcttctcgttgccatcactatgcttgcttgtactctcctgggttgatctaggaacatgttcgaggcatttgaggtgtaacaatcatattcaggt

SEQ ID NO: 38527 - DNA, 1501 bp, Oryza sativa
agcattggaattatttttaacaattgaaagatcatttcagtgattaatttaattagaaaagtaattgaaatcaacttttccttttcgggccgaattaggaaaagtcctctcacttcctctcggcctgcagccctctccctctctttccccaagtccagtttcgttccctccttcaatcgggccgaggaaaaggaagcccagccgaagtcttctttgcctccctggcgctacagtactctatcttcaacctccagacagagcccgagccgtcccaagcctgtgcagccgtgccgatctccttcccaattccgaccttcccgttgctcctctttctaaattagttgcgggaatggaatcctctcaatctcctctacaatttcaccaaaaaatccccaatagtttctatataaatcctttccaatttcgcggatcaatctttcctttctccggcgaagatcctaaactttcccgagtttttctcgtcgatctgggcccggacccgagctccctcccgtgcctatataaagtaccccctagtcgtcctctacctttcccctcaagtcctgtccttcgccgtcgccggaaacgccctccccgcgagcaccttctcactattacctaatgatggatatttaattgtagctcacggtggtcaatcatgattggttaattaattaattgcgaattaaaacttgctaatggtgggttgtgagcacatggttttgatggtcgtgctcatgacaattaagcaccgtttcacgagtttcggttgtaaaacattaatcgtgccaaccactagccagcatgggcaacggctttaccttttgtatagcatggttcactgcagggcaccagattgagaagtagcggagataagcccacgggggtcgctgggagcccatgccttattttataagggggtgattatgatcaaggaacggtgcgctgtggtggattgtgttatgcgaggggtagtgtcacaactcctttccgaggtaccgtggtggtattgaggcgcatggtgacatgttgtggggctgtatcttgtgggtacagtggtacatccctgtccagagtaaaactattcgaatagccgtgcccacggttatgggcgagtctaataatgtcttttgtgattagtctcacacttctcaccataataaatgatgctataactggtaataatttgattagctcctggtttagaatggtacattcctggtttggaatggtacatttctgatttggagatagatctgtacaacctggtatggttgttcaagattggttggacctgtgcagcatgggtgtgctgttcagtgttgattaatattgatgattaattactctattattttacaattctcaagtgtttgctaaatactgcttttgtaaatgagccctatattatgccattctgtggtatctttgtgcacttgcatagttgtgtggcttgcagagtattccatgtactcaccttgcaataatcaattaaacctta

SEQ ID NO: 38528 - DNA, 1501 bp, Oryza sativa
actctttaggaacttggaaatggtgttttggttattatgtcaggttctgtccagcatactgctctgagtaaaaaaggagaaggacgactgctaccagttctagaatctgcgcagtttaaaaaaaaattatatatattttttttaaaaaaaatgcgagcatgtaaaattcgtaccaattttgggacatgctaagaacttaatgtagaggctttacaaacatctggtggcctttatatgacaagcaaactatggttaaaacaaatcaattccatcctaccccgtactaccactttctaggccatcgataaaattttaaaattttaaattcaaatttagaagggaaaaatttagtcatctatttactgagaagttttcaaatcattcaagtactgacttgaatcgaatttgtttcattcattccttattcttctctatgagttactacttctctatttatgcatcttccggtcctatagagtaagatggggttttaaaatcaaaacaagattcataggaaaggaatttatccaaacagggctaagaagtaagaatagattagattttgcaaatatattttagtgaggacattaccctcaaaatattttcttttgaagccttactaccgctcagtcttaaaagggttcctacagtcggtcttggctctgataccaaagctgtcggaagcactccgaaccccttagtatatttgaaggatgaatagctaatcacaattcttccatcaaacatattaagacattcgacgctccgagagaaaaatatgtgagacattgccgggcctttagcctgccagtcaacttcagcctgagatgtgcccgtcaaaccactcgaaggtggcgaccagatgtgttacacaatcaggagacttgacaaaaatggctaaagatccacaacatctcaaatatctttaactcatactcatgtttaatatgtccctaacaaaaggaacacactaaacactttcatccaagcacatgatatctcaacatagggagttctaagttctaagttttagttaggatcatacaacttataacttagatacacatggccgattggctgaatagataggttcgcggaagcatcttctacccaaaagatctttcatgcaaccgactaggatagaccctagtaagaaccatcctggaagaaagaaacttccccaacgaaatcatcctccacaggagtgatctcacctgcaaccaattctaaacatgcaacaatataacaatacaagcaagagtcagtacaataaattgtactggcaagcaccaagcaagcctagtactctacatgcatggcaaattcaaagtaaagctaacatgggataattttagcataaagcaaatttagtttgcaaagagcatttcaaatttcagatttattttcaaataaatttcagcaagaatacacttagcaattgggcaccaaattagatgataaacacatataacatagctccttattgccttccatggcagca

SEQ ID NO: 38529 - DNA, 302 bp, Oryza sativa
tgtggtactcttttgaggttgctatcataaccccaatctttagaggttgctgtcataacccccagctgactgcattcttatcagatgttcagtttgttgaaaatgacgtaattttgaaaggatgtttatttattttgatttttgagttagaaggctggaattttatatctttgctaaaattgctcgtataaggactcgatgagtaagtgcatactggtttatttagctgatgtaaattgtacagcttacaacattttaatttgtaggttccctctctttgagaggacttgcaaggagctgaa

SEQ ID NO: 38530 - DNA, 1501 bp, Oryza sativa
gctggagttcatgattcccataaatgatggcattatcaaaatgtccttgatgcccgagtggttctattcgtctatcaagcatgaccaccctagcttgcaatctacgcaactcagttatagtttttgcgagatatctatccatagcacgaaccaggccagctaagaatagtcctggagtgtcaatctctctcatgtttccctcaagacctggatagtaattagcggaggattggtttgcgcgagctggaaagaaatgaaagaacccgtccaaccctggcctataatgtcggtaatacacaattgcttgtaatgcagcttcctgcattgctgagggtgcatcccaaccacaagcttgaaagtaaaggggtggttcatgggtccaaagtccctgtatacacagctcagccatatatgctcgagagatgaactccgctcatgagaaaagaaatgatactccggtggatgatcataacctagatgttgcagcataagccacaggatgtgaggcagtgcttcttcctcaaaacctccagaatagcccaatggttgccacatagaagacatctacaagatattggaagtatagaccaattagaatttcaattgaaactctttaggaacttggaaatggtgttttggttattatgtcaggttctgtccagcatactgctctgagtaaaaaaggagaaggacgactgctaccagttctagaatctgcgcagtttaaaaaaaaattatatatattttttttaaaaaaaatgcgagcatgtaaaattcgtaccaattttgggacatgctaagaacttaatgtagaggctttacaaacatctggtggcctttatatgacaagcaaactatggttaaaacaaatcaattccatcctaccccgtactaccactttctaggccatcgataaaattttaaaattttaaattcaaatttagaagggaaaaatttagtcatctatttactgagaagttttcaaatcattcaagtactgacttgaatcgaatttgtttcattcattccttattcttctctatgagttactacttctctatttatgcatcttccggtcctatagagtaagatggggttttaaaatcaaaacaagattcataggaaaggaatttatccaaacagggctaagaagtaagaatagattagattttgcaaatatattttagtgaggacattaccctcaaaatattttcttttgaagccttactaccgctcagtcttaaaagggttcctacagtcggtcttggctctgataccaaagctgtcggaagcactccgaaccccttagtatatttgaaggatgaatagctaatcacaattcttccatcaaacatattaagacattcgacgctccgagagaaaaatatgtgagacattgccgggcctttagcctgccagtcaacttcagcctgagatgtgcccgtcaaaccactcgaaggtggcgaccagatgtgttacacaatcaggagacttgacaaaa

SEQ ID NO: 38531 - DNA, 367 bp, Oryza sativa
caaaatttaacttctacatgttgaaagaaaaaaataaatttgactataaatgtaagttaattagttgtaatgtaatttattatttttacttgtaaaatttgaattttaacttaatgtttatagaatgatatatatatatatatatatatatatatatatatatatatatatatatatatatatatatatatatatatatatatatatatatatatatatatatatatatatatatatatatatatatatatatatatcacatactaatatattttctcaatttttttaatattttaactatttaagcgacatgcaaataatgagaagaattctctcgagagtgtttaaaataatctactctcccact

SEQ ID NO: 38532 - DNA, 1501 bp, Oryza sativa
tacaccagcacgatacgtgttactccatcctaagccatactcgatatatgacctagaaccgttaagtggcgggcccacgccttaaacttaacgccgtggtggcggacgcaacgggaacccacccacgtggcacaataccgttgtattggacagacttagtcacctaaactaccacgtcggggtaaatagaaagttcctctgaatcaacgactaattcctcagaattatcgactaactcatacacaccggcctaccagaatgtaaggctaaatcataaataatttactaagcttgggctatcccatactagcacatgtggttgtactgtatacgaaatgaattgacgctgagtgaagtccttaggtcggtttgggcacactgtccccctatcagtacacaactaaacacaatatgtgtaccacatgcggcccaaacctaaaatccacattttccaacattttatttaacaaatatcacattttatcattttaatccagatcataaaataaatcatttaatatatgtaattgagcccaaatggtaagtaaactcatcactaagcatggctgagcatttttatagacttgctatctcaaacatcattcttaatgtgacacaatggattgttcctaaggttttggaataatggttaaggtcttttgtggagttcaggtgataatgcaagttaaggagttgatctaacaaattttacaagattttaatggattagtgtacaatagacatgcatattttgcaaacttttcaaaaacatccaaatcataggttcaatgtgatcaaagaagggaggtggcttgccttgctcttccactccttgctcagctacaaagtaggcctcctcgagactcggctgcgaatcgtctaaacatacatatgcaaaaatttaaaatttaaacatacataaaaatccaacatgctctaaaatgaatgctttttttttatggagttggtgtgctccgtgttagtttgattttcagtgaaagaaacttcaatctaacagtttacattcaaagttacagattttttttaaagtgtttacatgttaattatggtcctaaatgcatttcgaattattgagacataaatctttatgattctgttaagtcaaacatttttatgacgcaaagcatgaaaatatgattctaacataatttagtttgcaatttttagagtcaggatgaattttctaccactttctaaagttctgacatttttcagttgataggaaattagtttttgtattttctcaaattttcatacatcattttcctttctcaggtccaccagacagagactaacattttgcgcaaaagcccctgggttctcaggaaatagatcccgcagcccctagcacgtgttccaggattttattcaaaatgggacttgagttctatgttatttacagattagtgcacgaccccatatgtaagtgattgctcgggctgctaatgcatccctgggagtctttaaatttcaaaagcca

SEQ ID NO: 38533 - DNA, 200 bp, Oryza sativa
atatgccctatacgtttccctttcacgaaggcgtcaaatcgttcgaccacgtgatccactggactctctctccatccaaggcccaatttaccgcctacaaaggcccatatttgaatgggccctaaattttgatcggccttaggtgggcctcgcttatgagagcttcgagagggcccacgtgtccactctctctctctctc

SEQ ID NO: 38534 - DNA, 484 bp, Oryza sativa
tttggtgtgccttcacacgagcttaattagcagcataacgcttacatatatagcacattactccaaacatatgcgcagttttatctcttttgtcagagtctcagtttgcagccatgcatatcatcagaaaaaaaggatcacgtactacgtaccaactgtggtcacaagacacatcctactgctcttgtccattgcagcatagcacagcaaccatacagtttacactcgacagcaccactcaacatgcaaaattaagtacagtgtttacagcatttgatcatcatccccccctcaagcgtaccaactcataattaaattcagttccggcaaaattccatcacattcgcatctactaggcgactttttctctgtatttgaaaggaacatctagcagtagcagggcggggggctaattaagatcaccacaaacttaattaatcagaatccctggcaatctgtatacgaaaattaaatggaaacagca

SEQ ID NO: 38535 - DNA, 1501 bp, Oryza sativa
gagaataaaaatatggaaaaaatgaataccgaatccttggaaatagtcttgatgacaaggaagtattcaatgtgagcaaaataatgggtgccgaatccctggaaacagtcttgacgatagggacgtacccagaataaaagagaaaaatataagcaaaaaggctcaagaaaagaaaaagttaaaaattctcttggttattttctgctaaaggttatttgagaaagagtgataaatgcaataggtctatatgtttagtgtttatttttcaacctatgtgcttgttaagatgttgcattataattcgtatgaaatcatgaattttgattgttgattcaagcttaattgtaaactctttggttcatggttatattttaatgcatgcttgctatattatagatgggttcatcttctttttattgcaacaaatgacatgatatgctatatgtatgctaagctcttatccattaatgaacataattcctatgcttgatgaaatcattgtcaaaagggggagaagccaagtgaaaatttttggagaagcaaatttctttcttttcaaaagtaagagaagttttcttttggattttcgagcacgatgtgtacgtttgtacgaagtgtgctttttaccagttttgtttttatttttccaaacaccaaaacatttttgatgggtttgccaatgtgttcatcaaggggttaattgtaaaatcaaaggtgtttttgattattattctgtgatgaacaattggcattggagattattggttttgatatttaaaattcattcacgaagtggttttggagatgattggatttcacaggtgaatctacaggtactactggattgggtccggtcagaccgggcagtggttgccggtcagaccggcgcaactcgcggtctgaccggccgactctgtgtcggtttcggtttcggattgtttgtttggatatccatgattgtttcatgattatagcttctagatggatactatacgtatgtaatactgttgtttgctacaaatgagtcaagttggagatagcttggtctcggaggaatatggtttctttgtttgttctttgtgtaggtgactcggatgccgggagagtatttgcggtgatggaccgggagtcggcttggggataagacgacatccgtggtggtcagagatcatgcgggatactatggctagagttcaatacacgtggttggtgaagattctatatggcatacaatggaggtattgtgtgcgtatgggatatggagtcgaatttttaaggagtccaaatttggtatgattggttatgtaaagtttgtttcttgcactaaagggtttcctaaggtgtttaggacttctagtatgtgtttgattcgtggctttaggctgcctacctctagtataaatagagggggagcgtgaggctttccggtatcacttttgagagcaaatgagttgagagttgagttagggtttcgagtttagtcgaaatttttgtaaggagt

SEQ ID NO: 38536 - DNA, 292 bp, Oryza sativa
cccccgcctttgcgttttcacttcccgttctcgggcccgtctgggctaaggctgggctgggtagaacgggtctaagttggcctcgagtacgggccgggtcgggctgaaattggactgcaacgcaacgtgcgggcccacgtgatctgcagtctcatttgggcccaattgaaagcctaatccggtgacgtgctgagcggtggcgctgttctttgccggtggcggcgttgcagaggcttgcggcggcaaggggacggaggcggaggcgaaggcgagcggcggcggcggcgagggg

SEQ ID NO: 38537 - DNA, 330 bp, Oryza sativa
agtaaacaatcataaataataggctaggatacctggacggctaagcttgctgcatcactgttcaatgttctgcttcagagggattgatgatgtttaagagcgaagcaccttttatttctaagatggtgattgcttcttcatgtattcctaaattaggtatctaggcaaagagatcgatggtgttatccctttggttcaaattctagtattataatgccctgttattcccatttataattcaccagactacattttaattatatataacatgcaaccttttttttagttaagctttgttgctttctttcactaatttatttttctggcagg

SEQ ID NO: 38538 - DNA, 308 bp, Oryza sativa
ttgatagcctggatacttggattacggtaagatttggtgcttattcactggtgtttggctatttcttgtcttgctttgctgctaccaaatctattgagatattgtcgggtgtgggcacccgacggtgccccatacccgcacgggggcgggaacgggggaggggaaaacactcccccgcgtgcggggatgggaatggggacgggattttttttctactacggggacgggacaggatagcaaaatccgacgggtgtagccttgtaggtgtagcccccccattgccatccctactcgtattccctcccagg

SEQ ID NO: 38539 - DNA, 1501 bp, Oryza sativa
aactgggtttttttttagggacgatttataattcggttacaagacgagggatctccggtgtactttttccttagacagccagtagcttttccaagattctgttttttcaggcccagttcatctggccacagagaggcccatcatcacgtaacgaaatgtaacccgactaggccttatggcccaaaaagtcgtaagaacggctaagccttatccaaaattccgaagcttatcacgaaacggacaataaggtatacaccctaatcccaaaaaccattgaactcaaaaggggaataaaatatcgactgggaggttttttctgacggttgtatcacaggatcacacagtattactagtgtattactgcagcgttttcagatcataaacagattctggcggcaccatacacgagaatacgagattaagtaatcacaagatcagcttggaagcaaggaagaaaaagaaaagagcaccgacacggcatttctctcgcatgcgcgtttgcgtatcagtgagtgcgcatttgggtcccgtcactcgcaaccaaagaaagattagtcgaagcaaggtgcagatatcttggataccggagagccggttgaccctagaaagaggagccaagatcatcagatctgccgggtttccggacgcatcaggattagcacatggaatatcctatgttatgcgtgattacaatgggcagcgcaatgcctcgccttggttggttgcctgcatctacagtctggacagatgacagtccgaagcggcttcattgtgacaaaaaagaagaagcaatctttggtttcttggatcagggaaagtggaaagcataaactggaacagaaggccaggcggaaataaactggacaagaagaaaaggcgtatgtaacgtactaacgtgcatgtttttttcctcattcaaagatttcccctcgacttctcattcaaacaaagcaaacatagcgttttctaaaatttatttattttaataatattctcccatgattagaaggggattaaaagaaaatctcttccgttgacagaaaccacatctctactgtagttatctgaattctgaaagcctgaacctctcgtcgtgtctcgtactctcgttcccctcccctcgcgtcgcctctccacttcgtctctataaagtcccacccaattctcgattcccaatccagcgcagcacaaagccctcctccttccaccgcagctgcgctacctacctccaagagggctggtccgctggtcgtggagaaggaagagagatcttccaggctgatccctcctattggtacggaagccctaaactcatcggagctttgccgcggccgcgagcgatcaaatcgaaatctttctttctttgttctttgatgctccaacctagtgtcggatttgattttgactgttgcaatggcagctttctccttcccgagcccgcttgaggatccccgccggagtagggattagggaggggagaacaggaggcggcgattcacca

SEQ ID NO: 38540 - DNA, 1501 bp, Oryza sativa
cgttgttggatcaacttgtcccccaaaaaagaaaaaattggcatatggcctatacatatggctgggttgataaagatgttcgtagcaaatagtagtgttgttctttgccacacactgacacaccggccgggacagcaaataggtgaatctactcggtatgtaaagacttgggcaggtatacgtgcgtgaggtgatggctgcatggcgccgttgctttcctgtaccaaatcttgacaatagtaacctgactaaactagctaggcgaataaaactgcatgtttcaccgtcactctgcccatcccacgctcttgtttgttccccagatcaatttgtccatgtacaaccagacattcacaatcaaaactattgttttcactgtcaagtggagtaaaattagacgcagtagacaacatgcaagtggtgtattttctttgtgtgccttgttggtctcatctgtgactaatacaaaaacaataacgaaggagtgagcaacgatttggttcctacaatcttttgcgctatatgtatattcctgtctggacaaaaaatgatactacagagttatgcaaatatgcattcatgctggaaatggatttcctgatcacaagtacttgatgaaatggatttcctgataacaacttgttggcttcgaatttttttgaggattaatattatttttatggaaaatcgcaaaagtagtggccaaccggggaaaatcgcgaaagtaggtccctgtcgaacgggtgcaattcgatagggcacctatcgaacgacggacagtcgacagagccctgtcgaacggctggcgttcgacacgctcgcctgtcgaacggagggagttcgacagggcccaccaccccgcgccgccaggcctgtcgaaccgggggcgttcgacaggtccctccaccgaccctgtcgaacaatgggcgttcgacaggccggtttaaagccccgtctccccagcccgcgatgcttgttcgatttatttgaggaccacatcgccagccgccgtcgagagtcgccacatcgtcgccgtgagcgccggagggagcgaggggaggggatagcaggccggagaggaggcgccggccgggaggaaagggttggcgacgccctccagcagtgaagttaaggtatacattagtaatccctaagtacaatgcatatgaaagtttaataaaaaattggtttaagagttgttaattgtttcgcattgttcgatgttagtatgtatggttagcacatatttgttattgctaaatgttggtagaggtatttaagtaattgtacggttaaattagttcttagttagtacatattattgatatgttgtgtgttaaaatatgtacaaaggtgttatattttatttggattattaaactagttgtttgttactaatagttgtaaattagtacacggcaatgtagtataagttgtaatagggtaattatcgaatgattaaatgattaaacgtgagactatttatcatgttttatcagga

SEQ ID NO: 38541 - DNA, 1501 bp, Oryza sativa
agccatgggaaataagtgtttaatgcaggcttcaaggaaaggctgttgtttttgcaattgattttatttaaactcttttctgaaacaactaagtgagatcttctcaaacgacacggatgagacagtgcgtctcgcccggtcggagtatgtgcaaggtatcagtcttttgaattggtcaaggttggcacccggccaacgacttttaaacggccacccgggcctggctgatcccatcagccgcaggttttccaaacatcgaacccaaaccacatcagcaaatttcacaaagcagtagtcaaacaaaactacgctaggaatcacctcacatccgcccatgaccgtgggcacggctgttcgaacagtttaataacctctgcagaggggggtacactttacccacacgatattactaacccggatcatccagcccgtgcagaacggccacgactagagaccttaaggctttcacgacaaggcatttcgaaagccgacacaggttcaccatatgccaacgagagggatcccagaccatactgtgccaggaaacccgggggtcctccccgacaccaccccgttgaatccacatgtctcttggcatcatggctcccccgattagctagttactcagccaggggtgtcccattccacccatgtggtcgtacttgtcttatgttcggatgaaattccaaggaaacggtccttaagtgcaagagcggggaaccgtacacccggtacgttccccggtccgcgaatttggaaattcatttaggttcgcaagcaccgacccaggtgtcgggttttccaagtgttttgtaaaacccaagttttacccaagatgtttctcagattttaagtttgaaggcgaccgtcgatattcgtgcagagtgcacgattaccgaggcgcaactaggtggttacaagggaacatggtataataattacaatggaggggtcaactgcaacaagttaggtaggtccgccaatctgccttgcagacgagacatgtagattaagtgcaatcctatcaatgcataatatttttcaagcaacatacttaagttcaaatataggctcaagatgttcaaaggtggcttgccttgctcgagatcttgagcttgatcctcgaaatcctcgcactgcgggtcttcgggctccgaaactacacgcgaaacgggacaactcagcaaacggcgaaaataaagccctattattgacctctaagcgtgccattagatagatctcgagatttgaggaattttagaagttgaacggagtcaaacggacttacggttgagaagatattgaatttataagattattggatttttggtctaaaggaaaaggatttatttaaatcctttttggaaaagaaaagaaaagaaaagaagaagggagggaaattatactttcctcgggcggctagggcgcggcccgagagaaaggggcggctcggccgagcttaatgggccggccggcccaagaaggcggcccaaagcgcgcg

SEQ ID NO: 38542 - DNA, 1501 bp, Oryza sativa
aaaagatgctttagatcgtgttaagtacatggaagatgttgtgaaaaccaatgaagtgctttcttgccccaaatgtcgtaaaagcaaagttgtcatggtagattgtgaaaattgtgctaatttagaaaaagaggtttcttatttgaaaaattctttgctaagattttctgatggtaaaaagaagctcaacatgattttagatcaatctaaggttagcacacataaccgtggtttaggttttaattcttatgctcatcatactagtcatcctcctgttgtgttaggtgctggtgctagaggtggtgagattttagttaaacctgatactaataaaactatgtttaaatatgatggtatcatgtctaccttgagtacatcttcttcaaagtccaatgttgtgcatgcaaaacctcctgttgttgcttgtgttgctaagtgatgaggacatcctccactattacccgctggcaaagacgccaaagtcgggcaacgaccgtgtgagcctttgaataatcccaccttgcttagcttgggaggaggaagccaccttaaaagggagagccacccttcccctattggactagtcttttagggagattgggcctttctccgagtgggtgtgcctaagaactgttggggtccgggaaaccttaagttattgggcctcagccgaccccacctaggccggattattatcactaagttttctgattctaccaatatgtcgaatcatcgtgaaaaattgtcacataccatgactttgggtgtttggaaaacatggaaatggtggaagaagtaaaataaataaaacttttgtttaaaacttatatgcttgcttgtttgtgcattttgtggtgtatgcatatggtttataggatcatgttcatatttaactaaaaccaatggatcaaagaaaaattcttggaacaactcaaaaatctgggaagaatttgtggtaacttcttgctgaccttagaaactaaatgtggattttaatttagcttatcaactcattagatcaaccaaacaactctctaaacacttaagcacaggattttgacagattctctggagcactctttgacacactgccaaaattggatcttgaactcctaggctgtaaaactcgatccaaactgtagttcaatcattgctttacaactttgcctttggtcactagctctaactctgcctagaactaattttaaactgaacccaaagatggaattccacctctgttccagacttggccaaaacctagatctcctctccttctctctcactagtcgctgccatgtgggccagggctgcatggcgggaccccattgtcagcctcacattcctctccacacgggcccactgcctgaactcgcatgccacgcgtgtgagcacgcgtcgagcacgggagaaggcgagctcctcttgtccatctccgccggcgaccatacttaacccgaccggccgaccaactttctctccctctcgcccttgtctcgtttcg

SEQ ID NO: 38543 - DNA, 1501 bp, Oryza sativa
taaccatagtttgcttgtcatataaaggccaccagatgtttgtaaagcctctacattaagttcttagcatgtcccaaaattggtacgaattttacatgctcgcattttttttaaaaaaaatatatataatttttttttaaactgcgcagattctagaactggtagcagtcgtccttctccttttttactcagagcagtatgctggacagaacctgacataataaccaaaacaccatttccaagttcctaaagagtttcaattgaaattctaattggtctatacttccaatatcttgtagatgtcttctatgtggcaaccattgggctattctggaggttttgaggaagaagcactgcctcacatcctgtggcttatgctgcaacatctaggttatgatcatccaccggagtatcatttcttttctcatgagcggagttcatctctcgagcatatatggctgagctgtgtatacagggactttggacccatgaaccacccctttactttcaagcttgtggttgggatgcaccctcagcaatgcaggaagctgcattacaagcaattgtgtattaccgacattataggccagggttggacgggttctttcatttctttccagctcgcgcaaaccaatcctccgctaattactatccaggtcttgagggaaacatgagagagattgacactccaggactattcttagctggcctggttcgtgctatggatagatatctcgcaaaaactataactgagttgcgtagattgcaagctagggtggtcatgcttgatagacgaatagaaccactcgggcatcaaggacattttgataatgccatcatttatgggaatcatgaactccagcctcttacagagactttgcctcctcccatgggtatttatcataatataaacactagagcccgcatgagagttggttttcatcgaaatcgtcgaaccatgccagaccctgcacttgctggagatccggtgctgctggggccattctatgagttcgagcggaatgggagacaataccgtttgactatggccactccgtcaaccacagtgcctcaacctcccatcggattctccgaagttccatagaatggtgtactggaaaaaaagaatatgtatggggtgtaactttcatttcttttctttaagatgtatgagatgacaccctaatatgtaatctttttaacggtcaaaattttgtaacaccaaggcatgaacttggtttcttatgaccattatccactcctatgtatctgtgatcacttagatcctttaaaactaatgtactggaatgaacttatgctccttttggaatggattgcttgctgtccagaaatttgtttcatgcaaatatatgatggatgacttgtaaattcggctataagaaatcattcctgtatgctacctatttagggtaatgtatatgccaattctatgctcaagcagctcatgtacttttgtactttgagtgcaggatgacacata

SEQ ID NO: 38544 - DNA, 1501 bp, Oryza sativa
cttgaacataacactaactgggagaaatgtctatcttttgctgaattctcctacaacaatagctttcaatcaagtatccaaatgtcaccatttgaagctctttatgggagaaattgtaggactcctctttattggtccgaagtaggagaaagacaattctttggacctgctatcattaatgaagctgaaaagaatgtcactcttattcgggaccgattaaaagaagctcaaactcgtcaaaagagctactctgatcgtcgtcgacgagagctaagttttgatgttggtgaccatgtctatcttaaagtatcacccatgagaggcactcaacgattccaaattcatggcaagcttgctccacgatatattgggccataccaaataatatctaagcgtggacaagtagcctatcaattggaattgccatttcagttgtctaatatacatgatgtattccatgtttctcaacttaagaaatgtcttcgaactccgattgagcacacctcacttgaagacattaatctaaagccaaatctctcctatcaagaatacccaattcgtattctcgaagaaagtgaacggcgtacccgcaaaagctccatcaagatgcttcgagtacaatggagcaatcatactgtggatgaagccacatgggaacgagaggaccgacttaaggccgaattccctagtttcttctagaatgacgaatctcggggtcgagattcttttgtaagggggtaggctgtcacataccatgactttgggtgtttggaaaacatggaaatggtggaagaagtaaaataaataaaacttttgtttaaaacttatatgcttgcttgtttgtgcattttgtggtgtatgcatatggtttataggatcatgttcatatttaactaaaaccaatggatcaaagaaaaattcttggaacaactcaaaaatctgggaagaatttgtggtaacttcttgctgaccttagaaactaaatgtggattttaatttagcttatcaactcattagatcaaccaaacaactctctaaacacttaagcacaggattttgacagattctctggagcactctttgacactctgccaaaattggatcttgaactcctaggctgtaaaactcgatccaaactgtagttcaatcattgctttacaactttgcctttggtcactagctctaactctgcctagaactaattttaaactgaacccaaagatggaattccacctctgttccagacttggccaaaacctagatctcctctccttctctctcactagtcgctgccatgtgggccagggctgcatggcgggaccccattgtcagcctcacattcctctccacacgggcccactgcctgaactcgcatgccacgcgtgtgagcacgcgtcgagcacgggagagggcgagctcctcctgtccatctccgccggcgaccatacttaacccgaccggccgaccaactttctctccctctcgcccttgtctcgtttcg

SEQ ID NO: 38545 - DNA, 1501 bp, Oryza sativa
caattaattacttttgcttgcatgtttgtttccttccgcggatatcttttaggtattaactatccgtcaaagataggagagttctctactatatcgctattaaatgaagatcaccaacttcaatctatcccttagttcaattatattcacaaaatagattcagttacgagcaacgttaacccagattttttttcagtctttgatggtatcgtaataatgagtctaattaatatgctatgaaatataatggattattgttgttgatgcaaccatgctaggttatagcctgattgtgctagaggaggcatcataagttgattgaaagggctaacgagtgcgggcggtgtgccctcatgaatgcaccccgatagcctgttttaggcaaccgcgtcctcatactctcttttgttcatataagtttatacaccgaaagtctatacataaattaaagtgtattaatcgatttatgtactaaagtgtatacatgaaagtttttatacacataaatttatacatagaaactatatataaaaagtttctaaatttttgctatacaaaagtttatcatgaaaattttgattgtgtttgcatgtaaaagttcattaactacatttggcactaattatagggagccgtaatcatgtgatgtgtggtgggacatctgcatgatctaaatgcatacttggttttgcatgggagcgacgggcgggaaaaagccacgtgaacgcttggctatcaaactccgccgtcataggacccacagtttacttcatgtgtatcttgcttctactagagactttgaaataaaacccgagatgttttaattttgtagattaggcatgaatgaaagcctttcatttgcaagtttgacaaccttcacctctttacgatatttttctacacattttctaaattattattttctgaacaaaattttattccaaaagtccttttttttgaacttttcctaaactttttgaacttaatcttatgtagaattaatggatttgatcatacatagtatctttaagttaaatttaaatatataatttaatttaaattccatattattttattatttatattattaaattattatttaaagataaagaatgactccctccgtcctaaaatataagagattttgggtgaatgtatgtgacatatcctagtacaatgaatctggttcattgtactagaatatatcacatccacccaaaatcccttctattttgggacggagggagtatatatagctaacacattgaggagtgtcatgtgaaagttttatcctacttgctgatccctgatataatggatgtatctcaagttgtctctctatgaactcatattagggatgaacttcactgatcaatccaatgatattctgatcgttgcgtgactgatttctacatgctcacactactaaaaaaaaatgattttttgcagagagccaaattttatttttacatgtaggccgttgaaaatccacttgtaataa

SEQ ID NO: 38546 - DNA, 1501 bp, Oryza sativa
atatggaaaaaatgaataccgaatccttggaaatagtcttgatgacaaggaagtattcaatgtgagcaaaataatgggtgccgaatccctggaaacagtcttgacgatagggacgtacccagaataaaagagaaaaatataagcaaaaaggctcaagaaaagaaaaagttaaaaattctcttggttattttctgctaaaggttatttgagaaagagtgataaatgcaataggtctatatgtttagtgtttatttttcaacctatgtgcttgttaagatgttgcattataattcgtatgaaatcatgaattttgattgttgattcaagcttaattgtaaactctttggttcatggttatattttaatgcatgcttgctatattatagatgggttcatcttctttttattgcaacaaatgacatgatatgctatatgtatgctaagctcttatccattaatgaacataattcctatgcttgatgaaatcattgtcaaaagggggagaagccaagtgaaaatttttggaaaagcaaatttctttcttttcaaaagtaagagaagttttcttttggattttcgagcacgatgtgtacgtttgtacgaagtgtgctttttaccagttttgtttttatttttccaaacaccaaacatttttgatgggtttgccaatgtgttcatcaaggggttaattgtaaaatcaaaggtgtttttgattattattctgtgatgaacaattggcattggagattattggttttgatatttggaattcattcacgaagtagttttggagatgattggatttcacaggtgaatctacaggtactactggaatgggtccggtcagaccgggtagtggttgccggtcagaccggcgtgtatcgcgcagtcagaccggcgcagctcgcggtttgaccagccgactctgtgtcagttttggttttgggttgtttgtttggatatccgtgattgtttcatgattctggcctctagatggatactatacgtatgtaatactgttgtttgagtcaagttggagaatgcttggtcttggaatatggtttctttgtttgttctatatgtaggtgactcggatgccaggagagtatttgcggtgatggaccgggagtcggcttagggataagacgacgtctgtggtggtcagagatcatgcgagatactatggctagaattcaatacacgtggttggtgaagattccatatggcatacaatggaggtattgtgtgcgtatgggatgtagagtcgactttgtaagttgtccaaatttggtatgattggttatgtaaagtttgtttcttgtaccagagggtttcctaaggtgtttaggacttctagtatgtatttgattcgtggctttaggctgcttaccttgagtataaatagaaggggagcgtgaggcttccctgtatcgcttttgagagcaattgagttgagagttgagttagggtttcgagtttagtcgaaatttttgtaacgagt

SEQ ID NO: 38547 - DNA, 428 bp, Oryza sativa
tatagagcaagggtgagtacaggagtactcagcaagccatgggaattaagtgtttaatgcaggcttcaaaggaaaggctgttgtttttgcaattggttttatttaaactcctttttgaaacaactaagtgagtgcttctcaaacgacacggatgagacagtgcgtctcgtccggtcggagtatgtgcaatgtatcaatctttgaattgattcaaggttggcacccggccaacggctttcaaacggccacccgggcctggctgatcccatcagccgtagattttccaaacatcgaacccattccacaacagtaatttcacaagcagtagtcaaactatgctaggaatcacctcacattcgcccatgaccatgggcacggctgttcgaacagtttaataacctctgcagagggggtacactttacccaca

SEQ ID NO: 38548 - DNA, 691 bp, Oryza sativa
cctgcagcctttgtgctatacaattgttggaagcatccgtggtagcggatgccaggagccaacttaggccttattcgttttgaaggattcctaaaggaaatctcaattcctttggaataatcactattcatgcatttggtttgtaggattcaaagaaaaattttccataggaacactatgccaatcctccaaaatgtactaattccataggaatgaaaacatccactctatcatcttttgtttaactcagtgtagtaaaaattcctgtgttgcaatcctttgttttgcacatgcattcctacactattcctacgtttttcctgttcctgtgatttggaaatcctgtgaaccgaataagcccttagctttatgcccaagggctttgggtgatcggactgaccctagttggggttgtttaaatagatgggatgtcagcttacctgatccttgacagcttacctgcatgtgcgatgccagccatcaagcttccaaaaggaacgattgaagacttagattggatgagaagagcatttctctggacaggggaggatagctgcattggagccagatgcttagtggcctaggattcaatctgcattccaaagcaatttggaggccttggtatcaaggatgttggccgacagaacaatgctctgctcgttaaaaggctgcaccatcttcactcttcaga

SEQ ID NO: 38549 - DNA, 1501 bp, Oryza sativa
ccataccatccaaataccctagccgagacctaaaaggtcgacatgtacgtcatcttctttccttatcatgaggattgccttgatgaattatcactttcgattttagctagatattcatcaatatatgaagtttgaccacttctatatcttcatgccacttgatgtcattcaacaagtaaagtccaatctttacccattttgcagtcaaactcgatgtgggtccacctatgaattacatcttattgatcttcaccatttcatcttgcattcttttaatggttgatgtgggttactcatagattcaactgacctcgggtggaccatcacggcaaagccttcaatcatccttatgaatgaaatggtcacggaaattacctactgacctcgtttctgaccattaccgtttctagacatatataaaatttaacttatttaacttatctaatttatttcaacatctgattgatgttgacactgaatagttcaattgataaatatcatcaattcccaattgatcgagcaacatttctgaagagatctgccccatttcatccctactcgtacgcaccaccaaatttggtcaattggtggcaatcacttgcttgcccttcaccatcgcatggctcatcatggcggacatggcttacccatcgccattttgttgtagataaataaaaagctatgtaatagctaaccatgtgcacgtcgtgtctccatgctagcacttgtagtagtcattatcaattgtggccaagagatggtaactaatcatgaaaagaacattctccaatgtagtcgtataacaagtgtcaatgttttatatcggtataataaaaggggtagcacacgggacctaaaaatagatggaagtggaagataagggtttgtagaagttcaggcctgcccaatgcaaggtattaccatattcctattttagtggattgtatctattgggtgtattgatcttgatgttgatctcatgatttgattgtgggttgtgtatctcatttctggttgccctcgatggggctccctgccaaccttatataggttggaggtgcagggttacaagtaggaaaccgaattagatattcctttggttaccttacctatacatggtattatttggttggggctatataaccttgcttggaatacaagaggtaacatggcaactgtattctactctattttatattacattgtagtcggatacctaactattgttatttgttatgatcacaaataattccacaagcgcacagatatcaatgtacaacttcaccatagattatttcaagggtatcgaatcataaggaacatgtgtgtaatatctaaaaaacatgtttgtccaaggacaataactaaatcataggcggaggatagagaagtttccgaagggtcaaaattcttgaattaagttttggtaaaagtctatcacttgctttgggtaccggctctcccctggcacaccaagcaaatctggccaatagctctgtga

SEQ ID NO: 38550 - DNA, 1501 bp, Oryza sativa
taatagtggacgctctggtttcactttcaaccatgtcccgagttagtataacattgtgtgtaatataatactgtaactacaggatatatatcattctcgttacattatattacaaatgtgcatatcttgtaattgtcatgtatgataaactgaattttcactaaaaagagaagaaggcaccatattactttggcttgcatgttcgcgccattttaatttcctagctttcaggtaagtatttatttttgtttagggtattcattacccatcacaggttgaattctatattatattacgataaaatgaagattactaacctcaatttataccctagttacacaaagtaaattctgttacgagtaaccctcctttttcagcttttttccatgatatcataataacatttattttcaatattgtttaaaagtctaattagtatgctcttaattaaatgtagctgatcatcattgatgcaaccatgcatagtttctggctagatggtgctagagggatgggtaaagggctaacgggctaacgggccaacgagcacgtgcggctgcgacaaatgctccttgacaactcattttaatttttaggtaacaatgtcgacacgtgctctttttttttcatgcaagtttatacacccaaagtgtgtatgcaaaagaatatacatgaatatttatgcaccaaagagtatacataaaagttattgcatacggaagtttatacatcaaaagtttatgatataaagtttatcatggaattttgagtaattttttgtggtaaaaatttgctaactgtattagcccaaattatacaatgacctaaccacttggtttataggtagacatctacatgatatggatgcacagtcaccattggatgggcagaaaccatgcatgctcagttgctcacccataggaggggccattgttccagtttatttcatgtgcctctcacattgggcctctctaaattaggcctaatgttaattttaattttgtgaattgcgcgggaagggaacttccattggaaatctgataattaccttcgctcctttaaggccttttgctaaacctttttttctagattattattttttgagctgattttattcagaaccatccttttgttttttttacaacttctcctaaactattcaaacttaatgttgtttattgtaatggatttgatcatatatgatatatttttttaaaaatattttaatttaaattgtagatctaaaatttcaattccttgttgttttgttatttttattttgtaaattattatttaaagagaaaaaatatgtagttaacacatcgaggaggattatgtaaaagtttcatcctagtcactgatacagtgtgtgtgtgtgtatatatatatatatatatatatattttctctttaaataatatatatatatatatatatatatatatatatatatatatatatatatatatatatatatatatatatatatatatatatagga

SEQ ID NO: 38551 - DNA, 863 bp, Oryza sativa
aggaatggaagatgaagagtaagagtcatggaatagaaagaggaatggagcaactaattgtcatcaactagccatgaaccatcctccactacacaaccatcaaccaacaatcaattaagagtaattgatgtaagttaccaatggaataggaagaggaatagagcaactaattgtcatcaactagccatgaaccatcctccactacacaaccatcaaccatccatcaattaggactaattgatataagttaccaattccttaatcaaatggattaattctcaaaactcttcatcccattgatatcccatagaagaatgaattcacatgaattcctagcataatgagccttggaatttatttgatttaattgatttaaatggattaattacccaattaaatctaacagcaggagctgaaaatataattagtctcgatcaaatcaagcaaaatatgaatataatttggttaagacaagcaaagtttttatatttgagaatggataaaggagcaatgttatacatagtagcagcggcggtcacatttcgatggattgcacatgctcaataaaaaaaataaccgaacataacacataatgtaatcgtataaaaaataaagtacaaccaataaatgaaggcacaagagaatatccaagataaataatagaatatagttatggagtcacctagctctagccagttgctggctagaggttatagcgcatagtggtggaagcacgaccgtgcaccgtggaaccacaaatggcacaatgccaacacatgcagactggtgctggcatagtcaccagcgcggcaaagggtacgagcgttgagcgataagtaataaagatgatcagttatgggtca

SEQ ID NO: 38552 - DNA, 1501 bp, Oryza sativa
aaggagacaagtggacaaataaattgacatgcagcaaacaaaagataaacataatgaaagtggaagtcaaaagattaaagatctagcattatgccacatccagcatataagtcataggcaacaaaagtagttgctacacaattatatctaatgtgtcttcacattaatgggacgggacggggtagggtgattctagttttgtggttgtttggttggagcgatacacggatgtgtcccattagatcggagaccagctcgtccccctaaatcaagcagcaattcatccctcttacatctctctcacgtgcattcttcctccttacggcacacagcacaaggcttgtgggaggaactagcatcgtggcaaaacctgatgagcagtggccggtgtttgcaccagtttgtgggaggagacatgcgacgttgtgcagcaaagctcgtggcagcctctcgttaatataactagctcttacataaatatgtgagggacattttctattgtcttgttttctaacttttttgcgtgttgcattgaagctaacttccatgttaacattcaatcgaccttgtttattttgtgtttaaaaaccaaaactagcttgcatactaccatacaagggctgagttactcactgtgaagggtgggttggctagcccagctacaacccattcactgcacgccactagaaccctgtcctagtactaggctacccacattagtcatcactcaccagcccataagcaactccaggccagtgattagatatggggcaatcgaccgttgtttctcttccaatcttgtgactacatgccccttcgtcatgacccataactgatcatctttattacttatcgctcaacgctcgtaccctttgccgcgctggtgactatgccagcaccagtctgcatgtgttggcattgtgccatttgtggttccacggtgcacggtcgtgcttccaccactatgcgctataacctctagccagcaactggctagagctaggtgactccataactatattctattatttatcttggatattctcttgtgccttcatttattggttgtactttattttttatacgattacattatgtgttatgttcggttattttttttattgagcatgtgcaatccatcgaaatgtgaccgccgctgctactatgtataacattgctcctttatccattctcaaatataaaaactttgcttgtcttaaccaaattatattcatattttgcttgatttgatcgagactaattatattttcagctcctgctgttagatttaattgggtaattaatccatttaaatcaattaaatcaaataaattccaaggctcattatgctaggaattcatgtgaattcattcttctatgggatatcaatgggatgaagagttttgagaattaatccatttgattaaggaattggtaacttatatcaattagtcctaattgatggatggttgatggttgtgtagtggaggatggttcatgg

SEQ ID NO: 38553 - DNA, 1501 bp, Oryza sativa
gagaatttttgtttactagggaacatgtgggatctgtctatgtgctatgtctggcataaataaagtcaactgataaattaaaatacattagcaatagaacagtgctatcatacaaaattgtgatgacaaccgattaagtgcagagaattaaaatttgaaaaaagaaacattaggttactctcttggatttgcgcaaatgtttatttccaactatgatccttgaaagttgagatttaattttgttacattttgttgcatatgcatgactattccttaggcagaataaaccgtttagtgtaattatgcgattcggtttagtgtactatgaagactcaacttttctcaagctaatttcgaatcagggtttcttaatgatggtggttttcatgatttaggggtgattcatatatttgagttcaatgctgataatagcatctaatactataatggtaagtcgtaaatatgctgcgcaaaattgagggttaattcctttcctgtctgtgagaacaagtaggatttcctcccttttcccgagagcttttaaccatgcatcaccagactattatataattgaaatggaataagtatcttcacttaaaattcgtttattatctactacctgctatcatatatttatttatttatttatttgcagtagtgctttagaaatgatgtagtgttctatctttcgctttgcttaaaatgagtggtctttccttttcttggaagtatacaaaaccaaaataatggtgtagctgaaattgtagtttcatgcctctagtggttcaccagttatccatgtttcttaaagatcaggtttcgtcaagtgttactgcgtttgaattgcggaggactatcaggttatatgctttttcctctatgcagttatcagttatacgaagttatagatgagtatgtttttggttatcgatttgtgaactgtgataattgactagaagatagtacaatcacaatatcacaatagacacaaagctggtcaggcttgctttcatgggtttgtacattctgctttgcacttattaggatagagaccagcatttactatcccgctttttttcctttcaaattttcatttgggaccaggtattgccctagtctgttcaatgtcttccataattgctgaggtcttgtgctgttacttttttttttatcagtgaccaattcatatctctgggaagatgaatgctggcacattcatgaggagttaaaatattgaacactgccagaattgccaaggtttgatctatcttctgcgatcatctcccgtcttccttctagtagtccattagtccatctacttaccagttaccactgctcgctttccttttgagggatgacaaatagtttcattttttattgttaattatatctcttgttgttcaagaaattttcattagtatgattatgatatatttgcaaatacatccatgatatgacctgggttgtaaatcctttcgttttgtggacctgccccactgtt

SEQ ID NO: 38554 - DNA, 1501 bp, Oryza sativa
gtcgccgacaagcgggtcccacccgggaccacgcgggatggacccggcccaccggctctctctctctcctccccgcccgcgcgcgcgctttgggccgccttcttgggccggccggcccattaagctcggccgagccgcccctttctctcgggccgcgccctagccgcccgaggaaagtataatttccctcccttcttcttttcttttcttttcttttccaaaaaggatttaaataaatccttttcctttagaccaaaaatccaataatcttataaattcaatatcttctcaaccgtaagtccgtttgactccgttcaacttctaaaattcctcaaatctcgagatctatctaatggcacgcttagaggtcaataatagggctttattttcgccgtttgctgagttgtcccgtttcgcgtgtagtttcggagcccgaagacccgcagtgcgaggatttcgaggatcaagctcaagatctcgagcaaggcaagccacctttgaacatcttgagcctatatttgaacttaagtatgttgcttgaaaaatattatgcattgataggattgcacttaatctacatgtctcgtctgcaaggcagattggcggacctacctaacttgttgcagttgacccctccattgtaattattataccatgttcccttgtaaccacctagttgcgcctcggtaatcgtgcactctgcacgaatatcgacggtcgccttcaaacttaaaatctgagaaacatcttgggtaaaacttgggttttacaaaacacttggaaaacccgacacctgggtcggtgcttgcgaacctaaatgaatttccaaattcgcggaccggggaacgtaccgggtgtacggttccccgctcttgcacttaaggaccgtttccttggaatttcatccgaacataagacaagtacgaccacatgggtggaatgggacacccctggctgagtaactagctaatcgggggagccatgatgccaagagacatgtggattcaacggggtggtgtcggggaggacccccgggtttcctggcacagtatggtctgggatccctctcgttggcatatggtgaacctgtgtcggctttcgaaatgccttgtcgtgaaagccttaaggtctctagtcgtggccgttctgcacgggctggatgatccgggttagtaatatcgtgtgggtaaagtgtacccccctctgcagaggttattaaactgttcgaacagccgtgcccacggtcatgggcggatgtgaggtgattcctagcgtagttttgtttgactactgctttgtgaaatttgctgatgtggtttgggttcgatgtttggaaaacctgcggctgatgggatcagccaggcccgggtggccgtttaaaagtcgttggccgggtgccaaccttgaccaattcaaaagactgataccttgcacatactccgaccgggcgagacgcactgtctcatccgtgtcgtttgagaagatctcacttagttgtttc

SEQ ID NO: 38555 - DNA, 1501 bp, Oryza sativa
ctgggtcggtgcttgcgaacctaaatgaatttccaaattcgcggaccggggaacgtaccgggtgtacggttccccgctcttgcacttaaggaccgtttccttggaatttcatccgaacataagacaagtacgaccacatgggtggaatgggacacccctggctgagtaactagctaatcgggggagccatgatgccaagagacatgtggattcaacggggtggtgtcggggaggacccccgggtttcctggcacagtatggtctgggatccctctcgttggcatatggtgaacctgtgtcggctttcgaaatgccttgtcgtgaaagccttaaggtctctagtcgtggccgttctgcacgggctggatgatccgggttagtaatatcgtgtgggtaaagtgtacccccctctgcagaggttattaaactgttcgaacagccgtgcccacggtcatgggcggatgtgaggtgattcctagcgtagttttgtttgactactgctttgtgaaatttgctgatgtggtttgggttcgatgtttggaaaacctgcggctgatgggatcagccaggcccgggtggccgtttaaaagtcgttggccgggtgccaaccttgaccaattcaaaagactgataccttgcacatactccgaccgggcgagacgcactgtctcatccgtgtcgtttgagaagatctcacttagttgtttcagaaaagagtttaaataaaatcaattgcaaaaacaacagcctttccttgaagcctgcattaaacacttatttcccatggcttgctgagtacttctgtactcatccttgccctatataaataatccccccccagttgctgaagaagatgaagcggatcccgctgacgaggagttcttccaggagcaagccggctacgatgagttttagggtttcagcctagttcctaagtcgcgcctgtgatgtatggtccaagtcttggcttccgtttcccttttgtaatgcagttgtgagctcgggatctgtccgcagcccaacatgactgtactcctactctataataaagagacctctgttgctgtgatattctgtcttcctgtgataccagcactgtttcctgggactggtatcgattaacaggttaatttggagcgtcacgggctagtcccgctcggggctagttcggggcgtgacaagagatggtatcagagcccaggcttggccctagggcgaaacccgacgtttaggacgaccctaaggatactaagttcaaaactacttgcgaaaagctaaggcttttttttttggtttctttattttcaatagtttgttgctaaaatggttactgatcttttctccctctttcaaaattgtagatggtagtgaacgccagcttcagttcccacggttttggtgagggtcaccacgtcgctcagcttcgtgacctcgcccgcttccttggcttttcgtgtcccgagtacacggggtactccgtggaccatgttccccctcgctg

SEQ ID NO: 38556 - DNA, 1501 bp, Oryza sativa
atttgccaaaacgagtcagtctagggttttagtaaaaatttttttaagatttattcgtcagtcagttgggatttgatgggtgaaatgtattaggtcctagctcaggaacatgggttgcaaggtatttatgctttatttgtaattacaagtatgtatctaaattccccattattttacctctatgtaagtccgtcttatttattcgctctcatgcaaaatgatttatgcataaaattttgctcttattcgattctcttatttgagtcctttattgctttatttaaatttggatttgagcatgcattgatcctactcctttgtcttctttagatggccggtcacccacccaaccaccatggagagggcatgattgacttcgtggcagagttggcacgcatgacactggtggtaggctaccccaacgcgccggagtacacgacgattccaccgctcagtggcgagcttcctcaccgtgtccgcttggaggtccatggctacgtggggacttgccttgctaacatggtggttgaggcgtcaggaggcacagcagaccacgcatgtcaggaggcagcctacctgatgatggccagactccgggagcgccacaactacatcttccacgacacggcgtaccgcttccaccctcgtcgagcccacggcgacgatgtcagttcgttccgtccgacagctggcgagaacgacaccaccttcggtcacatgtgtgctgtgatgaggggattggataggatgcactcggacctgcacaaggcgaccaaggccttgaatgatgggaagctcatgaggatcgtcgctctgaaggacgagatagcgcgcctgaagagggagaatgctcagttgaagggtcttcccgcgccaggaggagtccggatccgcactacgccccgcaagaggacgactgcacccgtgcgcatccagctcgcgcccaggaacccacctccgcccgcagctcccgcagcacctccagttccgcccgcagttcctgcagctccagctccagctccagctcccgcgtccgctctctccttcgctccagcatcagccgccaggggtccaggcagtggtactggaggttggttgtctgctactcccagtggcagcagctccagtggctcacagtccggcagcggagggacttatctgccaggttccaggagtcgctcagagggacctggtgacgagcaggaggacgccttcgactccaccgaccgcaggagccgttccgagcattaggctcgttttcccattagtttatcgattgtctagtttctgcttgttagtttccgtgtttaggttgcttgtttggggtcagtcgacggtcgatatcatgtgcctatgatatggctgtcccaataaggatttttgcttgctgtttaaagtgttttaattcagatcagaacagttgcagtttaatttctatataataaagcttagttcctgagtatctgtttttctccgtttccccgtctgctctccctccaga

SEQ ID NO: 38557 - DNA, 1501 bp, Oryza sativa
acgcaagtctaaccatcaggggaattcttcccgaggcgcaccacgccctcgctatggtcaacccatgcaatatcaccaattggtcactcaggctaaccgccagccaggctacgcccctcgtccttagatgaaccgtccggcacctcagccacagcagcatgccccaagtggcaacactgcgccaaacagtgttacctctttcaagtcaccgctaggactatcagcagttcagtgtttctggtgcaaccagatgggtcactatgccagacagtgccctcagaatcctaccaacaccaactcagggcatgctaatggtagcactgccagaactcctactctagcggcagctcagtctcgtcctagctctcaggcaagtggacaaggttctcgtgcttccaacaactttggtcgaggccgggtgaaccacattcaagccgagaccgctcaggatgctccagacgttgtgatgggtatgttctctgtcaactccgtacccgcaatagttctgttcgattcaggagctttccattctttcatatcacaagcttttgtgaaaagaaatggttggaaaacccaaaatttacgtgtaccaatgatagtacattcccctggaaggaatataagggcaactcaaatatgcccggaagttaaccttagaattgaggaagttgacttcctagccaaaccgatagtcctagactcgcaaagcttggacatcatcctagggatggattggttggctaagcacaaaggacagatagattgtgccgaaaggtccatcaccttgcaaggacctggaggaaagcaagtccgctttacctctaacacccctaccgcaagtcggtctatcctaacctgtttacaagtcacctccttggagtcggtgcccatagtctgcgattatcccgacgtatttccagaagaattagcgagtatgccaccagaccgagagattgagttcgccatagaactggcaccaggcaccgcaccaattgcaaaaagaccctaccgaatggcagctaatgagttagcagaagtcaaaagacaaatcgaagaattggagagtaaaggttatgtgcgacctagctcatccccttggggagccccagtgctcctggttaagaaaaaagatggctctgagagaatggtaatcgactatagagccctgaatgaagtaactataaagaacaagtacccgttgccacgaattgacgatttgttcgatcaacttaaaggagcaagagttttctctaaaattgacttgagatcaggttaccacaaattaaaaatcagatatgaagatatcccgaagaccgctttctcaacacgttatggtctatatgagttcacagtgatgtccttcggactcaccaatgctccagcgttcttcatgaacttaatgaacaaaatcttcatggaatacctagaccagtttgtcgtggtattcatcgatgacatcctgatatactccaagaatgaggaagaacatgctgaacacctg

SEQ ID NO: 38558 - DNA, 1501 bp, Oryza sativa
tctctcgaatcaacaggagatatcatatgcggataacctcgcattcagggcgattactagaacacacacggtagttcgccgtccccaaaaaacaggtttcaggctttaagctataatgatcgaattcaccgaaagtgattggcacttgaaaatttaccacgtgcaaagccttgttttagcggcctgtaccttgtgcgagaaccaatctgatagggggtgttcatttcgatcccctgaattcgttctcgttttttattttacagaggatcaacaagtgtactcgcagggaggtccccggctctgtgcaggaactgaccagcagatagatagatagattctggatagcataatgcactgcatcctatttgactttgcactcgggaggaatcgatggggccgtagcatatacctccaacctctcacactttgacctcacctcctacgaggatgattccattccctgtcccaaggacgatgttgagccatggccttatcgtcgcctcttcttttcctctcgctggtcgcctcctaccccaggccatttgccacccggaatatccactactccccctgcacgcacctccagcttctttgtttcttaatctccacgattccatcagctttctgcagtgcacgagtcaacagttgtcagaacggctgtgtgtttgcgacgtatacggagtattggatttaaccaaaggatcccggtattagatcgggcggcgtcgctttccagagttagttgcggttttcgactggatttaacccaggatcagtggatcactatcacttgcttaaatcgggcgtgtacttttcagagttgcagtttgcgacggcacaaactgcccgaatgcggcaatgcacacggccgaacttgattggccccgagcgatcgagctggtccagaatgaccgagactgattcaggttatgatgggaaaggaacctctgcgtgcgtgttagtcagcccgttccaaggaagttggctgaactgttcttgcttctcggccgtcactggcgtggcggctcacgcgacgcgacatgcgtttttttgcccatcctccatgccgatcctgtcgtgccgccattggctggttgtacgtacgtcgagagatgcaaagtcgtcgtcaactccatcggtccacaggggtcgagctgatgatgaagcgatcaagccaaggttcactgtaacaggggcccagagaaaaacaccgtaacaggtcaccatgcacgccatcatgtcacggctaaatatgcccgtgccatatcagagcggcgagcgagtagtggagatattatctgaagtggatttgggttcgtcgaaaaagatgcccgccttttttggcgcgagcgagaacaccagccagaacattgatgtgctcctgcagtcctggctcgcgcggttcatccttatctcgatagcctcctcaggattcggccgcggatatcgaccgatctgctccggccgggccgaaattagccacgcaccggaaggccagggc

SEQ ID NO: 38559 - DNA, 1501 bp, Oryza sativa
gccgtcccgcgaggccgctactcgcgccgtcgttcctcccgccgcgtccagctggcgggcggcggcctcccggctcccgccaggcgcgcgcccagccgtggcagcggcgccgctgccttcacgcgccgcgccggcgcccacgcggcgccgcggccgcgcactctccacgactcccttcgcccctcgccgagtcaccagcgtgccccaggcctggccggctagcgcaccctctccggccggcggttccagcacccagccggcagccgcccaggcgccactgcctctccgctccggctctccgcctctctggactccggtgagtaattctaaacctactagctgattttgtcattactttttggccgtattagccatagatgtacataatgacaactatcatttaggcattgaacaatatcaacaaacatgtttagagaaattcttggaacgattagttatacatgaagtagaatcagctattttcctatttctgaaatagaggcgaaagaccgagcaaaccatactactagtgtactaccccttcaatttcatatgacaattttgcatggtttgatggttgttaggagattgagcgtgatatcttctctgatgtaagtgaggaagacataattcactctttcgtgaccatgaagaagcgtaaagcttagtcttgactagtattaagtattgtaatatcctatttacattgttatttaggtaagattcaaacttatttgttactttctacttgtattgaatcatttagagttgcataccgtatcgtttaccacattttatatcgaatcatattgtattgtattgtattcggattttttttggctaggtctaccctgggttcaaatcctaagtccgccactggctgttgcaagctatcgctcgagttggtcagttttggaatagctcccctaacccaaagagctgggcgtgtttacctgatgatggcaaaaggatgcaggagcagaactggtgaacggccgtccgaagcagagtcggtacgagacaagaacggggcgtgtctcttgttacacttggcgaggcgcctgtacctgtgacctcgtctgattcctattgcctgaataaataaataccctagttagctatgcttcgcctttttttttttttgactattaagggtgaccctcccaaacaccccctgatacgggaggagcatttttcaaggtacgggatggtctaatgattagagaactgaagctaaaaaaaatgagctatgatctgcacagaggagactgctgtgagcctgtgaccaacccatcaacgggtcgagactactccaactacttactccctccgtcctataaaaaaactaacatagtaccagatgtgacacatcttagtattacaggccccatcgtttgcctttttccctgataagccaaaacggcttattagggaataaaaattaatttatagataaaacttttatatatgtgttcttggtgacttaaaaccaatgctgaaa

SEQ ID NO: 38560 - DNA, 1501 bp, Oryza sativa
cggttgagcggcggcataataggctagccatgaagacgatgacgtccatcagtagtggtagtggtataaactagccgtagaggcgagggcactagtcagcagcagacgagacgaccggcggtgaaaacaataaggccaatcaaccctggaagaatcatgcagccatgggagtgaagaaaccagttggtagcagatgtagatagcttgcattgaagatcatgacgcctattagtggtggcggcgacgtggccaaccgtgaagacgatagcaccagtaggcatcatacaaggcggcccgtcagtgaagatgtagacgtccaacaatggtgacataataggccagccgtgcaggtggaaacaccaatcggcggcggacgaggcagccggtcggtgaagacgtagacgaccaacattggtggcataataggccagccgtgcaggcggaaacaccagtcggcggcggacgaggcggccggtcggtgaatacgtagacgcccaacgacggcggcatattaggccagccatgtaggcggaaacaccagtcggcggaggacgaggcggccggcggtgaagtcgtggacgcccatcaacggcagcataataggccagccgtgcaggcggagataccagtcggcggtggcgaaggcagccggcggtgaagtcgtagacgcccatcaacggcggcataataggccagccgtgcaggcagagataccaatcagtgacggcgaaggcagccggcggtgaaagcgtagacgcccaacaacggtggtgtgaccatccatccgtataggcgagagcaccattcggcgacggcgaaggcaagccggctgtgaagacatagacgcccaacaacggtgatgtgaccatccaaccgcataggcgaagacaccagtcggcggtgacgacagcgagccggtgataatgttctgactgatccattcctgaagcataggagataagcttaaagccatgaatccctattatgcatatccggatctggatcttgcagaacaaacatataggatgagtagtatctgatgtaaatacggtactcggggaaaattcaagtattttaaaatgtttataaatatgtatttctcctcttatcaattttgatttccccgagtagatgactcattacgtttaaacactctgcccaactagtcatagcccccacgcatcgggagtcggcctaagcacttcccaaacatgcatatgagtgacatgagttcgtcattaatggaacaaagtttcacgaatcagaatttactactcgggtacttttgcaattgttaagagcagaaaataaatttatcttatctctatgcttttgatttattccgaataatacttagcaccttgcattacccagtccatccaacaagcccccgggtgctaggaatcggcccaaaggcaactatccatcagcaaaccaaacggaaagcataggaagatagaactccataactcgataggcacttttgtactcagattatatt

SEQ ID NO: 38561 - DNA, 807 bp, Oryza sativa
cggccagtgtcatgtgatgggaacgctagtaggacactacggagtacggagtaggctggaatcatgcaggcagcagcatttcttgtctctgtcccaagcctgagatgtttttgttctgtctcgaggggtgtgtgtttgttgggtgcctctttctgatgtaccgagcgagtgataagatcacgtgtactccctaaaaaaagtcaaaccctaagttttcgtgttcaacgtttgactgtccgtcttatataattttttttgtaattagtatttttattgatgttagatgataaaacataattaatactttatacgtgacttgtctttttaattttttttataattttttcaaataagacgaacggtcaaatattggacatgaaaatcgattctgacggagcagaatgatcccgtgtagtcctttcttcaagcaacaaactttaccgtagagatgcgtaatcagaatatctgatgatgctttggagacgcgctggcgagagagatttggagcactgttccgatcaatcagacttaactccagctcaatttaatttggaattagcgctgtcaacgtcgtgatcgactcatgacgaattggcgatcacgatatatgaccatataataaacgtgagcattaactgctcatcgtccggacgccaatcgatggccacttcgtacaataatcaacagcggcatactccctccggttccattttaattgacgttttagacattgacacggtctataagatacatctttgatcttatttttctattataatatatatattaaataaatatatatttact

SEQ ID NO: 38562 - DNA, 1501 bp, Oryza sativa
ggtacaacatatcaatgcacaaccaattttcttatattcatagtaatttccagaggttgttatatatgaatgaagttatattatatatgactcttaaaatttcaaatttataatgcaaacagaaaccatcatgatcgatcaggattttagcgtatattggttctagctatatttacataactgattggcatgtggtaaatattaaagccgggaacaaacagatttttaattgatatagctttttccaaaaaatttgaaaataaaagcctcccaaaaattgttttctgattcaaacattgttttacgacgctatcctgaatcctcattgccatactgaaatggtcaatgcaaaataaaatagttgatgcaccctgagaaggaccttgccacatcactgtatatatatgggaacatttatcgccaaaaggttcgttgttagaaatatgttcattgaatgttttttttacaacttatacaaaataggtcaaaatatagtaacaggctgaagaactctttgtgaaactgtttatacgtttttcacaccaattaaatcaagcttcacagaatttctgagaaaatcattcgctctataggtggcacattagctggaaaattctgaggaaaaatgataaatatttaatctttccgctagtgtaatttggttgggattacatggtaatatgaaacattattggatggatattatatactgaagaaaaagacctgaatagaaataataggaaagtaggatatccaccgaccatcaatgccggccttatctatatccaccagatcgacggcatttggtagcttttgttacgaaattattgggtgatctcatccataccttggatgggattggcaaccgagtattagccatggcttagtgatcaattagaacaacttaattgtgcttcataaggggacatgccttttcaggatatgttcacatcccctcctggtctataaatatttgaaatcatccatgtaaaacctagaattgaatacaaagaaactcctcctttgctcaatctctctcgctctctcgtttcttctcaacacgttatcagcactgctcgtgaagaagataaaggaggaaatcaatcaaggagccagcatttgaaggtatgatgcctaccttgggtgtaatgcctaccttgggtgtgattcttgacgccattctcggcctccctggttggcaccagaatcaccgtctacaccaccttctatgctgctcgttgtcgtagcactagggctaccgcatcacccacatcacccacttcgaagcatggatccgggtaggtggccgccgccaccaaccccggcgccgcatggtcgctgacgccacgcggcctctgcctcgccggcctctgcacagctttcccccacctcactggacgtgatgctgtgatagttgggtttgggcaagccactattacactttgataggtatacgagttacaatcgaggatgtcttactgtatcccgattcaacccgtac

SEQ ID NO: 38563 - DNA, 1501 bp, Oryza sativa
atggtgcagaaattttactaggaagcaattggagaatgcactcatactaatctgtgcattgtcccattctcaaaagagaaaaaaaaatcacttgagcagttatttgtactacattgagttgagctacatcaaaactcacttatttcattcctaactcctgttgataaagaaacaaccacgctaaagtataactgagctatgaccttactttacaaatcacatcatttagaatattcaaaaggaataaatatataagtagaaatcactgatcaatctcagggaaaaaaaatcatgagattaacttattcggtagtaccactgagaaatataaattatttagtcgtagcactgaaaaacaggcaaagtctaggtgtcccttccagcaaagtgcatgggttcgtttctgtatattgagaaaaattactactactcgatgagttcctttaataataagctactaacatgcatcaacagtttagcttgccctggcaaggtataataaacatagcaatgacacttcagctttgcccgactcatcacatctggacataacaacattgcaggctcactggagaatactaatgcacacaacaattaacacctaacaaacttaattaatcggacacaggagacaggagtagcaccgtaccttcacgaacaaatcaagcatcatatctgagagggatttgcaggactaatcatcagatctggaaggtatttgcagccataagaggaggggcgagcaggggacgcgttgttggccggtgctgctcacccgtcgtcgctgcgacgaggcactgcggaggcagtcggcgcttgggcaaggaaggggcagcaggcgccagaggagaagggaaacagggtacggtcgccctcacccgagacctgacgcagggacgagccggcgaggagggggcggcgaggagggaaggggtagcgcctggagtgggaggcgccgccggctcatcttgaggccggatttggcaccgccgaagctggggactgccggatctgtagcaccagcggcggcggcggctgcggcggcggatgttggctatgcggcggtggtggcggcggaggatctcggtgacgcacttgtggaggggagacggcaaacttcgtgggctatcgccgaaaaaaaaaagaccagtggcggctggggtagggaagtggggaaaagagaaggggatttagggtttagttgtggcttaattatagagagcagctacaaaacggaatcttgttgtaacgggatagtttaagtggctcctccccgctttcacgtgcactccatcttgatacctggtaccttgggtatcagttggtacctggtacttggaacttttggtaccgactgatacctttggtacctgatacctgatatcggctgcctttggtaccgactgatatctttggtacctaatacctggtaccggctgccggctggtacatgttatctagtaccgtgatacctagtacctgatacctggtagcctggagg

SEQ ID NO: 38564 - DNA, 1501 bp, Oryza sativa
ctcccactgctggcgtcgttctctctttccacctccgctcgaaggcaactctgggccggtgctgctcgaaggcggtgactcttggtgacggagcgaatgagcaagaagacgacgccacacgcagctgcttcgtcgtcggggtcatcgccattgaggacgtcgccctgagcacatcctttaccaaggccaccggatcggaagaggtgacgaggaggaggaaaacatgaatgaagccgccaaatctgagcggtggaggaggccttcttgaccgccgccaaagagctcgattgctcgaccgcggctgcaactcccgctccgcgctgccgccgggtaggtggacaacctgcccccaccgccccacgcctggcaagatccggtggctaccgccgatctcgtggccatgggaggggataagacgtcgtcgctgttgctgcttgaggttgccccgcccgaccgtagctctgctcgacgcttgccggagacgagctcgatgactccgcgtcggggccgttttgcccaacgccgagctcgtcgctcgtggccgtgtgtggggagaggatgtcgtagccggtggaggtagaggaggcaaggagggaggttcggggtggtcgccggtagcaactagaggtggtgctatggccagagtgtgagagaaagttagttgtgggggaagaatatgacaagtgggcccaggggcattttttttttacctttttacactatttatctctcccattgaaccagaaattaatatttttattgtatgcggtgtccattagcaaataacaatattttgagagcgtcttcccccaaaaataacttcttacggtgtatgtactgtagcaaaaatttgccaaaaaaaaataccgaaccacgtgaaataaatttaaacttaaagagtcgcaaaattacatgtaaaaattattcaaaatcagacaaaaataaagtaaaaccatattaaaaaaaagcaaaatctcatattccatagtgttgcaattttagtccgaaaaatgtgtaattttgaagtcactaaaatgtcacagatcttcatgcgtttgaaatatagcaatacccattaaatattataaagttacaattttaaataaataaaacatttttgttaaataaaatcacgtataagtttttaccgaaatcacatcgtgtaggagccgcaatctgatacggaaaccgaacacatcatccgtctcggagagacctcgccaagtcggcaagtcgccacgaaacgcatccaaccatcgcacgccagcttggcgggctcgccaccacgtccgtccgagtcgaacgcacactcgaaaagaaaaataaaaacgaaacgaaacgaaacgagccaagcctccaacaaggcaaaagccgcgacgcgacgcgagcgcgacgagagacagacaccacgcgcacctcctccgatctgctcgctccccatccccaccacctctccgaccgccgctcgccgcgccaccgcgcccaccctccatggcggccg

SEQ ID NO: 38565 - DNA, 477 bp, Oryza sativa
ttgtctcaacgggacccacacttgtgctagaggagagaggggagaggggcgaggcagctgacggggagagaggagcggcggcgccgcccgacgccaactcggggaccgccgctgcttcggggaaggagctcgacggcactgggccacccgctcccccgctcccgcgccaccgacgcgttcgggagaggagaggaggggtggacgacgtggagaggagggcgccaccgtggagctcgtcgcagcccccgcttgcgcgacagcctccgcttgctgccggctgcgccactggagcttgccagccacacgccccccgatccgcgacgacctccgctcgctgccggccatgccagccctcgattcgcggtggccggaagaggaggacgggagggcggctccggccacgccgcgccctcgatctacttgtcggagagggagggggagatgaggttgaggtcggcgagaggggagaggcggtga

SEQ ID NO: 38566 - DNA, 1501 bp, Oryza sativa
caccccctttttccttgaacatgcaaaatcttttgacctgtatcttcttttcaagctactgtaacaaatcatttaaccattctagaaattaacttggactcttttactggaattccacatataatcgtatatcatgggctcatggcacaaggtattatgacttatcagtctgcagaagtaaatgttttctgcacttatcaaagttacaacgcggcccggcgaaaaacaaaaagttacaacgctaatctaaatcgtaatctttcacagagatctaaatattaacccgaccaaacattgtatcaaggggagtaatggtttgtcctatttagaaaacttaggattcaagaaataacttattggtagctagcctataaaaatcttaaaaagttaggtttttcatttcgtagttatagttcatttcctgtattctataactacagcttcttaaaatacaagcgtaaatctaaaccatttgtagaagattctaatcctgagagaaagccacagctgtgaaaaagtatgagaccccccttgattcaaaggaaattcataggaattttagaggatttcattcctacaggaatttttcctatatagccttttaaatcaaaggaatgaatcctataaaatcctataaaattcctatgaaatgcctattcccatgcaaattttagaggacatttttatcatgaggtagaatctcatggaaaaaaaaatcctttgagtcttttatctcttctcaaattctggtgtttttcttgcggcctaataaaacggttattcctacgttttcctgtattttacaatcatctgttttagagctcttttgaaacaaaggagcaacgaaggaaaaacagaagatgtgagttcctatggattcattcactgtagcagcctttgatttgtaggaataggtcataggaaaactgaaggaaatattccttcattgctgattctatgggagaaacacatgaaactttccatccagtctgagctcatttttcacttgctttgcgtaggctcgaggcaatcaagctcctaatctctttcttcactgcaggagaacaagcaattaatggatataatttgtgttagttattagaaatggaaagtgggccaagttcttaagtaaaaatattcttgtgtttttttataccccattcaaacacatattcatatacattttctatgattttatattcctctattttacacgtgaattcttatcatattcctctattttttttctattcatttatttttttcaatcatatgtttgaaaggggtccttaatccttaaacttgtattcatgccaaaattctaattttccctattattctgtttttttattcatgtgattcaattgggccctgaatattgtgtgaacatgttagaactagcaagtttgtttcagtggaatccaccagcccgcatggcccgttctagtacggactgtcacttgtgagttgcgaaggccaaagcccaagaagctcccgatct

SEQ ID NO: 38567 - DNA, 1501 bp, Oryza sativa
agcatttctcttaacctctgcttgatgcaactgtggtgcacttttagttcgttcaacggagcattattattggtcaatagtgaatggatcgatatgcgaaacttgaacggcaatttacatcgtttctggatatgttttctagcttgtacgaagtggtcactggacaaatttacaactatctgcatgtttcattttcatgacatcaaactgatttccgtttccctaaaccatatattcatatcactactcactgattacagattagagaggttaataattgtatattcctattcgcccccagacgacgttactgcatgacagcacgctacaaccattttcttttcgtctgttcggcagtgacgtcaacgaatccacgtggacctgtaaatgaaccattttgattctgaactgttctgagaagaagattagattcaatactgcgatatcccaatgagaacgtcagccatgatagtgaggacttgacgaatgggaatctctgaacacaaagtgcatcgcccaagtctaaactggaatatacaagtcaatagaagatggttggcaatggagaacagaaacttttcctagagctgctgggatatactatacaaaccatgaacatatcagatgccatgaacatgaaagggtatctctattatcatgtaatagggtggtactattgtattcactaattagctcggctagctgctgaagattcggtttgtgtttttgttgataaacatgttataaatgcatgcgctctcaaggcgcggaatagtgaatacacaccttattcttgtaagtatttttaaaagattacacttatcactaaattaaagttataaatatgagcatatatatttagtttaccgaataaactgttttcatcgtcaaaaacctaaccagttaagctacgagtctactcccacttcgtctgcttgtgttttggtagagaaacgggggttcagaaacggtttcgagatgacgaggtccgaagaagcggcgggaatccggaactggacggcggtgatccctccctatcagcggccccacgcccgcgcgcgtgctgtctcgctcgacgcattccaagtcggcgatttccccaatttttccaagtccaccccaccaccgagagcctgcccctctcgctctcgctcgctcgcctcggctcggccccgtgccacccgctgccgataacgtgacccacgccttttcacaaccacccccgcgacgcggatcggacggctcagatgcagcgccacgacgatcgtgcggcgcgatgcgcaccgagtgagagagcaggagacggcagcgcctttaataccgtcgtcaccgatcggcttccgtttttgctcgcacacgctgcgcagcggcaaagtcgcgggaatcttcgtgggctgctccgagcggcgacggcgacggggcggcggtatctcgcgcgggggtcaacacagctagatctccctctctctgcgtgtatagaagggcggttgctggtgggagg

SEQ ID NO: 38568 - DNA, 1501 bp, Oryza sativa
ttcttatagaattttgaaatataagaaggcttccaaattgtcgtttaattgataaacagcatgcagattttaggaactaacaatacatgaagaagaaagcatgaaatacatgaagaagaaagcatgatatgagattctatgattattttcctctattttttctagaatagtccattccatagattttaaaggaattgatagaaatcaaaccctttttttcaaatgtctcattaggattattttacataggatattttttaaaaaaaaattatgtcttttatttgtttcaaatgagatcttagagtgctgaaatgttctcgctagcaccactttatccatgaaccggaaaattttcgacattacaaaaacctagttcttttctatttcagaaaaatacctgtttcaatatctaagtgaattgtaggctgtatttagatggtggaaaagttaggaagttgggagaaagttagtagtttatatgtgtagaaaagtttttaatgtgatatgatatgatggaaagttgggaatttagggaactaaacacggccgtaaactgatggtcatgagtcataactgtattcccccgtgagtgtttgttttatgctaccaaaatactactgatggagttatcaaagcaagattaggatttttattatgtagggagaataatagataaacaagttgatgatgcgtctaatttaagatcaattcatttatgtaccaggcaaaaaaaaaatgttgggtgttcttttcctcataaaccgctgtgtgaattactctgatgcattcaatatgcctatcttacgtatacatcttttatacttatacctggctggaaggattattaatatgtcatttaaggccctatttagtttctaaaaatatcacatcgaatatttagacacatgcaaggagtattaaatatagataaattaaaaaactaattgcacagttaggggagaaatcgcgagacgaatcttttgagcataattagttcatgattagccataagtgctataataaccaacatgtactaatgatggattaattaggcttaaaagattcgtctcgtagtttccaagcgagttatggaattagtttttccatttgtatccaaaaacatcttccgacatccggtcaaacgttcgatgtgacatccaaaaattttcttttcgcgaactaaacagaccctaagactatccatatagtttgtatatctttttgcgagtttgttgtgaaatgatgtaatccagatcaactggtgtctcagtgtgaagaacccatagatcctaatgggtgcgaagacagacaaaggcaaggtttcagaataaccatccaaggttctaatcaagagaaaaccaaaaacatccaaggttaattgatactacaagattcctctctctctctctctctctatttgtttcccaacatgacaacaagtttctgatttgatctgtgtctttcgttaggttcgacgatcacaaggcagagggtttgggta

SEQ ID NO: 38569 - DNA, 1501 bp, Oryza sativa
tatggagaaatcggtgtcctccttctcctgtattctttttattaattcttttatcccttcatcatctttctgagcttcccggatttgcgattctagggtaggctgcactgtcaagctggcagggacacctgactgtaccacggttagccttaacttctccaattctctgcacaggcgaccgtggtctggccatatttgagcttcattgcaataggtcttgcgacttagcgcatccgcgaccgcattagctttaccgggatggtaatgaattccaagatcgtaatccttgattagttccaaccatcttctctgcctcatatataactcggtctgtgtgaacatatacttaagacttttgtgatcggtgttgtcggtgacatggggccgggggtattgtgactagaggcttgggaagccgcggtcacccacgtggcctgaccccctcgggggggtcgggcccgaggatgacgtggccacccctccctctgtctccccgaggggtcggaccgctcccgtttcggccccgagggccggggcgcccccgtttcggccccgagtgctggggcgccccgaccccctgtggttttggcgccacgcgtgtgggttaggtgagcacagcggggctcacctaaccgcatttatagcaggattggacgagcgcgccacgccgcatttaatgcggcgcagcgcacgcttatccggtccgcgactggtcacggtgtgtgaccggtcacagaccggtcagatcgcgggttaggtggcaacaggcggcctgtcacacgcctcgccccgtcccgtcggaatgatgagagcttcctggctctcgtcactagccggagccggcgtgctaactcctggagttggtatgtcagtcccggtcagatccattccaggcttcagcgcaagtatggcaaggaagtcgctggccattaaatgaaggttgaaatgggcgtccaccggaaaagcgggcgagcggggcaggagacgtgcgctctgcttgtcagaggtcacttccggctgtagactagccctcattgtaaaaagcatgtttcccttcttaggcagctagaggcccatgtggtgacccctgaccagataaaaaggaggcccaggcctagaaaaaaagagggagaagagaggaggggaggggggactctggcgaatggtttctagagcctgaactctctttcgctctcggcctctctgtattccttcatgcacagatccactagaacacaggagtagggtgttacgcttcttagcggcccgaacctgtctacgtcgcccgtgtcttgcgcatttcctctctcgctgacgttcctcagatcgagggcaaagaaactcacttagcgcccccggccgaaccggcaaaggggggcctgcgcggtctcccggtgaggagccccacgctccatcatctggcgcgccagtagggggcgcgcgggtctttctaagccctcgtcctctttcgtgtgcgccaagcttcgcccgctcagcccaa

SEQ ID NO: 38570 - DNA, 1501 bp, Oryza sativa
ataatagggttccatttgcataaacagcctttaataaacatttcagaatttaataaaacagttaagtaataattaaacaatattaatccaacgctatacaacataccctgttatataggcccaaccattctgaacaaccatcccggctgcacagtcctatctccaaaccaggaatataccattccaaaccaggagctaatcaaattattaccaattatagcatcttttattatgatgagatgtgtgagactaatcacgaaagacattgttagacccgcccataaccgcgggcacggctattcgaatagttttactctgaacagaggtgtaccactgtacccacaagacacaaccccacatcatgtcaccatgtgcctcaataccaccacggtacctcggaaaggagttgtgacaataccccttgcacaacacaatccattacagcgcacctttcctggatcataatcacccccttataaacaagacatggactccccagcgacccccgtgggcttatctccgccacttctcagtctggtgccccgcaatgaaccatgctatacaaaagataaagccgttgcccatgctggcttgtggttggcacggttaatgtttcacaaccgaaactcgtgaaccggtccttaattgtcatgagcacgaccatcaaaaccatgtgctcacaacccaccattatcaggttttagttggcacattaattaattaaccaatcacgattgaccatcgtgacctatcattaagccatcattaaataatagtaaatcttaagttatcccaatagtgtgctaatgtttctaagcagggctaagcaattatatctaatatctagctgaaccaatatataaagctcaactagtcaagttataataacccaagatatcaaggaataaagtaatcaagaacaaaagggctttagcaaacaataggttaattccacccaatgacattcgaaaataaatgcaatagttgaatagaaatgatagctttaaacgggatcaacatgctcaaagggttgtttgggatctgtgtgacttgccttgctggccttggaactcttcaaactcttctcctgcgaaaacggactctccggaaacgacggaatctaagcagaaaagagcaaaatcaccaaaacagcacaaaaacaagcatgaacagtacatgtggatatttttaacatgtagatctcaattttagaaaaatttagagacttgaaccaactaaatccgagctaagatgaattagttatgaatttttgaagattaaatcggattaaaacacttatatggattttaattgaattatgacgcaataatgaattatttttgaaaaggaaaaagggatttattgcgtcagcagctagggtttcgcggtggaccgggcgcacggcgacggttcacgcgaacggacggccgagatcgacttgatccaaaacggacggccgagatcgaacggtccacgaccggctcacgggagagggcgacga

SEQ ID NO: 38571 - DNA, 594 bp, Oryza sativa
ccgtgcccgcggttatgggcggtcaaccagattcaccgtgattagtctcaccttagtttagtctaatgaatttggatagtttaggtggatggttgggcctgttgcaacgaggtgtggcgttggacagtggatgaataatactgcttaattttacaactgttttcgcattcaacccttgtttataaatgccagtatttatgcaaatgaacctgtttagctgttccttgttgaatctctgcatcatacccccattccggtatgacttgctgagtacagtgggtagtactcagtcttgctctatttctccccaatcccagagtttgagtttgtgtcagatggcgggttctccgaggagtaggcttcgtccgtgccgtcgaggatgcctgtggaatggtgttcccgctgcagtcaagtctaggcttagcctcagttatcttttgttttccgctgcatttatgtaagacttttataatgtttgtaagacgtggatctgtatgtcaacattgtcgtttgtgtaccccggccggtcctggacgggggttttaatgcacattctgcttggaatcctattcgggaatttctgggcgtgacaga

SEQ ID NO: 38572 - DNA, 1501 bp, Oryza sativa
aaccaataggaagtatatgagctatgaacactaataagtaaacaaaataattcctttatttcaactatagtcttacaagaagagtgaagtactaaagacatacccgaatctccaagaaaatcaggtgaagcatataaataaagtatgaactatttataaaacacataaccagtaagaagtatatgaactatgaacactaataagtaaacaaaataattcctttatttcaactattgtcttacagaagagtaaagtactaaacacatacccgaatctccgagaggactagagtaccgaagactactctaaggctaactccactattactcgagagaatacaatatatggaatgagagaatggctctttgatgtgtgtattgtgaagtgagaaactctcatcattaaatagtcctgtaatgatggttgtatggtggttggaaggtggagatgtggggagctgatggcggttcagccgaacaaggggtccggccaacccctgggcgccacctttctccactgcctttcaccaaaggctgctaggtgcgtctctgtagcgattgaggatggtttggctccactttagatcagtttcatatgacttgtgggcccatcgatctgtgtactcgcacatgattcgccagaggtgtgtttatttccatgttggctcttttctccttcactttagtgtataatctttgcatacatagtaattcgccaggacaaatgaaactacattatttataactaatatacgtggatgaagtgttagttctccttttatttattgaagtagttgatggtcgaaatcggtacttaatgaccgtcaacaatacccccaaactaaacctttgctcgtactcgagtaaagataaactaggttgttgatcaggagtttctaccttgttttatgtcacaatgttgccatgagtagaatatgtctttctatatataatttgaataagttgataatagtacttttacctctcttaccttatttcccatggggcttttaccttctccttgtcttactctttattcaactttctttccggagggtttcacgaattatgcaaataaaacccaaagtttctcaaatgattctcgcatatcgttcaatgcgtataattccttaccaaggcatagtattgccttcttttttttattctatctctaaaatgtttatacgtggagctcaaggtgggagaaaataacgagacaatacttgtattacatatattgcaaaatcaaaaataggatctaatgagaaaacaaattatacaatcttattgaaagtgcatctaggacccctcatttattttggtgttaatgacaacacaattagagggtaactaatgctttttgttgagatgtatgcaaggatgaaaaaggagtggatgtcaacacaataagtattgcggcatcttttatggtaattgtcttctaatccatgtatatcttgtgttcttgagtattaggatgccgtactattaagagggatgtc

SEQ ID NO: 38573 - DNA, 1501 bp, Oryza sativa
acattagtttattggctgacatttttattttctatggcatataagccatggcatatggtccgagtaacccaagtaaactggacactagtacggctccattcatttgtgtgttaaggctgtgttcttcccctgagatttcccaactcacctcttccctttttcacgcgcacacttttcaaactgctaaacggtgtatttttttaaaaaaatttaaatcaaagttatttaaaaaattatattaatctttttaaaaaaaatagttaatacataattaatcatgtaataatacgtatttcgttttacgtgccggtgaggaggggtccgaacgcagcctaaggggtgaacaactccctcatatattagcatgtttactaacatgctatacgttctttttatttaagaaaaaccttctatatctatgtttttaacaaacaaataaattcattttaagtttacaataattaatactcagtcagctgtcgtaccctaacaactcgcttcgttacttatgccgtcaaaaaactcatgccaattgttcattctaacctagctttaacagcatattttcttagaaacaaaatacaacaaatgtaggcgctaacgtgtgcacacataaccttataataacctttaaaaaactggcccaacatatattgagattgacgaagttaccacgggtacctcgctgtggataggtacgtcatataccactggcagaataattagttacaaatgcgagcacccatgtcaaatctaggtacccgtgtgggctagttccgccacaagaaacctaaccagttgaactacgttcactttgcttacccttaacaactttgtctttcttagaatatactcaatataaagataaaagttcgtaacaaatccaataatgttattttgtcttcctaaaatttttcaaatggaggaagaaatttttaaagtaagttagcttcgtattacttccatcgtaatactccatccgtcccatagtataagagattttggatagatgtgacacatcctagtacaatgaatcaacacatccacctaagatcccttgtactatgtggcggagggaataaatacctcaagcccctaaaggcaaaaatgatagctggcctatgacaagaaatggctctaactcgaacatttttagcaatagcccctattctaaagcacttaatgacttgatgggatcgctcccatcttttgggtataaaaattaacttagaacttcagcaacaacccaacaacccctatttctttggtcccatttctatttctgttctattttaatatacacactatatatttatgcctagtttaacactagaataattcaaacacgtagaattattcaaccatatctacagtctcatcttttcacttatacttatacttatcagccaaaatttaaattttcaaccttaaatttagagttgatcttggggttttttttcatcgaaatttatttttcagcctttgcttttagaactttaag

SEQ ID NO: 38574 - DNA, 1501 bp, Oryza sativa
caatatgctcgaggggaatttgtgacttgccttgcttctttgaaagaatcttccgaacacttttcctcgcgatcgcgaacttccgaaacggcggaatctacgcgctggcacgcaaaacaaggaaaaactctaataaaaaccaagtaagcagtacatgaaaagtaaacaaacatgtagagctcgattttagatgaattttgctagttgaatggcccaatttggagttcgaatgaattagttatgaattttttgagccattaaatgaattcctataattattaacactatttatgacgtcaccgagaggataggtggcaccggcaagcgggccctacctatcggtggctcaaaggaggcgggtgcacggtggaccgagtccacgcgcgcaccggcccgcggctagacagctccggcgagcggcggcggctcggcttggcgaggggagagtgggagagggcgcggggagctcgggaaaaattggggaaatgtgagaggagagcacggggatcgtttttatgggctcgggggagggaatccgtggtcgattggggtggcaaccggcggggaaggggcggcatcatgggggaggagagaggcgacggcacacggcgccgattcgtgcggggatagaggggaagtgggggcggttgcaggcacgaggtggaagggatgggcggcgacgtggcctgcacgagggaggcgtgaggaagccggatggggcggcgacgtggggaagaacggtggccatagcggttggacttggggagccggaggaagggaatgacaggtagggcccacggacccacctgtcagccagggagagagaaggccgagtgagggaggaaaggagtgggccgagtgggctgaaggaggggaaggggaggccggcctggccgggaaggaggagggagggagctgggccgagcctaaaaggaagaagagggaaggattaattcgttttctttttattttaattgagttaatgaactttgtattattataattacttcttgagctccaaaaattcatgggaaaatttcagagaataattagggcacaaagaatattacaaaatattcacggccaatgatttttaaaggaaaatttttaattctcccattatttcacttgattaaattgctttaacttttatttaatttctagaaaatgctttatttaatgatttttagtcccgaacaaaaatcggggcgttacaaggcgtccgcgtctcacttcgcacggataaggatagcgtggagcggataaagctaaggccggctcagctatcctggtttggctcagttttgtatgggtgtcggttttttaattaaccagcatctataatatataatatattataggtgtgtcggatctttctaaaaatcggtaccggtttttcctaataaaccgacacctatcattcttaaaggtaccggttgtatattttttcaacgtgcgaaggtaggaaaaggctcataggtgtcggttttaaatgaaccat

SEQ ID NO: 38575 - DNA, 1501 bp, Oryza sativa
actacaatcttatgtttccattctatgatatatatacatagtgcagatttatcagattgttcttcttttctttagatgtaaatacatgatgcttctgatttcaagaatgtgtcagactttcttcttttaaggaaaactgaagatgtgcacatttgaaaagcctgtaatattgttgatgtgttcctttttctacaatcgcatgtatttaatagttcgctggacaatctatttaggtggttacctttggtaattgtttcctctctttttatagcagggaagaagaatccttaccctaaggtgatttcacatcaagaacatgtaattagattgatggccactgtcatcaagaacaagaacaaggtgagaagatatccaaaaagtcaagaatttctgatattctgatgtgtcctaatcaggtacatgcacatggctctctcatgcttttgggttacttgataaaatgcttaacaattcgactttttatcattttcggttgaatcatgtgctcatagcaatggactaaaataattgagttttttttggttttagagtcaggccctttctcttccgtcaaatttataaggtattcttgaattttttcgatgaccttttggagaataatcaacttttggaagagaagaccaaaacgatatataagttctggggttactgatatatgtttttaatcattttcatctctattgtgttggtgttgtttatttgtagcttcactaaaaatatagtgtggcttctccggctatgtactccaggattttaagcatatcagttccttcactaaaattatattccaggtttgtgtatattttagatctatgtatatgttcttttagattgttcaggtactgctaaaaacttctgctaaaaatgtgttacaggtaccccaaatctcaccccttattatggcactgaatatcttgaactgaaattttgatgttacagtcattaagtataagatctcatctactataaagatttgtagtggccgcgtttaatgaaatcatgaggtaagtacatattcatgttttttagaaaactagagcttcacatagacacatacctaatttgctgtcattggtaagcatgttgttgttagaggattttactatgctctgataactctgaatgacataatcataagaatttccacttttttctgatcaaagtttcatatttgtgacgtacatgattccagtcatctgaaatctatatattattttccgagaaactgggcacaagagatatgccccatcacatctaaaggaggtagtcttgtcgagggaagatcctcgaaagcggggaatcgtgagacccccctcttgtgagttcagaagacagaggcttgcttcttgaaaaccactcgctcgtccctaagattactggcaagcttgcacgccgtcggattatacaggttcgggccgctatgaagcgtaataccctactcctgtgtttaggattatggtagagttttacagaggtttct

SEQ ID NO: 38576 - DNA, 744 bp, Oryza sativa
gttatactttactatatttcgggcaatattaacatatatttgtttgctcttttattgttttcttagtggtatatgaactataaaatgcctagcactcatccttgctccttccattacaaaataaactaattaacctagtactaaatatgatacattgtttaggatacgtcacatttcgtactaggttgtttattttaggacagatgttatagttgatatagaggtggaaggtagtcactccacttcgcttatctaaaagctaccacattcatattcgcgataaatatggactaatcccatctttttttataataataataataataataataataataataataataataataataataataataataataataataataataataataataataataataataataataagtgcaagaacaattttgcgagcattggtttctgctacaaacatttttaaagatattttcgctagtttttttctgttcaattattagaaattttagctgccacacaaggccactatttcatcgtagggtgcctagatgcgaaaaggctcaatccaacagcagcatcggcaattctttccccctgccacctttttcttgttccaccacggctatcatacagaataaaaaaaaacagaatacacctttctgtaaagaaaaaacacaaggaaatgtgatacatatgtatatgcatatctatttgtctcttttttttctctctactttgtaaccttca

SEQ ID NO: 38577 - DNA, 1501 bp, Oryza sativa
ggtccttctaaagagtttttgaaattttattatcttttaacctttctaatataaattaaaaaatgaaccttcaatgaacttatatttaaaaaatgaaccttggggccacaaatgttgctaacactggtgtggcaaggtctttcccatgttgtgaggatttcttcgcataccaatgatttcatttttaaataatataagaaatttttgataaaatagaataatctttgaactaaagtaaatatcattagcagtaatacagattaaaaatcctcatcatgacgcgggttgaatttgtatcaacgatatgtaatcgtgaatcagaacgtaactccattcacaacaacctttggaaatatctatatataaattattcataaaattggatgtgcattgatgggttgttaccttaacagtagcaaatgtcaggttgtttccatatgctacggtgaatctgcaaattaattgaagttttagaaaagttattcctgaaagcagtttgtatactgaaaacttattagacaaccattttgattatgtaagccaaacaacagaactaatcaaacataattaaaactcaccctgcggactggccatccacatgccaagctctccagtcatctacaatgggatagttgagtgacctcacccaggtttgtgtaccaagaaatggcaaaacggtatcatggtcaccgctgcgcaccgaaatgttatttttttattaatgcagaaatatgataaagaaacagtttagaacactggagtgcattatgcccttttgccaaccggtctctctagtcatggtagaggacatgcatagctggctagctagctgcaatggtcatgcagataatttattagatagatatgtgcaaaatcattaatacactaagcatacagatctcaaagtgttccacgtaaagacataatggcagaatttatactactctggtctagtgaacatatcgattttgacattaacagtaccaaaatgcaactttgaccactgctttattttattgatccctactgttttattaagagaggcaaattatgctaattcaatggacacaagcttggttatttgaagacaatgatgagttcactactaatctgcagttttgaaaaaaattcaaaccacagtgtgtttgtattgtagtataattcctaagtggatggttcgaacttctcacaaaagagtgttctgaatagatcccgtaatatctataaaaaaaatcatgattcaaagcataatcgccgaatcatctctagttatattcctatactaatataaaaaggaggagttcatctgtagcaatcctacaggccaaatcacagattaattctctactatccatccgcatccgcacataccgactcccgcagcatcaaaacagcggcagaaaccacgccaccccctccgcctccgccctcctaatgatgaccccttgatcccgcttccatccttgcgaccccacttcctccccggcttcacctcccgagc

SEQ ID NO: 38578 - DNA, 320 bp, Oryza sativa
gttatactttactatatttcgggcaatattaacatatatttgtttgctcttttattgttttcttagtggtatatgaactataaaatgcctagcactcatccttgctccttccattacaaaataaactaattaacctagtactaaatatgatacattgtttaggatacgtcacatttcgtactaggttgtttattttaggacagatgttatagttgatatagaggtggaaggtagtcactccacttcgcttatctaaaagctaccacattcatattcgcgataaatatggactaatcccatctttttttataataataata

SEQ ID NO: 38579 - DNA, 292 bp, Oryza sativa
caatgcactcgtgaacactgaaacacacacacacacacacacacacacacacacacacacacacacacacacacacacatatatatatatatatataggacactcatatggagcaccaaacaaatttactatatatatatatatatatatatatatatatatatatatatatatatatatatgtatatgtatacatatatatatgaaggttacaaagtagagagaaaaaaaagagacaaatagatatgcatatacatatgtatcacatttccttgtgttttttctttacaga

SEQ ID NO: 38580 - DNA, 1501 bp, Oryza sativa
aaagatcattacaaaatttcgtcattgacatcgtactacatttcatcaaagttaccgaagaaaaataatgttatgtgggtataaagacaaggcaaccaaaataataaacggatgaattcttataattgaaaataagaccttgttttgcccaagtcattgaagatggtaattgatggctttgctgcgttctttcgcctcccttccaagatcaagtcctaagcaaccatcataaatttggaaatttggatggcacatgaattaaaatctgggtaagcaatttgaaaggatttaaaaaaaatggtgattatggcccgagtcctagtaaaatgtaaccaagagatccttctgcccgatacaccgtagaatatatctttcaacactaaacgcatatcagagtgacaattacaaaaaaaaaaaatgtagtagcagaccactgaaacttgaaactcatctgactcacccaaccaccacaatagaataacaaacttctttaagaaaactgcatcgtggaataacataatgatgaggccctgtgcgttccctaagctttactccctccgtcccaaaataactcaattcctgcgtttccgtgtccaacgtttcaccgtctgtctcatataaaatttttttatgattactattttcattgttgttagataataaaacatgaataatactttatgcgtgacttatcattttaaattttttcataattttttttaaataagacggacagtcaaacgttggacacagaaactcaggaattgagttattttgggacggagggagtaggtgacaccaaaactggagagtgctgcttttttagttcttcaccaaataaaagtcttgcgtatgcaaaatcataatatgaacataccaagcaatagacttagaaatctataaaatttagttctaatttgaaatattttaaaaggttccttaaacaatcaaaacatgtgacatctagattagttaaatatgtaccaaccgtacttgttcacctaatccaaaagtttcatgcctgagatgttatgttacgtgtctatccaaaaggattatattataactctactcagtgcagaataaatcaaaaagcagagatacctcaggattatattattataactctatttcgttttacattataagtcgtttgattttttttaagtttaactaaatttatagtaaaatttaccaatatctaaaataaaatctaacattgaatatatattgataatatgtttgttttatgttcaaaatactaatatatttttatataaacttgatcaaattcagctagaaaaaaaagttaaacaacttataatgaaatggagggagtagaaattaaacacggagcgggcccataaaaagcagaggaccgacgaggagcttcttgtgcggtagcgcacctgcagagtgcagacagagacaaaggcgacgtctatcatgtccctgcgactgcgtctcgccttccgtctcctcttctgctactgcctcctcc

SEQ ID NO: 38581 - DNA, 1501 bp, Oryza sativa
cattcaggacaaaaatagaaatagtccaggatcgcccaactcccccaaaactagtgtactttttaatcactatcttggaggggacttcttctaccatggagaagatgactttagccagaactctgcctctgaacctcgggtcgttagaccatctaagcaatcgaccaaatgtgcctactgccttgtctataatgcggtcagtttgaagatccaaaggaaaatccagaaacatcacccaactttgactaattggaggagaattacgacaagtagaagtgttgtcatggtaggagaaccttagtacaaactgataattgaccaaataggcccccctaagaactagggcatctcttaaaacaacagaagctaagtgaacataagcaaactccgaagcatgcctactagtatccaaaacatggaatccaagagtattctgaacataatctactatcatctggatgaactgggcatagagttcaagcagcgaagggggcaagaagcatcttcatgcctcttcgggggatcatctgtgataatcaaatccgcacgagggaggcgatgcatccaagcatcattgatggctattgcaggggcacgaacagggttgggtctggattaacattcgccattggagaatcttaggcactgtagattggactgggagcaagaagcaaggaagaagaagcggtggacggaaactgcctagaatcgaggcaagtaatcggacaagagctgattaaaatatttttatttacggccacatgagataacttcggagccactgagacaatctccaaaaaactgggctgcgaactgggttgggccttgtggacccaagattggctcttattctttttattccaacagaccaaagcctggtgatccagtttgtagcaagaggcacaacgcactctactaatacattcagactccaagtggcccaattttaaacacttgggacaaggaggcccagtggggtttgctttctttttagaggaaggcggattcaacacttttgaatttgaattatcaacagagtcagcaaaaaccacgcccttacctttagacttatccgaagaaccagcatcaatcactcccttgaaattagactttgaaattgaaatacttgatgatcctgcattaaccccgcctgcatgaatcacgccgtcgacagcagaatgattgagacccttaccaccgacggtgatcgccggaaaagaagaagaaagccaatcaaaaacaaacttaaccggaataagagaattgcccattcgaacactagagtgagctctaagaaaatccttcggtcatgcggggaccagcacctactacacctacaatgggtggcaatatttcatcttattttttttatgatttttctactttgattttactttgattatcttttcaaacatcgctcagagctcacgaaactttactttgatttgatttgaaaaaaaaaatttgctactagaatgctgctgagtacacagattcctga

SEQ ID NO: 38582 - DNA, 1501 bp, Oryza sativa
gtacggaaaaatcgttattctactgccatttactgtatcagggtaataccatcactcattttaaccaatttttttcgtagtaataagaaacataagaaaaacaaattgtcactctcacatatcacatgacggaatgtgtagagtcatgcaaatatgcgaatcatgggctagttaaaatatgacacagaaatttgaccctattgaaagatcttcatatattatttttccgggactatggttttataatcttgtgcacttcaccacagagacgtgcgtgttattgattcctccgtggggccagaccgacagtgcgtggtaaaaatactgttagaaccatgattattttcttcccagtaacccttccaattacacgcaacctgacaccaacctaaaaacggcgaacatatgttttattttgatctgatcatatcgttgtatatcgttgttattaaaatttttaataaaaattatataattatattttgataaaagaaaaatatatgtttcaaaccgttaagtttcatactcccttcatcccataatataaaagattttagagggatatgacacatattaagacaatgaatctggacaggagctcccataatataagagattttggaggaatataagagattttggggggatgtgacacaaaatccttccaaaatcacttatattatgggacggagggagtacgtgatatcgacatatttcaatgtgtatcttcactgtgtttcataatttttttaaatgtttcagttgctatttttttcgtttcactatatataagttaattttcatttgttggtcaactgcaatatttgatagtccgactcctttttttttttttttttttagaaatcaggcacccaaggtgtagtttctctctgtctttctccatagttgtactttcgaaatctaggatttgaaattttgtatatcaagccactagtctagtaggctattgatgagtcagagctatttcctccatcgtataagattttatttagatttatagtattaaaatatgttatcttttatcaggtttaattttttattgacatacttcctatatcctaaaaaaaagacaaaccctgatttccgtgtccaacatttaaccgtccgtcttatttaaaaaaattatgaaaaaaattaaaaagataagtcacgcataaaatattaattatattttatcatttaacaataatgaaaatactaattataaaaaaattttatataagagggagtactgctatagcctatagcgctgtgccatgccgtgcagcagctacatgcctcctgtctctgtgcgtcatgccgtcatcggtgagatttgaacacatacataatatattgtgtgctccgcgaggaaaacgcggggtgaccagatagccgggccaccacgtctgaaagcccatgtgccgagggcagttgcaacctcgctagctgctaccgcttgccagttgccgttctcccgtgcgaggacaaggcagtacag

SEQ ID NO: 38583 - DNA, 1501 bp, Oryza sativa
ctggcccaatcttcgaagatgctcataagggtgagtgtgcgtgcgttgtgagtgtctgcattgtactgtgtaattctaaaaaaaaatttacatatatgcatctattaataccacaacaaaacacgaggtatcatccaataggaacgatgaaatgaaccaggttcagtgattggaaaaaaagtacttaaaaacctatgtattaatcattgttttgaagtgtagaaactgcataaatcaactactcctttcatgactctgtccctccgtcccaaaagttgttatattttagaatggagagagtaataaactgatcatagctaaacattagattggttagtcatatcaaactggctatggaagacattgtgggcaactttttgtgacaagtcgacaagcacgattgcagcacctaaacaccttgcggtgatatggagtcaccaacctcctcgatctagccaaatggccaaatcaagatgggttatgtagaaaaacaactaaaccggctaacggagccgatttagagatcaaaatcagcctctaagccggtttagatcgatatgaggataattacatgtttcgtgggcaaaacgaaaggttttcaggacaaacctacaaagatgtgtcacactctcgcagcggcggcggacaatttacggcacaaatcgacaaagatggactaaaactagggtaaaatagaaaacatagctaaaaagtaaagataaaagaaaaagcgattcaagtatattgtgtgtatgggagattacaattgaaccggccttgtcccttaaataggggttggtcttgccctctacaggctctcctccatgtccaacttggtatagaaaccaaaggaaatccaaaatatgccttcccaagcaagaaaacccgagacccgacgaaaacatactcagactcggaatctgacggtctgaccggacccatacctgcggtcagactggagttcaagccacggtcagaccgcccacatacctacggtctgaccggccccgtgaaggaaacccgacactttccaaactttggcaattttcccctatttcgtgcataggtgccaaatttcggtgtaaacagacatattgttgttcaactgtagctactactacaccacggttcgaaggcccaaatacgtccccccctaccaaaccataagacaaccggtagaaagaccatggaaggactagcatgttgcactgaggcaaaatatgttacaggatatccagaaaatttgtaattggctagagaacaccgcaaaaacgtgtatcaactatagagcaccgcaaataactggtaattagctgcttgttggcgctgttaatgacaaattttatgccaccaatacctgcataaatcaaagaaatagaacatccaatatagtgatagcgttaaattctaacatattccacaaagtgttagtgtatatttatatgcaggtaataaaccgccaaagatggatgaaatatagacttaagtgaaggagaattcc

SEQ ID NO: 38584 - DNA, 592 bp, Oryza sativa
gccagcaaggcaagtcacacagatcctaaacaaccctttgagcatgttgatcctatttaaagctatgtttctattcaactattgcatctattttcgaatgtcattgggtggaattgacctattctttgttatggcccttttgtacattgattaccttattccttgataccttgggttattacaatttgactagttgagctttatttatattggttcaactagatattaggtataattgcttagccctgcttagaaacattagtacacttatgggataactaatgactcactattatttcatgatggcttattgatagttcacgatggtcaatcgtgattagttaattaattaatgtgccaactaaaacctggtaatggtgggttgtgagcacatggttttgatggtcgtgctcatgacaattaaggaccggttcacgagtttcggttgtgaaacatttatcgtgccaaccacaagccagcatgggcaacggctttatcttttgtatagcatggttcattgcggggcaccagactgagaagtggcggagataagcccacgggggtcgctggggagtccatgccttgtttataa

SEQ ID NO: 38585 - DNA, 449 bp, Oryza sativa
gacttgcctgctggcctggaactcttcaaactcttcttccgcgaaaacggactctccggaaacgacggaatctaagcaaaaagaagcaaaatcaccaaaacagcacataaacaagcatgaacagtacatgtggatatttttaatgtgtagatctcaattttagaaaaatttagagacttgaaccaactaaatcggagctaagatgaattagttatgaatttttaaagattaaatcggattaaaacacttaaatcggtttaaattgaattatgacgcaataatgaattatttttgaaaaggaaaaggggattattgcgtcagcaactagggtttgggtggaccggcgcacgggcggcggttcacacgaacggacggccgagattgatccgatccaaatcggacggccgagattgatcgggtccacggcggctcacgggagaggatcctga

SEQ ID NO: 38586 - DNA, 162 bp, Oryza sativa
catcgatctgtctaaagagtgattagatcgagatgaccatcaccattgagcagcctcaccttggtgagctcatgatccttttctctctctctcttgatttcttgattccagtccgtgaggaagaaaaggttcagcaatgttcctggatggatggatggatcg

SEQ ID NO: 38587 - DNA, 261 bp, Oryza sativa
tgataggggcgatttagtgtcccgcacgaccgcagagcaaggctgcatgcggggttgacgggcaaaagttctgcctctggtcccggacgggagtctcaagtccctgacaggcgtccctgcgatggagaggtcaaccgcgcgcggccgaggttgacgactgcaagtgcgatgagaccgtggtgacacacacgcagttcgcagcggtttgagcccgggtctggcgtcattgcaatgccactgttccttcactccggtgacagc

SEQ ID NO: 38588 - DNA, 730 bp, Oryza sativa
aaacctaattacaataatccgcaaatctccatataacagcattaaacttcggatgatcatatcttggtcatacgagctctgaatcgacccgttcaagtctcctaatgtttgtataacctaaagaaccctgtgctttcttcttatgtattgttattgcttctttttaggcttgtagctttgcttgtgtgcttcgcgtagtcttcgtcgttccggaggttcccgaagcgtggttcgcggccgtcgccgaaggttcggaaggccgttctctctgagcaaggcaagtcacatcatcctttagcatattgaatcccagtttataaaattattttgatttaaattaatgcattatcgtttaattcccgcgttatcactgttttatctagccatgcctatttacctttgttatgaccttatcattgttgttattgttactattaccttgttcaccctagaataaacaaaaccccaactagtgggtactctattcctggttccactagtatgaatttaggtagatgcttcgctgattaataggacaacattaggtggtttttataactttagactttgggaattctcatatcatttggacactatggaatggttggcttatggtggaattggacatacccctctcttcctctttcaaagcccctaaaacctgtttttcggtggggtttgggtgcatgccagttgtgggaagtagcaccccggccactataaggattaa

SEQ ID NO: 38589 - DNA, 1031 bp, Oryza sativa
tgagtggggcccaaattggaggtagattaggatgagtggattacttatttttttctacgtctaatctaatggtcgaaaaggatgcacccatcaatttaaatgaaaatcaagggttagatgttttttgccacgtggcagcttagtagcgtttgtagagtgtcatgtgacgacataggagcgtttgtaggaagttaatgaacttttagtatatcctccctctgtttctaaatatttgacgccgttgacttttttaaatatatttagatgttcgtcttattaaaaaaatttaagtaattattaactctttttatatcatttgattcattattaaatatacttatatgtatacacatagttttacatatttcacaaaagttttttttaataagacgaacggtcaaacatgtgctaaaaagtcaacggtgtcaaatatttagaaatggagggagtaatagatatttttaatataaataaatctttatttaaaaaattactccacaaatttatttttcctcttttttgaacgagctgaccatcaggagacgcttgtgggccatcttttccatgctccattttcatcgttttctattgtccgagtatgcacttgcaacctgcaagcaattttttgtctgtttcggtgggtgcctccgtggaggccaaataatccacgattttaagacttgttcataaatactccgtatctagtgccaaaaatagctggggctggtgatttgcacatgtatacatctggacaggggaccttgttagggaaggttggtgccgtacgcagacaccgtcattatcacgattaggatcgagattttcaacgtcctctcctaattactatagtgcacatggatgctaaggcatgcaattgatgtgacgtgatagtgtaattatacaatcattgagacctgcaacgcgcacattgaatacaaatatatgaacgcaaaatggatatctaaaaagaaaaagcctaccgaaagcaagtatccaaaatggcatccattttgattcgattcgaagtcagt

SEQ ID NO: 38590 - DNA, 385 bp, Oryza sativa
caagaacacttgaacatgaacatcaagaatattcttcccagccactgggaaccatcaaagctactcatccccatcaagaacacaatcacaaaatacacatcaagaacatatagataacacaaaaggctgccgctcaacaccaactccgctgctgccgctcgacaccaccgcccctgccgctgcctcccctccgccggatctagcggagaggagaccgctgggaaaaaaattgtatggcaccccatgccacaaagcatgcgtggcacccctatcaagatcttgccacctggcgtgcacaaatcttggagcactgatctaccttcaaaaccatactagggcaaaaactaattaacaggctatcgctaatctcgcgcgcgcggaagga

SEQ ID NO: 38591 - DNA, 892 bp, Oryza sativa
ttgattcatctcatccgtgtgggtttttctagtagatctcgaatgacggcattccccgttagttttttttttttttttgactttgctcggatgaaatttgctcgttttgtttcctgttcttgcgattgcaagtcattagttgatgggatagtgaaatccctgacgcgcattggtcgtgtagggagctggatctgttccatgcgttgctgattggatagaggggattagagtttacgatttagggctttcctctgcaaaaactccttgccgcagcacaggaagcaggtctcctccaaccgctccacaggcggactgctcgtttcaatatggccttatatgcagatgacgctgtagtgttccttagaccagataaacaggaactccaaaaggtccaaatgataattcaaaatttcggcctcgcgataggcatggtgaccaatttatcgaaaagcgaagtctatgccattagatgtgacaccctcgacttacaggatattctctaccccttcccggcacagatgaaacacttcccttgtacctatctaggacttccactccacatcaggaaactcagaaaatcagatgttcaacctctcatcgataggttctcagctaggctcccaacatggaaaggaaagttactaaacaagactggccggacggttctgataaagtctaccctctccgccctcccgacctatcacctcactgttttcccccttagaaaatgggctgaaaaaaagatcgacaaaatttgtaggggcttcctctggacagggtcagaacagacacaggggggacactgcctagttaactggaagagagtctgtagaccataaaaacatgagaggccttggtataacaaacctcgaactttttggtcgctctttaa

SEQ ID NO: 38592 - DNA, 511 bp, Oryza sativa
aaccactcggttggttggattattttccttgactatatgcttggtttgttcaattgaccacatagttggggggctacacctattaggtgcatctagtcgatgcacctgactttatttttcagccctccacagtcttcagatttggtaaaagtactcgggagaccatagcaacgatgattgaagcactcggctttggagtaatctagttcgagagaagattatcttttcgactatgaaggtcttaggggctactgtggagattatgggtaccccatacccacacggcatggttatccgactagtcataggggatagcttatatctatggaatatgtaacaaatcatgacttgggtattacgtttccttttatattatggagcagcctaaagtcctgatttgataatattgtaaaatagatttaggaaaccgataccgtattggttaaggtttctatcttgtaattctgccccccatcctatataaggtgggtaggaggccctgtagggggca

SEQ ID NO: 38593 - DNA, 419 bp, Oryza sativa
tggtgatgcttattctctccgttccaaaacaaattcaatcctcggtgtgaatcgcgcccagattcaaactgaggattggattttttttttttgacagaaggagtacgtagttgctctcgccaagccaagcagcacgcaaccactagctaaataccagtagagaatttttattttaaaaacattttttattccaaaaaagaaccctaaaaacctatttccaaacctattttcaagtgtgacgaaacaacaccatcactcccaccgcatatagtgggcggccacactctaactagcatgaaaaacctcgtcatgcgagtcgtgataaaaaagttcagatttggatataatttgtataggagagttcagttttgaaaataaaaagttccaaaaaaaaattcagattgctttgtgccaacagc

SEQ ID NO: 38594 - DNA, 1501 bp, Oryza sativa
aaatttaccgtgcgaattaaccgtacgtccaacacgaccctgaaactgtataacaactgtcaactattaccataataaattctcagatcaatcaacggtacatcgtatgtatgtacgactttacacggcataactctttgctagtagctatagtatacagcgtgcgtcactggagatggcgttttggagtgatctagcttaggccagaggctgtcaccgtggcagacatgaaacaaaatatatgactcacttttttattattttttctgggaaaataaacctcgatcactttggtcgccatcacgtacgtatacgctccgtatgtcatgccagccagaagttttcttgcttatgaaacatgcatgcatctttaaattttataataaatagcaaaaataccagtgcgttgcaacggataaaaataatttacatactccaattataatgactttcaagtttcaatgttagattgttagatcatatatatctggctcaaatcataattatattgatacatattgattgaatatggtgcttctgcatggggaagcgatgcagatgagaaaaaaacatgtcctaagcgcaccagctgcgttctcatgcatgcacgacgtattaccgagtcagaatcggatggctacattatcatgcacgaacgacacgtcgctttattgagtcagacgactcggactcggacgacgctttgccttgatatgccagtaaagcgcttgcggcagccccctctgctcgagccatattctaccctaatacgggcatggaatttttccactgcgttcccaaaagatgtataaattttccccaattagacccttgataagcatgtgagaattcgcaataacacatgagaagctgagatgacatagaagcgatgtaacatggacctgtgaacaagattgaggatggagattgatgagttaaaaaccggccaaatagagaaaagttttttaagaaaacaataaccacattgctctggtggctagatgagcgcagcatgtagtatgtaccctaggagaccggagtttgaatcccacacacacatgcatgtatccctgatttttgcatagtatatagtccacgtcaccggtagatggttttcccagtctttttcttgccggtagacagtttttttccggtccaacagtcgtatcgctactatatggtttttttagtccgatccgggttttatatgtgtttaactcggatgacggacgaaagctaaggtgagtatggaatcatcctcaatttttataataggtaaagattattattattattattattattattattattattattattatttggactgggcttcttttattattggagtcaacaagtaaccgtccatgcagatatgaggaggtcactgttggtgtcgtacatgtcgtccattccaattcttttatacactttaaatccgttactccctccgtcccgttttgtttgacgttgtagttcattttaaaaggagtctaaa

SEQ ID NO: 38595 - DNA, 1501 bp, Oryza sativa
tgcagcagttgcagcgtgcctgaacctgataaatgataaggttttacagtgttcatagatcagtggcaaatggcaaatggctcaggtgatcgatcgatgccgttgtaggtgaaaaggagggcatgagatcttactacaagtgttgtaaaattttgtccaaagattctgctgggtctcaggcctggggtgcccaattatgagtagcggcgtcgggagagagcgccggcggctccggcaaagaggggtggcggcgacggttccagcgagtacgggtggcggcggcatcttggaggtgagccccggcggctgggcgtagcggccggcgtttccggcgttgggggtggcggcgtttccgcctctttcttccgtcgcgggctcgcggcggcgactcacgcgttgagaggagaaggcccagggcaaatatgtaatttcacacgttccttaattttcacgatctggtcggaaacgtcaaatataacgggacggagggagtactgtatacatgaaaaatataactctgaccatcgtcctatgttttaggccatcaaatgatctgagcttcacattatatatgctattgtgtgtgccccctccatttttctatatagtgttggttagtacaatattttgaaccaaaccaatgtcacatataaaagaatagagggaatatatactaattatttaacgaaaaacattattatgttagcggttaactcgcttgtttcccgttataacatgaaaatttattgttatatctattggagatggtaagaatattgtcttgcactcttggtggtacgtagagtgaaatcatatttggctgtttccttttattgtcctttatttataagatatggaatgatatctaacaattgtattgataaataggaataaaagttagaagaacaagaggtggagaaaaatatttgtgttggaaacaaaatagatcctagcttctttcttaatttttgccactttttgtttggtttgttggcggttcttttttgaagttgtgggaatttcagactttctaaactaagccttaaatatttcgaggttactaaccatgatgttgagtgaaactttatagatctatccgtttcagattaaaaaacaaaacggacatatataaaaataaatattatatgccgtaatcatattatggcccaattaaacaattcttaaaacgatagcccaggttgccttaatttgttgtccgtccagatgtattggtaaattatggcccaccaatctttagtatcaagatgtcgtacaagtcttgtccttcgctcaactatagccatgctcctatttaattttctagtatccgttatgctttgctcgcttctatcgaagcttctatttaattgtgcatccgtcatcgtgctaagcttagacctactcaaattagcttttttaaattttgtggcatatatccgcaatgcttcgctcagccctttctagacacctattaatttgctcccgcgcttttttgaaatgg

SEQ ID NO: 38596 - DNA, 560 bp, Oryza sativa
tcgaataattttttcagcgctttgaatcctgcaattgtgtttcttgcactccattagcaaaagcttgagaacattataatttctctccagaatatcatgcatccatgctagctacgttctacctagactactacaagtaggagtagctaattaactagagttattcttctacctaaccagatctctcagaccatatcatcctgaagaaaaattcaagattttgggtagaaaaggaaccaagcaaccaaaatatttagttaaatcgaatccccaaaccctgtgggtgcaccacagtttcaggctcaaatccgttggtccctgtaaagcgttgtacaaatgtacagtgctagctgctgctttctgaatgagtggagtgcactatgcagtgtgcaggttggccaccaacttccaaacgagtaaaactccggaagcagaggtccattgaacctacccggctcgtgggtttctgcacaaaaccgtggccgcgcgccaccaagttcatcccatccactcctcgatctcctcgtacgcctataaaatcatacggcttcttgctctct

SEQ ID NO: 38597 - DNA, 672 bp, Oryza sativa
tttattaatagataactccttttttttgctaggattattaatagataactcgacagctacccttttcctacaaaagaacacaactatgtacaggtagctagccggccaagaacacaacacacgtgaagagtcagagaaaaaaaacacagatttaaacataggaaacacataaatcagcttgtgctactactgaattagcatttgctagttttggtttctccacttatatctatttgaaggtgcattgctggccaacagttgccaatggcctctaatatcacatcttcaccacaattagggccaacaattggtgttatatatgcattcagttggtgatattccacttgtacatgttcttactctctctctgcattattcaaaatatttatcaagatttgcaagaaaattttgggcatcctactaccgcatagctatgcatcctaggtcacctttgggagaaagcaagcttggccaggttatggaatggagtccatggatggttggaaatttcacttgattttgtaagtgatagatttgccttatcattgaaaaatatatgttgttattatcatggtgtcttggtgctcctgtcacaactgatggcgcgaaagctactagattaacatgtgtcagaaatgtgcaggccggtgcatatatgattgcagtcgacca

SEQ ID NO: 38598 - DNA, 488 bp, Oryza sativa
  unsure (1)..(488): unsure at all n locations
ttcagagtgcactaatgcaaagcaaaggtgatgtgaaccttcagaaaatgtagtactgctagtatatacagtaacagagcaacggtacagtgatctggtagactggtacggatacatgacgacgccacgtcacctcgccggtatagcatatcgccagctcaatatatggccaaagtaaccaagattgatgtacgaacgaagttctgttttcccaaatcaaccagctaaactgctgctggttttatagagaatgaattcttttatagcttaacttcgaaaaaaaagagatttgtagaaagaaatgtttctccagatgcttttcttaaaaaaattgtttaggaattgaaaatagtatcttagagttgaaattaaattggcatatcccttacaattaacgctaccaagtgcatttcctaaaagttaggctgtgtttgtgtntagttccattcaaacttttaaaaatttcgtcacataaaatatttggacat

SEQ ID NO: 38599 - DNA, 567 bp, Oryza sativa
gggactaagaggagggcgaacgcatcaccctcgggcccgacgtccctcgggggtaccaggctacgtgtgcgattgtgtctgcctcaaacctctagtcatatactcctgatcccatgtcaccgacaaatatggttacgacggtattgtaagagcaggcacaatagcatcttataaccaactataacacacatcgagaagaccaaatttgtagccagctgcagcacaaatacaagacacaatgtttgtctgataagtgggaccaggtattactagtgtggtacatatttataaacaactattgtataaattgactgttaaattaactatagatgatttgaatctagtactattaaacttgctctaaacctctttgctcattacctgggtaagaagttaggtccccatcgtttggttttttatggaataaaaataaatttataggtaaaacttttatatagatgttcttggtggcttaaaaatcaatgttgaaaaagaaactatattgaaaatatcacaaaatcaaaaatttaaattttggctttttcttttactgattaggccatccga

SEQ ID NO: 38600 - DNA, 627 bp, Oryza sativa
  unsure (1)..(627): unsure at all n locations
aatccgttatctttgttttcttctgttgtccccttttgtgcaacaatactaacagttttgtaaaagaaaccaacttgttatcaacttaaggggaaaacctgaagttcagcatgtatatagttttttttttcatattttacatagcataataaatagtatggtctctacccatgtacgtcgggtcaatctagttaaatagcaaaaggaacaagaaggtggaggccaccagccattgtgatcatagataaaccacctnctttgatctcctaccttgcactcaataaaaacatgtctttttatgatgctcaagtttttaataagatggtatatctgatcctctgaggtatgaaaatttgtactattctatctgtcccaaatataaaaacgtattaatctggaaaaaaaaatgtgtctcatccattactaattttttatatttttgggatgaaggtagttaaaaaaaattggtacacttacaaccagtanaatcttttgttntttggttctgtttgtttgtgtacatactatagatatatacagattcaaataatcgaaaaaataaggaaggagatggtgttcttttaccatgnggaacttggacttggcggcggcggcgcttgacggaca

SEQ ID NO: 38601 - DNA, 228 bp, Oryza sativa
gttctagatgaagatgagcacacaatcaagtatcagtccttggaatgacaccacaccaagaatcagctacaaacagcaaactcatctatccatccagggacagctaaaatggagaatcagacggccaaaatccgtaatccccaatttacaccacaggcaaccagcttccactagaaaccgaaatagccgcggggggcaaaagaaaaccaagaacccatctaccgttac

SEQ ID NO: 38602 - DNA, 382 bp, Oryza sativa
atcaatcaatcaatccggggagggggtctcctaaacctagttttaatctctgcactaatttaccattgatcatctccaagaatcagtatttcacggttcttagaaagatcaagattttctacggggagaggatctcttgtagctcaagaacaagggagattaaagcaggaaaagatgcttctttttgtgcatcaaagatccaaactttcgccgtggaaccgaaagctttacctcttttcttctcaccgggatgcgaagcggcgggcggcgcacgggggaggccacggcgagccgcggcgcggacgagattggggattcgttttggattggggattagggcgacgagaagaggagagagagagagagagagagaggtacccga

SEQ ID NO: 38603 - DNA, 461 bp, Oryza sativa
catacgtacgtctacaacgttatacacttaaacaatatggtattttttaagtatttataaataatcttttagaagtatgaaaataaatattttttttatgtgtgtattttaaaacaaagcgagtgtaccttttgaatttaagttttgatggtacacaagacgtcgatcttaagatatatcaacccggtcttatagagagagactcacagaaataagatgtgtgtttataaggataagtgtgtgcgtgttgcgaatgtctgtgtttgtactgtgtttcttttaaaaaatacgtgcttgtgcatgaactatttcattttgcattcctgcataccatccatccatccgtagatcaagggacggacggctgcgatacggctgttcagacggtagagtgtacatgtaagatgtaacctcgcccgttgccacggtcgcacggccacgactccatctctcctccatcg

SEQ ID NO: 38604 - DNA, 289 bp, Oryza sativa
tttgaattattagttggacctataatttttttttggttgatgtgaatatattaatcttacaattattggttgcacatgcaatttttttttgttaatgtgaacgtagtaatgtgtgattgatttcttaatgtgaacaaattaatttattcataattacaaaatctatccatgtcctagcaaaacactctgctcccatttttcaactcagttacacaacatggtgattatatattcttaggataataatctcattattatccagtaacttaagcccaatcaggtgaggaca

SEQ ID NO: 38605 - DNA, 454 bp, Oryza sativa
gttgtattcgaagtaatggagtgtgagtgatagcttatgaaacttaaacaagtccataatggttatgcgacaagtaagcacaggtcatacaccatctttttctattagagcctttaatgtgcaatatttgaaattcttatagatgcttttacgaacatgatttgcagtaactagccatttatcaggtaataagaaaaaagtgagctctattaatagttgtgtcatctttgaactattgctgtcggtaatctcacattctcacacagtgtgggtgatccttcgtatacttaatgtctaatataagtaacttttttttattaaaaaaagtcatgccaggtggagagatcttatttgattgcttaaaatgttatatgataaaaatcacagaaatgtttatatagaataaagaatttatggtaccaaaaaaatcttcattccagaaatgtaatgaaca

SEQ ID NO: 38606 - DNA, 151 bp, Oryza sativa
agtttccaacttttttttcctaaaaggaaaaggttcccacaaagcatggataatgcttttccttatcaattatattcttacccatccacgtcactcgttttcgagaaagatagtaattaggaattgaaagggacagagagggagatataga

SEQ ID NO: 38607 - DNA, 1501 bp, Oryza sativa
gctgagatggtgaagagttaatcgaataggaacaagaaaggaacataatatacaggtaaaatatctgtcatcattaatagttatgatacaagacaattaggaaatcaacctctctctttaatttaattggatcagttctagtttccaaagttcgtcattgataatagttacgatataaggcaaataggaaatcaacctctctctttaatttaattggatcagttctagtttccaaagtttctgtgcttgaaagattggagacttctgacccagtggctagtagctgctcctccgcaatctcttgctattacagcagcagaagaaagagcagtgagaactgtaaaccgaaaaattgcaatgacttggcaagataaaaacatgtttttattcacaacatactatttcagctaccggctcggtatctttcggcaacaaaggattcttccagatagaggacgacaagaattctcttgtggtaactttgaacagcctgatccgaccatcctgattcgtgtaagcaatagtcttatcggcattatccatgccctgtcaggtaaacaaaatgcacacttagtaatttggcaagaaacaggatccaactattcctgacctcatatatgtcattagaagatatcagataaactgtacattgtggcatccaggacagctcccgggacccttgtgcccactgacaattcaagaacccaagatagtaacatcaaagttagaatcttaaataagtgcaatgggacggagaacgctgtggctgttcttaactcttacgtctggtgatcggagaagagccatccggacactgccaatctgatggagggaacatgaatcatgagctgtagcattgaattggtagttagaatgagaaggcaggaatcctacactagtacactgtagtaggttgttttctgaaaccgttgacagttcgccattacaatgaggaaatgatgagtacagagatgtggtgtgtacctggaaggagaggaaaaggaggacggcaacaaggagggcgaggaatccggggcagcggcgcagtggggacagacttctgggatacgccaccgacgaggtggaggggaatgccatgggtggggtcgtggggatacagacttcctttttgtttgttttatttgtgcaccttttctgcgagggaaggaaatttcagaggacctcctggctcctccttgtctcatccaaaggacctcctcccacaacacaacaccgttcctaatgacaatcttcaaccaacaacaatatctgcaaccagagaattggctatgaatatgcgttattttgaacaactaatttgattttaaataacatgccgtttagctaacttaccgagaaaggctaatgcttgcaatgttagtgaattggctgtgaatatatgttatcgccaaccactacaatatctaaaaaaaaaaattccaatatctatatgtttcggtttgaatattatgccttttgtctgactcattaaagttaggat

SEQ ID NO: 38608 - DNA, 213 bp, Oryza sativa
cacccactgtgtcatccacaaccatctttgtttaatgagaggcatcagagactttttcccttcatctttaatctctaaaaaaaatattgaatgtgtatatttgtaagagggggaagtatgcaagctggtactatgctagtttgagctaaaccggaagatcaacatgtttgtgcaatgtgtcttacacagatcagtcgtcgtacagaaaagaaa

SEQ ID NO: 38609 - DNA, 1501 bp, Oryza sativa
taatattcaaaccgaaacatatagatattggaatttttttttttagatattgtagtggttggcgataacatatattcacagccaattcactaacattgcaagcattagcctttctcggtaagttagctaaacggcatgttatttaaaatcaaattagttgttcaaaataacgcatattcatagccaattctctggttgcagatattgttgttggttgaagattgtcattaggaacggtgttgtgttgtgggaggaggtcctttggatgagacaaggaggagccaggaggtcctctgaaatttccttccctcgcagaaaaggtgcacaaataaaacaaacaaaaaggaagtctgtatccccacgaccccacccatggcattcccctccacctcgtcggtggcgtatcccagaagtctgtccccactgcgccgctgccccggattcctcgccctccttgttgccgtcctccttttcctctccttccaggtacacaccacatctctgtactcatcatttcctcattgtaatggcgaactgtcaacggtttcagaaaacaacctactacagtgtactagtgtaggattcctgccttctcattctaactaccaattcaatgctacagctcatgattcatgttccctccatcagattggcagtgtccggatggctcttctccgatcaccagacgtaagagttaagaacagccacagcgttctccgtcccattgcacttatttaagattctaactttgatgttactatcttgggttcttgaattgtcagtgggcacaagggtcccgggagctgtcctggatgccacaatgtacagtttatctgatatcttctaatgacatatatgaggtcaggaatagttggatcctgtttcttgccaaattactaagtgtgcattttgtttacctgacagggcatggataatgccgataagactattgcttacacgaatcaggatggtcggatcaggctgttcaaagttaccacaagagaattcttgtcgtcctctatctggaagaatcctttgttgccgaaagataccgagccggtagctgaaatagtatgttgtgaataaaaacatgtttttatcttgccaagtcattgcaatttttcggtttacagttctcactgctctttcttctgctgctgtaatagcaagagattgcggaggagcagctactagccactgggtcagaagtctccaatctttcaagcacagaaactttggaaactagaactgatccaattaaattaaagagagaggttgatttcctatttgccttatatcgtaactattatcaatgacgaactttggaaactagaactgatccaattaaattaaagagagaggttgatttcctaattgtcttgtatcataactattaatgatgacagatattttacctgtatattatgttcctttcttgttcctattcgattaactcttcaccatctcagcatatctgatataccattatgattcctgcagg

SEQ ID NO: 38610 - DNA, 594 bp, Oryza sativa
tttttaattaactagaacctataataaattaaagttgttggttttttttaaaaaaacgacatctatagtattggtgttggtttttttatagaatcggcacctatagtcgcttaaaggtgccggttttagctattccgacacctatctagtagtgattacttatgtagatataaagtactgaggtctcaatcggtaaaatagtacaaaaggacatcaataacaactcatttctactcctccagtcactattgttatgtcatgtttttttttctaagaccggtcatgttctggaatttacctagcaccataagaaatgtgaatccctggatatagcctaggtgatgaggaatcataatactttggtaccatgttaaagacagaaataaagcctatgttcctcctaatagttgattgattcaatttaaaatatcattcagtgaaagagggatcacatgtttaatggaggtagaattgtaaagaggtaaaagactacttggtcaccttatctagagccccattgtttcgcttattcatattcttatccgaatcacttattagcaaataaaatattatttgtgaataaaaccgcaccgc

SEQ ID NO: 38611 - DNA, 945 bp, Oryza sativa
accgccgccacttgaaatttctccattccacaaattgtgccaaccacccttgacatgttgaagcagactaactatatcaatctcccaatgcttctcaagcctacattcagcctaaaaagaaacagtgttctttctttctgagcttggcgaagagaaagatagaatgaaagacgagaaatagtgagacaatataatgagatgcacatacatgttcatataactattatgtttggctatgtattccttcgtggatatagaggccggattaatgaaaatccattatctaaaaaaatataactattatgtgtcttttattgcatctatcatctctgacaaaaaagagttaatctagcaaatgagcacctgcaagtactaaatcactctttgtgctcaacaagggcattgaatcacttgtacttggcagtactctgcagtgtgaaaagaaaggattgggataatttcactcagataaagttggcacaagacatatgtgacgatcctagggttcgtggctctagatttggggaatcgtcacaggaaacatggaagaacagaggaggaagaaggagaattcaggagcagagaggttggtagtagtttgttatcatctctcttcttcgataccccacttcaccaaccacgcagggtttataacacacccgtgttggtggctcggttcttacaagacggcccaatagttggcccaacacaaacaatgtcccttacaaggcccattgatcatgacattccctcccccttaaggactggcttgcccccaagccagcgcagatggaaaacgacgccataagtcggccaaattttcccaggtggcaagagtatcaggaagccctgaccatcgtaccagaacagaaggaatggaagaaccaccacgcttgatcaactgacgacgtagaatggctttaggatagacttcacttcatcagt

SEQ ID NO: 38612 - DNA, 479 bp, Oryza sativa
tttacttcaccatttggcttggcaccggcataatgaaggtttcccggcttcttgaatcctaacacatcccaatcccatgctccatatatgcacaaggccagggtagaatacattgacatgattgactaccataaaaggatcacaaaccggaaagagtggaagccttctagctcttccataggcaagaagcagagacgaaacatgtatatacttaattagatgtttcattaaaaatgagtaaattttagaaaagcaccagcctttcaattataaggttgtgtttttctcccctctttcccaactcacttccatcgttttccgcgcacacgctttttaaactgctaaatggtatattttttgcaaaagttttttatatgaaagttgctttaaaaaatcatattaatccatttttcaagttttttttagattaatacttaattaatctcactataatcacgtgtttcgttttccgtgtcagg

SEQ ID NO: 38613 - DNA, 334 bp, Oryza sativa
agatgagtggtcaaacgtagtgaatatcgcttatattaggggacggaaggagtagatgccaagtgcacaagggatcgcttgtggatgttaattcaaatttttagctgtctgcaaactattcttgtgtgtggattttttttcaagcatttcgtagcccctcttttctcccctagtatgttgttactgcaagattatgagtgcagcaccatagagtgacatgtgagttgcacacaattgtgaagtcataaactcacatatatactgaaactaattgaataatttagaagtcattgttggtcaaaatttcaatatcttgatcagttgttttttcaga

SEQ ID NO: 38614 - DNA, 1501 bp, Oryza sativa
acgcgatgtcggaacggttctcgttgtctcgtgtacgtcgctcctctcggcggccattcaggtgatcgtggagatcgcaagtgccgcgcggtggaggggtggctcaatgaggcgattcccggtgttcaggattttcaccattagcatcgccagttggtggctattccgggtgtgctgcaacagcggcctcttcgaacgcgttgctgaggttggtcactgattcccgtaaccgctctgtccatcgtgcgagatcgtcattcagaacgggatcgtagggggtttccctctgtattgcgttgacggctctgatgtgctgggccggtgtagtcacttgattctccgcttccgcattggcgcgcgctgacgtgccgacatcgtcgatagccaataccttgtgcgacgtactcattgtcgatgaaccatagtcttcgagcaggtgcaagactgatggttcgtggggatcgatgtcgattaccccaacaaatcgatctgaaatcagcgtcgctccttgttccttgtcctcatccctgagggggacgcgtgactgctggaccttaggaggtggcgtcttcatggcgctgagaaagaccttgcagctcgagaggtcgtgattctttgcaggacaatagacatcacgtgttggagaagtacgctgaattccacgctctttgcaggcacgaatttcagcgtggacgttgagaaaaacccagcagagttgcaatgtgtgttttctggttttgtggataggacactaggaccttgtcaccttggaattcatcctcgtcggctcgtgattcttgtcggagagacaaggcttggctgcactaggatccttctcgggctcggatgtcgtcgacgctccgatctcctcttcggcgggaggatccttcgacatggaatcgccctgggttgtagccactgcgttctcgttttcggccattgacagatcggctgagatcggcaccgtggtgtaaaccgggaagacgatttcgtcgacttgagtccacaccaacattgttgaagcagaaactccttggttgaggttagtgttgacgttgttgtcggcgaagctggatgtcatagtagtagaaccttaagcaccaagcccctctacctggcgcgccactgtcgacgggggatacccgtagaccagatatagagggtattggggtacgctggtacgaggatctacgtaatacgacatcaagcaggcagaaaacaaagattatattggttcaggccccttgataggtaatagccctaatccagttgatatgggattatatggaggaaaacacagattacaaagggaatagtggaactcaacggtaccgacgagatcgtagtcgagttgatccgactagatcacccggcgacttggctcctgtaggctccggcttcgtaggctatggtggatgtgttggcggtaagattcgatgcctcgggtcatcccggggggggtcccttttataccgcaggtcaactggtctccaagtaggac

SEQ ID NO: 38615 - DNA, 555 bp, Oryza sativa
tcataccggaataggggtatgatgcagggaattaacaaagaagagctagagtggttcatttgcataaaaactagcatttataaacaggaattgaatgcgaaaacggttgtaataattaagcagtattaaacatccgctgtccaacgctaacccacgttgcgacaggcccaaccatccacctaaactatccaagttcaacagattacactagggtgagactaatcacggtgaatctggttgaccgcccataaccgcgggcacggctattcgaatagttttactctgatcagaggtgtacaactgtacccacaagacacagccccacgacacgtttccgtgcgccgacatgccaccacgacataccggaaagaggccgtgacaggacccttcgcataaccccctctagccaagcacaccacacctcaggtttcacccccgtccccagcgggcgacgggcagtcccctctcgtgcctaggtgaatccggaagcgacagaggccgtcgcagggcccgccccgctccatcacgcccacccttgcctggatgcgtcgacta

SEQ ID NO: 38616 - DNA, 1501 bp, Oryza sativa
tcagaggtgtaaagttttggcctgttacgtcggatattatataggatgtcgcatggggtgtttgggcactaataaaaaaactaattacaaaatccgtcagtaaaccgcgagactaatttattaagcctaattaatactatgttattagcaaatgtttactgtggcaccacattatcaaatcatagagtaattaggcttaaaagattcgtctcgcaaattagtcgtaatctgtgtaattatatttcatgcaggtgtttaaacgttcgatgtgacagggtgtaaaatttctatgtggaactaaacagggctatagtaggggctatatacaagataggtttagctcctactccctccgtcccaaaataagtgcagttttgcactattcacgttcaacatttgaccgttcgttttatttgaaatttttttatgattagtatttttattgctattagatgataaaacatgaatagtactttatgtgtgactaaatatttttaaatttttcacaattttttcaaataagacggacggtcaaacgttgggcacggatatccacggctgcacttattttgggacggaggtagtacgttaagaaataatacattacccatgtattgatggattatatattctactgaatatattgatgatatgctgttggttgcgatcttgtgtggtcagttgttctaccttgcccattttatatgggttggagatagagttatcaggtaaggtaacctaaacctagctgaatattattttagtttgtaatctagataacatagtattcggtcagagctctatacactatcttggtttacagcctaatatgataaccaagttctactctatctcatattatatagatatgatcccctcctatttttagtcggataagcaaactgtgtgaccattgatatatgttacctatactcttcacaatcggcctcctccggtgagatgcatccatgatgacgataaatctagcgcgcaacgtctgttgatggcggcaacaaattccttatggctggaccataaacatatgggcaacctttaacttgaggttttatgtgtagttcctgtaacgtatatggattatagccaactataaggttcataataagattaagttatgagctttcttgttgcaccctaaatagaaagcccctagaagggcagttaatacttttgtaatcttcacattgtgaattgtctacattatatttggggtgtcattattaatccgtttgaccatgaatttttatttttgcattaatcttcagtgaccgcccgtcatgtcgccattgtctcagccaatggagaggggagggggagggggaggggaggataaggagaggagaggagggcccactcgcccccctgtgctaaaaaacggaacccgactccttgctcaactcaccgacatttataatataccaaatgtgtcaaggttacgggtaaggtataccctctacccttcgatatacgtcacatatcgata

SEQ ID NO: 38617 - DNA, 280 bp, Oryza sativa
ttcaactagcacacagtggggatctcatttaaaacctagactataggtttatatgataatgttggtttaataccaccgctctggtgttggttaaataaaatgaaccacatggtgggctgtgggtgcatggttttgctagtcgcacccatggcagttaaggaccggttcgcgggatgccctggaagaatttatcgtacttaccacaagccagcgtgggcaacggctgggcttgtagtgtagctttcctctagtcgacgcatccaggcaagggtgggcgtga

SEQ ID NO: 38618 - DNA, 173 bp, Oryza sativa
aggcctggttgacccgtggtgcagtcttgtgccagacggagcatgccgtcccgtgggaagagagcacctcctgcataagagtagaggagatggagccgtagagccagctgaggacgacgcagtccatctgtgtccagtcggcgtgatcagggcgaggtacgtcggagaagaca

SEQ ID NO: 38619 - DNA, 1501 bp, Oryza sativa
tcaaggggcctgaaccaatataatctttgttttctgcctgcttgatgtcgtattacgtagatcctcgtaccagcgtaccccaataccctctatatctggtctacgggtatcccccgtcgacagtggcgcgccaggtagaggggcttggtgcttaaggttctactactatgacatccagcttcgccgacaacaacgtcaacactaacctcaaccaaggagtttctgcttcaacaatgttggtgtggactcaagtcgacgaaatcgtcttcccggtttacaccacggtgccgatctcagccgatctgtcaatggccgaaaacgagaacgcagtggctacaacccagggcgattccatgtcgaaggatcctcccgccgaagaggagatcggagcgtcgacgacatccgagcccgagaaggatcctagtgcagccaagccttgtctctccgacaagaatcacgagccgacgaggatgaattccaaggtgacaaggtcctagtgtcctatccacaaaaccagaaaacacacattgcaactctgctgggtttttctcaacgtccacgctgaaattcgtgcctgcaaagagcgtggaattcagcgtacttctccaacacgtgatgtctattgtcctgcaaagaatcacgacctctcgagctgcaaggtctttctcagcgccatgaagacgccacctcctaaggtccagcagtcacgcgtccccctcagggatgaggacaaggaacaaggagcgacgctgatttcagatcgatttgttggggtaatcgacatcgatccccacgaaccatcagtcttgcacctgctcgaagactatggttcatcgacaatgagtacgtcgcacaaggtattggctatcgacgatgtcggcacgtcagcgcgcgccaatgcggaagcggagaatcaagtgactacaccggcccagcacatcagagccgtcaacgcaatacagagggaaaccccctacgatcccgttctgaatgacgatctcgcacgatggacagagcggttacgggaatcagtgaccaacctcagcaacgcgttcgaagaggccgctgttgcagcacacccggaatagccaccaactggcgatgctaatggtgaaaatcctgaacaccgggaatcgcctcattgagccacccctccaccgcgcggcacttgcgatctccacgatcacctgaatggccgccgagaggagcgacgtacacgagacaacgagaaccgttccgacatcgcgtctcttcacggcgtcacgataacgaagaacgaggaggccgttcgagcgaagaccgagaccgtgataaccgccacaaccgccacgatcacgacgatcgcgaatggcgggtgctgggcgatactggttgaggacgtcgccataatgacgacgacgatggagatcggcgccgagacaacaacgggagacgacgacaagattctcgagaacccggccgacgtcctcgtaatcgtacgccggaaccaagcgacccatcc

SEQ ID NO: 38620 - DNA, 195 bp, Oryza sativa
atgcataaatgtccaaaatttttaaggtaacaactagcaactgacaactcatgtatatactgattattatttagatattatactaagggccctatctctagtttcgcactggcccctgaaaactcaggaccggccctaaacacgggtgctcgcatttacgactaattattctttcaatggtagacgacgtacccg

SEQ ID NO: 38621 - DNA, 347 bp, Oryza sativa
gccacgaacgaagaccgaggggagagaggggatgggtacacatgtgtgtcggtgcgtttagtcaattgagaatggcggccaccgatctaattttacgagaagataaggcgcgtggcacagaccattttaatttccacatatccctcgtaaaatatacacacccagtcagagctcacagtagcgcatcccacaagtcacagaattattattaatcaaaacattggctagtgcaattgcccttacccctcctctgcctcctataaaacggtacattgtggaggcatgcaataccacaccaaactcactccccaattcatcacatataccacatccaataacaaataaca

SEQ ID NO: 38622 - DNA, 1501 bp, Oryza sativa
gactgctagtcacagtctatgagatctgggtgatctctagatactcatgaaaaggtcaggagtatgacttatacgctccaaacagaggggatgcaaacggcagcctagtaccagttaagggtttgagtgaaacctgaatcgcacaagactgacaattcaaggcatagtccattgttcagttgtgatctggtgtagctcttttcctaggtggaagttcatcctaacagtctccaccgaaacactggtataacaaacaggatcagaatcgagagcatttcctgtgagccatgaaatttggtagggattgttaaattaatgggctaggcccaattaaatcctaatatattccattggcccacattaagtgctatgggtaataataccacctcggaaatctaagtgaagaggtcttaacttaaatacggagctagtggagagtctctgttgaccggttgagatggtgcgcggacaaccaggcggggcgaggcgaggtgaggcgaggcagacagctgctactgctgcgctctctcgttttgtaacggacggtaataaacatggagaattgatttcgtatcaatgaacgcgtcggttacggaattaaacgtcgtgaattgattccgtcggttacggaattaaacgtcgtgaattgattccgtattaacgagcgcgtcggttacgaaattaaacaccggggttgatgactctgaacgttactctcgcgctcgcatatatatactccgcagcgaccagaaggactgaggaagttcttcacgactcttgcacttcgagttcctcctcctctgttcctgagctgcagaatccttccctggttctgttcacctgcgcgcacaggtgtatgggacgagcaggtgcctccgaaactccgtccgcttgagaacttgcacgggtaggcgggcgatcaagtttttgggtagcgcttcaagtgcgactgctcctgttcttcgcgactactattattgcatcgacgccttcgtcaacatgtcgatggagattggagacaaggaggtgaacgacatcaacggaggcaatactgcctcaaaatccagcggtgggacgttcttagggtatactttcattctcctgattctattagatgtttctttattgatgttcttcgcaatggcagcattgtgttactctgtaaatgttgatgcttatttcatattaagcatgctcaagttgtatacatctagcactatcactagatctactcatattgcaaatgtcatgtttattgtcttaatattttggattaaaatatgccgaattatgaccaaatttccaacacatacagcataatgtatacaagttatgacaagcataattttcatcatactagcaaactacattctccattcccaaatattcccaattttcatcattgtaccgctcattttcctctaacctccccaacttgtctaattcacccttctttaaacaataaacggaatctgaaacaacatcgctagaggttcctagg

SEQ ID NO: 38623 - DNA, 1501 bp, Oryza sativa
ttccactcattaccttggccaccatctcatttttatttctaactagactgtaaaggttaggatactccttctcaaaggattgaactcctatccaacaatcttcccaaaatcttactcgtgagccatcttgtattaagaaggaaccaatcctttgaaaagactctttgtctaacatgagactagcccaaaaaatgcgagtcccctggtcttttttggacttgcaaaattgtttctttgtcaggtatttttttcctaagcaagctttgccaaattccttcttcattgatgtcgagggggcgatctctctgacaatggggagtggagatccctccccgagagtgaagatccggccatggggtttgcggtgagaggtacggatgactgcaatcataaagggttcacggggaccgaccatcctgcgtagagagagagagatagataggaatttatacaggttcaggacacccggaggtgtaatactgtcggagaataaactccatcggggaaccgtgaggcccccctttgtgagttcggccaggggcagcgggtgaaattcgagggcttggtgagcgaagctgtgtaatcttgaggggattcaaccccccaaagacgatgagacaaaaggggtttatacaggttcgggccactaagaagcgtaataccctactcctgtgcttgattgattgagtgtagaacataagtgcttggtgttgcaagactcaagcgccagttcgctcggagctcccccctccaccactaggcctggacctccttttatacctcaaggggttaccacatgggcccaacaacctaacctagctccggtagagaagtattataatctttgcattaaatgcatgtcttgtctcttgacttgggaagccaagcgcacgtcgtcttgatgatggggcctgtcaaatcttgtcgcctgacacggggggtgcccatgtcagtcaccatttaatgggtgaagacttctgggctcctattacaccggaaaacgggagccttgctttgaccagagcaggaggaccgactccggctgggataagaggatgagaacctctcaccatcattatttgatgggatatgtcgggctgcacgtcgcctgacacacgcgatggtgcgcctgacatcctgggtcccatcagtcattcgaccggtcatagaccggttgagtgcactgcacaccgcattaaatgcggcgtagcgcgaccgctcgggtcgccataaatgcgggtaggtgggcacctgtaggcggacacctaacccaccgtacgtggtgacctaaagagggggccggaggagcccgacccctagtcacaggaggggcagtcgtcacccgaccttgggcccgatcccccctcgggggagggccatgtggcacctggggtagcctcctccgtccaatctctgggaaggagtggccgccaccctatctcgggcccgactcccctcggggagggccacgtggcattggggggcagcttcctccgactag

SEQ ID NO: 38624 - DNA, 160 bp, Oryza sativa
atgaaaatgtcgcatttaatacccatacagcatcgatgtagctagtattgaccctagttgcctatcgttctgtgagttctaaagtgcatacaactcgattgttgctatcactcaattcaaactgccaaatagtatactctttgtatatatataaaataga

SEQ ID NO: 38625 - DNA, 309 bp, Oryza sativa
ccgaccaaacgaacaaaagaattattatagaaattatttttttacaattttcgatagtctagaaacatatatcttccagttgaaaacattcttcttttgtccgtgaagtcatggacaaccattaaaactgtttttctctggcagaatactaagtatatatcgccttgcttacacgcacaaggtgttttcctctctacaggcttgataagaagccgatccatgcatttcttttatgcatatatggacattttagtggcggcacaatcagccaaattagcataatatttccctcaaggatccagagcaaca

SEQ ID NO: 38626 - DNA, 1501 bp, Oryza sativa
tcgatcttcaactacaggtaaaactgttatgacggcttgcgttctcgggattagtgcttccatatttatgacactctaatcttgtttatgtaagttgtcgagttatcatatattctatataatctctgaaaacattgttatttaaccttcagtcggctaacatctgtcactaggaagcagccgattaggttaaataccaacgttgacctagattatatagggtatccaccaccctatgaaacatccaatggcttgattgtctagatattgttattctttccatacttataggtgcatcaattaagtttgaccttataagtcgtgattagaatctcaatctctagcctgctttttggttgaaaattagggtagtatcggggtttcagccgatcttacctgatttaactcctttatgtcttacattcttgattgacatgttaaatccgccctttatgttaagatcttgttgcatttaggtatattaagcttcctatttgatgtattttgcttgctttaatatcttaatatagagtggtatcagagtattagccgatacatgctagatctatctgatcggctatgctatgaatgcttataatctccctattaatgtatatttcgatctaagtgatttatactgtctcggcatggtgaccgatctatcccaatcacttgatttaagtatatatcgacagaggcattatataccattaatatctacagccgatcgaatagatttagttctaccttgtttatttataactgccgatcgattgaaatatgacatcggcttgaagataaatgatatgtcatcggctgctggccgatcggctatcgtttatggatttaaccgtggtttcttttgtctttatttattgttgattgcaggatcaaatcaactggcacactcacgaacctaaaggcaagatttttggacctgcactgaagttaagcagatcttcctggccactgtgtgttttttgcatcaacactacagtaccattgcttgtgcatagctaaatttttaaatcaaaatcttgtgcaaaatacaagtgctaaaaaagtgtatgtgtatggtcacaagttaacgcaagtgctaaaagtacttctatttgtccatacaaaaatacatagtagcaaagcttagtactagtaaacttttagaattctaatctttaaacaataatatctctcacattgcatattattttttagaaccggtttcaccataatgctttaaaaagacattacagcaagacaatagtcctgttactatacgatgatcgagacaaaaatgcttttataacgttgttactgcggaaagtagtcgtgttactgcacattgatcgtcgcgtttcttcgccgttctaaagagatgagaactaaaaaaaagtaaatctcaatctttagaaagcaatatctctcacgttatatagtatttttctaatccgtctgcaccatggtattcgtaaaaaagtgattaacaaaactagatccatca

SEQ ID NO: 38627 - DNA, 1252 bp, Oryza sativa
aaacagtaaaacggttgagtaattaaagtaatattaaatctccactgatcaacgctacaccacgttgaacaggcccaaccaacccacctgaactacagtgcattgggtcgatttattaagatgggactaatcacggtgaatctggtcgaccgcccataaccgcgggcacggctattcgaatagttttactctgatcagaggtgtacaactgtacccacaagacacagcctcccgacacgtttccgtgcgccgacatgccaccacgacataccggaaagaggccgtgacaggacccttcgcataaccccctctaaccaagcacaccacacctcaggtttcacccccactcctcgcaaggcagcgggcagtcccttctcgtgcctaggtgaatccggaagccgcataggccgtcgcagggcccatccaaactccatcacgcccacccttgcctggatgcgttggctagaggaaagctacactacaagcccagccgttgcccacgctggcttgtggtaagtacgataagttcttccagggcatcccgcgaaccggtccttaactgccatgggtgcgaccagcaaaaccatgcacccacagcccaccattcagtcgcattttagttggataattacgaccatgaagcatggccagatgtctcgagcacgcagctcattctgatattaaaaggtctaatactgtaattgtcctatcaactgagctagtggtaattaagcatggctaagcatatagttctagctaggtcatcaaagtaacacaagctaggcgatttattacccatggttgacaaaggacagatatcaagtaaacatggcacaagcgagcagataggtaaaaccctgaccccatgtaattagcaaaacatgcatatttatttgcaaacagtaaaacatttgtaaattgggatcaacatgctcaaggggaatgtgtgacttgccttgcttcttcactttgatcttccgaactcttatccttgcgaccgcgatcttccgaaacgacggattctacacgctggcacgcaaaacgaggaaaaactctaataaaaaccaaggaaatagtatataaaaagtaaacaaacatgtagagctcaattttagatgaattttgcaagttgaatggcccaatttggagttcgtatgaattagatatgaattttagaagttttgagccatttaaatgaattcttagaattaaactcgatttattgcgcaattattatttatttttccaaagg

SEQ ID NO: 38628 - DNA, 1501 bp, Oryza sativa
gacttgaagttcatcagtggtgtccctttgtagagagtaatgacagttgctccccctacgcttacaactgtgccaatcacttttgccatcccatacctcttgtttatgtttacttgctcaagcctattaattaaccatagaaagaataaaaggtagagacaccagattagcacagaaacgtacgaactaatgttaaccaattaagcttttagctttgttcagtcttcttttcatgaacacagatgtgcattcaaaatacaatatgttactgctattactgttattgttcttgttactaactaggagcacttttttttaaaaaaaagaaatattaccaagttttgattgatagcttcaatgagtagcaaaagttaatgaagtgcctaaatgataatgacattattgctggattacctcagagaagcagccaaggcaaaggttattgctggtactgtattttggatagcagaagcataggttggagacaggtagtgcaaaccaagaagatagaaaccctggttgcatgttatcctgataaagcaaagcatatggtcattatacataatctcaagcaatctatttatctttcagtgcaatgtgcatcgaacttacccgcagaatgccagaaagaagagctgggccagcaaagagaaggtgaggggtggtctatttttcctacagatgtaagataaaatgtatagtcagcttataacagacaggacaaaaacaaacatagcaagataaatagaatgtaaaggaaaaatgtattctcacaggcacacagaatagatgtttctttttcccttctaaatctcaatataagtacaatttagctgagaatttcgaatttcatgcataaatggcaacgaattgaatcgaagaggtatgtctgagctcacttttcaaggaagtatgcaaaaggtatgagcaatgccaaggcgatgcagttgcggtagacggtgaagacgatcttgctgatgcccatgttgagggctgccctggacacaatatggaaccccgcgaggcagcactgcagcgccagcacccccagcagcagcttcaacttctctggggcgctttccattaccatgacctccctctccctgacctccttttcctcttctccttagctttgactccaacctagctcacctctgtgtgtaatgaaattgttgtttgttgttgttcccctcgttccatcttatatagaagttacataccggttcgatctcctttacgctgtacatatattttaattagactaactatgattacaatgctcgtgtcaagtaaaaaaacaaagaaactgaaaatgacccaaacaaaaacgatgaagccaattcgtggtggagaaacatgcaccaacaacataaattaatcacagggatataatttggcttcctgagctacttgcatccactaatccaagttgatccaagcattatgcaaatgccatgttacaggggacaatacaggccatgatgccaatatacaatcagcc

SEQ ID NO: 38629 - DNA, 467 bp, Oryza sativa
aaacagtaaaacggttgagtaattaaagtaatattaaatctccactgatcaacgctacaccacgttgaacaggcccaaccaacccacctgaactacagtgcattgggtcgatttattaagatgggactaatcacggtgaatctggtcgaccgcccataaccgcgggcacggctattcgaatagttttactctgatcagaggtgtacaactgtacccacaagacacagcctcccgacacgtttccgtgcgccgacatgccaccacgacataccggaaagaggccgtgacaggacccttcgcataaccccctctaaccaagcacaccacacctcaggtttcacccccactcctcgcaaggcagcgggcagtcccttctcgtgcctaggtgaatccggaagccgcataggccgtcgcagggcccatccaaactccatcacgcccacccttgcctggatgcgttggctaga

SEQ ID NO: 38630 - DNA, 1501 bp, Oryza sativa
atccaaccggggttgaatatggaggagtaccctcctcaggaatttgtcttaggaatatatattaacatggaggaatacctatactgagctatcaccgtcagcggcgcacctctactgtcccgcagcatatatgcctagatagtgatatttagtaatctaagcaccatacttacattaataaatactactctacacctctgtagatgatataaagcaaccgataaatcggacactaaacccacaccattgcacctctctagtaggctactcacacaattataccgacacaaatgtaaagtaagagcaatacctatactaactaaagtaccgagaatatataaagaagtgtatttcattaattctgaaagtattatagaagagggtagaaaagctattagagccataccgaaactcttctggaagctctgaggaccccgagaactattctatactactccgcttagcactaaaactactaaaataaagtatgagaggaaccttgagcttgcttgagtgtgttgtgaagttaaatgagctcctccatttatagggtcggtatgacggtttctgagaaggcaaaatgaccttctgccccacaaccgccatcagcgagcaatcctggatgtccacgtgtaaggccgggctgagccgtcgccactagtgttcggccgaacgtgggccggcccagcaggcctccatgtttggctagggtaccgacaggtgggtcctgttatcggttgtgacagttaaggtggtttccggatggttacacctgacatgtgggccctccttatccatatgcttacttaggagtgagttttccttattttttcattattttatttgcttaattcttgcaacaaattattctccaagtacaagtggaactatattaatctaaaacaaatatgcattataagcatagctaattctcttttattatagttatattggttgtcggaactggtttatgacaaccgtcaacaactggctggggctccccataaacatgtttcatttatggcggagaggactgcttcacaacagccctgtggagcacgcccatctccccagacgatcctgaggtcgcgcccttgcgctttttgtgatgataattcatctattcttgggcaagattctcgaagatgtctttgatgagtagataatgtatttattttgtatgtttcgacgctcttctttgcagaagaatgcggaaactacaagggctaaggtgtccccggtcccaggacgaggccgggactgaggcagaccttagttttatatcttctaagatgtagaccttgtatgtctctacgctcctcctactggatagcataggacttacaaggactaaggcgtgcccgggacccaggacaaagccgggtccaaggcagaccttagattacattcttaagacatagcttttataggtctcaacacttctcttcactgagcagtattgtaacctagatgagctaaggtgagcctgggacccaggaca

SEQ ID NO: 38631 - DNA, 883 bp, Oryza sativa
actatggtgagaagggtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtacctcggaaaggagttgtgacaataccccttgcataacacaatccactgcagcgcaccttcctggatcataatcacccccttataaacaaggcatggactccccagcgacccctgtgggcttatctccgtcacttctcagtctggtgccccgcaatgaaccatgctatacaaaggataaagccgttgcccacgctggcttgtggttggcacggttaatgtttcacaaccgaaactcgtgaaccggttcttaattgtcacgcgcacgaccatcaaaaccatgtgctcacaacccaccattatctggttttagttggcacattaattaattaatcaatcacgattgaccatcgtgaactatcattaagccatcattaaataatagtgagtcataagttatcccgatgatgtgctaatgtttctaagcagggctaagcaattatacctaatatctagctgaaccaatatataaagcccaactagtcaagttataataacccaaggtatcaaggaataaagtaatcaagaacaaaagggctataacaatgaataggttaattccacccaatgacattcgaaaataaatgcaatagttgaatagaaacaatagctttaaacgggatcaacattctcaaagggttgtttgggatctgtgtgacttgccttgctggccttggaactcttcaaactcttctccggcgaaaacggactctccggaaac

SEQ ID NO: 38632 - DNA, 1501 bp, Oryza sativa
atttgcttataacttagaaaatagcgtttaagtccagaaactgaactcgtctcatggacacattccattgcatctaagtactctctttatcccataatataagggattttagatggatgggagtatggtcttatgggacacttcctagtgttcatattgatactactagaaagtatcatattattattttggagagagtgatttagtgaattgggcacattattattttgaaggtatttcaccggcgctaagaacaggaatctctttctgggcctagtgctttttctaacactgtcatctgccttgaagcaataaaactaatcactaatccaacaaagataagcttaaaaagaaacagcgacaacggcagctctgtagtgttggtaactgtgtgatgttactgttgggataaccggatagttaaagataaaatccagatgcccctccaaatagattttacgtttttttactatatatgtacatccttttcctcttcaaataaagttttctctcgaattacttatccgatctataatccgattacaccactaagttcgttacaattaaatcttcataacaagatcttacatgattatattacgatgaaaaaatatttatatttgtaaattactaagttacttttatcacacacacacacacatatatatatataagttatttttagagttgactaaattacttcttagacatataaaagtctaaaagtaatttacatatattataaaaataacttaaaacaaaacagaagtaattttgtcacgacattagaagtaaattcgttgtagggataaaaatatgactttatctagaaattaaatttaatcagcacagatcaacacacataagtttaacaatttttaaaagtaacttcaatgttaattggaagtaacttttgcatggttcaaaagtaactctctgtaaatctgtttaatcatcaattgtttttttcctttcatttttgtttttcatgtagaatgagaaaaaaagatactattgtatttttcaagttgaaaggagatactagatagaatacaaactagctaccactaactgtgtagtcacatccaattaaaaaagacattcattaaagttaatttctttttgttataaattacttctataatatatgtaaattacttttaggcttcattgaatttacttttacatgtctaagaagtaatttagtaaaatctaaaagtaatttagatatattataaaagtaatttataatttttcattaaaatataatcatgtgagatcttgttataaagatttaattgctataaacacaacggtgcaatcggatcgtagatcggataagtaatttaagagaaaattgtatttaaagtatatgtggataatatctttcataaatggagtggtagctggtttagacaaactagctagcactagctgtggagccacgttctaaaaaaaggcatgcatatagtgccatgtagcagctggactttttcatgtt

SEQ ID NO: 38633 - DNA, 1501 bp, Oryza sativa
aaaagaaagaaaccttacctctgccaccgccggtcatcgccgacgtcgtgcgggaagtacaccgccgtcgtcggtcgttgccgtcacgcgtgggaagtcctccatccactgccaccgtgaaaaatggacatgattctgccaaattgaatgaacaaggtcaaaaaacgccctcatgctccacctagaaattttcaattctgaagatattagcttttggaatattagtgccaatttgaacaacacaaggagtatggtcagagactgatcttgctaaaggtttcaccaaagtatttggaaactttaaagtccagtcagtggaagtgaaaaaccaatctagctgctcaagtaagggctactcaaggtaaaagccctacccttaatgggcaattcaacaaggctaagatcactaatgatttcattaaaaaaatatcattcatgtcagcaccaggcctattccttttagtgactgagcgataaaaatagacatctccaagaagcaaccatagctgatcgaccgaaatattgagattatgaagccacaacacaaagtcatccctctcactcccagcacagggaccataaacagacacaagagaccaaaccacaccaaagtgatttgatgtaaatttaatctgaactgcaaatctctcaacagtctcaacaggaccataaaaaatagaaatattccaacttacaaggatgcccccagaagcatccacagaaggagaaaaagcaaatttgttaaatcccttaggatcaatttcttaatgtaagaatgatgaaaagtactcctttttgtctcttgcaaagaaaaaattgcacatccacattcttccaccgtattccggatggctaaccacttatcatgagaattcagccctctaacattccaacataaaacattccagtttcttagagcagcattcttttaaataggaagagtagaaacattaaatgaggaaagatataatccaacctccaacaaaagcaccaccccatgagtcataggcagtatttgtcacaccttgaaatttcccctttttccttagcctcaaatttagtaataaatcacccgaagaaattatttaatttaacctggagctacctctaattcaccaatgcaattaataagtggaatttgcatggtggatttttttttagttcctcgtgtttaaatacaataacatgatttttagtggaatttatcaaaggaggcaattttaataaatccaaagtaatgatcgagactaaatttaattaaattccttcttctccctgatgaggatgttaggtcccgctcttccgacaggtattgataaacagtagatttgcacggagtcgtgacacaactcgatcttgcttctaaacgaacacgctactgagcctcgcaatcgtagcaccacgtctcctctggttatcaaccgtgccgaaacatagttgacctcgccaagaagactaatctctgtatgcgaatcaaagaacacaagcaagaacaagatag

SEQ ID NO: 38634 - DNA, 523 bp, Oryza sativa
ccggccgcctctcttcccctctccgcgccgcccgctcctgcctcctctcccctctcccgcttcttccccgtgcgccgctgcgcccgcatctgcccgcctgctggggagaagcaatgagagccgacctcctccccctacttctttccggcgcgccgccatgcccactctgccctagccgccacacccgcatctgcctgcctgctccacgccgcccgcctgccgcgctcgcttgccgcctgccgccagcctccactcaccgaagaagataagagagaagagagaaaaaagaggagaagaaaataggagagggcaactgatatttgggtcccacgtcagcaaaaccacccatatatactgccataggactctgagtgtacgttttgtgtgggtttaggtgtgcaaatttctgattttgtatttaagggactcaaaaaaatctcgctattaagttgagggatctctggtgaacttattccttttgtttttgggttcccttggcccatcttgttcttttctgcaaagc

SEQ ID NO: 38635 - DNA, 1501 bp, Oryza sativa
ttgttttaagttatttttataatatatgtaaattacttttagacttttatatgtctaagaagtaatttagtcaactctaaaaataacttatatatatatatgtgtgtgtgtgtgtgataaaagtaacttagtaatttacaaatataaatattttttcatcgtaatataatcatgtaagatcttgttatgaagatttaattgtaacgaacttagtggtgtaatcggattatagatcggataagtaattcgagagaaaactttatttgaagaggaaaaggatgtacatatatagtaaaaaaacgtaaaatctatttggaggggcatctggattttatctttaactatccggttatcccaacagtaacatcacacagttaccaacactacagagctgccgttgtcgctgtttctttttaagcttatctttgttggattagtgattagttttattgcttcaaggcagatgacagtgttagaaaaagcactaggcccagaaagagattcctgttcttagcgccggtgaaataccttcaaaataataatgtgcccaattcactaaatcactctctccaaaataataatatgatactttctagtagtatcaatatgaacactaggaagtgtcccataagaccatactcccatccatctaaaatcccttatattatgggataaagagagtacttagatgcaatggaatgtgtccatgagacgagttcagtttctggacttaaacgctattttctaagttataagcaaatagacacgcctgcacaagtgtaatactccttccatccaaaatataagaatatagaaccgtcccaaaatacagtttacttgcccagattcgtagtaatagaaaatgtcctatctgatactacgttcttatattttagaagggagggagcatgtgcatttgtgcatcctgagttgtataaaaataagagtaaagtgtacggacggtctttaaacttatagggttgtgtcatctaagtccctaaactctcaaaatgcatatctaagttccagaacttgtcatagtatgtcatctaggtcccaaatcgccaaaactccttcaggaccatacgttgtgttgatgtggcatgccacacggatatgatgtggcattattttgactgacaaatgttacccatttaaattttttcctttttctttttttcttatctttttcccctttattctcctttctccgtgacccgggtagaagaaaggaaaaaaagaagaatgagaagaaaacggaaaagaaaaagaaaaataaaagaagaaaaaaaagaaaaggacacgtcacgtccatgtggcatgtcacatcagcgccacgtaggatcttagaggagatgtatcgatttgggacctagatgatacactttgacaatttctggaacctgaatatgcattttaagagtttagcgacctagatgacacaaccctacaagattaaggatcaccaatacactttactctaaaaataataatgcattgg

SEQ ID NO: 38636 - DNA, 1501 bp, Oryza sativa
atataaatacatatggacaatctcaaatttattagtatcagaactttgcgtctaacgatctacaaatctgtccacatatctccatgtacgaggaccccgtataacccatcaacacattttcctggaggttatggacaattccaacagctcatcacccaagtgtatctccgttttttaatagatcaagccgttgattttttatcacacgtttgaccattctacttattaaaaaaatttacgtaattataatttattttgttgtgagttgttttatcactcaaagtactttaagcatgatttatatatatacatttacataatttttttaataagacgaatggtcaaacatatgttcaaaaatcaacggcatcatctattataaaaaacggagggagtattagaattatcgcagcaacagatttcatcgtagcacgataaatttcaatgcatctttgaaatctcatttaacacgctgaacttttaaaataaaaattaatcaatacttaaaagtacattactactgacgtgttcatacactccatttgtaaaataatttttttgcggggcatttgtaaaataaatttaaaagcatcgtaaaatacaaacatggatttcatcactgcacacaatatcttaatcaaaaaattgcaccagaagattagcaacgtaccatgaccaagcacaaaaaggcatatcatatattcattattggaccatttgctcaggtgaacaatttggtgccatacagacgaactcctggaatattgtaagatcaacatgtgttttgattcttcttctatgatgaataattggcatctgtgattattggttttgatatttggagattagtgtcgaagtggttttggagataattaattttcaggtgatgaacagggtttgctgttttgtcaggaccggtcagaaaaggcggtggttgccggtcagaccggcttgtgttgagcggtcagaacggccagcccgcggtctgaccggccgacgctgtgtcggtttcggtttcgggttgtttctttggatatccatgattgtttcacggttatggcttctggatggatactatacgtatgtaatactgttgtttgctaacaatgagtcaagttggtgatagcttggtctcggaatatggtttctttgtttgtttcatgtgtaggtgactcgatgccacgggagagtatttgcggtgatggaccgggagtcggcttggtggtaagacgatgtccgtggtggacagatatcatgcgggatacttaggctagagttgatgcacgtggttggtgattggttatgtaaagtttgtttcttgtactagagggttttctatggtgattaggacttttaggatgagtttggttcgtggctttaggctgcctacctcatgtataaatagagggggagcgtgaggcttcccgatatcgcttttgagagcaattgagttgctagtttagttagggtttcgagtttagtcgagatttttgtaaggagt

SEQ ID NO: 38637 - DNA, 1501 bp, Oryza sativa
ttagtccggttcacatgttctcagggctcctgcgatcttactcccaaccgggactaaagatcctaactttagtcccggttggtgttaccaaccgggagtaaagatcccaggggtctttagccccggttggtgttaccaagcaggactaaagatcaatccctttatatatgtcttcttcctcctccagctcgagccaagcttcgaaattcttcatacaagaggggaggtcatgcgaaaatttcttgtgaatttattttagttattatatacaaatcggaggtgtctgattagcaacttcattctccaatgttttttgttgtcatattacatttggagctatgttttatacacattattgtctctaaaactttgttagaagttgatgagagagaaaatttgtgtagggaagaagaatatattgaaattttgtttatttacaattttataaaaagtttttataaaatagttgagaaggaaaatatattgaaaattaatctaaaaaaatagaaaacaaactaaattgaaaactaaaagaagtgcaacacattaaatattattttaaaactttaaaaataatttcaaaaagaataatttgtggcattattttataattattgtatgaataatgatatgtcattattgtatgactgtttagtgggtttcactttcgttgaatatttttacgatttttttgcatttcatgtagatggatcggcaatgcatgtacgcggaccggcggtcgcaagagtttattgacggcgtgcattattttttgagagcggccgatgctaacaagcataagggttttatttgttgtcgtgcaataagtgcaagaaccagaaggaatattcatttccacttgtttgagtcggggttcatgcctggctataattgttagacatcgcacggagagctaggggttcaaatgaaagaagaggaagtggaagacgggaacattccggactgggctcagtacgctggatttgaaggaaatagaatgggcgggtggacggggatgttgacgataacgatggtgcggatgatcttggtcagatgctgcaggacgccaaggaggactgcaaaagtgaaaaggcagcccataaattggagcctttataagaggaccacagaacgtcgttgtacccaggttgcgaacaggggcacaaaaagttaggtaccactctagaattcttgcaatggaaggcaaaaaattatgttagtgacaaggcatttggcgatttattgaaactcgtcaagaacattcttccggagggaaacaaattgcccgagacaacgtatgaggctaagaagatagtctgctctctaggactggaagttcagaagatacacgcgtgtccgaacgattgtatcctctatcgcggtgaggagtacgagaacctagaaacatgccctgtatgtaaagcactatgatacaagattagatgagatgatccaggtgaagttgacgggtagccaacgaaaaagagaattcctgctaagg

SEQ ID NO: 38638 - DNA, 1501 bp, Oryza sativa
cgtgatgagaggttatctattagtaatcaacctaagcagcaacttgcagaatgtacatgtcaaaaatcataaaactacgagcataccttgattgataagttcataaagggaatatgtagctcacatggcgtccgttgcgtgatttcatcgacgaggcaggtggtttcatcctgagcttgcatcgcgtcgatgctctgttatcctacctaccccgttgaggtgcagccgctatgattgcctgaggggctgaccatgacaggaggaatgtacggctggggctcatggctccgctgtgcggccatactttcatccacctttcttgccacctcctcttgcatactgagctcatagttcgataccctatcttcgagatctgcaatcttcgcctcggtatctctcttgctcctcatccaactcctgtacatgtggatgtcctccttgaatccaatcttccaaggaaccacgcctttccctcgcgtttgtcctggatattcgggagtctgcagagcgagcgtaagctcgtccttctctctgtccggtcgaaacatgccctgagaagaggcttccactgcttccgttagtcgattggcagcctcgcgtatctgattgctgaacaccagggagccatcagcggggttcagcgttccaccgtgagcatagtaccagcgctttgatcattccagccatttagagatggccggttcgatacctctctcaatcaagccggcttcgatatcctcccacttcggcactgtgatgctatagccgcctgaccccaggtggtgatggtacttcttcttagcgggatttgctttgtttcggtcgatctgcgcttgcccttgttaccctgtcttgtaagcaacaaagtcatcccaatgatccctgagcttcgggaatgagttgaagttcattgtctgccctttcatgatgcatttcttgtagaggtctcccttgtagttctgaaactgttcagtcactttcttcagagtccactctttcactttgtcttccgtaccctcatggagcgtgaacgtctcgagcattatggtccacagcatctctttctctgaatctgggacaaaacattcaaaatccccgtgtgtccttattctgcgccagtacaccgtgctgacaggcatgttatccctcacaacccaaccgctgtgtcgtacgaaattccaggctgcatctgacggggcacttggtcagctgtctttgtccacttcagttatgatgtgccgaccctcaatcttcttcacagcacctcgttgtccgcgtgccctcttctgtctagcggagggttgacttccactaccctcctcctcctcgttcccctcctcgtttagttactggttcggatcctcgttcccctcttctttgttctagtactggctgcttccctctacgatcgtgtcgtattgtatctgttcgtcatcgcgatcagccatctgttcatacaagaaatatttgcaggcgtatgttatttacaacttatgtcggg

SEQ ID NO: 38639 - DNA, 823 bp, Oryza sativa
ttaaccccgctgccttgcccgcatgagcctccgggaaaccgtgccgccactgcatcggtggaattgggggctagggtttcaacccatgccactcaatcggataaggtgtggcaccccttgttgggccacactataggctgagaccattagcaggccgacggtcccgatgggccagttaacccttggatggccagtatatagaggtgggccgaatatgaattcggcctataaaaggagtcgggctcgaatcgaaatttggcccaaaaacggcaaaattccgaatattttctgattttatgcggatttggaattttagcggaatagtccctcgggattatagaaattacagagaatatcacattttttagttattccgtactttcaattttctgtatattaactgtttattagttaatttttgaatcaaccatagaatcctagagacatgggttttaggaaatgagctgtcataatttgaaatttagtacacaccagagagcatcatatttatggtttattttcctacctgttttatattttcaggatactatttaatgggttagtaattcatctttggtacctaaataaatagtacagtaattctgagaaatgttgggagaattatgggaatatattgacatagtactaaatttagataactaggcaatttactatttgcacacttgtcatgctcttacttgcagtacttattgaattttgcatgactaatgtaggaaaatgactgatattgctaagagagattttgctgaactagcagtcagcggcaagaattacctgacatgggcactggatgccaaaatca

SEQ ID NO: 38640 - DNA, 870 bp, Oryza sativa
tttagaggatatattttagggtcgttatggtacgtgacacgagggcctcgggggaggcagcgcgagagcccgaggggcgtgacgtggcaccccgaggccccctggctacttctgcgactcgcgaggcgcggggggagggccaggctgtagagccacgtgactggatgggaaggtaacttcccctcactttgcctacccccgggcccatatctccgacagtagcccccggcaccgcgtcggacattggccccccgagggcagtccgacgtggcgcctcacgacttcccgtgccgagttgtgggcccgacgaggaatccagacggttgccgccgggcggccaggctggcgcattagtcataacggctatttgaccgccactaactgtgcccataacggcgatttgaccgccactaactgcgccgatgatggaggcgcttagggcgcgaaaatcggggggtcggccagaccacgcccagaatcatcacccacgccgcctcgactcccccgcctgccaggcacgcgacgggaccgacagcgggcccgcctaaccatgcccgtgaacatcgcatggcccgcgccgaatgtgccgctgacaggtgcaccaaacgcggggcgcgggttcagtggggcggcgtgatgagtgggtgcgagagtcgaggaggaaaccgcaggtgcaggaatcgagggggcaaccgcgggggcgtgaaacaaggaggcgagcgcgggcgaggcggggataaaaggatagggaggtggagagttcgtctccttcctctcgccgactgctcacccgcatactcgctcctcaagccctaacgcttctctcactccacgctattccgtacaccaaactcctcgccgtttccccgc

SEQ ID NO: 38641 - DNA, 547 bp, Oryza sativa
ccgcttctcgttcgatagatcggttgtacttgggataccccatacgcctgtcgcgcatggggtggagagccgcaaactctcttgctacgtgcgccataagggacaaatccacgtagtacaacccatcgatcgaacgattagcggagaaataaaaataacagaaaaagatctagcaagtttatcgttatccctatagaacgagattagatcagatcgatgttgacaatataccttggctgaagagcacctcatgctgataacttgttagaattcatgttgtcaacaatcgaacaagcacacacgaacacacggacacgaaagtggagggcaatcaactttattgatgtttttctctctgttacaagtcttactttgccctcaacctcactattgtatttatacccataataggatgtcctatatggatacatacatatatatatttggtataagcccacttcattaataaggaaacagaaggaagaggaggaggtaccgtgatcctcctataaatccgactcctttgggagatcggttttataacagt

SEQ ID NO: 38642 - DNA, 177 bp, Oryza sativa
caccaccgccagagacgccaccgccgccccaccgccaccgccatcgattcttgctaccatcctcaccaccgccatcatcatcctcccccaccgcgctgctttcgattcccctgaccgccccgcgtagccgccgccatcgtttctccccgacgccctcgccatcctcctcgccacagc

SEQ ID NO: 38643 - DNA, 1501 bp, Oryza sativa
ccgccccgacgccctatccgtcctcctcgctgccgccatcgccgccccaccgacgcactctccgtcctcgtcaccgccgccaccgccgccccaccgccagcgacaccaccgccagcgatgccaccgccgccccactgccactgccatcgattcttgctgccatcctcaccaccgccatcatcatcctcccccaccgcgctgctttcgattcccctgaccgccccgcgtagccaccgccatcgttcctccccgacgccctcgccatcctcctcaccacagccatcgctgtcctccaccagctccctcccccactgccgtcctcgccgccgcctgtcgccgtcctcacccaccagcttcgacgccgtccatcctccccgctgccctcactgtcctcctccaccagtgccatcctcctccaccgcgccgctatcctacaagaaaaatgaatttgtgatttagaagtaaaataaatgcgtacaatatcactgacccttgaagtcagatgtgatacatctttgagtgttgatcttataatgctggctataatccaatgtcagatgttatatgttgcttgctcatggatacaaagcagtggatttataatgtcgacggcaatgcagcttaatgtacaatctgtttttatatacatctgttcatgtggatttactattgtgaaatctgcttgcgatttttcttcatttctttctgatctaccaaactgagatcatatttacatttgtctgaatcagattttctttctgttatcagatgaaaagttcaaaagcaaactaatcagagaatttcttcttgcaggtaacaagcctgccgccaggccttggttctggggttctcctccaccattccagtcttcgccgacactgcccgtgcctccatccaccgccgccggattggaactgcgcttgtgcgccgccttcgtgccgcctttgtgagccaatttcttcatattctttgcagctcatcaatgcctcgtttcaaaacaaaagattcattacctattataccctaagagctcccctttagcaattggttatatacttttcagtaatgaattttcaacatgaacagatggatgtacaaattatatgccgtaagagcatttggattcctgtttaccatgcaactctgaataggttttgcacatgcttatggatactccatgcatgagctattttagctgcacatgtacccctccagtttgagcttttatccactaattaattattttataaacatgcatggattttgcagtacagatatttggagcttttacagttacaagggtacagaaaaatccatatgggaaacaccttaacagaacaatttgtaatgctatttcttcagtacaaattgggaaacacaatggaatatcctatgttttttttatttgatcttcctgctgatggatcccctgcaggctgctgtaatcggttttcgttgagaggttctttagttagctaaaccttagcattgttagacttgc

SEQ ID NO: 38644 - DNA, 1501 bp, Oryza sativa
cgataccgacgccgccacagccgccatgcccctgccgccgccctgtcgacgccgccatagccgcggccactgccgtcgcctctgctgatgccgccactgccgccgtgccactgcctctgccggcggccaccagtgaatgaacgtgaacgaacgagaaaaagatcatgaacgaacgagaaaatgagtggaacgaacgtgaacgaacgatagaaatgttagaacgtacgtgaacgaacgagaacgacagaacgaacgagaaaatgagtggaacggacgtgaacgaacgatagaaacgacgcacacgccgccccgcaccgcggccgcgccaatgccgccgccgccaatgccgccgccgccatcacctctgccgacgctgtcatagccgccgcaccactgtcgccgcctctgccgacgcggccacagccgccgtgccacagtcgcggccactgccgctgcctatgctgacgccaccagtcgccgcgcctctgcctctgcctctgccggccgccgcccgtgaatgaacgtgaacgaacaagaaaacgaacatgaacgaacgagaaaacgagtggaacgaacgtgaacgaacgatagaaacgttagaacgtacgtgaacgaacgatggagacagaacgagaacgatagaacgaacgtgaatgaacgagaaaacaagtggaacggatgtgaacgaacaagaaaacgagtggaacggacgtgaacgaacgatagaaacgatagaacgtatgttaacgaacgaacgagaacgatagaacgaacattaccgaacgatagaacgggacacctcgttaacgaacgatttaagttacatttatattagaacaatttagactaatacatttgtttgcattttactgaaaaatacatggtcaagcactggtcgtcaccgttgctcaagcctaagtggtatcaagccctcggaggaatttgctcaggcaagtgacattaacgatcaaacgtgattcaatattgttttgaattgtaacaatcgtttgtgcccaaattaaaattgttattacattgtaataataagttgtatttaacatacacccgacataagtcaatatatgattattagagtttaaaccaattttaaatcttggacgatgtaaattgttctcgatgtattgaagatccatataatccaattgttgtgtggcatatgttaattatgtatgattattagagtttaaaacaattttaaatcatgcttatgttaattatatatgaatattataatttaaaacaattttaaatcatgcttatgttaattatatatgaatattagaattttaaacaattttaaattatgcatatgttaattatatttgattattacaatttttaacaattttgaataaagcatatggtaaatatacatgattattagagttgttattacattgtaatagtaagttgtatttatcatacacccgacataagttgtaaataacatacgcctgcaaatatttcttgtatgaacaga

SEQ ID NO: 38645 - DNA, 1501 bp, Oryza sativa
atttttgaaagttagatacaagttacactatagttacagtgtaattacatgcaagttacagtgtaatacactacgattgtactgtaattacatctgttaaatttttggagaaaaatttgtcaataaatatttagcaaaatcgtttcttcaaactccatgcacacttttgtagcattagaaggaaaagaagcttatggcagtaggccgcgggccgcctcactgaaacaggcggaagcccaggatgcagcccaatagtactcgcgcagcaggcctcacggtacaaggtacggctggccgacgtggcgtgcgatcacacggttcgccatttttccggcccacccattgcttctgcttttcattttggaataagttcactttagttctctcaatttgtccttcagtctgaaatttgtcatgctggtatttctatcatgaatagctggtattgtgacatcccttaactcacagaaccatattaactttgatctctcgaaaatattgtgaccagttttagctgacataacaagtgtgacccacgtggacctcacatgtcagcgggccatctattcttcatcctgggccgaggctagtcgggctagcacgactcgacctacatgtcgggctaggccgtgcctgcacatgggctgcacgcacgacccaataagtctcgggtcgtaccgggccggcccgaaggcacgatagtccatcatgcttctccatataataagtctatttttccgtcctcatctctttatattgtgtcttatgtggctggaataagtctattttgtatccctgtctttaggcaatgccttatatattagatttgagtctattttggacccctcaactattttctcgactgtgcgtgccgcgctgggccggcccgaaggcacaatagtccatcgtgctcctccatataataagtctattttttcatcctcatctctttatgtttgtctcatgtggctagaataagtctattttgtatccctctctttaggtcatgccttatatatttgatttaagtctattttgggtccctcaactatttctcttcgaccgtgccatgccgtgccgggccagcccaccctgccaaggcatcggcccaagcacgggcccaacaccaatcgtgtcatgccgtgcttgggctaggccaaatggccgttcatgggctgggcgtcaggcctcggattttatagccatctaaaccatcctatgcctctccctcttcgttctctcttccccatctctcgagaagagtgcacagtgaggagatgggtagcgactggcgcgcgcggtggctggcagagccgacgacggaatcatcctgcgcttcaacatgtcgccgagggtgggttgtggcacggtgaggcgggaacccacggcttatcggacggacggcatggtcaccgcaccggcgacacggcgccgtggtggatgtccgagcacagctcccgccacaccagctcgagcgtttggagcgcgaccacgacggtgg

SEQ ID NO: 38646 - DNA, 238 bp, Oryza sativa
ttcagtaacacttgcattctgcttttacaaacttcatgtacactctttgaggaagtgcatcaaaataacacacttccgaatatcacagtgttatctaatcgatcttttctactatagtgctcgatctcctttagaaagcatcaaatgtatctcgtttttgtatagttagttctccttagacagagtctgaaggcagcggcggacgttattaatcaaatgttaattcgttgtcttaaga

SEQ ID NO: 38647 - DNA, 536 bp, Oryza sativa
gtccaccaccgcttgcatccacaattcgctacccaccgttgtcgccatccaccatacactggcgccacggacgcccctccgtccgccggcggtttgccggccggattaggccgacggctcccgatcctcatcggaatcggaggccggccgagcccggacgccattccccggcaccccgttagggagtgtacggctaggagagccatggggaatggcgatgaaggtgtggcggaggccgggacggcaaacggcggcttcacctgcatgacgacgagacgaggacggattgaagaagggcggctcccccgtgcgcgcagccagggtaccggttctgccggaccccagtagcgcgggagtgggggaacggcgtcggcgtcggcttggtgtcggtggaggtggtgaaggggcggtcagtggtggcggcagcgactccatctccagggaaaggtcacatggctcgccgggcagtgtcaccactgccgtccatccgtggtaggcgcagtactgcaccccctgcacacagatacggcgaggca

SEQ ID NO: 38648 - DNA, 175 bp, Oryza sativa
atgttttaaaataaagtctacaccattatattgtgtacccattaaattaacaatttaaaatttatattaactaatttacatttacactagaaccggtgaacctattatttaaatcatcggatctattgttaataaataagtgtccgaagttctccctttttggcctgctgcacaa

SEQ ID NO: 38649 - DNA, 1501 bp, Oryza sativa
tctcctcggcttggtgctgcaccaggcgtcccaggtcggcgagagtgtcttgagccgcgacgagctggctgaccaactccgcgccgccgggctacccgcctgccatcaactccttctcccgagcctccagctcggaagccctcgccgccatcgctgcgcgctcagcgcgggcgctctccagatgccgggcctcgcgcccagcgatgacctcctcacgcttggtgagttgctcgcccagccaccgcgccgccacctcgcgacggttcacctcggcctcatgtacggcaagcgcggcgtcctgttcccggcacgcctcctctcgaagccacagctcctccgcgcgacgagccaccaaagctctgcggtgagggtggtccggttgtgctcagctgcggtctcctcacggaggcgaagggaggattccgcctcggtggccgttctctcgtgggtggccaaggtggtctcgcgctggtctagcatgcgtgcccgctcctccagtgcccgggtacgctcctccagcgcccgagcatgctcctccaactcccgggctcgcagcccctgttcccggctacgcccgtcctgttcgcgctggttacggtcgaggacctcgatccgtcgacggatcatggcctcgaactcctgcatggagcgggcacgctcgtctaaggccttgcgctcggcctcgagcgccgcagtccgagcccgcagcgaggcgtcgacctccgatgcccgccgctcttaggcggccgccgcgtcgaggactccacgggcgtcttcccagatcctcggcgtgggcctcgtactgcaagcggatgtcgcccagcgtctcatccaggacgcttgaagcgatgagcgccgcctggcactcctcctgtctcccgcatgaccgagtctagcgtttcctcgcgcgcctggatctccgccagttgggcttggtgcattttgcgccccacctccaccatgtcgtccatggcgcggcgcccctcgtcaacccgcgtgcggtccgccgcgagctgtgcccactccgcctccagggccgcccgctcgtccgctagggcttgaacttgggcattgagcccctcccggacggtggaatcggcggcggcgagcacctgcaggagtggctccatgctcgcgggagttggagaagaaaaagtcgcggtccgcccccgggatgacggagtgctgctagaccccccgcgatattgggggctgctctcggccccccttccgcacggccagccctgaggacgccccagatgcagaggggaacggttgcccccgtcaccccccgccttgggccctcaggaagactcggcctcccgagtagcgctcctcgtgggtcgcgccctcgggatcgccctgggggggcgcctgtaacgtcccgccttcccccaggccaccccaggccgggtccacttacatctgatagctttcataggtcatagactgccctcacagaccaacacgccttcccccaggccaccccaggccgggtcca

SEQ ID NO: 38650 - DNA, 1501 bp, Oryza sativa
ctcgagtttgcgtgaatgtggaaaaactttgtgttggcatccccttctttcagccatgtcaatcgcgatatctgccttttcttcgactttgccactgctgctagccccaaaattcttagcttgaggtcattcctgagctggtgttcatcagtcgcttattatacgattgagttacggttataaattagagatacatagctggatgcatgagttggcaaaatattcagtagtcattgttacatatctaaccaacgaaacaaaaatgtacataaatcaatcacatgtttttcccccttttttttccctgaaaactatccacgcgtctacaccaaattaagttcataacctcaaggagtgatgagacccatggtggtttacagcgcgtcgcagccgttggaaatctgtgccagtgtcagcctgaccgcaacgcaaaagccggtaagaccatgcttgccagattgccactaatgctgcagcaccaagatgtcaagtgatcgatggacttgaactgaacgctccagcggtaatgctctcggcgactatttcttgagcgacatcttcttttcccgtggcctctcatttctatggcattttttttgttttcggtaagcaataacctcaagctgatgcaatcgtggaagtatatatatagtttatgagagttgttctatatagcatataaatatggtggaaatatgggaatgtgccacctgtgagtattcctttctcattttacatcgtctccgtttgttccactcttgcaattcacactaatgaggaaggcccagcgtacgaatgggaggacgacatatgaacggtcacaaatgcttagttaccggaatagcaacagtctcaacatgaggagttgaaatcttacgaaagaacagtggaccgacaagctacaaatgttgaaagaatagtataacaaaaagtcaaaaacttgatgagcagatagccatatatttctcaccttcgcctcttctaacggagtttctgttagatttaattgggtaatttatccatttaaatcaattaaatcaaataaatttcaaggctcattatgctaggaattcatgtgtattcattctcttatgggacatcaatgggacgaagaattttcagaattaatccatttgattagggaattggtaacttatatcaattactcctaattgatggatggttgatggttgtgtagtggaggatggttcatggctagatgatgacaattagttgctctattcctcttcctattccattgcattggtaacctacactaattactcctaattgatggttgattgatggttgtgtagtggaggatggttgatggctaattgatgagaattagttactctattcctcttcttattccatgactcttactcttcatcttccattcctcctataaaatgagaatggatttgatctccctaaggagaagtgagacacactttcatccatttccaaggctgttgctgctacggtaatcccatcccga

SEQ ID NO: 38651 - DNA, 1501 bp, Oryza sativa
gcatagtagggtttcatttgcataaatagcatttaataaacatttcagaatttaataaaatagttaagtagtaattaaaaaatattaatccaacgctatacaacatatcctgttgcataggcccaaccattctgaacaaccatcccggctgcacagttctatctcaaaaccaggaatataccattccaaaccaagagcgaatcaaattattaccagttatagcatcttttattatggtgagaagtgtgaaactaatcacgaaagacattgttagacccgcccataaccgcgggcacggctattcgaatagttttactctggccagaggtgtaccactgtacccacaagacacagccccacaacatgtcaccatgcgcctcaataccaccacggtacctcagaaaggagctgtgacagtacccctcgcacaacacaatccaccacagcgcaccattcctggatcataatcacccccttataaacaaggcatggactccccagcgacccccgtgggcttatctccgccacttctcagtctggtgccccgcaatgaaccatgctatacaaaaggtaaagccgttgcccacgctggcttgtggttggcacggttaatgtttcacaaccaaaactcgtgaaccggtccttaattgtcatgagcacgaccatcaaaaccatgtgctcacaacccaccattatcaggttttagttggcaaattaattaattaaccaatcatgattaaccatcatgagctatcattaagccaacattgaataatagtgagttataagttatcccaatagtgtgctaatgtttctaagcatggctaaacaatcatatctaatatctagctgaaccaatatataaagcccaactagtcaagttataataacccaaggtatcaaggaataaagtaatcaagaacaaaagggctataacaaacaataggttaattccacccaatgacattcgaaaataaatgcaatagttgaatagaaacaatagctttaaacgggatcaacatgctcaaagggttatttgggatctgtgtgacttgccttgctggccttgaaactcttcaaattcttctcctgcgaaaacggactctccggaaacgtcggaatctaaacagaaaagagtaaaatcaccaaaacagcacataaacaagcatgaacagtacatgtggatatttctaacatgtagatctcaattttagaaaaatttagagacttgaaccaactaaatccgagctaagatgaattagttatgaattttaaaagattaaatcggattaaaacacttgtatggattttaattgaattatgacgcaataatgaattatttttgaaaaggaaaagggaattactgcgtcatcggctagggttcgcgatggactgggtgcacggcgacggctcacggaaacgaacgaccgagaccgatccatccaaaaacgaacggccgagatctatcggtccacgacaggcctacgacggatggcaacga

SEQ ID NO: 38652 - DNA, 467 bp, Oryza sativa
cagatggtgtggatggctcggccttgcctcccggcaaagacaagaccgtgtcgtcattggcctcgatgatggactgttccgtaggatcatccccatctccctccagaccatccatatggcggttatccatcccatagtcatccataccaggagatagttggcgggcatcgaccgacctacgggaaggaccaggcgagcattggcggcgcctttgcgagggtctcgacgaggttgacctccgacgagtatcgccccacatttttgctgtggaaaggaaataactatgttgctctgtttatttgtggtgcatttttcttttatgataggaagaagaagaggaggaggaatttataaaacaaattgccctcatgagctagttgtttctcgttgctcttgcacacaacacacaacacatttgctgcctacgggctccacagaggcacatggcgcagccaatcgcctcacca

SEQ ID NO: 38653 - DNA, 1501 bp, Oryza sativa
tggattaattctgaaaattcttcgtcccattgatgtcccataagagaatgaatacacatgaattcctagcataatgagccttgaaatttatttgatttaattgatttaaatggataaattacccaattaaatctaacagaaactccgttagaagaggcgaaggtgagaaatatatggctatctgctcatcaagtttttgactttttgttatactattctttcaacatttgtagcttgtcggtccactgttctttcgtaagatttcaactcctcatgttgagactgttgctattccggtaactaagcatttgtgaccgttcatatgtcgtcctcccattcgtacgctgggccttcctcattagtgtgaattgcaagagtggaacaaacggagacgatgtaaaatgagaaaggaatactcacaggtggcacattcccatatttccaccatatttatatgctatatagaacaactctcataaactatatatatacttccacgattgcatcagcttgaggttattgcttaccgaaaacaaaaaaaatgccatagaaatgagaggccacgggaaaagaagatgtcgctcaagaaatagtcgccgagagcattaccgctggagcgttcagttcaagtccatcgatcacttgacatcttggtgctgcagcattagtggcaatctggcaagcatggtcttaccggcttttgcgttgcggtcaggctgacactggcacagatttccaacggctgcgacgcgctgtaaaccaccatgggtctcatcactccttgaggttatgaacttaatttggtgtagacgcgtggatagttttcagggaaaaaaaagggggaaaaacatgtgattgatttatgtacatttttgtttcgttggttagatatgtaacaatgactactgaatattttgccaactcatgcatccagctatgtatctctaatttataaccgtaactcaatcgtataataagcgactgatgaacaccagctcaggaatgacctcaagctaagaattttggggctagcagcagtggcaaagtcgaagaaaaggcagatatcgcgattgacatggctgaaagaaggggatgccaacacaaagtttttccacattcacgcaaactcgaggagaaggaaaaaccacattcaccaactccatacaacaagtgctatcctgacagaacatgaggaaaaaagtgacgcgcttttcaaccatttcaactcaatcctaggcaacaaggaggcgtgaaattgcaccctaaattggaacgcgatggatctaccacaggttaaccccgatgaactagatgaaccttttacagaggaggaagtttgggccgctttaaagcagatgccggcagaaaaggccccaggtctagatggctttaatggtaccttctacaagaaatgctggcagctaattaaacaggatatcatggatgttttccagtgtttgtataacctgtcaggatgaaactttggagcactcaacagagc

SEQ ID NO: 38654 - DNA, 1501 bp, Oryza sativa
cccagaaattcctgagtagaattccaagcagaatgtgcattaaaatccccgtccaggaccggccggggtacacaaacgacaatgttgacattcagatccacgtcttacaaacatcataaaagtcttacacaaatgcagcggaagaaaagaaagacaacaggagctaagccttgactagaactgcagcgggaccaccactccacaggcatcctcgacggcacggacaaagcctactcctcggagaaaccttcatctgacacatactcgagctctggggttgggaaaaaaatagagcaagactgagtactacccactgtactcagcaagtcataccggaataggggtatgatgcagggaattatcaaagaagagctggagtggttcatttgcataaagcgagcatttataaacagaagttgaaagattaaacagttgtaatatttaattagtattaactatccactgtccaacgttatcccacgttgcaacaggcccaaccatccacctaaactatccaaattcaaaagattacactagggtgagactaatcacggtgaatctggttgaccgcccataaccgcgggcacggctattcgaatagttttactctgatcagaggtgtacaactgtacccacaagacacagccccacaacacgtttccgtgcgccgacatgccaccacgacatatccgaaagaggccgtgacaggaccctgcgcctaacccccttagccaagcacaccacacctcaggtttcacccccgtccccagcgggcaacgggcagtcccctctcgtgcctaggtgaatccggaagcgacagaggccgtcgcagggcccgccccgctccatcacgcccacccttgcctggatgcgtcggctagaggagagctacactacaagcccagccgttgcccacgctggcttgtggtaagtacgataagttcttccagggcatcccgcgaaccggtccttaactgccatgggtgcgaccagcaaaaccatgcacccacagcccaccatgtgatttattttaattaaccaacaccaaagcggtgtcactaaaccaacaaaaccattagaaccaacagtctaaacattaataggattttccccattgtgcactagttgaactaagcatggctaagcaatccctagtccaatctctagtcatgttataaccccaagctgacaaagggacatggtacgacagtagcatggctatgacaataggtaaccatcccatagtaacattataaaacaatgcaatatttgaaagaaaacaatagagcatttgcaatataggatcaacatgttcaagtgacaagcatgacttgccttgctctgctgctggaggaatctcggcgactatttcgaagtacaccggagcgtcggaggaaccggaatctagcgacatacaaggcaaacattgcaaacaggctataagactactgaaacaggggacaaaaccatttttaatggattctacacatttttcttgatt

SEQ ID NO: 38655 - DNA, 1501 bp, Oryza sativa
cgtgagccgtcgccgtgcacccagtccatcgcgaaccctagccgatgacgcagtaattcccttttccttttcaaaaataattcattattgcgtcataattcaattaaaatccatacaagtgttttaatccgatttaatcttttaaaattcataactaattcatcttagctcggatttagttggttcaagtctctaaatttttctaaaattgagatctacatgttagaaatatccacatgtactgttcatgcttgtttatgtgctgttttggtgattttactcttttctgtttagattccgacgtttccggagagtccgttttcgcaggagaagaatttgaagagtttcaaggccagcaaggcaagtcacacagatcccaaataaccctttgagcatgttgatcccgtttaaagctattgtttctattcaactattgcatttattttcgaatgtcattgggtggaattaacctattgtttgttatagcccttttgttcttgattactttattccttgataccttgggttattataacttgactagttgggctttatatattggttcagctagatattagatatgattgtttagccatgcttagaaacattagcacactattgggataacttataactcactattattcaatgttggcttaatgatagctcatgatggttaatcatgattggttaattaattaatttgccaactaaaacctgataatggtgggttgtgagcacatggttttgatggtcgtgctcatgacaattaaggaccggttcacgagttttggttgtgaaacattaaccgtgccaaccacaagccagcgtgggcaacggctttaccttttgtatagcatggttcattgcggggcaccagactgagaagtggcggagataagcccacgggggtcgctggggagtccatgccttgtttataagggggtgattatgatccaggaatggtgcgctgtggtggattgtgttgtgcgaggggtactgtcacagctcctttctgaggtaccgtggtggtattgaggcgcatggtgacatgttgtggggctgtgtcttgtgggtacagtggtacacctctggccagagtaaaactattcgaatagccgtgcccgcggttatgggcgggtctaacaatgtctttcgtgattagtttcacacttctcaccataataaaagatgctataactggtaataatttgattcgctcttggtttggaatggtatattcctggttttgagatagaactgtgcagccgggatggttgttcagaatggttgggcctatgcaacaggatatgttgtatagcgttggattaatattttttaattactacttaactattttattaaattctgaaatgtttattaaatgctatttatgcaaatgaaaccctactatgccatcctttgttatcctgtgcacttgcatatttgctgcgtggcttgttgagtatgtcatatactcaccttgcaatcattcatcaga

SEQ ID NO: 38656 - DNA, 774 bp, Oryza sativa
caaggatgcaacaccggctagaggatccagagattgccgatgcaccggcttgatagaagtttgtccagcaccataaactttaaaatcggagatttagcctcctaaaccgttcaaattacctctgagttactttgatagtggttttgttttttttttttttgagagggtacaaatcagaacgcacacgaacacacacaacactcacaccacaacgcacgcacacacgcgtgcgcgtccctaacacacgttaggaaagagattcgaggacctatgcctcactgtacgggaaacatacagtaccaccgaacacgcacgtatatgtaccctattacctaactaggaccaaccgaagttgactcaggaaacgggaaaaacccctgtgaggtccgtgagtcgatgagtggtcctcaaatcttaaacaagcagttttggaacataccaacagagctacgctcaggttttggataactggtatggcatgttcacatactgtcaatcatcggttatcaatttatattctatagtgatgtcatatcagtattatattaatcatccatttgtaagggggaaatttgatcgaacccgacccgtattcacccctttatcacataatcatactcatccaacgattatgtaaattaaataaaaactactatgcaaaaccattttaagtgtaatataacatctcataggataggattagagttcagggtgctgcatccacgttttcaaatcatagggggcatttggacttaaaaaaaaatgaaaacgcga

SEQ ID NO: 38657 - DNA, 243 bp, Oryza sativa
atgttgacaagttatgatccaaggctaagaaaataaattctaattaaactggtagtctcttgttacatatcttttcgacgattcgttgtacgtgctgcattttactgtttcgctgttgcgtgtttcaccccctttgtttggatgttgcatcaattatcttgcacggatctctgtacatattccacaacttctacacaaatgttatacatttttcgtagtgatgtttcatgtcttatttgagaa

SEQ ID NO: 38658 - DNA, 178 bp, Oryza sativa
gtggttttacaactctagactttgggaatattctcatcacctggacaccatggaatggatggattattgtggaattggattcacacctccccctctattcaaaaccctcaaaatggttttaggctgggctcggggtgcatggttttgatagtagcacctcggccatataaggaccggt

SEQ ID NO: 38659 - DNA, 583 bp, Oryza sativa
attgctttgttactgtgaataattaggatcatgatgcatttgtctataagcaaggtgctataaaattgtactttttgaactagccataaaacttcaaaacaatcatgactttgtaaaaataaacaagtaatttcagataatatctatttcatgcgtttgttttggcaaactatgctgatttggccagaggataaaaagtttcaacaaataacatacatgggacctatttggggtagcttatagctgctgcagcccccaaacagtccagattgttacccagattctgagaatctgtaattgtagaatccggaactagaatccagaagctggaaaacccagcttctccagattctcggaagctagctactaaccagcagattcttagaatcttaagctcccccaaatagggccatggactgctcttatttatttttatatcttaagttgtcttctcattcctgaatcaggagatccaactgaatctctaatcgaacgtaactgttgtgccaactctatttagcatgaaaacctaccatggtagtttcgtatgacatgcaaatttaatctgatagtgttttttctt

SEQ ID NO: 38660 - DNA, 331 bp, Oryza sativa
  unsure (1)..(331): unsure at all n locations
cgcgtggtttgnattagtannnnnnnnnnnnnnnnnnnnnnnnnnnnnnctttttcccctaaaccccaggacagagagaaaaagggggcctctaactccaagttaagctccagtcgaaaggtcttcacatagtaatgtttttgcttaattaaacgcagattttacattagtttccggtagcatgtctttaagctactaaacaatatgtttcataaaaaactttctatatagaagtcgctataaaatacagatataataattaaaacttaactaatcatgtgtattaatagctttcttgtttacgtaatttccgtctttatttctctttaga

SEQ ID NO: 38661 - DNA, 1501 bp, Oryza sativa
tattgagatttattcgtcagtcagttgggatttgatgggtgaaatgcattaggtcctagctcaggaacatgggttgcaaggtatttatgttattagtgttattatagtatgtatgtaatttccccactattttatcgttatgtgagtctgtcttctttattcgctctcatgcaaaatgatctatgcataaaatttcgctcttattcgattctcttattgagtcttttattgctttatttaaatttggatttgagcatgcattgatcctactcctttgtcttctctagatggccggccaccccccccaaccaccgtggagaaggcatgatcgactttgtggcagagttggcacgcatgacgctggtggtgggctaccccaacgcgccagagtacacgactgttccaccactcagtggcgagcttcctcaccgtgttcgcctggaggtccacggctacgtgggtacctgtctagctaatatggtggttgaggcatccggaggcacagcagatcacgcctgtcaggaggcaccatacctgatgatggccagactacgggagcgccacaactacatcttccacgacacggcgtaccgatttcacccttgtcgagccagcggtggtgatgtcagtactttccgtccgacagccggcgagaacgacaccacctttggtcacatgtgtgctgtgatgaggggattggataggatgcactcggacctgcacaaggcgaccaaggccttgaatgatgggaagctcatgaggatcgtcgctctgaaggacgagatagcgcgcctgaagagggagaatgctcagttaaagagtcttcccgcgccaggaggagtccggatccgcactacaccccgcaagacgacgacggcacctgtgcgcatccagcctgcgcccaggaacccacctccgcccgcagttcccgcacctccagttccgcccgcagctccgacagttcctgcagctccagcaccagctccagctcctgttcacgtgtcagctcccacgtccgctctctccttcgctccagcatcagctgccaggggtccagccagtggcaacggaggttggttgtctgctactcccagtggcagccgcgatctcagcagcaacagctccagtagctcagagtcgggcagcggcgagacttatctgccaggctccaggagtcgctcagagggacctggtgacgagcaggaggacgccttcgactccaccgaccgcaggagctgttccgagcattaggctcgttttccattagtttatcgactgtctagcttctgcttgttagtttgtgtgtttaggttgcttgtttgggatcagttgacggtcgatatcatgtgcctctgatatggctgtctaaataaggatttttgcttgctctttaagtgttttaattcagatcagaacaattgcagtttaaattcctatgtaataaagcttagttcctgagcatctgtttttcttctttcccccgtctgcttttccctccaga

SEQ ID NO: 38662 - DNA, 250 bp, Oryza sativa
gcatattttgtacccacgaacattaccaacacattgcagcttacattttttttcatgctttctgaagtaacacgcatttttcactttttacagtcgtagtgaatctgctaatgagttctttgcttacacataagaagacccgaaaataattgaaggatcagtgtatggcgtcaaaacagaaagtaataatacagattgatcctaggtgggctcaggccctcccagtttgtggaagtgattccctgcatta

SEQ ID NO: 38663 - DNA, 1501 bp, Oryza sativa
catcgtgcatctgtagcttttggtctagggaagcagctcaggcttcgttttcaaatagggctttcgactttggaagcagctgagttatatgaacaagttaggtgagcttctttttctacactctaatcactgtgttggcttgtcaaatgaactgatttgtggtgcaaccgtgcaagtgattaggttcaacttactgaccgtaaggtccaccactacccgtcctaccatttcggaaatttttggcactaaattagttaaaatctacagaactactattaggagcgcagcattccgagcgccaaacatgcatcagcacagacccaccccaccctacgtgccgtcatcccactcctaccgttgtcgatgtaaatgatttactcctatcgcgggcctctaccacttacctttattcgagtaaacgatttacttcgataataaaaataactttcttgctttcgatcccaccccacgtcccgcatcgtgttcccaccattatcggagtaaatgatttacttcgataaaaaacaacttctctgctttcggtatatattatatttttcccgttcccaaccaaccactctcgcccctgcttcatttttttccttttttttatctgaatcgatacaccaccctagcccacagattggcaacacaccctggaggaggacgacgacatcgtggcggttgatggcagtggccggcggtggttgaggcgacggcactgcttcgggcctcgctgtcggacactggacagcaccttaaccagtaaggaggtgttcacctaggccaaatagcaataaccagcggctgcttcacgttggcgacattgatacaataagcaagtaaggaactgacactctgatttggatctgcgtgctctccttcaacttcacgcatgaagctttttttttttgcaaatcaaattaacgtgcaatctctaatattaacttatctcaattgatgggttgtacgggtcctacatttgcacatcgtgctccatgtggctggtcgcagaggatagggtggagtccgccggtgatggaggttgtttgcaatttttcttttgctcgtcatctctattgacatgaacgagagtgtttttgcttttttttttcgtgcttgctagatgatggatggctgctactacacaacgtcgagctcatctctagaccacaccgctacatccttccacgattctatcgtcgactactgctcgtcacatggttgccctctccactaccagtcccaagtcacagaccatcctcttcatctttatagcaagatccagcaaagccacaggatggatttttgactgaatcatttttttcttttctagtttgattcacctgtgagtgattttatcgcttgtgtgtgattgagcctgtaattttttcattcatacgactattttgtgatacagatcaacaatactcttagtataagtgtcagggttacggataaggtataccctctaccgttggatgtacgctatacggcaata

SEQ ID NO: 38664 - DNA, 447 bp, Oryza sativa
agcccctggaagataaaggctttggtgtctagctcgtgcctgccgtcaagcgcctgtggtcgtcgccctagtctttcgctgcttttcgtttatcttcttgtgtgctgggtcttcgccgcccatgtaataaattaattaattacgcttccgcttgttaaactctgaattgtatcaacttttggtgtaccttgcctcctaggacaaggaataatgcacgcacgtaaggaacgcccgttgggttatttccggtcgtaacaagttggtatcagagcccccttgaccctaggacgagccttagatcccaagccttagcaatatttttgaaataaaaatcctttcttatttgtgaaaatcctctagtctctctctgtcctgctgcttcatttatcgccaaaatctaatctttaaaatgttgcttttctcttttgttttttttgtttgtagacg

SEQ ID NO: 38665 - DNA, 452 bp, Oryza sativa
cgagagaggcagtatgtgagtcctcggggccaggcccgtccctcatcagtgatggggttttgttgcggtctgtccaagataattgataataggccacaacgaaaatccatcaccgatgagggtcatggtcatcggtgacgggccaggtataacagcctgacaaaaataactgtgaagcccatcatcgatgaaggttgatctttgatggggtttgcttgtggcccattactgataacccacagtataaataatgcaagaccttcaaggaattgttatcccaacctagtatgttgttcacacttcaggacagatggctagaggggatattttttttccttttaatttaaggaaagaaacaagatgcttccaaggtaataataaataaattacaactcaattttcgtataatacatagctatagatattatacctgttttttcacaatttgaaca

SEQ ID NO: 38666 - DNA, 255 bp, Oryza sativa
tattaatcatagcacttaacgtgggccaatgaaatttattagaatttaatttggtctacccattaatctaacaggcgcaaccacctacgttgcacagcgcgccctcgcgtgcggtgagtccacatggcacgatagggtagcatacgcgagacgggttgcgatacatggaaattgtgttgcggcactcaacaggagcagcgacggcatgtggttttttttttttttttgactcctatgtggttttgttcgggttga

SEQ ID NO: 38667 - DNA, 1501 bp, Oryza sativa
tcgctagctactttctcgcaaaaaacatgtacgggagccttagatcatcaagccatccctaatattcgcctttttttatattgcatcaagaatatccccccaaaaaacggtggagcaatctgaaccctgaaagaaagatacatacaaagattttagtttacatcgacactggtctcactaccaaacattagctaccgaaattggaaaaccaccttcatttcatggggacaacatgatctctatataatctgaaatgaacatggcccatgcccctcttccttcacttctgtgtctcaaggaacctatatatgatgttgttgctgaattggaactgctgataagtaaggtgcgtgtttgtctactttaactacttgcctgttttccataattagcagacaacaatgttcttgagctcttccatcaggagcctcctgcagttcaacattcagaatgttagaaacgagtacttcaggtgtactgttgtgtaatttatgcaacacaattcaatttgttactggagaccatagttttgcttgttttcatagaagttcacaccgaatcaattataagctgaatttccaaagaaaaaaagggtgaggaaataatgcgctaactggttgcggttccctcttataaacaaccttctatggtttggggatgcaaatgttctgaattctaccaaatgagtaggctgaacataattttgagtatccgtgatcatgaagaagaattcagaatctgtctcatgcaaaacttgcttcactttcccttttacagacaacaaactgaattcatttgctgtgggacaggatatatctgtcattcagttttcaggtggcaaaaaaaaaaaaaacaaatggtgattgagcttccctttgacaatcaatacaccaccacagaaacagaacagccacatgatgggtcttcctgttcttcccagcagcaactcagcttgtacaactacagccccagcgatccgcagctgttttcccagccaaccacaggatcaagaacgtatttgtcaggtgcagtcaccatccctgggatttgcaatgacaaaagtaatcttggacaacaacaatttcagattgatgcagcgcttagtctagggtaccagaggatcagatcaagcgatgccctttgctacataagtcgggtgctgatggaggacgtcgatgagagggttgacctgcaccaaggggaggctgctcttcaggctgcagagaaacccttctatgatattcttggccaggtatatccaccatcgctaaaccggctagcactccatagcgcaaatgaaccagatacgcctgatgagagcagtagcagaaacaattatcataataggtaccatagtagccattccagtttcaacatgttacagcccttgccaaccccattgagtccatatagctatggcaggagtctttttcttccaaaccaacacttggtaagcactgcctggacttctacctttggcatccctggcttccaaattaga

SEQ ID NO: 38668 - DNA, 463 bp, Oryza sativa
gcgtagatgtcgttattcatactgctccaacgatgcagtcatgaaacctacaagtctaaaagacatgttttgttgattttggttaggcgtagttgcataacacattgcaaagtcaaggtaagaaaaactttacttacgtggatttcttcccaattctaatcatgtgagataggatatctcatacggagtacagccaccactacaaaattgatttttctggatgagaccctttttaggttgtacacggaccataactgcttccgcctacaaaaatccctcccacggggtcagttcaaagcgttgcatgcaaaataacatttgcatgcggcctcttaagagatccacctgtaaaaatggactaaccttttcaggcgagcctcctaagtggccacatgcgaaaatcagatttttacagacgcctccttaagaggtccacttggaaaaatcactgcaaactaaatat

SEQ ID NO: 38669 - DNA, 1501 bp, Oryza sativa
gttttgggccttataattgtgtcgtgggcttagcctaagggggtgtgcaccctagggcaaccctaggacgtccctaatcatatttatttggtagccgtcatcgtttagactcgggttttgcttagattaatttgtcaagaacagtttcgtcgctagattagtttgtggaaccccaaattcgagtgcttaatcattcatatgcaattgtgttgcaatctatcttgttcttgcttgtgttctttgattcaaatgcagggattagccttctcggtgaggttaacctggtttcggcatggttgataaccagaggagacgtggtgctgcgattgcgggggctcagtaacgtgttcgttcagaaggcggatcgagttgtgtcgcgactccacccaaatcgactttttatcaatacctatcggaagatcgggacctaacatcctcatcaaatggtgtttgatatttcgacgctcttcagttgtgtgggacgatgacttgccgtggtacaaacagtatttgtccttcttgcatttctttcttggcggcaagccttgttctccccccttacttggcattgaagttttttttgaaggttctcgacttcttcgatagttgttataggcttgacttgtctgttcaaaatttttgccatgccattgggacctaagccggccttggttgacttccgcttgcttcttgttggaccgctttggcctgaactacagctttgtcatactgggcttatatttcgacctggcacttcgtatcctattcgcctcgcgtgtacctgtcaatgatatgaaaaaggtggccgatggtttggggtttctcccagtgattttccacgtccgttagcttggtcgaagccctgccgaacggcatttatgactgaaacttctgtgatgtcttggacttggcatcttgcttgcgaaaatcttcgcatatactcccttgtggattcgctaggtttttgtcgaattccgaacaggtcttgttgggtcttgggttcttcatacgtttttacggctgttaaataccaaatttatgccgtcaattaatacctgcataaatctaaaaatataaaacatccaacatagttgtagggtttatttctaacaaattccatgagtgttggtgtatatttggatgcaagtgataaactaccaaaattgagataaaggaggggaagaattacattcatatccaagccatggagttttgggcccacaaacccaacgaaataccagaaaatggacccaaccactatgccactggaccaaggacccacctgccagggcccaggagaaaacccagggccaggcaggggcggccgacccccaggcctgacccatctggccttcaattttcacatgccggtagttaccgactatccaaggcggttgtgaccgtttctaccggaagaaaccgccattgagggacacttggtagctcaagagagaagttgctcctttggatgcttagcatctccacactccgaaggcacctc

SEQ ID NO: 38670 - DNA, 1501 bp, Oryza sativa
tgctttctcttttgctgcccaacccgttgaccgtttatgaaatcaccaaactactccaagctaaaagaaaatagtgtacagaaaccaaataaaaaaggtcaggaaaagctaaaagagcaatttaaattgtacaattacctaaaaaagaaaatgctaataataatcttactgtagtagtatgaatgcaaaataaatgtgggtgtgtaataaagcagttattatcagcagttaatagtttcacggggtacggccgtactcctcctcctcctaccatacgttgagccagtcagtgagtgattggtggtggccccgcgatggcagtgggccagctaccaatggttggagggtattatggtaaatccgcgcgtggagacagcgatggacggacatggctggtcgtcggcgatccaacggcgcatgatggcggtgcggtggtgggctccgccggcgacgacggcgtcgtagcgatgggttgtccgcgtggcggtgggtttggttgacgacgacttgtcctcactgatgacttgaccaaacaacaagcttagctaaaagctgtttagctctagctgtgtccagcttactgcttgcgctgatgtccatttctcatggttaatgcttttgcgttttcttctcctttggaaacagtcaccccagtcaaacgttttccgtcgagatgtgcacgtgcattcattccgaacataccacgaaatttcatacttttactacaaacagaccataattactactcctaggttaattcattttttctttttctaaaaaagaattgaactttggttgcaggactaattttatggattttgcttatcattctatttaccataataagatactcatatgttccaaaattcaagcattcatgattatgtatgtagctagccagagcgatttggaacggaggtagtaagtaaaagttattcaaaactactttttattattattatttttaaaaaggttaaatctttaaatcagatgctatgctaatcaggcaatctcgtgtttgaaatttgcaaaagaaaaaagaacaaaaaaaaaaaagagagagggagggaggaaatgaggaaatgcgcgtggtttgggaggataacggcgtgaggaagcaaagcaagttgccaacttggaacacaagaaggacacaaagctctctctactcctttttccactcctcttcctcctcgcgacgcgtttcctctcctcccctttttttctcctctcctccgcccaatctcccaccaccacgccgttcctctcctcctcctcctgctgctgctgcggccgcgccgccgagcctcggcaaccaaccccctccaccaccaccaccgccggtagaggaggcgaggtcaacagcaacaacccaaacacaatatccatcccttcttgcgcgcggtggtttccgggcagatctgagacacaccaaacaaaagaaggtctcgatcgatggcttcttcctccccttcctcctcctcctcccccccttccgccg

SEQ ID NO: 38671 - DNA, 1501 bp, Oryza sativa
attccaaattgagtacaacttcaagcttattaattcctgagtttggaattattgaattaattaaaacgataaattcaaactccaccatgacaacaaataggtagtgagtaattcctgattttcaaattattaattagattatgaaatgctatagtggacactgcaaaccaaactgaccacaatccattatgtaccaattattaattttagaaaaaaaatcatgaaaaatctataaatcagagtccaagccatgtacaactcaatacttattaattccaaattttattcattagattaagaaaagaactaaatcaagaatccaatattaagtaaaggtattactaattaattccatcttcgcaaattattaacctaagaatatgaaagtaacaaatgagatgatagctaagatgtattatatatatactttataatagctaatttgaattttgaaattataaatttgaaaaatcgttatgtccttagaacaatgtaataattgtttacatactattaaaatttatctctatagtaattgggcattgcgagtcagctgccacattaaaaaaaagataaagacatgattaagtgatcatatcatcgtgaccgtatattatatactgagaatttgtattgcagataccgtgacactttatattagttcccttttctttctaaaattttgaattaatgaacataaattgtatctatttgaacttagttaacactttcttagttaaatttttgaatgcaaaatttgtagttacaaatagtgactaacatggactatttttgcatcgtaatatgctataattttgacaatgtaatttccgaactaatttgtgcattaaaaccctcatccaggaatcagccgaggtacacaaactgataatttaatgtacagattcatcaaaataactaaaacgataaatacttacataagaggcacttagtcctcaccatgaagaaaactgcagcggaaaataaaatctagcgaagcttcagctccactcccacaggcagcacaactgggatctaagccaaaggtcttctccttctggatcctttttcttcaactgaggtttgatgattattgcaagaatgagcatatgacatactcaacaagccacacagtatatatgcaagtgcataagaataccaaaggatggcataatatatggttcatttgtgaaagcagcatttagcaaagagttgagaatttgtaaaacagtagagtaattaatcatcaatattaatcagcactgaacagcacacccatgctgcataggcccaaccaaacctgaacaaccaaccctggtcgtacagatcaaacctccaaaccaggaattatccattccaaaccaggagtcaaattaattatcacattattatcattaatgagtagtgtgagactaatcacgaaaaatattgttagacccgcccataaccgcgggcacggctattcgaatagttttactctgaccagagatgtaccactgta

SEQ ID NO: 38672 - DNA, 1501 bp, Oryza sativa
cacatatgtatgtgggtatgggtgtgatgtgtgtgcacgtattcggtgttatgaaagaaagaatgcatataagttttacttgtcagtttcaagtttctaagtaattaactttgcgtcaacattatttgttgttgcgatttttttaaaaaaagaagcactatatgaatttgtatagaaatagagaacaaaatgaaaggaaagaagtagcgtgagcttatagtgtttcttcttgtagaacctgttgactcgggatttaagttacgactacttatttgttactaggggtgaaaagaaagctcgggttcgtgagcttagctcggccttggctcgagcttggttggcttggctcggctcgtaagccaaacaagccaagcccaagcctcctttttagctcgttgctgaaatgagccgagccgagctagctcgcgagccgcttgttttggctcgcgagcctaggccatcgtgtgtttatattgattattttactttatatagtgttattatttgtcaacttgaaatttatcactaagattttgaagaattgaatataaaaacttatttaaattttacatgttgatgatttgtttttactttttttcaataattacaaaatatatatgaataggtgtttcaacaggaaagcttgcaagccagctcgagctggctcgagccaggaaacgagccgagccgagcttaagttttagcttgtttccctaaccaagctgagccaagccaatcctagttttttgcgagccactgcaagccgagccgagccaggcttggctcggctcgtttccacccctatttgttactgatagtctttcttcggaggttcaggtgcttacagaagatgtgtgtgcgtatgtctggtttcatagcatcgtgcttcgtagaaaaatagagtaaatttcataaaaccccatctattatgatccaagttgtataaaaaccaaaataattttggcacgtgatatataaccttgggtattatgattctatagttttacaaaatcacacctttaaccattttgatttacttttatataaaaatttttaaaaaacggatgtaacatttatatgatgggataaaatccttataatttgagatatgattgtaaaactcaaaaatggtattgcgaaacttaagaaccataatacctgaggttatataacacatgccaaaatacttgtagttttgtgtaacttagactataatattatcggcggagttttatgaaatttagtgaaatgaaaggatggtaaaatggaacgcagggaggtccggcccacagggacatgcggcccagtaatagaagaagtcgattaggagcagcgggaaagcgataaggaaagcgacagccatagccactcgctgcgcctcctcctcatcgcctcgccgtcgccggagaagacaaccatgaccaccatcgccgcgcggatgccgtttgcgggcccacgcctcaggcctccctgcaacctcaccgcctcgaggccgggtccc

SEQ ID NO: 38673 - DNA, 1501 bp, Oryza sativa
gagtaaggttccctgtgataaataattgttcacaagtgacaagtgttagcaaggaataaaaagtatgcatgattagtcataggaaaattttatttgttgagacttaatggtttcaatttttatttggagttaaactaaattgtattcaatttttctgcgaaagtttaactcacaaacaggtgaggagatgcacaaacctgaccacatggcaaaggggtgacagagctgggccaggcaatggtcggacgaacacttggttcggtcgacccatccaggactcagttctggctgctaaattttgtgcgtggccgtgggcctgtgttcataatattgacatgttgagttgatactgttgcatgtcaagagttccaaaaaagactcccccacacttattttgtaccttatcttcattcaacaaaaacatagaaaaagaaataggctacaaccggggtgaaataccggtgagccaaattttattcaagtaactctaggcgtatgaagtacctaaatttactttatttttattttagtttgtcatatcttttttttccatggaaatcatggaggtgatgggtaacttaacagggtggagatatgatgcacaaggtgtttgagattcttactagataggtcttaccaagctttaaaccaaatgcaagagttaatgcaacaaagctttgcatttattttgcttggttcactgagcatctattttcccttgaggccaaggagcatggtatttgtcagggttatagataccacatacctaattgagtcgactaaatctcggcaggacccacaacataccatgtcttatacggaaacgaccttcggatataggaggagttccgcataaggaaggatgaatagagttctgcatggaaacgacaaggactactcggattgtatccatattggtttccctagttctatttggacaaggggacacctatgggtataaatacaaggccccctaggaggagaggggacacggaacaatagatcaagacagaagatcaacatacaagccaacatacgccaagacaagacgccagatatcgacttcagagatagacatgactagtcccctacggtgcatatggctaccgtcaggagagatatagcgttgtctctgatctcgccggatgcggattcgaggaggaaggctatcctgttgtcgactatgagtcagtactacagaccgccaagtcaacaacagttagataggctaccctaaatattgtactggtgtaattatggtgaataagagcaataccggcttcggccaacaggatgtagggctattacctgacaattcaggggcccgaacctgtataaaaatcttcgtctccgtctcttttactacaatctcgcatatatcctagtaccaacgatccccatatcatgcaaataccggaattgcgacatcagacgtcgacagtggcgcgtcaggtagggagattttggtgcttcagagtttaaacgagatgggtttaagaga

SEQ ID NO: 38674 - DNA, 394 bp, Oryza sativa
gacctgattcttgtgaacgaagtggcttgtgcaaaattatttatctgataaacgaactatagaatatggtggagatttactcagtttgtgaacgactgttatgtgatgacccatttatgtgggttcacatgtgctttaaaaccttatttttcagctggctgtttcatgtgctctggctttcaattgttcaactaatgttatacctttgatttcatttctctgcatttttttattgtctgttagttcttaactgtaccgcattctctcgccctctgtgtgtgtgtgtgtgttttacaagttattactgtggtgcatgactaggaactttagctgttaaaagaaccacaggttagtttttttttccttggtcatcattagcttttcctgtctcagg

SEQ ID NO: 38675 - DNA, 1501 bp, Oryza sativa
ctgcggaggtatgcatggttgatttggttatagagggactttattaatgctccatctttcctaaattgatcgttataaaatttaaaattatttaaattgatcatcatataaccacatggacacggatttcatcagaatacaattaatgcagcatgagagaatatatgcattctaaggtgtaattgatatggtgttttaatcgatgcatgtattgtggaaaaatgtgtgcatgatatttagattgatgtgatttaaattatctttgtcttggtgcagagtatgatgattaatttggaaagaagagagtaataccgaaacaataggtcaatagacttatttggtttagtacttatctcttatcaatattttaatagaatgacattgcaaatgagtgtgtccaattgatgctaattgagagtcaaattctatactatgattttagtcttaaacattatcactaattctatctcacattatgaccatgtttatattttaatagaatgacttttttagtatttaatgccttatgacagttgctaacattgtatatggctactcgtaagatcttatggctctttcttatagcacattgtagatgtcttataatttattatcaaccatttggtttcaaaccaaatcatgatatttacttttaaaattacaaaaataaaataattgggcgtgttttcgtatcaatcctctatacatgccaatgtgcaattcgtacaagtacgtgaggattgtggctaaatgaaaagtttgctgtgatatactccatccgtttaaacatatttgatgttttaagataaaattcagatttttttttaaattctgaccatcaataacttcttaaatgcttagtttgcaaacaaaacaaatgatatgtatagatttgtgccaaaaagcactatcataattatgtaaacttatttcagaatttgcagtgtgaaatttgagattataaatgtaaacttatttcagaatttgcagtgtgaaatttgacattataaatgtaagttttctaatttacatcgtaagacaaaactgaaatgttttgtgataaaaatgtgatgtcataattataactagtctcgcacatgtacttatttgttgcctttagtttaccctcgtgcctagctagggatgggccgggcttggcttatgaatgcatacaaaattggaataagttcatttgaggtcccttaatttgacaacgaatccgattttcgtcgaaccggaaaaccagataaaacgggtctctcaactattaaaacatgtgtaatataagtcccaaggcagtatgcgactggttttgtcctccgtggcaatttcaacagcgctgagttagcgtgggccggcgggagaagctagctttgtagaggaaggacgccatcggttgccgtcgacgacggtggtggcaaggcggacaaggaaggcgagacccgggagcacggtgtcgtcttcccctcactgcacccctcctcccctattcttccccaga

SEQ ID NO: 38676 - DNA, 203 bp, Oryza sativa
attgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcgtgacacacgggcacggcacaaagccggcctagctgagcca

SEQ ID NO: 38677 - DNA, 1501 bp, Oryza sativa
tatactggttcaggcccctcgataggtaatagccctaatccagttgatatgagattatatggtggaaaccacatatttcaaagggaaagcggaactcaatgataccgccgagatcgtaatcgagaaggtccgactagatctcccggcgacttagctcctataggcttcaactccgtaggctgtgggggatgtgttggctatgagattcgatgccttaggtcctcccggggggtcccttttatatcgcaggtcaactggtctccaagtaggactcggagacattggacccagcacgatacaatgacgacccagtcctgtccgagtaggactccttccatctgtgaactccgtggcgaatttccttaacgtatgccgaaaacgtccgtatacacgcaagtataccatatatatatatcgaagggcagagggtatacctttcccgtaacctgacagtttttttttaagttccctgtaaaaacattaaagaaagggtgactgtggaaataatttgtgtgttagtgatatattgaattaatggagctatctttttttcatgtactcccctcgttttataatatcatattataagtcgtttgatttttttttcttagtcaaactccttagagtataaccattgtaaaaaatatagtaatatttttaatgcaaaagaaacattgtatcaaaatatatttaaaattaaatttaatgaaactaatttggtgtcataaatgttgctaatttttctagaaatttcgtcaaacctaaaaaaaatttgataaaaaagttaaacgacttataattcatccgaaacggaggagtgagtaagtaaaagtagagcgcagaaaaggcatatagagttgtttgaatgagtttgtcctatatatggcttggtttagttctccaaaagttttttctaaaaacatcacatcgaatctttgaacacatgcatgaaacaataaatatagattaaaagaaaattaattgcacagttagggagaaatcacaagacgaatcttttgagcctaattaatctatgaattaattaggcttaaagattcgtctcgcagtttccagacaagttatgaaattagtttttttcatttgtgttcaaaaatctctttcgatatccgatcaaacatatgatatgacacacaaacgtttccagtcgcgaattaaacaggcccttgccgtatgcatatgtaacttgtacgtacgacaagaaagaaatacgggcgcgaaaagcagcctgagcaataagtaggcaacagggacagtgttgtgaccaagcagcacacacttttgagagtataaaagagcaaattattaggtgctgcatgtcgcttgtacctcgccatcattgcaccatataacttgccagccatctcggaagcaaactcatgcccatctttgcatgcatgcatgcacgctccccatgtagtatcaagtttcatgtttttgcacttggagagagctagtacaactagggaggaacaaaaaggat

SEQ ID NO: 38678 - DNA, 1501 bp, Oryza sativa
gggagaaattcagtattctgcaagatgacatcaagcaagtgccgatagcagagaagaaaagtgcttggctaaagttcaaggagagcttcgattatcctgcagagcacgaggaccttatcaagcaggctgcttttaaggttaaggtcgatgagttcgtcttcaacccgatgaatcccgatccaacagtgaaatttccttggatcacggatcaggtctgggagtcattccacgcgaagaagtcgacccccgagtccagagctagaagcgaggcatatcggttactccaaacgttgaaccagcacccgcaccgacttggcaccgccggatatgccggcaaggatgaggaatggaggcaggaggatgaagaggcagaggaatcgaacacgccgcgggtgtttggcgatatcccacaccctcggaaaaggaactgggccagggcctggtatcgtaagaatgatgatgggacaatatgcatgccaaatccacaagatcaactagtctacgaagctatagtaagtgtctagtcacaatagatgttcgcattgtgtcgcgagcgagaaaatttgcattttcccgaacgctagtgtattaatccccgtcccaggaaaagccggggtacaccatacaaacatgatacaaaaggcacatctttattatatcgataatatttacattattacaaaggcacttcaggcttgacagacaaaaataaacagcaacagactagcgggcctatggctccatcttcacaggcgctcaactggggtataagtcaggactccacctaagacttcttctccaaagcttctcttactcaagggggggaagatagagcaagaatgagtacaaccatagtactcagcaagccacaccggcagatgcatgattaatgcaagggggtacaaggggtaataatataggggttaaattttgcagtaaacagcatttaaaagacacttagttgctcaaagctactttgtaaacacgatcctagagctacacaatattattaaacaaggccgtaaacccacacgaacctgccttaacccaaggcctacgatgattcagaccgaactggcaacccgaccctgggtcccagctcgtcccaagccaacccaggccaaccattccacattttagttgttaagcaaattttaagaagtaaaccactaacttgggtacattgctaggcttgcccataaccgggggcgcggctattcgaatagatttactctgatcagaggtgtacatctttacccacaagacacatcttcctcacgtgtaaccacgtgccacataccaccatggcatacggacgaaatacatgacatagttcccaacccatcctagacataaacaagagtaccgacccaactccacctacagccggaacctctgggataggcaggcaggattgagcccctagcaacagaacaccagccctgtgccatgacatctcgactaccaggccgcagctcgtgtagccatcatttgtcctaga

SEQ ID NO: 38679 - DNA, 498 bp, Oryza sativa
ttagttcctcacatgatatgtttttctaagtactttaacgcactactatagatagggtttttccatacggctgagaaccatctttccatctttccaagacatcatttttgcatgcggacctcttaaggagacccgtatgggataatcgatttttccatacgggcttcttaaggagctgtttgcgaaaatgccgcgcgatttttgcaggcgccactagttatggtccgtttgcaaaaatcatggggtctcgcacagaaaaatcacttttgtagtagtgcgttgatatgttttaattttgaacagcctttcactactgcaaagagcattttttttcaaatagtcaaaaatgtattttcgcatgcagatccgtggcctgcctgtaactgaacgatcataaaaattcgacattttttttaggctgttaagcacatgcatgcatgtgaaaatcgtttttgacgcgcatgccaaaataaaacactagatcctacaatatatagg

SEQ ID NO: 38680 - DNA, 1390 bp, Oryza sativa
cctgcagccctctcgtcgttcccggtcgtcgtggcgttcgtccctccgtcaagccgttctcgtccgtcgtccgcgtccgtcaagtgtgccgctgcagccccgtcgtcgtcttcgtcctcgtctccgcgtcgtcaagccttgtgccggccgcgtctcgccttcgtccaacgatcaccgccgaagtcgtcccctcgccgttcatctccgtcgttcctggccgcctccgccgcgcccgttcgtcgttgttgttcccacgcctcatcgcgtggtggtaaggatctctcctctcgctgccccgtcctcgtcctttcggtgtcgccccgtacccgttgtgcggttgtcgaccccggtacccgtgtaccggtgtcggtagtcgttcacgtgtgcgggtggtgaccgtgtagtgtccgtgttagtgtgcccgctcggtagccgcgttgtttccacgtgtgcagcccgcgtggtgtctagtggagtccgtttgtcggccactcgcctcggttgacacacggggtccgcttccgtcaacccgtggaccgtctctgtgtactcggtctactgcggtcctttaggttgacatgtggggtccgcatgtcaacggcgcagccttcctgtcttttctaggctagcgcttacacatgttttatagttgcaaaacctaattataataatccgcaaatctccatataacagcattaaacttcggatgaccatgtcttggtcatacgaactctgaatcgacccgttcaagtctcctaatgtttgttataacctaaagaaccctgtgctttctttttatgtattgttatttcttctttataggcttgtagctttgcttgtgtgcttcgcgtagcttctgtcgttccggaggttctcgaggcgtgggtcgcggtcgtcgccgaaggttcggaaggccgttgtctgcgagcaaggcaagtcacatcatccttgagcatattgaatcccagtttataaaattattttgatttaaattaatgcattgttgctttatttaaattctcgcgttatcactgttttatttagccatgcctatttacctttattatgaccttattattattgctattgttattattaccttgttcaccctaggataaacaaacccccaactagtgggtactctattcatggttccactagtatgaatttaggtagatgcttcgctgattaattaggcaacattaggtggttttataactttagactttgggaattctcatatcacttggacactatggaattgttggcttatggtggaattggacatacacctctcttcctctttcaaaaccccgaaaacctattttccggtggggtttgggtgcatgccagttgtgggaagtagcaccccggccaatataaggattaa

SEQ ID NO: 38681 - DNA, 400 bp, Oryza sativa
caaatcagcatatacatgaatacatccgtccatgcggttgagctaacaaaatgatgaaacgagatgatcgccagattaatccattgtttacatgcagccaaagtacaatgacagttgacaaccttcaatctgcaggcaataatttacacttttcttttaaataagccttttttttcctcttagaaattaaaccgaagctgtgagcaagagcacatcatggtcagttcttggaagtcttttgtttgacacacacttgaattgctcccattttttcccaaccaatttgccacctaccatgcctatctgcacgcacccgtcgcgcggtttattagcctcttttctcctgcgaatcacggcgagctgatcagcgattaggcgaagcaaacgtaccaaattataa

SEQ ID NO: 38682 - DNA, 1501 bp, Oryza sativa
ttgtactagctctctccaagtgcaaaaacatgaaacttgatactacatggggagcgtgcatgcatgcatgcaaagatgggcatgagtttgcttccgagatggctggcaagttatatggtgcaatgatggcgaggtacaagcgacatgcagcacctaataatttgctcttttatactctcaaaagtgtgtgctgcttggtcacaacactgtccctgttgcctacttattgctcaggctgcttttcgcgcccgtatttctttcttgtcgtacgtacaagttacatatgcatacggcaagggcctgtttaattcgcgactggaaacgtttgtgtgtcatatcatatgtttgatcggatatcgaaagagatttttgaacacaaatgaaaaaaactaatttcataacttgtctggaaactgcgagacgaatctttaagcctaattaattcatagattaattaggctcaaaagattcgtcttgtgatttctccctaactgtgcaattaattttcttttaatctatatttattgtttcatgcatgtgttcaaagattcgatgtgatgtttttagaaaaaacttttggagaactaaaccaagccatatataggacaaactcattcaaacaactctatatgccttttctgcgctctacttttacttactcactcctccgtttcggatgaattataagtcgtttaacttttttatcaaattttttttaggtttgacgaaatttctagaaaaattagcaacatttatgacaccaaattagtttcattaaatttaattttaaatatattttgatacaatgtttcttttgcattaaaaatattactatattttttacaatggttatactctaaggagtttgactaagaaaaaaaaatcaaacgacttataatatgatattataaaacgaggggagtacatgaaaaaaagatagctccattaattcaatatatcactaacacacaaattatttccacagtcaccctttctttaatgtttttacagggaacttaaaaaaaaactgtcaggttacgggaaaggtataccctctgcccttcgatatatatatatggtatacttgcgtgtatacggacgttttcggcatacgttaaggaaattcgccacggagttcacagatggaaggagtcctactcggacaggactgggtcgtcattgtatcgtgctgggtccaatgtctccgagtcctacttggagaccagttgacctgcgatataaaagggaccccccgggaggacctaaggcatcgaatctcatagccaacacatcccccacagcctacggagttgaagcctataggagctaagtcgccgggagatctagtcggaccttctcgattacgatctcggcggtatcattgagttccgctttccctttgaaatatgtggtttccaccatataatctcatatcaactggattagggctattacctatcgaggggcctgaaccagtataatctttgttttctgtctgctt

SEQ ID NO: 38683 - DNA, 371 bp, Oryza sativa
tgtacccaagttagtggtttacttcttaaaatttgcttaacaactaaaatgtggaatggttggcctgggttggcttgggacgagctgggacccagggtcgggttgccagttcggtctgaatcatcgtaggccttgggttaaggcaggttcgtgtgggttcacggccttgtataataatattgtgtagctttaggatcgtgtttacaaagtagctttgagcaactaagtgtcttttaaatgctgtttactgcaaaatttaacccctatattattaccccttgtacccccttgcattaatcatgcatctgccggtgtggcttgctgagtactgtggttgtactcattctttctctatctttgcccccttcagt

SEQ ID NO: 38684 - DNA, 393 bp, Oryza sativa
  unsure (1)..(393): unsure at all n locations
agccgattctagtcgtagctgatctggactccagccgattcttactttggtcccgcaacaatccttatctccaactccggttcgatcccatcttcacctccgacgctgatattaccaaattcggttggtacacatgccccccaagtccgggatatttggtaatgttccggatttgccgggtactgacttcgagcaagtttcgcactttgctgttttccgaccgttattggcgggcttgaaatactaaccggcaccctcgagaaatctcacaccgtgacttctgttttcaccgctcaagcgaaactttatcctctctctctctccggcgattcctccgacgcaaaagcgacttccgggtgacttcatctncagcgagacctccgcctgcagcga

SEQ ID NO: 38685 - DNA, 1501 bp, Oryza sativa
ttcagcgacgccgccgcctgatgatccacgagtggcccgatgatatcagtcagagagagagaacctacgcttcatgaagttacaatgctatctcggaagaaaaatgcaaaaggaccgctgagtacactcacattgatggcagtttcgtgttcggctgcccccttatcgcaaagggggacggggacgttgttcgccattgtcgggccgctgatcatcaattggccgacgcggcgctccacggattcactgctcaaacctgtagatcgagaaccagaattcgataagtcaggaggaacacgcacacaaggaagtcaatttaaatacaagaaaaataccccaaggagaaacccgggtcgcgtcctcaggtccagaatagtcaaaggctaggtgggctcgagcctggagcggctagatccgtctaccaatgaagtcggcagcgacttcataccccgacaacccccgtacttggaggtcatcaatgatatcgatgaaagactggagggatggggccaaggcgggtttcgcggtccaagacgaaatcttgtctggtcgttcctcaggaacaacgaagactggatccgaattttctatctgaagatagaaccacctcgcccgccatatgctacaagaagaagggcactggaacgggatatagtgcgacttcaggccatcccggagttggaaaccgacacatgcggataccctgttgggttccatccaacgcaactcgtagtagaaacgaaagaggtcaagaaacggctctaccccaatgtaggcctcacaaagatgtgaaaaaatactgaggaaggcgatggaattggggctcaaatggagcagagaaaggccatagaaattcaagaccaagagaagaaattcagaaggcggaggaagaaaaccacagagaatgtagtcctcgatcgcaaccatgcgacccaggacaggctggggttcaatacctcctgcttctctctccatggtcccgcgaccgggaagggcgccatccgcctgtagtttctttagcgacgcgctggtggaggtggacttgtcgagatccattgccgccggagatcgccggagaagggaccgagatgaactagctagggttcttgcgggagcggagaagacaaggaacgctcggaggctggagggtcttttcacaacaggcggacttcgaaatggatccccaaaactcccttaaatagtcgcacttccgacgatgcgaattccaaggaaaggagagagatagctgccggaaatttctgggtccgttacacgcagcagtttttcatacttcaatttaaattcactcatgaccgttagtttcactgggcgttgtcgattaatcctcgtctctcggtcctcacatcgagaacgacaacaacctcgacatcagaagtcacgatcgggttacatgagttcatttaagcagaagtcgggggctactgtcagggttacgggaaaggtataccctctacccttcgatatatgtcacatatcgata

SEQ ID NO: 38686 - DNA, 238 bp, Oryza sativa
gaaccgaccaaaggttgagattcatggagcatatgaactttggttcatatatgcttagacctatatgtacgtgtgtgtatatagagagtagctctattatacaccccttccttagaataactattctacgcccctctcccaccttccatctgtccctcccgaagtctcaatctctcatcccccaatctctccttttcttcttttttcttctctccctccttcttctctcttttttagg

SEQ ID NO: 38687 - DNA, 715 bp, Oryza sativa
ctgttgatataatacactacgtaggattggaaagttttatatttgcctgataatacgagtatctcatttggtatagccaaattgaccaatagaaaaactgaaagctcaaccataatttgcacttaaaattttattctgtacccatctaaccaattaacatacctactgaatatgttatttggcgtactacgtacgacgtcattcagttatatgttacttgtacaaataattcatcactaaaccaaacaaacaagttggaatttgggcatttcctagcttgacagcggtccggctggctgtacattggcctgtgagtttccaaactcacaacatctaaatcttagcctaacacatggtcaccaaaatatatcatgcatgtaacttaactacaaaggaataagcatcttcttgcgtgcaaagaatgtattcctatatagtattctgactaatttggaatttcttcatctattatgtttggtcagccctgaagaagttagtcatttattattaagtttatactttgaaattcgatccatgtttaccaaacaaacaaattaatcacacagctaggaaatattctatctgtccattaccgttggagttccgtccatccaactccgttagccttatccaattcttttaaatacccaaagtgtcctcattggaccatttctatggggctgacgcctaacttgttctacatgtgcgacactga

SEQ ID NO: 38688 - DNA, 1501 bp, Oryza sativa
ccgcgggggagagggcggccggccgccgcccgccggatcccgcgcgccgctgctgccgccatgcaccgctgtcgtcgcctacgcccgctgccgccgtcgggactcgggaggagaggagagaagagatcggggaaaaagagatagagaggagagatgtggggagtcaagaaaatgatatagagaggagagacgagagacgagaggagagaaagatgggaaaatttaaagtgagtagcatggagagagagggagagagagtgggtatttttgtgtgtggctctcttaataggtccgcatgtaaaaataatctcctttccacgtgtggttcgtttaagaggaccgtacacgcgaaaatgaacttattttcccgggcgcaaccaattatggtccgtctgtaatctaaataggtccacgtacagaaaaatcgcttttagccatgcttaaccttaaacttacttgtagttttatgataaatttattttcaaatatgtagtttcaagatacgccatcttaaatctattgtttttataatgatttgatcaaagtatttataattttgtgaaatttactctaattattttgaaattttcgtgccccgcggcgagctgaaagcttttatctcttcgtcgtcatcagctagctcctcagagaattgacgtgggcaacggggccccgctgcattatttctgtagcactgtcgtcacccggcgctgctggtggaccggactccagccttcaccgattgcttcacatcttcgtcctgttcctacttgcaatatatgtcttgatgatctccgggaggataagcctcggaatatttgaggaacccggacgcgcgacgtgtgtagtgtacgttgtccggttccatgacgttccgtgtgtactagtataatcaccgttattcacatcttcaattcacacggacggagatatcgccgaaccaaacaaacaggaggttcacagctgcgagtgaatgaatgacgagatattcgtatcatcgcagccgcgcctgctctggaccgtctgttacagatccagctcgtcctagtggtcctaagtcctaaccgcaggaaatgcgtgcgtgcatgtgcatccactatggtcgattgattctacagcttgttgaatacttgtaggcaattgacacgattctgcttcagcccaataggccgtttcacaaaattggccggtcagagagttttgtttcaaccagtcatttggcatctccaaaaccgtcacgctctccacacattataaatgtggcgttcgtgtcgacgagacgaggctggaagcggttcgctcatgggggcagcaaggccaaagagctatagctagccaagattctccagtgagattctcgctgtccccggccgttcgtccgtccaaggaaggagagccatggtgggaacctcctcctggtcatcgtcctcgacgtgcacgtcgtcgctcggctctctcgacgacgacgtcgtcgtcgcgtgcgtcgtcaaggcagcggacg

SEQ ID NO: 38689 - DNA, 300 bp, Oryza sativa
cccccccccccccccgaaattttttatttttgttttatttgtttgatattttttcacgcttagggacacacaagaaccaaccatagaaaaattgaactcaaatagacgtaatatgtgacatgtagaatttttcctctcctctcttctctccgaactagtgcagaggagagagatgtgcaacttttttatttttattttattttttgatatttttttcacccttaggaactcacaggaaccaaccatgtaaaaaataaactcaaacggacgaaatatgtggcatgtggaattttccaaagc

SEQ ID NO: 38690 - DNA, 337 bp, Oryza sativa
acaatggtagtggaaaagttagaagtttgaagaaaaaattttgtaactaaactcggcctatttttcaatatttcttatcggaagtttttgtcctactagtgtgcaaccgtgcatctattcctagagtagggtagaggaacacacttccataaaaagccacgcaagcgagggaacagagagatgcgaaccgatcgaacaaacgaaaactacgaaaaggtgaaaagcggcgcctctatatacagaggagagaccgcgtcgtcctcctcttccttccttccttcctccctcccctctgctgctgtgcttgataatggagaaggcaaagagaagagggcaa

SEQ ID NO: 38691 - DNA, 1501 bp, Oryza sativa
ggagctggcaccgcaggcacaccgcctcccacccgcacatctccctcagcttccgttgcaactctggattcacaatccaaacgtacgttgtaagagctccgatcgatcgagagatcgaactaccagtctcactcaggagcaggttgcaggtgtaccgtggaaagggagggagcggtcgacggagacgacgcggttgtcgccgccgacgtagcgcaacgcgccgtcggcgtggcgagggaggatcctcccgccgtagctgcagaggaacttgacgaacgtcccctcggctgcggcgtccgctgccttgacgacgcacgcgacgacgacgtcgtcgtcgagagagccgagcgacgacgtgcacgtcgaggacgatgaccaggaggaggttcccaccatggctctccttccttggacggacgaacggccggggacagcgagaatctcactggagaatcttggctagctatagctctttggccttgctgcccccatgagcgaaccgcttccagcctcgtctcgtcgacacgaacgccacatttataatgtgtggagagcgtgacggttttggagatgccaaatgactggttgaaacaaaactctctgaccggccaattttgtgaaacggcctattgggctgaagcagaatcgtgtcaattgcctacaagtattcaacaagctgtagaatcaatcgaccatagtggatgcacatgcacgcacgcatttcctgcggttaggacttaggaccactaggacgagctggatctgtaacagacggtccagagcaggcgcggctgcgatgatacgaatatctcgtcattcattcactcgcagctgtgaacctcctgtttgtttggttcggcgatatctccgtccgtgtgaattgaagatgtgaataacggtgattatactagtacacacggaacgtcatggaaccggacaacgtacactacacacgtcgcgcgtccgggttcctcaaatattccgaggcttatcctcccggagatcatcaagacatatattgcaagtaggaacaggacgaagatgtgaagcaatcggtgaaggctggagtccggtccaccagcagcgccgggtgacgacagtgctacagaaataatgcagcggggccccgttgcccacgtcaattctctgaggagctagctgatgacgacgaagagataaaagctttcagctcgccgcggggcacgaaaatttcaaaataattagagtaaatttcacaaaattataaatactttgatcaaatcattataaaaacaatagatttaagatggcgtatcttgaaactacatatttgaaaataaatttatcataaaactacaagtaagtttaaggttaagcatggctaaaagcgatttttctgtacgtggacctatttagattacagacggaccataattggttgcgcccgggaaaataagttcattttcgcgtgtacggtcctcttaaacgaaccacacgtggaaaggagattatttttacatgc

SEQ ID NO: 38692 - DNA, 198 bp, Oryza sativa
gcggcccgggccggaggagtctctgtaggcggcgatcgatgcttcgcctccacgtacggtgcgatgccgacgggccacgccacgtgtggccggcggagcggtacacggctcggtgacaagcgcgcgtcgacgtcgatcgggttccgccgggttgtttgccgatttgggcgagcgcgcttgaccggcttagatagctaa

SEQ ID NO: 38693 - DNA, 1501 bp, Oryza sativa
gaagttggagctgctctagacttctagtacaatagagatttatgtgtttaattacttttcaggtgtcagaaaagcacaaaggcgataacttaccatgtgatcgctatcctgttaaggtatatatcctctttacctatctggatgagctagtttgcaattaaatttttgttattttgcaaagttgctaactgttttgacaggttttacgtttgctgaatgagcacggtgggaaagagcatgcagtccatttgtgtgatgagtggtgagttcctatatgcaactattgacatgattccatttttattttctatatacatatgaaccttcatcaatctattgcctatatatttcaaaccactacaggttccatagccttattagcccaggcgacacagtaagtgtcattggagaattcactgaccatggaatatgtattattgatcatgacaaaaatcttgttatagtgcatccagaattactcatatctggaacacgggttagtattagcctccccccatctctttattataacctttgtagtcaatatcccagatcaatatgaacaagctgctatgatatcctcaaatattattttataagaactgtttgtaaaaatacattcatcttatcttgtcatcatattttgatatatagcttattttaggttgcttctagttttcattgtccaagaaggtctgttctcgatgacagactaaaaagcaatgaatattcaacaagtgctttgattggtactctgctgcatcaagtattccaggttcgttggtgcaagaaaaattggcagctctggttaatacatcatgcactttatcttcatgtaacagttgtgtgtgcctcactttgtttctttcctcttgtgcctcaggcagggctacttgaagatgttccttcaacgcaattcttagagcagcaagccaaagaagttcttttgaaaaatattgagagtttatatgcatgtggaggtaagattcgtgacaacatttttaatccataaaaaacacactacacaaaagtatgacactatgacatggactgttcatgacttattatgttatactgagtgccctgaccaataatgtttttcttactctattcttagagcaccgattcagtaaggctatagttatcagtaaattatcatgtgctactaaattttttgtgaaactttatatttaatttttgaatgttgctttgactaatttgatccaattttctgtgctatatccttcctattatttttatatgtttacacaaggaacatggaatgtcattccaaaagttctgcaaatctgttgtgtttgttctgaaatatcaacatacattgtggttgttctcatacatcctcatttactcaagtcatattggtatatgtcatgtttgattacagtactgtactgtagctcagcttctttattgatatttataacattacacaaactatcttatatccccagccatgtgcatatcttactggttttgacat

SEQ ID NO: 38694 - DNA, 389 bp, Oryza sativa
ttcctatttataaactcatttttcttcagttttttttctgtattttgattctctttcctctacgtgactacacattttgaattgaacatgctctgtatctgctcggaatacttattattcagccaacttaaatgcatgagatttgctccggtccaccaaaaattacctcgaggtactagtacctcatggtaccaaatcgtttccgatcgtgaaacgatttggtaccgtcagttaccgtacctagagatctaaatgcataggggcatttggaatgtgcacttaacagttgtttgaacacttccaaggaatttctcctcagttgtcggacgactcattcattttcatcgcttccaacaattatcaactgtgtctcttcctctccccctaga

SEQ ID NO: 38695 - DNA, 716 bp, Oryza sativa
cagctcctcaaacagtgtagattctcatctaaatttttaaaatatatagttatagaatccagagataaactattggcggctttgtttatttggccgcaaaaaaaaatcttggattcttgtagtgacacaactttactattttggcactgaaaaagcagcttggttcccgtcgcggtagtgaaaaaaatacgtgagttcacgttaatgaagtagaaaagagataatgggttttctcgtagttataacttttttttaggatatccagctcctcaaacagtgtagattctcatctaaatttttaaaatatatagttatagaatccagagataaactattggcggctttgtttatttggccgccaaaaaaaaatcttggattcttgtagtgacacaacttcactattttggcactgaaaaagcagcttggctcccgtcacggtagtgaaaaaaatacgtgagttcacgttaatgaagtagaaaagagataatgggttttctcgtagttataacttttttctaggatctccagctcctcaaacagtgtagattctcatctaaatttttaaaatatatagttatagaattcagagataaactagagactataattttagaaacctagtttttctaaattataagaagctggttactaatccattgtttctcataatcttaagctcccttgtcactaggagttaaaactccctcgtgactagg

SEQ ID NO: 38696 - DNA, 1501 bp, Oryza sativa
aacaaccatacccggctgaacagatctaatctccaaaccaggagctaagctaattattaccaggtataacatctataattattatgagaggtgtgagactaatcacgaaaaacattgctcaactcgcccataaccgcgggcacggctattcgaatagttttactctggccagaggtgtaccactgtacccacaagacacagcctcaacatcatgtctaccatgcgtcgcgatactggaaagtacccgaatagaggctgtgacaataccctttgcataacacaactcaccacagtgcaccattcctggatcataatcacccccttataaaacaaggcatggactccccagcgacccccgtgggcttatctccgccacttctcagtctggtgctccgcaatgaatcatgttatacaaaaggtaaagccgttgcccacgctggcttgtggttggcacggttaatgtttcacaatagtagctcgcgaaccggtccttaattgtcatgagcacgactctcaaaaccatgtgctcacaacccaccattatcaagttttagttggcaagtaattaattaaccaatcacgattaaccatcgtgaactatcattaaaccatcattaaataataatgaatcataagttatcccaatagtgtgctaatgtttctaagcatggctaagcaatcacatctaatatctagctgaaccaatatataaagctcaactagtcaaattataataacccaaggtatcaaggaataaagtaatcaagatcaaaagggccataacaaagaataggttaattccacccaatgacattcgaaaataaatgcacagttgaaataaatagagaatttaaatataggatcaacatgctcaaaggattgtgtttaggatctgtgtgacttgccttgcaataatcggtattcaattaatcttcttgaatacttccggcgcactcgcgaaccttcgcaacgacggaaacgacaagctaacacacaaaacgaagaaaaagactaataaaaaccaaataaacaatacataaaaagtaaacaaacatgtagatcataattttagatgaattatgagtcttgaacggcctcattctgacttcaaatgaattttacaagattaaatctatttaaagcccatttaaaaagaattaaataaatttaattcaatttatggacaattttaatatgtagatctttattttacacaacttttgcaacttgaaccacattaaactaagttcaaatgaattagttatgaatttttaaagattaaatcggattaaaacacttatatggattttaattgaattatgacgcaataatgaattatttttgaaaaggaaaagaaagattattgcgtcagcggctagggtttgcggtggaccgggtgcacggcaacggttcacgggaacgaatggccgagatcaaccctatccaaaacggacggctgagatcaaacggtccacgaccggctcacggcggacgactccga

SEQ ID NO: 38697 - DNA, 1501 bp, Oryza sativa
cataatcgaatcgtgtccgtggaacgtgatgcgtgcgttggttggtcacccctctcgtctgtgtgaaaattatcattattttgtttgttaacttgtgatattgtgccaatataagtcctctattttttttatcttgggaatatttgtgctatctaaactaatgtaacacgcatgtggacggcttcgctcatgtcggagtaagagaaaatatgcacgcaaatgcacctaaacccaacaccaacaggtacgtgaagctggcacccgacaattcccgaaatgacttgacatgaaaaattttggtgttgttcagacagtttcagatccaaaagcatcagccatttgtttgattgttcgtcggcatagtgctcttggcctttctctggttggccttttgtggaatgaactttcaggatgtttttccagtgtctgcgaagtaacacccccaacaggtcaggttagttagtactccctccgttttatagtgtaagtcattctaatattttccacatttatatttatgctaatatatatatatcaatataaatgtgagaaatgatagaatgacttatgttgtgaaacggagttagcagtaaaaaagcaatttccctctctttctttccagtatagcagtggcttctgcaaatgatagtaatccactgtgcagaactgtaggatacacgtacggagtagagtgtgtactatgtgttgcacaatgcagagccatgaatgtgattgctgttgtctgtacatcatccagctatctggaatagtgtggcgccacgagctcgtctttatagctctctcgcctatggagtatggacaactcacggtcacgagcaagcaaccaatgggacgagagagaatgagctccccaatgaagaggggctgaaacagttgagtgagtgaatcatgcccatcctcaacgcctcatcatgggcgcgtggcttcaccatcaaatccatcatggtttacatgggaaaaacgccgcagaggccagagatacagccgagtccaagctggtggccttaacttctactcccgtcccataatataaaggattttgagtttttcttgtaacgtttaatcactcgtcttattcaaaaaaaattgaaattattatttattttatttgtgacttactttattatccacagtactttaagcacaacttttcattttttatatttgcaaaaaaaaattgaataagacgaacggccaaacgttgcaaataaaaattcaaaatcccttatactgtgggatggagggagtacgagtacaagtgtcagaatttgtacaactctagaggcccaaactatcaatccagcccaatccatttgccagattcatgccgtacagtctatggacgcaatgcggattaactttagatcactgacatataaatatgtaacaaagtggattaatatgttattagtaacccaaagttagtggcttagggtagaggatattgttccacagtctgtccgtgaaatcatgcaccatg

SEQ ID NO: 38698 - DNA, 1501 bp, Oryza sativa
tctggttaggccacattcatgcaaatataattcgaagtgatacaaatgaacgataagactttgttatgtgcgtctgttgtaaagcaaccatgaataatagccttgtaccactatgttcaggtcaaatatacaggtgttaaacagacatgtaaacttgaatcaatggatgcagcaggtaagtatttacagttcaattatgtttttcaaaataccaagtccatatatgttgcaaaagcagagaaaatgaatacgaggtcttaaaaatggtatggtatgcacacgctaaggatggggctgtggataagtacctctgcattgcaaagggtgcaaaagagtgcctcttcatcataatcttcttgttggtaagcttcgtcatctttgcgacaatcctctttcacaaatatagcacaacacaaacaaccagctcctaaacatgatttgtgcttttggacatcctcataggttctcgattctgatttgcccgtttcgtcttgtgtgtctaattttgcttttgagcaaaacaagatgatttgctacattagtataacatgtgcctactactacatgaattacatcaaagttccaagtatgagcagataccttctgacttataggttagagcaccgttgacagtaatcatgattccagggtcagcaggatcaatagcagtacatcttacatatagaatcagtactgataaggcctgaaatgccagaaatgaacatcaaacgcttgtcaaacaaaatctactactccaaaattcaatgcgtgaacaggaagaacattaccagaaaactataaacacctattgcgataaattgatacaagtccttcccaagaaatggtgaaaagaaagcatagaattctatacacaacaagaagaacaccgttatagctaccacctgcaaaaaagaaaaagaaaaaaaatattcaatcacttgctttaataagaggtaaacatgggatagcatgcatcgacatcagcacatgaaaggaagtacaggatctaattaagaggctacaaattcagcagataaagaagagtagaagactaagagtccaagatccccatatatacaccatctttctagttaaaaggaaggctgaacattactgatcctaggggattcttacaaacattgaatatttcaagagctttgagtatgaggtttataggcgaaaaacttaaaacaaaattacacaagacgatcatgcatgctcagatcttacaggcttttatgaaagattaagctttatttgccaagagtttatagcctcttcccttgtttgatctccaaaacatgtaaacttagtgaggtagtgcagataaaacaacatagaccagagccatgagtccatgactaagaatgcacacaagttgatctaaattttagcgggatactgcagttacacaggtaaactacagttcttcaatgaatccagataaattcttgcacatgacacattaaacagagctgaaaaagtgcataactgggaccgt

SEQ ID NO: 38699 - DNA, 1501 bp, Oryza sativa
atcagcagcaggggcagcagtagatgtggcttgatcagcactatcagcaatagcagtaggaggcctgtgaaagagatattgaacaaatatttaaaaaacaaaatggcaactgaaattgttgatcaaaacatgacacacttacatagtgttgttaccacaagtaggcacttgttcaggcttagatttcttctttctaactctcttaggcttgggtggagctgggggagaggcatctggatcatatacaggttcattgcatgtcttttgtaggtggccaaagccatggcacctcttgcatctccttcttttctttcctgaaccaccttcttcaacaccaatgaacttccttgttctaggtcttccagctgatctcttcagtattggtggccacatcttgaatcctgtgtccactttgtcccataggctcttgtctggcattggaggcacagttgtggaacaggcagtcctgaacatggccactgaatagtaggggctgacatagtcttctagctccacttctctcagggatccaataaaagagatggcatgcctattttgtgggaaccttttttgtggtagcatctctggtaggaacattgtcagcctgacttgcttgtgtgggtaaaaccatactcagtggaaccactgtttcagcttcatccacacaagacacaatttgggaacaaggctcactcattgtcacatgcaatggaagcttcctaacatccctgtattggttaaatgcctctaataacacagcatcagaacaaatttctacatccctacccactctcttgtcccagaaagtcactgtaagctcctgcgcactaccacggatgatttcatcatccaagtccttcatcaaatctatcaagcttacggtgtctttatctacaacccacttatatgaagatgaaacatgataatcttggctaccattatccatatactcaacataagcaacaaccctaaccacaactctacatgcagagttcggatccatcctacaatgcgacggcaaatgaagagaaaaatgggatcccaaatcagatccaccaaaccatgcatctcaattgaatcaaagagagaaaaaacgaatcaaagataagaggaatccaaacttaccctttcggaatccatttcggcatcggcggcgctgccgccagcgcagattctaccgcctcctgtgacggtgaagctatcaccgccggtcaaacttgcatcccaccggcgacaatgcctgggcacaactagtatcgagggtgacagaatcggtggaatgggcactgtttcggtggaattgatagagctagggttctaccacccgtactgcttgcgaatggagccaaaacgagtggataagaggagtctccaccgtccatgtatatggggagtctcctttgaggtcattttcaaattaactgtacctagggatgtacttagcagctagctctacttaaacactcttaatgtctcaactaaaccaccacatctgacatca

SEQ ID NO: 38700 - DNA, 467 bp, Oryza sativa
taatccttatattggccggggtgctacttcccacaactggcatgcacccaaaccccaccggaaaataggttttaggggttttgaaagaggaagagaggagtatgtccaattccaccataagccaaccattccatagtgtccaagtgatatgagaattcccaaagtctaaagttataaaaccacctaatggttcctaattaatcagcgaagcatctacctaaattcatactagtggaaccatgaatagagtacccactagttggggttttttttatcctagggtaaacaaggtaataataacaatagcaataataataaggtcataacaaaggtaaataggcatggctaaataaaacagtgataacgcgggaatttaaataaatcgacagtgcattaatttaaatcaaaataattttataaactgggattcaatatgctcaaggatgatgtgacttgccttgctcaga

SEQ ID NO: 38701 - DNA, 1501 bp, Oryza sativa
gcaacagctcgcccgccaaaaggttgcggatggagacctgagtagggacccagacagggtgtaccatcttgatccaagttttggaccgtttaagagggggaccaatggacctgttgtatggcctaccattttagtttcattttgtttttttaacatattggaaacaattatgaaattaagttgtttttaacagtccaccagtgttgcaagttttgaactgaaaggagtgaagtatgaattacgcgggtaatcttttgctctgattactactaccagtgaaagatgtagccttgaaagttatcaactctagagtaaatgccatttagctcaatcatgcgtgcagattgtggataaaatcaatatttaatccatctccgtggatcctttgttggaatgatcctctgtgggcctatcttcttgccaataattctcttaatggaacaggctggatactactgtggtagtactcattttgttttgacttttgaggaaaacggtctgcaatatactggttttgtgcattatactcgtgtcgtttggactttttgtgcattatactcgtgttgttttgacttttgagaaaaacaatctgcaatatggtttagactttagaatgcttgagactacccggacatctacattgagatgatcggcgtcttcggaagcaattcagatggtccgttcttgttcctttctatcagaacttctgaaagacgctttctatcagaacttaagaaagacgcttctgaaatatctatgctgactagtctttattgtgtgttagttaacggaatgcgtacaccaggaaagaacacattcaaaggagcacgtcgttctcagaactcggaagagttgctgcaagccatgtgcaaaggatccaagacctaaatgaccgtgataggatccggaaatttaacgaggatgctacaaatttcttcgctgtcagatgtgattgccgggcccaacgtcgtgtcttcagtgaacaaatcagcttgtgttgtttatcaccaagtcattgtactgatgttgttgttcttgacctttttcaggtacgtatgtgggtttggatcgtcaaactatcttggccatccgaatgcttaagctcgatatctgcagatatctttgcacagaaactcatctcctcatcgtttatacttaagctcatttgtttgtttgtttgtttttgtgtgtgtcgaagagagtttgttcttcacgcgctgacgcgcacgggggtggggtccttccgtccctgtgaatgattcgacctgacgagatttgactggtacgcagataacgaatgctctaccacaaattcatacaaaccagtattactccgttttacatatatcacatgtgtaaaagcgatgtagaatgtagatgcatttaccatcggtacgctttcgtcttccaagttccaaccacatgtttgatgtgagggcctgaatattttctgaaaaaaaaaggggttaatgatcgtacttggcctgagaaagtgacacct

SEQ ID NO: 38702 - DNA, 189 bp, Oryza sativa
cctgtctctagttctggtctatctttcctggcttgtttcctctctcacctcaatccctgtcatagatgtttaacagagaaaaatgaaagaatgtcagggggtatgcctccagtaactcaagttttcaactcaatccaccactagcctgaagagagttaacaagggcacacccttggtccattccgagca

SEQ ID NO: 38703 - DNA, 1501 bp, Oryza sativa
tttggatctgaaactgtctgaacaacaccaaaatttttcatgtcaagtcatttcgggaattgtcgggtgccagcttcacgtacctgttggtgttgggtttaggtgcatttgcgtgcatattttctcttactccgacatgagcgaagccgtccacatgcgtgttacattagtttagatagcacaaatattcccaagataaaaaaaatagaggacttatattggcacaatatcacaagttaacaaacaaaataatgataattttcacacagacgagaggggtgaccaaccaacgcacgcatcacgttccacggacacgattcgattatgttctttccccggggaaaaaaaacagaaaacgatttgtgtccggttcaaagaattattcgccgtgtctgaaagtgtacaggtaaccgggatgtcaactgcttgattgatcaaaaaatgatttcgttttggggcaattgtgtttgtgcaaagcgctgcagatttgtcttgggcgattgcagcatcggcagttgcattattatatcgatcacgtcgctgcaaattgcagcctcctccatgtgccgggataggggggagagcacagaaacaaaggtccacggtgtagcagcatattggtgtactctgtactcttcttccctctggtttgtctgcacgtatagcctaggtgaaaaggtcatggactcttacgtagttttaatatagacatggagattgtccccaaaataaaattatactaccgaacagattcccagggcagatcactgcgctctcttcgagagaagaaacaatgcttgtgataaactggatggatggcattggagataaggatatctgagcacccaattttgcatactttagaacaagtgtccacatgcaaatatccataggtaattctgtatcattttggacaagactttccgaaaatattatttgaatacttatatttgtcaaatgttatattttgtgcttagtgaactagagattttgagaaactagattatccgactggtcatggttactcaagtccgatcttcttttcagttcagtagctacttagttttagagtttttgctattttagaggtattctaggagtagctatgtcattaatgatttaatcttttattcttctgaaaaatgggaatgaattttttttaagtgaaatgaaaatgaaagggtcttcagattgacagtggggcccaccggcaccaaccgcgattataccgtacggcgaaaggagaggacggcccatgaggagaatccaagaccgaaaaaccccacaactatctcctcccttccacctcgcctccctccctccctcccctccccaagtatccactcctctcctctctcgcctgactggcacaggcaccagcgccgagagggggagaggccagaggaggagaagccgtacgtacgggggcgctcgctagggtttgccacgccgcgccgctgaccccgcgaggacgtccctaccgccgacgacgccgccgcca

SEQ ID NO: 38704 - DNA, 1501 bp, Oryza sativa
tagctattatgatgatttgtttgtaatattaaatgcatttacactaacttttttagatttgcttgtgatattaggtgacaaatacattaggattatgttaatgatttttattgcttgatattctttttatgttacaatttgttgttaatcatgtacttcctccgtttcacaatgtaagtcattctagtattttccacatttatattgatgttaatgaatccagatagatatatatgtctagattcattagcatcaatatgaatatggaaaatgctagaatgacttacattgtgaaacggagggagtacgtaaaaattgactatttttgtctggaaaatatgccaaatcgcatataagcaggcccttatgataaagtcaactcagaacatttcccaaccttgatggaaataaattatatcaaagttgtagatgcagccattttgaaagggtcaggtgacatcgacatgcaggattagattaatcatcgagcaaaatagtgataattactagtatggagtagtagatgtgaactcataataattactgctccctccgtcagaaaaaaactcaacttagaaggtgtataatggaggggtacaatgaatatagacaagaggcctaattggcacagctccatccctcctggagctggagctcagccaaacagttccagctccacaaaaaatgggagtggagctgggtggagctctttcacaaaatgaactaaagttgtagagctgggtttaggcagctctacaactccactccagacctaactccttgagttaaatttaggagttggagctgtcccaaacagatctaaggttaggctttttgggacatagggagtatgtattaaaaataacctaagtactcatatgtgcagcaccctcacacaaacacatttatttttcctattctaggtaagtgtgtataaaaaattagaattgtacaaacttatcggatcggactatcactatcgatttgtgaaacagaatgtgatgattgtatgagttctgttttctcaacaggcagtgatgctccccgactattactgctgcatggttagtgccaattcaaaagtagacagtgatagtaaaaaaacatacaatgatattaaacaaaacagacagtgattttatattataaattgttttgacttttttataaattattttttaaaagtttatggagaaatatagtgactcttataacatctttcattaaatctaacattttcattaaatctaacattgaatatattcttataatatatttgttcggtgttaaaaatattattatatttttctataaattgagtcaaattaaaactcgatttaaaagaatcaagataatttataatacaaaaaggagggagcagcaatttcgaaccggtgcttagggtgtttttctgtagtaggaaatccatggaatgacatttggccatgtcatgttttaattaggtcgagaagctcatcgagaagctgacccgaaacgggcg

SEQ ID NO: 38705 - DNA, 180 bp, Oryza sativa
ccggaagttgaacactggtcttataaaatgctactccttgtaagtgcataccttctatacttgtgatatgattggactatatctcctaattaaattagttctaatacataaatgttttatggttgtgttggatcgagagtcgtcgccttggtaatcaggttgggttccttgatccatcca

SEQ ID NO: 38706 - DNA, 294 bp, Oryza sativa
gctgaaactatttggctgagctccagcttcaggaggggtggagtaaacgcaagtactataagcatcttatcactaattacaagatgccatgtagactcaaatgatgatgtggaggagaaaaaagaagagagagagaggagcagccacccctcatgtaaggagcaacctccacacaagtttcaagaaatatgagagacagagagttggacaaaattagatgtgaccacctcctctgttataaaacttgacctaagaaggctacctgctgctgtgcttgctttgattattgcgaga

SEQ ID NO: 38707 - DNA, 604 bp, Oryza sativa
ctgtgacggagtagcaaataaaggcccgtcagaggtgacctacatgtgacgggcctttacttttggggccatcacaggtagatcacctgtgacagcttctaactacggagacctcaacctctgacggcctttatttaaagggccgtcagagatgagttacctgtgacgggtcctaactcgccctaggctagcggagaccaacacctctgacggccttctagtaacttgctcgtcagaggtgggtgtcacctgtgacggccggccacccgtcaaaggtgactggactcaccagtgaccactgatcactcaccatgcgcgaagccgtcaaagatgagggtttgggctcgtcacaggtgaccttggccagtgtagtgaacgtagtgcatgttctgtcaggaagagttcagtatttttaagaaatacaattgtgtaccacttgggaggaatcaccatggtgatgttatataaggaaaaaatgatggcgtatatattaattgatttttcattatttaaatgtaccgaagcacaaactagatcaaatttgtaaaacttcaaaagtaattattaataaatcaaaatgttgaaatggacactcgctaggtgt

SEQ ID NO: 38708 - DNA, 266 bp, Oryza sativa
atatcgcgctcccaggtgaaagtgtagccacacaggaagtgggttagggacagccaaggtagggagcagcttacaattttaagaggtccgagaaagacctgaaatgtaagctgacagtagacagagatctgaaggaagcgaaggggtatgccttgcagatttccagagaaaatcacccaggcagagagaacagtgagtgcaaagacctagcaggggtgggaggtgggtcggagaaggggcatgtgcgcctgacgtcagggaaacca

SEQ ID NO: 38709 - DNA, 578 bp, Oryza sativa
gttggtgacaccaaccgggactaaggccctgtttgtttcagcttaggattattataatctggattattaggagtaaattgaaataaacatatagcttattatgatagattattacaatctataagccaaattactataatctagtaatccactctaattgtgctttttttagattattgggttgctaacacctaacaaccagctaatgatccagagaaacaaaaagctaacaacttattctatgtcggcttattataattcagcttatagtaatttgtctcaataatatagattacagtaatcttaagctgaaacaaacaaggcctaaagatcctcgaccccctgatatgcctctgacaggctatgaaccatctttactcccggttggtgttaccaaccgggactaaagatcaaaatttttataaccaggactaaaagcaaccttttgttctgtttctttttggaaccgggactattgttgattttgccagaccgaccaaagatggtttagaacctagaggttgagaggtatccgtcgatgagcttggccactgttctaactgcatgagctcgcttga

SEQ ID NO: 38710 - DNA, 619 bp, Oryza sativa
taatgaagggtagtaagtgaaaaacttgtctaaagtgaatcgtaagaacaagaagtattttgaaaaaaaaaaagttgattgctagaatgttgaaacagggagcaattattatgaggatcatattaattaagaagtcctctcgtaaacagacttatcttctaacataagcggatgaacagactattcttgtgcggttattccatgtgccaaagggcctttcctgcaacatgtcgtctagctttttttttttttacaaaataaatattgcatcatgcatgtatgaacagggtattccattagtagcacttgatcaatcaaagccattggcaatttgacaaaatggctgtgtcacggcctcacgggcattggagctagctggccatgttttttttttcaccatgtcattgttacgtgggctgcagttaattaagtcttcaaattgaaaatagagcagcagtctaatgcttcgattaccatatagtatggcatatatacaattatagatgccccaaacgtccggggcgacctgactgacctgctctaggactgggcctgagtcgtacacttagttcggagcagagttcacaattttgataccagttactatgccgacactagc

SEQ ID NO: 38711 - DNA, 174 bp, Oryza sativa
ggcaaatatgccctggttgagaatgatattctagtgaagccaatttatgtgatggtattctagcgaatccaatcttatgtgatggtacatatgcaattttctccaatttatggtcgtcatgttgttagtttctctatccagtagtagtttcactaatgcaatttatgatgcaga

SEQ ID NO: 38712 - DNA, 1501 bp, Oryza sativa
tgccggttcggccgggggccctgggtgagattctaagctcctagtctgtgtgtggaaggttcgcgagaatggaaacacacaagacacgggcgatgtatacaggttcgggccggtgaaaagcgtaaataccctactcctgtgtttttgtggatctatgtatgaagaagctacaaaagagctggagaaccagagagcccttactctctccctctctgatcgttctggatccgaaaatccatcccccttctaagtgggcaaggtcctccttttatacctcaaggggataccacatgcaccatctctctcttttttgtggggacttatcctatcttttcataaacagacggagacttgtatggttgccgtccgaatgaccttctgatgggacagcccatacctacctccacttccgccggaagcaggcgcgacgtgggaacatggctgtctgttgacgacatgatcagtgtcagaccggtcacaaatcggtcattcttgtccaccacgcgtcagtttatcaatctgcatgttcgcccctcttcatacaatgtcttgcttgtaatggttaggatgaagcctggtatatatatctgaccgggaccaacgtgccatctccaggagctaacacgccggctccggctagggacgagtgcttggaggctctcatcctgacgggatggggcgaggcgtgcgtcagaccgcctgtcgccacctaacccacgatctgatcgggagcgcgctgcactgcgttacatgcggcgtgacgcgctcgtccaaaccgcaataaatgtggttaggtgagccccgctatgctcacctaccccatatacgcggcgcaaaacccacaaggggtcggggcgcctcggccctcggggccgagacgggagcggtccgacccctcggggagacaaagagaagggcggccgtatcaccctcgggcccgaccccccccgagggggttaggccacgtgggtgatcgtgtctgcctcaagtctctaagtcatgatactcccggtcccatgtcaccgacagtagcccccggcgttatgccagggcgatcgccctcctcgagggaagcggtcgggcgtgacgccacttcctaaggcctggtgacatggtggggccggtctaaaaatcgggacaagccggttcgtttttcctggagatatggtgatggcgctttggtcggcgagcgtaattaacgcgcgcacgagatgttccatctcgactgccacagccgcatatccacctcatgcaccgcaaacgggcgaatgggattagtggaagcgtgggcgcgagaaacgagggggcaagatagtgggcgcgagaaacgaggagccgggcacagcgttggcaagggtataaagtcgccgaggaagagatttgcttccttcctctcgccattatttcccttgtcttcgccgcttgcgccctaactccttgtttcctgtgccctaccttcgccacacgcgctcgctcttaaacatctcttcctccggcgtca

SEQ ID NO: 38713 - DNA, 561 bp, Oryza sativa
  unsure (1)..(561): unsure at all n locations
ggaaatttattaaaaaaatagtcataccagagaagtttttattaaatttcaaagttttaaaatgtttactttgcatactattgatgagaaaaaaaaataatggagcaagcatcaattggtgttacaaccctaataaacnntggctggacattgnnaagaacatgctnngaaccatctnncttccgttnnggtgganntgattgannnttttcaccaannntttcattttttantttgtactnaagttgagagtanaggaacttttgaaggttcacttttctnngttaaggannnacttgaaggttattttgtatgtttagaattttcctggatactgaactacagaaatatcctaggctgtacagttgagaccaggaattgaaatttcttttttgtgctgtagctgtatatttcgtgtaattcaatcagctcttttattattttgctacaaacaatcatcaatcaggctggataacactttttgtttttacaaatcagggtactatttgtagaatactaaaggaacagtttcatcatcttctgtatgagcaaataaaatgc

SEQ ID NO: 38714 - DNA, 1501 bp, Oryza sativa
gcccctttagacacgtcgaatcctaatatttggcatggttcacgacattcccttggtagaagtagtggcgttggagggtgtagccgaagcgtctccttgatgactaagtgtaagtaatgcagactacttatggtctcctcggttattctttcttgtccataaagcacttgtcgtatctcgtcttgtgccttctgcatcacctttggattgttcaacagctctgacattgcccattgcagcgtcgtcgccgccgtctcgctgccacctataaacagatcctacatgaatcggaagaaaaacaaatattcaactgaattttctaaagaaaaatgaatcttgcaaaaaagtatataatttgacagaaaaatttgcagacaaatattgcaaatattaaaccattggatcacaacctaaaaacctagattacatccatggtctcatatatatatattgcccttaatggcctagttgccggcgctgccatcctcccccccaaccctctcactgctgcctattcacatcgctaacgtcacctccaacaccagcgaggctcgccgacgaaccctctatactaccatcctccatcggcttctttgtccaccaccactgacggagcgtggggctcctcaccgggagaccgcgcaggcccccctttgccggttcggccgggggccctgggtgagattctaagctcctagtctgtgtgtggaaggttcgcgagaatggaaacacacaagacacgggcgatgtatacaggttcgggccggtgaaaagcgtaaataccctactcctgtgtttttgtggatctatgtatgaagaagctacaaaagagctggagaaccagagagcccttactctctccctctctgatcgttctggatccgaaaatccatcccccttctaagtgggcaaggtcctccttttatacctcaaggggataccacatgcaccatctctctcttttttgtggggacttatcctatcttttcataaacagacggagacttgtatggttgccgtccgaatgaccttctgatgggacagcccatacctacctccacttccgccggaagcaggcgcgacgtgggaacatggctgtctgttgacgacatgatcagtgtcagaccggtcacaaatcggtcattcttgtccaccacgcgtcagtttatcaatctgcatgttcgcccctcttcatacaatgtcttgcttgtaatggttaggatgaagcctggtatatatatctgaccgggaccaacgtgccatctccaggagctaacacgccggctccggctagggacgagtgcttggaggctctcatcctgacgggatggggcgaggcgtgcgtcagaccgcctgtcgccacctaacccacgatctgatcgggagcgcgctgcactgcgttacatgcggcgtgacgcgctcgtccaaaccgcaataaatgtggttaggtgagccccgctatgctcacctaccccatatacgcggcgcaaaacccacaagg

SEQ ID NO: 38715 - DNA, 550 bp, Oryza sativa
attttcatagcaaacagtaatgtagtttgatttgctcaggctctaaaaaaaaatttggtaaacggccactggaagcgcccaaataatattccttccatttttaaataatggacagcaggcactattcactttctcactaggaccaatccaattcacaagatatctacaaacactaaaaatgatgtcatgttcttaaaatgtattatatccaaaatataagcatgaaattttcattcactttagtctaaccatttatgagtaattagtggtcaaagtttaaatagtaaagtcaaagatgtcaattaattaaaatgagaggaagtaactatcaagtgagggaagcacccatacaccataggccccaggcccgatacgcatccaagcaattaaaccaagcgtttcacgagggaagcacccatacgccataggccccaggcccgatacacatccaagcaattaaaccaagcgtttcacgagtgaaaaggctaattggcggttggctgcgcgcgccctctcccgcgcggcacaaccacgtggcttgccgcagaga

SEQ ID NO: 38716 - DNA, 792 bp, Oryza sativa
atcggccgccgggcagccccgtgacggggaagggtgaatccgctagggtttcaggttttgggtttcaagttttagttttttttttcatgatttttcttttagcagtgcagtgacataatttaccgcttgtgaaaagtggaatttcatggacgggtgtgccatctgcttgtaaaaatagctacttttactgacacctccgagcaggcagacggcccaattgcatgcgaaaatttgttttgacggtatgggaacatgcatttttgtagttttgaattaccttatatttaatcaatatacatattcaagttggcatgaatacattttcatattctgaattgtccgggctgatcaatttgtgatagcgaacagaatatgtatttagttcacatgtacatagtatcttcctctacatgggcatattccatgtactatctgatctaaatatttaatgcatatacagccattattgatgggtggaaataaaaccaaattagcacatcgatgtccagatatgcaattcaattggtttgccagatccaagtcctcgtgaaacaaattatatacttaaagaacaaaagtttgcgtatggccaatcatctcctgccatttaatcttgcattctgcaagtatatatgctatttgtacgtactcatgctcccaaacaatctttcttcaagtttgagcttgaatagttgttaagggaaaggctttcatgagttagtagcggaagtttggagaaaagagaacaagggttctatgatgatggaaagatagcaaaataagatccataga

SEQ ID NO: 38717 - DNA, 294 bp, Oryza sativa
atacatagatccacaaaaacacaggagtagggtattacgcttctcagcggcccgaacctgtatatatcgcccgtgtcttgtgtgtttccattctcgcgaaccttccacacacagactaggagcttagaatctcacccagggcccccggccgaaccggcaaaggggggcctgcgcggtctcccggtgaggagccccacgctccgtcatctggcgcgccaggtagggggctttgcgtgtgtttttctaagctctcgcattctttcgtgtgcgccaagcttttcctgttcagcccaa

SEQ ID NO: 38718 - DNA, 1501 bp, Oryza sativa
ggtactcttaggggcagcatatggagaattaggacagtagcaatgcgtcccgccttatagaggagcccaaatgtccacattggaagaaaagcagttgaagctcccctttccacagcgtacttgtagctttaggtgggctcaccaccttttcttttcaggctggccccaccaccttttcttctccttcccccctctctcttcctctccctcggctcccacgcgcacggcggcaactcgactcccccatgttccctcctctccctcccccaccccaacgatggtgcaggtttgcgagctcgtctccggcgacacaaggcggcgactctctcgcctcctcctctccctccccacacctatctcatccccaaccggcggaggcggctccctccccctctctccttcctccaccaaccccacctcgactcactgagcggcgacgaactcgtagcggagcagtggtggggtggcccaagcggcgtcggcgtcggtgccgggcggagtggcggtgggggacgatgaggtcggcagagtgggagcagttgaaaagcggcctgatccacccctcctctcgtcccccgattccccgcggtgaggccggtggcgtgagagcggggacggcgaggtcggcggcgtgggagcgagggacgatggacgacgagatcaatggcgcttctccaccgaagcggcatcggcgccgactcatctatatcatccatggccatggtcagcgttagcctcgaatgtgggcttgcttgagtgcctaacgacgctgacaaaaagttgatgaagaacgtcgtgtgtctcaggccccgtttagttccccaaaaatttttcccaaaaacatcacatcgaatctttggacacatgcatgaagcattaaatatagataaatgaaaaaactaattgcacagttagggggaaaatcgcgagacgaatcttttgagcctaattagtacatgattagccataagtgctacagtaacccacatatgctaatgacggtgagttatgaaattttttttttcattcgtgtccgaaaagcccttctgatatccggtcaaacatccgatgtgacacccaaaaattttctttttcgcgaactaaacagggcctcagtttggtcacacgttcttggtttggtcatgggaaacacagacatgactgagaatctcctatgtgtaagcttgagactaaatgccacataaacacactgtaaaagcccttacggcttgtttggtaactcgaggtaaggggattggaagtttacacaagggaattgatgatgagattaagatgggaatttgatttttaatcccaatatcttgtttggtagaggtgatggaaattattagggagtttagttagagattagatcattaataaaaacgaatggctgagatttgcttagacaaagtaaaggaggaattccctcccaattacctgcccctattgaggtattgaaaaggagggagttccttcctcaattcctcatccccattcc

SEQ ID NO: 38719 - DNA, 261 bp, Oryza sativa
agccgtgcctcccacccgtgccgcgcacgtgcgcgcgcgtgcgcgccgttgccgcgcgttgaccgcgcgcctcccgcgtgggtcccgcctgtcaggcgcatccccgacctctagccgccggcctccttcctctctctcccgtgaaccctagcgttgttcctcctccaaatccaccccattcaagccggctctttccaaattaaatagggggaattaatccccattgattcctctttgatttcccccgttttcccccttgaa

SEQ ID NO: 38720 - DNA, 1501 bp, Oryza sativa
cctggcagagtccggcctcctcccgagcggcttcctcggtctggcgagcccgggcggcctcccgagcggcctcctcggcttcccgaaggcgatccgcggcttctcgccggtcagatttccgcctccgggcctctgtggtcgccgggtcctcggcctcagactggccggacttggaatggcgggagggacgcgacgggatctcgctgaagcagaagaaaagccagaagacaaacaagatgggtgaatgaaaacttgtgttggaagaatgaatacagccacaatgggcgtgggacgaacctgcgagggggtcggttaaacgaccaccttggaggggaaatgaggtttccccgggatggttctgtcccccccatcttgcggagccgtttcttcttccgctccctctcgagctgcggcgtcggcgcggccccctccgggcgcctgctgctgacacgcgccgccccgccccctcggggaggagatggggaggaagtaccctcttgctttctcttccctcgggcgtcggcagggcggctgccccccgagcccccatcacggggcccagaagcacgaccccctcccggggtagattgttcccccctgcggctcccgcccgagccatcgtggcctcgaggagcccgctcctccgacgccccgaccgcctgcatgatggtcaggatgttggcgcgatatggatcgctgcagagggggaggactccttgggggatgagggatgcctccgcggagctgagattcagcatccgttggatcattaccttgaagtcttcggggacccagtcccatttgaccccccggtgggtcctcatacagtcctcggacccggtgtactcccaggcaccccgggcgcgccgctggagtggcgcgatccggcgacgaaggtagtcgccatacaccatggcccctgtgagccccagggatcgcaggcccgccaggcggtcgaggacggcgtcatagccatctcccagatctaccggcgcccgccagctggaggcctgcgccgggggctggctcggaagtcggaggcgcgcttcgtcggcgaggggggtgtagaaccagtcgctcttccagtcatcccacttcttgcggaggacgcagggaatatagcggttcaacaccggcccccgcggctggaagtagcagccaccaaccaccgacggcggcgacaccgactgtacggtgaagaaccaccgaaacagccgaagggatgggcgcaccccgatgaacatctcgcacaggtgcgcgaagatggccaatgtcattaccgcgttgggggtgaggtgcgccatctggagatcgtaaaactccagaacatccatgaagaaagaagaaaatggcggaaccagccctgccattgcaaaagggaggaagaagacggaccgccccgggtagcatggcaccgggcgtccctcgcccagcgtaactatctcccggccggtggcagattccggcatgaagcggcgcggcagcccggcctgcctctcgc

SEQ ID NO: 38721 - DNA, 327 bp, Oryza sativa
ccacgtagcaaggcctgtacagttcgcgaaaaagatttagaagctacatgggatatttgacgggatgatagaaggatttttcagacacgaatgaaaaaaactaatttcatgacacgcttggacacggcaagacaaatcttttgagcctaattaatccatcattagtacatgtaggttactgtagtacttatggctaatcatagactaattaaactcaaaagatttatctcgcgttttacctctaactgtgcaattggtttttttaatatatatttaagagtaaagtgcaccagcggtccctaaacttgtgcgggtgtgtcatctagg

SEQ ID NO: 38722 - DNA, 1501 bp, Oryza sativa
tccctcggatttgttcggaaacgtttccccctaaacctcgccggcgcatcaatggcggccggatcttccgcggccgattccccgtcatccggccgttctctccccctcccaacgctatataaacgctccccgtgcctccctcctccgtttccgccgctcgccgctctctctccccgtcggaatcgagctcgcgccgtcgtgctctctctccgccgtcgccgccgagcttcggtccgccgccgtcgtcgccccggacctcctcccgcttcggcatcgtctccttcggcttcgacgcgtcctcgccgacctcgtccaccccttcgtttcgcccgccgaccgccggaacgccgccgtcctcgtcgacccgagccgcgccgccgcctctctccgcttcggtcgccgtttccgtcgtcgccgtcgacccggggtgagccgtggaccgcccatttcgcttcccccttccctcccctctctcgggcgccgctccgtcgcgccggtggtcgccggcggcgaccatcggggcgcgggcgcgtcgcctcccgtcggctgtgccggcgaggccgccttcgggcgcaccccgcggctgccatgtggggcccggccgtcagccgcccgcgccctcgagtgcggctgacgcgtgggacccacggcgtcggccggcgcaagccgcgtgcacccggtccaccgtggaccgtgaggctgccgcgtgggccccactcccgtggacccggtccgcgcgcccctcccctcggctgacgcaataaatccgattttaaattaaaatttaaatgaagaaattcgcaaatatccatttaaagagcatataaacttcaaatggccataacttggccatttgaactcggaattggaccgttcaagtctctaatttttccttaagaagtcaagaacccatttttttgctttgtttctgcttgttatatggagtttagtagagtaaaagccgtttcttttccgttggtcgtgtagacgctgcagcttcggaagatccgctcttcgtggaagttgaagccgacgtttgggaaagcgagcaaggcaagtcacatcatccttgaacatattgaatcccagtttacaaaattatgttgatttaaattattgcattatcgctttatttaaattcccgcgttatcactgttttatttagccatgcctatttacctttgttatgaccttattattgttattgttattatttccttgttcaccctagaataaacaaaaccccaactagtggacactctactcctggtatcactagtatgattttaggtagatgctacgctgtttaattaggtaacattaggtggttttacaactctagactttgggatattcatatcacctggacactttggaattgttggtttattgtggaattggattcacaccgccccctctattcaaaatccccaaaatggttttaggctgggctcggggtgcatggttttgatagtagcacctcggccatataaggaccggt

SEQ ID NO: 38723 - DNA, 485 bp, Oryza sativa
cttgctaatggtatatgcccacttaacttgttttattttagaaaataaggatacatatcatgacttcagaattgtattaggaaaagtattgggtgtgcatgtacaaaaatatttttattctagttttatgaaaactcctataagatttcgcggtagctttgttagtttacaagggaacacaaaattattaggtggagatcaacatattcacatcttgcaaaaaagttattcacaaaaattcagaaaagcccattgacacaatcagtaactccttcacttcatgaatcggcaactagagaagttatatgatgaaaataggcagaaaggggattactagttgacttcatgaaggcctttggtttgtttgcatttgaacagatgcagaggcttaaatcttttgcgactgcatatgcagatgcgggggctgaaaaaatgatggccagatctgaaacttcaaaaatcgtgtggttttgttcttgttcagg

SEQ ID NO: 38724 - DNA, 1501 bp, Oryza sativa
cgttgctgcagacaaaggccctattcatttctccaacaaatgttagataaatttttcgatactcgtggcatactttttaaacggctaaacggtgtgtttcgtgtgaaaactttatatatgaaacttgttctaaaatatcagattaatctatttttcaagttgtaataattaaaacttaattaatcacacgttattatcgtctcgttttgtatgaatcacttaatatttatctttatcttcatcttaagagatacaaacaccaccaaagaaacactagaggaatagcaggaacctcatcgaagaaagtttgattggccagtgcaacctcttcgaatcctactttcgcagcagatatgttgcttgcccttcaacaattgtaggtgtgagagcttaaccctacaaccgttggccagacaacgaagctagtgcaaacaccagctatttcgtcgatgagccatggttgccacgatgaggaagacagacacccgcatcttcaaactatgcaagagggagagggaaggaacaacaacaacaacaacggaacgagccgaactatgagataaacccaactgctcaccggccagactccccccaccccggccaccaacctgatagccaacggccaccagagacgtagatggaggggaaagggagtctcatgggaggaaaagctggtcgcgtttgggatcgcctctcaatctctcatgttagaataggtgtcgaatatactagtcctatatatgatcatagttggacttggagttgtaataggtggtaggggtggagataaagttggactctgtaacccggcaactctcttaaatagagagggggcaccacaatatagcgtagatacgcagggagatgatggcagcgtagccatggacttatagcggctaggagctatgttggttgaggagaagcgtccataatcagagccccggagatgtagccttcggctgaatttcgttaacaaatatagcatatctcgtatgatcaatgattgaatcgatcgagaaggttagtcgtcgttacgctatatcgactaacttttataacatctcatagccttaggatggatcgagagaggagcttagtttgtttttcttgtgtgacatatggtgacataggctgttacttcacagttatttttgttgggtggggacgtggggtggggttcatggagtggttgaacattagcaaacatcttccgaaaacgttcgagatcgaacatgtgattaaaaaaggtgattccggtcatactcaaatgccggccgccagttctaaagtaatgtcgtcgttctcatcagccattagcgcctagaataatccaaggtcaaccacccattcatttatcatgatgcatgcatgcttaatactgacactggatgcgtgtcaaattggagttccaatataatgggcactatgatttgctctaaatattggtcattacagactaataatccaaagactcgacacattttcaccatggctggatttc

SEQ ID NO: 38725 - DNA, 229 bp, Oryza sativa
ccaccatctggaactctgtgtctaacagtgcagcggatagcagtagggattgacaaaggggcacagtggcagggctctgctaatagaggtaccgtggacaagcttgtgttggccgaactagtcaaaccagaccgcctcctcacgctgtcaattggtcaactcatggcactgccagtggctgaatttgatcctgtcagtcaatatcctcctcctctcttctctttgtagt

SEQ ID NO: 38726 - DNA, 595 bp, Oryza sativa
tagcgggcgagcggcgggccgacgagggcttcaagcccgttcccacgggcgggcagcggagcggcggccggccggccagcgaggcggccgagcttgctcccacgggcgggcggcggagcggcaggtgggcggccggcgaggaggccgagcccgctcccacgggcggccagcgaggccagcaaggccggcgatggccggcgccctcctctcgatctatgcgattcctttcccgatatgtgtgatgaattttccgatctgtgcgatgtgtggatgaaattgtggataattttggtttagaatttgtagatgtttttgttatcttgtgaatgatttgtgatgtatttgggaattttgtgaatgggatatggagaaaatgcagctttgggcattttttgaatgttttgtggtgctcgaatgatttatggaggaatgattcgtggtgctcaaatgatttaaggatgattttatgaatgattttataaatgatttgtgcccaaatcatgtgagcagaaaaaaaaagaactggctaaaaatttagtcccggttgataacaccaaccgggactaaagatggagtcccgattattttaatcaga

SEQ ID NO: 38727 - DNA, 261 bp, Oryza sativa
attcctgcagcccatgctgactcccaatgttttcaggttttactccgaatattaactagggtgtttttggacctcagatctttgcagttaattttctccaaatcagaattaattttccctccactgaactctggtttttatcagtttctgagtaagaaaagaaaccgatgatgcttttacccttgcgtttagtgatgttgagaaccttctgtgttctactttaatctatttgtgtttctagagcccatctttttttttagt

SEQ ID NO: 38728 - DNA, 958 bp, Oryza sativa
ggaggggtgttgtgaggggagcgttttagttataacgcaccctgggtgcagtttagcgtgtccatatatatatatatacacacacacatagagtaaaaatgttaaaaatattgtcaaaaataatgtgaaggaagatgattagatattgatttgtagaattcaatgaattatagatgaagttgcatgcttgcataagttttatatgtaattattgctagtagatgatgatgtggaatgtttgcatgttgagctttagaattagagggttataactttatagtaaaatggattacatttttgacaaacaggttaaacaacggaaatgaaaaaaatggtatcatgcctagaaatagggctgtcaacgagccgagctcgagcgagctcgtctgcctaggctcgagctcgatacaagctcgagccgagcctataaaatgttcaagctttctgacaggctcggctcgagcttgaccaagctcgagctcgactaccgagcttgattttttttacgtaatacagtatatatttgaaagattatcttaaaaaaataattaatttctagttcatcatattaatagaaaaggcaaaaaataataaaataaatatatgatgtcaatataaggcatacaaataacatatttgatatcctaatttattaaataacaacaaaaatcatatattactaggctcgttggaagcttgacctcggcttgacaaagctcgcgagcttagggagaggctcgggctcggctcgtctggagctcgagctttttttgacagccgtacacagaaacatacatcattttccacataggcgtagccaagaaatgatcacacctaggacagaggagggcttagttgatgtgttcttagcaatattttaagggaaatgctaaacactggtataccgtctcgacgggataggatagacaccaaccaatccactcttcttctacctagc

SEQ ID NO: 38729 - DNA, 1501 bp, Oryza sativa
ttttatgcttgacaatcaaaatgttatcaaaaaattttaaatactttataagataggttaatatacggtatatctttttataaatatgcgagttaaaatttgatttatataattaaaaaaacaaatttggcagtgaattacatgttcttttcatagttaaatttgttatttttatttctacctgtataagttgaatttaaatttatatgtttgcgaagcattatagatcgaggaccccgagtcccccaagctatttcgagcgataaagccattcctaattcacttcacattttcctcctgataagttctctcccctagcccaaaggaattttctcctgagcttgtctagcgcctctaacaccgctttggaaacctgatggaggtgagatggtagatgggttgcgagattagcaccacctttaggcctggtttagtttccaaaattttttctcaacaacgtcacatcgaatttttgacacacacatggagcattaaatatagataaaaacaaaaatagtgcatagtttgcatggaaatcgtgaaacgaatctttttagcctaattagtctatgattagccataagtgctacagtaatccacatgtgctaatgacggcttaattaggttcgaaagatttgtctcgcggtttccagccgagttatgaaattagttttttttattcgtatccaaaaacctcttttgacatccggtcaaacatttgatgtggcatccaaaaattctcatttcatgaactaaacagggccttacaagggcggatctaccggcttgattcagaagctttccttgccaatgtgtcagccttgtcgataccttgttcactagggggaaactgaaacttactcccttcgtctcaaaaaaactcaacctaagagggaatgagattcgttgtctttagagtggtctggtcatatcctcttttagattaagttattttgagacgggggagtagctttgaaggagctaatggtagcctgagataagtcagcgggaaggttgttattaattgttgccatgaggtgcacgagcatgctgttgaggtcgagggaccgacatcgaattgtgtattcgttcattcttaacggaagacgataaaccttaccctatttaattttccctactgaattttatccttattaatttaatttaacaaagtcaacttgatttcctcaatgggcatttttatgtcgcatatatgcttgcgtgcgcgcttcatgcatgtcaataacttagtataccatactaatctatgtaatgaacccaatcgtcttggaacagctctcgccatggacgccttcgtgcatacaagataatcttgtttttgttcttgataatcttgttttatccaagattagatagtactactagtaatgaggtagtatataaatgtcgtctcgatatgtacacccacactgccacataaatcctttgcgaaaggaaagggaaatggaagacgcgtctcatggctacgtctacgtcggct

SEQ ID NO: 38730 - DNA, 1501 bp, Oryza sativa
tccaactcaaaatttcttttagaaaagactacaagtgcaagttgctctacctaggacaacctctgaaaactcagtacaagaatctttactcacttacctcgtttccttgcggaggtgaggaaaaccttcacaaacttttccgggacatccacaagatctttggaagctcacgggcgacacctaatcgtctaggagaagatctccaagagtaataagcctaagtgacagcccacaagatatccaaagtgctcaatcaaacctaatctttaagccatctccaaaacactcatacactctcatctaatctcacaatctcacaagataggctctagatttgagtggaggaagcaaaggaagcttgggagtggctagaaaaccctagaacatgaatgaacagaagtggaatggccaaaaagtgacctggggatgaaatccatatatataacggctaggtgacgtcatctagccgttactcacaagtttgaactggaaacctgccaggaggttccgggcaaaagtgccaggaacttctgggcagcacttaggaaatttttgcaaataaacggtgcccggaagttctggccataacctcggggtagccttttctgtcccggggagaaaatcatttttcaaaaatgattccaaaaatcttttgactcatggataagactaagagcactttgtataccctagaaccacacttgaaacccctcttaatagtacggtttttcctaaactcaatttcgaaagtgaaaaacctagtctaatcaccttcgatgatttttgcacttaggaacattcgaattggggggtctccttgcattcttagccatcacaactcgctttgggactaaactcctgtgaataaacttgataaacacgttagtcccctttaaccaccttgtcattaatcaccaaaacccactagggggtttaagtgcatcttcaatctcccctcttttggtgattgatgacaacatggttaaagcaaataaaaagatgatagaatttaaaatttgaatgatgagagaagtgtgaagctccccctaaagatatgcatataaagaactggaaatgaaaacaatatgcataagatgaaggaaagctcaaaagaaacctcacactacccttatcaaagaagagatgcagatgaaagtgctcgaatgatgagtgatgcaaaaagaaagactagatgacatggtaatcactcaaaaagatgaaaagaacacatcatcacatcaaaatgcaacatccatatggtctaacttactgacaaaaaggataataaagcatctaacagtcattacatccaaccataatagaatacgattacatgtccatatagagagagataatagagaggaaatctgcctagccggaacctccggatcacaggacccggaacttccggtcaaatgaccagacaacagtcaaggcagcaaaaaggatttaaatggcccccttcaattcacaacttctccccctttggcatcaaggcacc

SEQ ID NO: 38731 - DNA, 348 bp, Oryza sativa
ggaggggtgttgtgaggggagcgttttagttataacgcaccctgggtgcagtttagcgtgtccatatatatatatatacacacacacatagagtaaaaatgttaaaaatattgtcaaaaataatgtgaaggaagatgattagatattgatttgtagaattcaatgaattatagatgaagttgcatgcttgcataagttttatatgtaattattgctagtagatgatgatgtggaatgtttgcatgttgagctttagaattagagggttataactttatagtaaaatggattacatttttgacaaacaggttaaacaacggaaatgaaaaaaatggtatcatgcctaga

SEQ ID NO: 38732 - DNA, 495 bp, Oryza sativa
aacaaacactaattcgaacaaacatataaaacaaacaaacaataacctctaatcacttagtgtcataaggtgaattggttaggggagttttctgtgaactatgagatcatggtttcaagtcttaaattctcttaatttatttttcttttttttagaaaaaagaaaccggatggagagattgggaggaggagctgggaagaggagggagagagattgggaggaggagctgggaagaggagggagagaaaaaaagaaaaaaaatgaggagggaatatatatatatatacactatattacagatgggaagaggagagagagaaaaaaagaaaattaaaacacacccccacaacaccccagcccgcaccccccggggggcgccctaccctcccccctcctcatatagtaattcgattactgtcaactgtacgtgctatgtatactactcaggggcccaactacagaagccgcccctacttcttccccgcgctctccatt

SEQ ID NO: 38733 - DNA, 161 bp, Oryza sativa
tcatacattttccttttaagttatttcacctgttttacaatgttgaccttttaccactaaataatgtggataaaaaaagttttaccataaattattttggtcggattttttttgtctcgtgctaatcatttcacacacctacgcgcaaaaatgtaccatat

SEQ ID NO: 38734 - DNA, 1501 bp, Oryza sativa
tcctcacctccgcaaggaaacgaggtaagtgagtaaagattcttgtactgagttttcagaggttgtcctaggtagagcaacttgcacttgtagtcttttctaaaagaaattttgagttggatcttggtggtcactcaattctagaaaatgacctagaagtgttgagttgaaggctgtggacctcttctgggatctttgcataagtgaggcaaggggttaatcgagacctggctctttggagcacctcaacggagagtaggattcgtgtgatctgaacttcgggaaaaaatcgtctttgtctctcttgtgcatgatctttgtgtgaatctgctgatattctgctatcttcatcttgttcttctgtgtgtctaaacttctcttgctaggacctgtttttcatctcagttttaatttatctcagctgcccggaagttcctggctcaagaactctagtagttcttggctactcatcctgcccggaagttccggtgttcatcaccaggaggttccgggccctgttaatttaaccgctgcaattgtagagaaaatttcaggaaagcctattcacccccccccctctaggcgacatctctgcacattcaaaatacagtacacaaaaaaacacgtataaacgtgattatgacgtagaaaatgttgtggaagtaatttcacttaaattgtaatggcatttttccaaatagttaaatagtggtatttttccaagcctacaattttcagtgacatgtatcaagctattctctttctagtgacatgtatcaaactattatcttctttcctttttttttttttgccaggagaggagattattatttctttattgggggaatgggcttaggccggattttaattcaaaatagaggccatttaagcatgtttttacaccgaataaaaaaatgttacggtccggaattttacactattttttcccccaaaacaaggcttgcaagaaggcccaaagtattttcctcagtgaggccattaagcctgctaatggtgcaaaatccaccccatatccaatccaatccacagcagctagcaatacacctccaaatcatcccaatccactagccatcctataaaatccaaaccaaccaaatccatttccctcgtgagtctaaaccgaaccaacccattcctcttttatgggcacaatccattctccgaaccattcaaacccacttcaaatccactttggtccttgcggtgggtgtcggcgacgccgacgccgccaacgtctgggacactgagggtcgcactgcaaagcatgagacgcatcgtgtgaatcctcttggagcaaggaaggacggcggggagagaggcgctcatggtcctcgacagcgctggtgtgatgtccaggggaagggggaggttgttgcgccaccggtcatcgtgctgtaggcgtattaggtgtcgcaggggcggatgagtttgttgccgccatcagagcggtagacgaagttgatctccaggtccttctcgt

SEQ ID NO: 38735 - DNA, 602 bp, Oryza sativa
aatcccaaagtgagctagttgatctaagcatgactaagcaatcctagaccaatcatctagtcaaattattaacctaggctatcaatgaatcaggataaacaaaggctgagtatgggtagaaaccatcccacatgacattataaaagtaatgcaattttgagagaaaagcaggggttttgcaaataggctcaatatgatgaatgatatatgtatgacttgccttgctcttcagctgacgggacctcggcgaccacttcaaaataaactggagcgtcggaactgccggagtctaaacgacaaacaaggcacacaataaatacaagctaaaaagctactgaaacatcaaaagaaaccaattttaatggattcttgacattttaacgaatttactgcaatttgaatgggttaaaacaaagctctgattattaagttatgaattttacaagatgctctgtgttatttactattgacagaaacttaatcaattgataggaattagagcccaaaaggaacataggatcaaaggataggttgactagcaagcaaacctcacgagataccgactcaacgagtcaatttaacgtgacacgggatcaccgaaa

SEQ ID NO: 38736 - DNA, 346 bp, Oryza sativa
agtttgcccctctgcctcatgtacctcctgcggttgatcacctcctcccatcaggtccgtgcattagaaatttttactgtgctgctatggaccgctggttctgaaccgtttgggacttgaacaatttgtagtgaacccttgtgctagtataaaagattgtttgtgtatgtctactcagctcacgtacgtattcgacctagtgtttcagtgtattagcgtgataaataatagccatgctgcatgttctagcttgagagtataagaaataatatgcaaattaaggaaatgagagacgtttggcttgcctggaacagtgcgccttgtggaagtaatcggtggtttttga

SEQ ID NO: 38737 - DNA, 202 bp, Oryza sativa
aatgatatgagaagaaagatcccttcagtgtcgcagttgagaaagtaacactaccctttggagcatccatcatctagattttctttttggttcttgaaatggtcaatgttaaatgtattaaaatcagtaacatccacatgtccctaaaatcacggatatggatttatgggtgtatgtcgctgagcataaatagtttcaatga

SEQ ID NO: 38738 - DNA, 1501 bp, Oryza sativa
  unsure (1)..(1501): unsure at all n locations
ttcggtagataattacccgtctggtgggcaaaacggaaggttttcaggacaaacctacaaagaggtgtcgcactctcgtngccgtggcggacaatttacagcacaaatcgacaaagatggacaaactaaactagaactagaagcaatatgaaaaaacgattctattgattgattgtatgattgtctttacaattgaaccggccttgtcccttatataggggttggtcttgccctctacaggccctcctccacgtccaactcgggataaaaaccaaaggaaacccgaaacatgccttcccaagcaaggaaatctcgagacccgacaaaacagactcgggctagaactttgccggtcagaccggccacacaccgtcggtctgaccggccaacacacggcggtctgaccggccttctcagaggaaaacgggcaaaacttccgaactttggcaatttccctatttcaatcctaggtaccaaatttaggtgtaaacaagaattagttggagttgcatgctatagtccttatttgtatggtattatttgttcaagttatgatatggacatacctctttctttttttaggaaaaagcaagagatgtgcatacaaagaaatgaagtaatagcattttcatatccatttgaatttatgcttcttggagttctaagctactatgtattttaaatagtactgctaaatcataactaaatacatgttttttgtatgatggattcactatatttaaagtccttaatttcatgatgatgctatgtcatcttggcatatggttaattaattgaaatatgatttacttggtgggttgtgggtacatgcatgatttcatttggtggtcgtgcccatgacaattaaggaccagttctcgagaatctctggaagatatactcatactaaccacaagccagatgggctctaggctgaatcttaagtataatcttttctagctgacacaccgttggcaaggtgttaacaatgaaatttggtaagcccctaagagaattatcacattaccaatagtcaaattcttgctatattcggttaaggaaattaatcgaataaaaggatgcatatccagaaatgaccgagttcaaggaggatgcggcatggcaagttatctattaattagaaatagtttgttagtttccttttatctttaggaaagtgtgtttagtgtcctataaggactttatgttttccttttatctttaggaaagtttctttcttgtcctacaaggactagtatctccccatgggtataaatatgtacacccggggtcatggtaatttatctctcgatcaatactactctcggcgcatcgccatcctctctcctgaggtttttacttatcaaccggcggaatttggcacctgacgcggggctgcatcgggtcagttcgatctccagcgaaggggtaagtcctacgttccgccgccctagtgaatctattggctaaattggtgttgttcaaggctgcattgctttcg

SEQ ID NO: 38739 - DNA, 166 bp, Oryza sativa
tcaaaaaatcctaagctattattagaggggcatcaaacatacagaagttatcttgaaaggaggggctaagtggctatggagaagaggaattccacagactgctgcttatcatcaatctccagccaccgctggccttcgtcagccattttgcctcttcgcccacagt

SEQ ID NO: 38740 - DNA, 1091 bp, Oryza sativa
tgttttgtttttgtgcacataagtacgtacgggagaagacatcgtataaacctgtacgtacatgacaacagtagtagctcttaaatcatatacagagaaagttgaaattttttaataatagatataatccaatggtataaaataacgggtccaccaatttaagtgaaaatcgacggtgagatttgataatgccaagtggcagcctatgagcgtttgtagcatgccatgtggcggtttaggagcgtttgtaggaagtttaattgacttttagtatataatagataatagatagatagatagatagaagattgcatacttactgtatgaatgtttcgttcttgtaaattttatcagtgatatgcctcacaatcattaacacattatcagtgtactgcctgctgccactctgattcgagtcaagtttgttgtgcagagcactgctccagttaatatacgtagttcagtaattaatttcggaggtcaataatatcgtcataccacttattgtgcttcttgtaagtgtcacatggagccatctttgttattccaatgatattggcccaaatcgatttcatcaaatttcttggaacatgctcaaattttaagtggggtattaccgtattagtgggaaatgttcgatctttctatagatggtgctgggtacatatcccaagtggtgatttgttgctgaaagtgctcctccttttgaaagattgtgttttcagtagatgctatcactgaagaatcatttgatgttttaggtttttagctcttagcattatctggctgcagttgttaggccaccttgatttgatgtagatattagcctgtagccattatcatgcaagatctaatttgttgtgtattctcagagtttactgtactctcgatgctgtaaccgtcctttcttctgatttcttttagagatattaaatgttaagatcatttcagacttgcattctgtgattgctttggttactgcaactttattagtgaacagcaccttgctgtaatcttgctgattgaattctattttgatgtgcagagtattacccagttcagtaattaattcgtgagttgctcaatggaag

SEQ ID NO: 38741 - DNA, 305 bp, Oryza sativa
ttcctgcagccctttagaaatatttagagacttgaaccaactaaatccgagctaagatgaattagttatgaatttttaaagattaaatcgaattaaaacacttatatggattttaattgaattatgacgcaataatgaattatttttcaaaaagaaaaaggggtttgttgcgtcagcggctagggtttgcggtggaccgggcgcacggcagcggttcacgggaacgaacggccgagatcgatcctatccaaaacggacggccgagatcgaccggtccacggccggaccacgagggacgacgacga

SEQ ID NO: 38742 - DNA, 216 bp, Oryza sativa
ttgggatactcacaaaaaatgggattttgttttcagtcaaatcattttatgatgcaatgaaaatagaaacaagtggttaccctttcaagaagatgtgaatttaaaatttcagttaaactcgaagtgttcatttggttagcacttatcttgactaaagataacctcattaaaaggggatagaaaaaagagaacatgcggagagcgcgtggagcctca

SEQ ID NO: 38743 - DNA, 690 bp, Oryza sativa
tacgcgtcatttttttatgactcaggtaaataaaataactcttacgcgcttttcagaccgcaacatggctttagagtcttcgagatcatcgaagatttctgcatcggcaaactgaaggactgatgatgatagagatgagaggctcaggaatctcccaaatgtgaacccttgcgttccacggatgttccttgaaggaatgaaactgtctcctgcctgtgatgaggactggccccaagctctgtggttctcatttcatctttgacctggcactcttactagtagcagtgtttggaccatatggactatatttatgtgagttcaatctcaatgttttcgtcgatttatctctttgaaaagatatgtttccttagatttatggaactttctcagataagacaacgaaatgtgccaacttttgtatttattgtttctactacaatgacaatgatatgcattttttacttggtccaattctccccctggtcgtgtctgaggattacacggctattgggtttcaggaaacacgtttggaattttcatgtgctcatgcttgtgttggtgaagtaatctgggtggctacaataagaatattttttttcaagatctagtccatttttcctgatgagaaaatcaagagtttgtacaactattttggttcatttgtcctgatgagaatcatgatattgtact

SEQ ID NO: 38744 - DNA, 395 bp, Oryza sativa
tatttttctttaaaaaaaatgtttcaacagtatatcctttcttgttctaccgttcggttctgtttccgaaaaggaaaaaaaaagcaaaggaaatggtctgagcatttttctatccgttttcattcctagccctttagccataaatattaaatattaatatttagcacaagttttggtcattttttacaatatttatgactacgtagagtatactagcttgggagagactacaatcaagtaaacactgtaacatatcactgcatgcgatctccaagggaagcataataatcttagttagctgcgtgatgtgcatgctacaaaaactcgctagtcattacaatgacaagcattctcgcctgtatgcacaaaacagtatgcaacaacaaatgtaccga

SEQ ID NO: 38745 - DNA, 1501 bp, Oryza sativa
gtatacataacttcaataagatcctcttcattttcaaaaggtacaatttacctgcccttaatttggaataaacactaggcacagtaagtgtaaaagagacaagaaatgaggaaaaaaaagcctccactgattttcatacggacaatgaatgaatggacgcagtactttcagtgtgaaacagagtgaaatgatagcaactgaaggtcttagagaaacaacccaaaaaaaagcaccatgcaactaacaaagctactagcattttctttaagaaaaaaaaaacgagccagtagcacatataccgaccagagcacttgaaagagatgtatgtctaactgaaacagcatgaaaatattcccaatatgaactggacagcgtcgcaatatgtcacatatataggcttttagcgttcgtcgtttgtatatcgaataacctttttcttttagatgtgatgccaccaaaaaacaaaaaaacaaagacaagagatttgagtagtggcaaagggctgtgtgtacgtgtccacgtagaatcgtataatatcatcagtgaacttctcgcccaagtaaattaactagccttagtttagctattttggactttagtcctcctccacacttaatttacattatcgagttgattgtggtatctatgcagcatatatcaaattttcacctgaaaaatatataaaacaataatttaggctcctatcgaatagcctattcagccaaagaaaaagccaaaatttgaattttcaaacttaattttgatatttattttgaggtattttcaacgtagtttctttttcagcattggcttttaagtcaccgagaatatatatataaaagttttacctacaaatttatttttattctctaataagccgttttggcttattaaaagaaaagccaaacgatggggccattacattatcgagttgattgtggtatctatgcagcatatatcaaatttttacctgaaaaatatataaaacaatgacaaataatttacggacaaccaatgtcattttgtgcataggttcaagctcacaaacatatgtgctaatacaaaactatcttccacataatttaatccatggttactttgtagctgacattttaattacaaaccatctccgaaacatccagaaataaagtagaacagacaaaagtatttccaccaacatatatatatatatatacacatttgatttgcacttgatagtgcagttgcaagaggtgtgtggttttaacatcgagatcgcatgttcaatccccaatacacttacattttctttttaaaacatatttagaggtacaaatctcccttcaaatctagttttttttttatttgatgttgttccaaaccaaagtgtccaagctgacgcttttgggtacaaccctccactaatctaaaatttgtttaatggatcattgcatcaccccaacactgtccactagctaagctaatgtagcttagcccgatcgatccgacatggcgttggcca

SEQ ID NO: 38746 - DNA, 1501 bp, Oryza sativa
gattatttatatagtaactatatcatacatatatgatttgatcacactacttaaaaaaggcacatagagctcggtgttataggtgctggaagtaataaaaccggcacatatataccatttcccatctatgcgggttgaaaatacaaaaaaaaaaaaaactgccacctttaatagactgtaggtgtcagttttctattatatagctagatgtatttttttttaaaaaaaactaacacctttaatttactataagtgttggataattaaaagtcgagccgagccgatcggtggtcttgagcggataaggttgagagggctcggtgcccctctctctcgcacggataagaccgatagtctcgctctcctctcactctctatctaacgcgcgctctctctctctcgagcgcattcctctttctctcgcacacacgcactcctctctctcggcccggcagcggcggcagcgtcttccgctccgctagatctggcgggaggggaggtggtggcaggcggcggcgcacgagaggaggcggcggcaatggcggtggtgtcgagcggtggctctttgtgctatctatttgttcttgatgtgttttttgtaattgtgttcttgatggggatgagtagttttgatggttcccagtagttgggaagaatattcttgatgttcatgttcattcgttcttggatgttcttcgatgtgttctcggcggggtgaatgggagctgctcgatgcctttttttgattcctaaaacctctctaaggtcccggttttggaacccgcacctttgatttccctcatctttgccgcttcctagatgccgaatgggaaatcgaacacctatgacggattcccaagtggtacctatccatgtttctatggtattgtaagtttatgttgttagattatttacgtaataaattgtttatgtggtagtgtaagtttatgttgtcagattatttatgtaataaatttacagttaaaaacctatgtttattataagtatgtcagtattatggatacatcttatgcgaaatcgcaacaccctttaattatctttaagaaaaattcacctcccaaaattgatcatagataattataaattatttatagcgatgtattaaaatattatatattataaaagctaacaaatagtatctaagtaacgaggatgaagaaaatttatggcgaaataatgctttggaaaaatgacaggtgtcattcggttgatattccatctatataagtttttcaaacgcaatctaaaatacaagcccgcgcaaatgcacgggctacctttatagttagctttaatactagaaagtagtcgtgcatgctttttttatagcccgtgtgttatctaatgagttctttttaatttcaagcttttgaaaggatttgatgtagaagttttgcactaaaaaatatatcaagatgatattaaaaagagtagtgctagatattaaccatcaaatggaaaagaatccctgtaggttgat

SEQ ID NO: 38747 - DNA, 1501 bp, Oryza sativa
gaagcaacagaggaggctgctagccaaaaaccgggctggttgggccggcccctggttcggccgaacccccttggcaacgttggatgcagggtttcttctagacggcgtggatcactccccaatgatggttggagggcaatatcgaccattccaactgccacaaccgtcattggcagcctatttaaggacctcctcttcttaattcattcacacacctcaagcaaagctctctcatattctctcaagtttagcttagtgttcttaagctagtggagtaggaatagagtagaaatcggagtccggatgccttcggaagagttcgggtatggctctagtaacactcctttcctcttttgtaaactttgtacttttattagaatatactcgtccttatacatttatggtattgaaatactttctgagtatatgaatgccaactttacatttgttcatgttatactgattatactgctagcttatctgggagatgcattggtacgggtataaagtttgcttatgcaattactctatgtcatgacgatgatattagagtagtatctggtagcttaggcgtggtgtctagattacgggatatcattatttggggttatatgctgcggatgagaggtgggccactgatggtgaaagctcagtacgggtattcctccgcgcatgtatatagtcctaagttaaattcttggggacgatactcctccgtatttagccccggttgtatggtcacgacgggctgtcgtaaggaactcggcagtcaggggtggcttctcgaagtaacaagagggcatcggatagagggtattagttacttaattatataactagaatgtgtgtacactatgcatactagaagtataagaatcgattctctttctattttctttccacttagcttagatattttagtatgagaatgagtagttccccgcttgtgtgtcactctaccctttgatttatcttaactcctgcttagactattattattacaagtaacatctaaattattagtccggttctctcactatgatcttcccacgggattaaataaatacgatacccttgcaatactatctggtgaaatgctacaatggtatatccgtgtgcttgcggatgaactctgtaaccataatataccaggagtatttctgcgccattgctgggaattatattcctagtaatgtcgctaagaaataccaacaatcatttctggcgccgttgctgggaaagaattataatagagattaccagaactaatactttatatttacctctacataatcactatcctttgcaggctaaccttggttgttttcactattgttgtggaaacacggtattgcatgactggtttcaacttgccggaaaactttaaagaaaatccagaagctttttttccggagcgtcaagccgcgagtcgtcgctccgcagaaaactctcccgacaaagaaaccagccataccagcgccaccgaccttccagaatatgg

SEQ ID NO: 38748 - DNA, 203 bp, Oryza sativa
cccatttcgcacgagaaagaaaaagaaaagggaaaaaaaaaaccgagcttcaaagaggcgcagcgctacaagccaaatcgaagaggcaaaccaaaccaaacccaacccctcctccgccgcggcccgaaaccccaccggatcggcggcggcggcggcggcaggaggccggcgggcggaggagatgtcgctgacggaggtcagga

SEQ ID NO: 38749 - DNA, 800 bp, Oryza sativa
gatcattaatgattaaatattactgaactgttctttgtatcatttaggaattgagctccgaaaaatccgagaaaatttcagagagtataattaatcatggagaatttaatgaaaattaaatccatccatgctttaaatttaggaaattttatttcccacatttgacttcacttgtaaattaaagaatatttaatataaattctattaataatttattagataatttataaatcctgaaacgaaaatgaggatgtgacattgatcctatttaaagctattgtttctattcaactattgcatttatttttgaatgtcaccgggtgggaacgacctatttcctttgttatagccctttgttattgattacctatactttgtcacctggttaataattggattagctagaacattatatggttttagctaaagtaattaggatgcttagccatgcttagagacactagctcatatgaatgggataactaatgattcactactacttaatgatggattaatggtagctcatgaaggtcaatcatgataggatgattaattaagatgccaactaaaacatggtaaaggtgggttgtgagcacatggttttgatggtcgtgctcatgacaattaaggaccggttcacgattttcagttgtgaaacattaaccgtgccaaccacaagccagcgtgggcaacggctttacattttgtatagtgtggttcattgtgggcaccagactgagaagtggcagagataagcccacgggggtcgctggggagtccatgccttgttttataagagg

SEQ ID NO: 38750 - DNA, 186 bp, Oryza sativa
tcatcactttggataatgctaacaccaatagtgcaatgtcgaagttattgaaagctaacgttttgcaaaagggtctactgcatgggcaagggaagctattacattaacattgcatgtcacatgttttgaatttaatactctattgtaatcaacatccatgggagcattaagtatattaaaggataa

SEQ ID NO: 38751 - DNA, 398 bp, Oryza sativa
ggtgtgaatgcggcgacgcatcagggaggccgagctcgtggccggcgcgcagggagggagtttgagctcgaaaacgaaaacaattttaacatataattaagtctttaattattactttctccgtcccataatataacgtacgagacactcctgcggtccagattcattatgccatgaagtgtctcatccaatactaggttgctatattattggacggagggagtacaaacttaacaaattaacatatttaatatgttaaaacaatttctatatagaaagttttcgtacgtaacaccgtttagtagttaaaaaaaactatgcaaataaaaaacgatgtaaaatccgaatcttaattagaaaataacaggattgaccagagtcgccaccacactcttagc

SEQ ID NO: 38752 - DNA, 413 bp, Oryza sativa
ggcaccatggtttcaaatgcacaaaattactcaaatttttcaaaaattttaaattgtgagtatatacctagttataagaattcgattcatacatatatctatcaacaaaacaactcaaatttaactttatttcacaattcatgattacatacctaactaattatatgtatggatgctatatacctagaatcaaaatctaacaaaaacaagttcaaattcagttcaaacttgctttgaactagttagtaaagtagttaatgttaatacctaaataattgaaaaagtttcatactcatttgaattggttatatactcaatttcaacaatggtgcccgggcaccatggagcaccaaacaaatttactatatatatatatatatatatatatatatatatatatatatatatatatg

SEQ ID NO: 38753 - DNA, 655 bp, Oryza sativa
ccatgccgagccagtataaatcacttagatcgaaatatatattaataatgagactatatatattcatagcatagccgatcagatagatctagcatgtatcggctaatactccgataccactctatactaagatatcaaagcaagtaaaatatatcaaacaaaagcctaatatacttaaatgcgacaagatcttaacataaagggcagatttaacatatcaatgaagcatataaggtaaacatagttaaatcaggtaagatcggctgaaaccccgatactaccctaatcggcaaccaagaaacaggctagagattgatattctaatcatgactcataagatcaaactcaactgatacagctataagtatgaaagaaggacaatatctagacaatcaagccattggaagtttcatagagtggtggatatcctatataatctaagccaacgtcattatttaacctaatcggctgccctccactgacagatgttagccgattataggttagatagcgatattgctagagattatgtaagatatatgataactcaacgaattacataaacaagattagagtatcataaagatggaagcactaatcccgagaacgcaagccgtcataacaagttttacctcttgttgaagatcaaaaacga

SEQ ID NO: 38754 - DNA, 212 bp, Oryza sativa
ctatgcaaagaacccagaagatgtgcaaggccttcaacccaacacttctagcaccacaagggatcatgtcttttgtgatgaaaaacttcatcactaaaaggctgtttctcatcacaattacccccttgtgacgaattttggggtcgtcactatgttgtcaccactactggcgtcacaagtagcatagtgatgattttttttttcatcacaga

SEQ ID NO: 38755 - DNA, 1041 bp, Oryza sativa
cggtgattatggatggatgcttctcaattggtgtacaaattaatgtatggattgtgcgtcgtgctaaattgttacttatatgtatcagatattcagaaggtagctaggcttgttcatcttgccgagaccaactcgtacaaaacttctcgtgcataaaaaatgttcaaaaagagaagttcacacacacataattgtgtcatacctgcacgtgcagtagattagaaggagggtttttttttcggttgtatacaccctattacgtacacggaagaagattaggagtggtggatttttaaaagatctaatctaatggtctaaaataacataacaggtccaccgatttaaataaaaatagagggtttagatgtttcttgccacgtgacggtctaagagtgtttatagagtgtcatatggcggcttagtagcgtttataggatgtttcatggacttttagtatacaataactaggaaggtagcccacggattcacgcgggcatgtatcttaagatgtgtttgagatacttatatagttataaggatggaatattaacagtagaacaccgtcacgcttcgaaaacaatttctatgtgcattttttttgtcatcattgcctgtaattttttttgtcatcattgcttgtaatttgattaatccccataagaagaaggaaaacttagtttgttttaaaaaatatatctaacaaattaacgtaaattaaaaatcctaaaaatggaattattagatcccaaattgataaattgttgtttaaatggaattattagaaatgattttaaaagcctagaagaaaagatctaattttaagtaataaattccaatataaaagtgggtaaatttttattaaatacttcccttgattctacagttcctagatttttcggggatttatttgagccaagaaagtatttttaataaatagaattgcatttcatgaataatttataaggaaaaaggtttaaaaatccttcttttggttttgggccgaaagtcagcccaagtctctctctctctctcaccggccta

SEQ ID NO: 38756 - DNA, 1330 bp, Oryza sativa
gtggtataacaaactcaaagctgtaaaaacatgttgctggccagtcgtcaatcagtataagagaggagttaaggcaaaattatatatgcaatgtcggctagctaagacaagaatcaggagtatggagatctttttttttcgctgtattttttgatgaaaggtttagcaaaggatagacctttgtaaaggagagtagatgcatgcatgcagtgatgataagataatataggcatattaaaggcttaggataaaaccaaaggcaactagaagtgctaatgtcgaacattacagcccctgaaaggtgattccttcatgtgataatctgattgctttctgagtgcttctataaaatgtaaccccctatacatgtataggtttaaattctagaactagcatcaatgcatgaatcacaaattaattaacactggtttgcatgacatatatattaatgcctgcaattaatgtacacatgttaaaaggtatattaattatttgacattttaatttggtaggttaaaactatacttgtatgttggagaattaataaatatatatcacgctagctagcagcctttttcacactatttgtggagaacattatatttgagctctatatatatatgctctattatttgttcaccgatatcaccattggctatatattttatttaaagatacactgactttattcctaatatttacttatgttcttattttgaaaaaataacctttccagtcatgaaaaatctgtgagatcaaggttaatttgattaattctcaagggcattagtcatatagaggaaaaatagtactccctccatcccaaaatgtttgacgccgttgacttttttaaaaaatgttttgaccattcgtcttattcaaaaaatttaattaattattaattcttttcctatcatttaatttattgttaaatatatttttatgtatacatatagttttacacatttcacaaaagtttttaaataagacgcgcggtcaaacatgtttaaaaagtcaactgcgtcaaacatttagggaaggagggagtagtattagagcaagtttaatagtatagccaactactggctctaaattatctatagtcaatttaataatcaatttatacaatagttacctatacacatactcctccgtactcgtaaaggaagtcgtttaggacaatgtttaagtcaaaccttgggaatataaatcatgaataactcttaagttattgagtttgaaaatataaaaattatatgaatagattggtcttgaaaaatactttcatacaagtatacatatatcactttttaataaatatttttataga

SEQ ID NO: 38757 - DNA, 478 bp, Oryza sativa
ccgacagtagcccccggcgttatgccagggcgatcgccctcctcgagggaagcggtcgggcgtgacgccacttcctaaggcctggtgacaggtggggccggtctaaaaatcgggacaagccggttcgtttttcttggagatatggtgatggcgcttcggtcggcgagcgtaattaatgcgcgcacgagatgttccatctcgactgccacagccgcatatccacctcatgcaccgcaaacgggcgaatgggattagtggaagcgtgggcgcgagaaacgagggggcaagatagtgggcgcgagaaatgaggagccgggcacagcgttggcaagggtataaagtcgccgaggaagagatttgcttccttcctctcgccattattccccttgtcttcgccgcttgcgccctaactccttgtttcctgtgccctaccttcgccacacgcgctcgctctcaaacatctcttcttccggcgtca

SEQ ID NO: 38758 - DNA, 1501 bp, Oryza sativa
aaaagggtatccttgcaaatcccagcagaaaatcagacaatgcgtcgcaaacaggtgaaaaacggcatcattctcatgccagaatatactgaaaacccgaattttagttcagaccgggtcctcaaatctgaggcggttttctgcaacgaatcaactcttgcgcgcaatcatcctaccgccgactactgaaagaccacagatctctcccactatttccccaccgagatccacgaagttggcgcctggcaatccgcattaatccctcgccataggacgcagcaaaaactacaggaacagaatgcagtagggagcatggaaagttctagaagcgcacctggagaggagagcccgcaagaagagattaccagtggagcttagctgactgagagtgagtgagtgagtgagtgagtgcgcaaccaccaactaggtacagaatctggatttagaccccctgaagaggactcgtttaatattcccaatcggactaaacaagagtgtcttctgatgtcgccatggccggagctccctgcatcagccaatgcgccagcagaaaacagaataaactgaaatggtgacagcagaagaggctcagctcatatgatgaggggatcgtggggtccgtttctttgatctgaactgggtactgctcgaaaccagcggatcagtaaccgtggcccccggtttcatgggcacgattgtgtgggcagttggaatgttgggatcttgctgaataaagaacaggatcagtattgaggcttgacagttgagaggatgggcctctttgggtaatcagccatttgtcctcagtctcaaaataggtacagctatggattttttttcggttttagatttttttttaatatttacagaaataatctatggacaaaaaaaaattgcagaaatagcccctgccgcccacctctggggcggcaagctgacgtggcaaacgggggaggaacgggtggtgacggagggagggttttttgcaggaaaacccttgccgccctctggtggggcggcaaggggcccgaatgcaaaaaagccagtcggggccggctattttgcaggcggccccttgccgccctctggccgggcggcaggcctcgctgcctataaaaggcctgctgcccagcccccagccctcattcttctctcctcaattccagtgaaaaaaaaagaagagaggggaggagaagagaagaaggggcgaagccctgccggattcagacgccgatttcaggtaatattcatagatcctatatgtgactattgagttaaatagtgtgtattctttaaaaatttgtttgaataaatgcattatatttttagggttttagttgtactaatctagaagtgcgtattgtagatatcggtaactacgtagatctgctagtttggaattaatacattaccgttgcattggcttacacaagaagatgttacgttgtagatgtttattgcatgaaagagtaatatgatctagttatttcgttgacagata

SEQ ID NO: 38759 - DNA, 546 bp, Oryza sativa
tattgcaaggtgagcatatgacatactcaacaagccacacagcaaatatgcaagtgcacaagggtaccaaaggatgggcatacataggctcatttgcaaaagcagcatttagcaaacatttaagagtagtaaaacaatagagtaattaatcatcaattttaaccaacactgcacagcaccccaatgctgcacaggcccaactatcctgaacaaccatacccggctatacagatctatctccaaaccaggagctaaacaaattattaccaattataacatcttttattatggtgagaagtgtgagactaatcacgaaagacattgttagacccgcccatgaccgcgggcacggctattcgaatagttttactctggccagaggtgttccactgtacccacaagacacagctccacaacatgtcaccatgcgcctcaataccaccacggtatctcggaaaagagctgtgacagtacccctcgcacaacacaattcaccacaggcaccattcccggatcataatcaccccctcaaaaaaaacagaggca

SEQ ID NO: 38760 - DNA, 1501 bp, Oryza sativa
cctcaggctcctggaaccccaggtcatcgtcgccatcgtcgacgtcctcggcggtggccttctgcttggcctcacctcgccggttgccggcgggagccgccggggtcttgccctcacggcgctcctgcctcttctcctcctcccacttcctcgtccgctcagccaaacttttgaccgcgcggcagtccacgaggtcgtggagggaggtgttgtgcacggtacaccacttgccggttgggcgctcccacctgggagcaccggcctccttctttttgtcgctcgcaggcctcccctttcggggggcccgcgaagcgccctcgacggcgaggacatgaccctcgtcgtcggaacgggccgaccccttcttcctcctcccgtcccgccgccctgaccgagcggcggatccgggggcggccggagctgccacaccagaaccggaggagttccaggtccaggcctcctccttgcgagccacacggtccgcgagctcaaaaagttgcgcggtggtctggggctccttggaggcgatcttctcgagcatgcggttgtgccgcacgccccccctgaacgcgtagatcaccgcgtgtgcggggatgcacggtatggtgttgcggacttgacagaaccgctgaatgtacgagcgaagagactcatcgtcccttcgctgtaccgcatgcaagtccgcttcttcgcctgggcgcggatatatgccctggaagttcgtggtgaactgctggcacaaatcctcccaagagtggaccgacgcgggtggcaagttcattagccaaccccgcgcctgacccttcagggccatggggaagtaattcgccatgaccctgtcgtcacccccggcagcctcgatcccggtcgtgtagatctggagaaactcggcggggttgacgcttccgtcgtatttttcggtgatggtgggccggaatcttgggggccaacggacgttccgaaggctcgccacaaaggctcgacagccagcaccgccaaccggggacacggggggccggcccccgtgcccgaaccgaagtggcgctccggacgaggaagcgccctccgttgcgtgggcggcgcgacgagcgtcgcgccggcgctcgatattgaggcgggcatccggccccccacgcacatcttcttgggtcggaggcgttgacgagggaatggcggacgaacggcgggtaacggccgccgctcgccgcgccctccgcctcgacgacatggagccggctgcggcagcgccagaggcctcggtggcggaggaccgcccgccggcgcctaggcgccgctgcgccgtcatgaccaagtcggccacgtcatccagctaacgtcgggctggagtctctggatcggggacgacgggcgggtgacgcaagagcgcgcccgcagcctggagcgcgccctggggcgtgccgccatcgccgtagacgaggcggcgacgcgccctgtctcgccgtcctcccccgtcgcccgcgggcggcgaagtcgcggatcg

SEQ ID NO: 38761 - DNA, 1501 bp, Oryza sativa
atagggacatttaagtatttaactgatatatacgtctacattctggtggtgctggggaattcttttttttcatataaatcttcagtatttgtgattgaagatagcacgtgtacttgtttattccatgtattgaccgttgtccgctgtgatatcaacaaatgtacgtaccccgatactatacaaaacaattaatgtgtactctcctatgtagcacaccacaaattctttattgaaaacgaagcatagaacattatatagaggccggccggtgccatccttctctcgaaggatcaaactttgctaatccatcgttccatcttctgtgctaggttggcaccaagctagcgtacgctgtctatccgcggaataaccatccggtcatgcaaattccaccttccttgtaataccattccaagtcaaagctcggagaatacgaaagggaaccaagccaagtcttattttgtcattccgatacctattttccccatgtgaaattcgaatgttctcaacatgactcgaaactttgatactactacctgttaactgctttctcatgcagatcccagcgatccggatcggggttcataaaaaaaccgacacagctggagatggaaacatggagaaccaaacaaccccaagtgacgcgaacgtggtggtgatcacacgctgctacgggacaagccgatgacaagtgcacgtctgcgcccagcaactttgacatgtgccgttggccaagccaaatttaatactccgtatcatacacatctgtaccgaatcatctgcgtagcagtatcatggcgtatcatgcacacacgtggcggataagctggcttggacggctaaagttgtacgcgtccagagcgaggaggtgatgaaaattagaggagaaaggttgcagtcgcggcgaagcaagatggacaagcagacgccacaggggcacggcgagaagccgcggtatttgcccagatgggcgcctgttttgttcgaacccgacaggtgctttcagccggaaaggcgaggcatcatcatccgcgtcgaagacgcgtagcgatcggtagagccatcaacacacgcacgctgcggtctcgatcatgattcgcactttcacagcggttcgtttctggcgttttttttttctttttttgcgagcacgatcacgatctcagctagctagttttacatccaaaactagtactgtcgtgtacaaggaataaaatggaacggttttggggcaaaaatccttcttttccccaaggagagggagagttttgcacataataagccttcctctccgaacgaacatcaacatgagagggattgaaactgacacaagatatccagtttgcatcaggtttgatgaggatggagggcatttgtgttccttaaatgtaaggttgtcaggaaatgctggcgaattttgaatatggagcaaattcggttggatctccttgaaaatggggagttttgaaccaacagttcaagagaacaaactgaaaagata

SEQ ID NO: 38762 - DNA, 1501 bp, Oryza sativa
ttggctcagctaactggcggcacttataataaaataatctattaatgcataattaatcggttcctataaacttaaaaatagaattatttgattttagaaaagcctttttgtgtagaaacttttacatgaaacacaacgtttagtaattctggaagtgtgttcacgaagaagaacgagtaagttgccattgtaaattgctctctagaacttagcatacaaagtataaagtgagtagtagctagctggtgagaatctaaaaaggttgaaggttttaatttctgatttttagtttatttcctaaagtgtatagcttttattctcgtaatatatacttctacatgaaaaagattgactacccggtaccgagcaacttgtcatgtgattgactttatgatcaatgtcctgatgtgcagtactatctccaagattggaagatgacgagccaaatgacgcagtttttgcatcgaagcgttgaaaccggttgtcaaattaaagtatttcttttcttcagattaaagtatatctgcaaattctttaagctgcattattttgacttgggagcaaccagccaagaccacggaaacaagagtgacatgggcaacaaagtcgataatgtacctagactgagttcttttcatcaaccccaaaccgtaattttttagcatgtttctcaaacgattaaatgatatgttttgtaaaaaaaaattgtatatagaagtaactaaattaatttttcaagtttgtaataactaatacctattaatcatgcgccaatggtttatcttacgttcgtgaaaaagtgcagccgaaaatctaccactagctacttagaaaagaacgcacccttatattaaagtataagtgaattgtttgtcttttttatgagctaagtttttatagtttatattgaactggatgatacatacaactcagtataacttctctttgccccaacacccaaaaaagtttcataatctgtggcactgtctgtgggcctcatcgtttggcttttttcgtaataagccaaaacggcttattagagaataaaaatgaatttgtaggtaaaacttttatatatgtgttctcggtgacgtaaaagccaatgctgaaaaagaaactacgttgaaaatatcacaaaatcaatgttaaaattaagtttgaaaatttaaattttgcctttttctttggctgaataggccatccgatggaagccattgttgtaaaacatggtactcctagcagatattcggttgaagcaatgccaacatgtcatcaagtacaatatcttatcctctttgtaaaaaaaattataatcctaacttcgaatctagatatatacgtatagaggtttgtagctagaatttgttttttttaaggcagatcttagtagcttccaaagccgtcatgcattggttaagccttaactaagcctaacgacatatgtcaatcacgatcataacttgactgagagaatgttgttgcttcaaggagtaactaacag

SEQ ID NO: 38763 - DNA, 1501 bp, Oryza sativa
tgttgcatgctattcgtacaattcactgttttcttgagcacttttactgatgtaatgtttgcaaaatggtgattggttgtgatatatagatgatggaaagtgcgtgacaaaagaggaccttgagtcggacgaagccgtgtgggccttatttgagcgctattgcaagtcatacaacaggaagtatgatcatgctcagatggttcgccgcttccgtatattcaagttcaatgcaaagagaacatattgctggaaccagtatcttcataaagacgtaaaggaattagctcgcgccaaaaaggatagggatttaggactacctgtcgactcttggtacctacaaaaagagttaggcgaatacgacgatgggggggagccacttactgaatattggcggaaattttgatggaaaaccatctgccgctggtgtgtcctgcatcactccacatgttactgcagtaagagcagtttgctccccaaatcacttcactgtaataactagtagtcctttgacgttccgtgtttcttactaaggatgcgttcgtttgggtgatagggagtgagaatgcacatcgttttccgcacgcacgcttcccaaactactaaacgttgtggttttttgcaaaaattttctatatgaaagttgctttaaaaaatcatattaatccatttttaaaatttaaaatagttaatactcaattaatcatgagttaatggcttacctcgttttacgtatctttctaatctcctcaatccccttctcctcaaacacaccctaagttatgcttgtgtaccatctacttaattatctaagaggtcatgatatcttgcatatggttccacgtatgggagtgtgtgcgtgtctttttttttttttagcctttttggtttacaagcacaagttttctagcagaccaagatcaagtgtgatgattctggtaatgtatgcagctgtttgtgcacattaatttgttgagcatttattatgacgaaactaaaggttagtatatattgttatgtctcaaaaaattcaacagtttaaccgttatcatttactcattgttcgttcattgatgtatacaatatcaattatatccagtggtaggacctttattaactaataacacatgaatcttacttgaatatatatccagtgatggaactaaaatttgttatttggattagttggcacattggacaaacgaacggctgttaactacctatgtgaaaaattacttagattgatcatgtggctgttaattcagtttatctagaaaatatttttgcaacctacttgtttggtgcttgcattgtttggcaacccaatgagcaagctctaggtgcgcagccttgatctctagttacatgtacagtagttgcgctgcctcaaggcaccatgttaaatgcagaaatctagacaaaattttgtaatatatcctgaataacttcaatgttcagactctttcctatgattcttttgcaatgtaaagaacttcatcaagtt

SEQ ID NO: 38764 - DNA, 511 bp, Oryza sativa
aatttgttttggagggctgagatctgagctatgtcaccttgtgacatgcctaccatatgtcatccaatctgaatcctgaaaaggccaagatttctcattgtttgttagtaattttttcctagtcaaacttaacaagtttgataaagtttatagaaaaatttagaaatatttaaagtatcaaattgatttcattaaatctaacattaaatatattttaataatatatttattttgtgttaaaaatactactatattttttttataaacttgatcaaacttaaagggtcttatgatatgaaacaaagggaatatttagctctgatccatgtaacttaaccatagccactaccactatctgtacataacctgtagctagggaggaggataaggaggaagtcacgaagaagttaccagctgcccaggacgccggcaaggagccttacctgagcaaggaagcagcaatcgaggcagggttcgtggacaaagatggcaagatcctgtggtctagcta

SEQ ID NO: 38765 - DNA, 1501 bp, Oryza sativa
ttatctctcatattttatctcactaaaatatgtttacagctggctaatagtaacgtggacccttagaattggataaaattttagatagtcgcttgtcaaactgctaaatgataggttttgtatgaaactttctatataaaaattgctctaaaatatcaaattaatctatttttcaaatttataataattaaaactcaattaattatacttaataccatcgcattttacgtaatagacttgatcttcaatcttaaataacaccaccgaagtctctgacaagaagacccgtgctccccgccggccgccggtggacggagctctgtgtcaaccggagctcgagctgctttccatcaccggacatgatgaaagccttgatctgttgccggcaacgtagtttctctgccggccaacgcgacggcgcgacatcccctaatcactctcaatccattctgtggtaaggtagggcaaccgcaggtgattggagaggcaccctcaaaatctcaatccacccgccggcgtacatctccgctaccacctgctgcgcgtggcgtgatggctccaagctagctttccccgccgcgcccgcctgaggatccacaccacctgctcggctgtcacggctcgccccacatcgcgcgcaggatgttcgacgaattgcctgacccggacaacgtctcgccgttacgcgtcgttgaccagactgcgcctgcttcccccggcatgtgcacgcccacgccgtgcagctcgggcttttgctacagcacgttcgtcgggagtgctctgcagctctggtgcgcatgtcccggcggcgcagggtcagacaggcgctcggtatctctcttcttcctctgttagatgtcttgccgttacatgattcgtcttgtgctgatttctgttggatgcttatgctaaacagggaaatttacacggagagacatgttgcaatatcactgaacataccgggtggagatcatttctgttctatattgttggagggcgcccaggaattctttgattcattcagattttaccatcaggttgcacagatttggtttctggttcattataataagcaataaagcaacaagatgacccaaaggatgaattctttgcatctcccatctctccacaggtaccaccttttggctccatttgcttgtcttctttggcctaactggtttcctccacagctgcatagctctgtcagattatgtgataagaccaattgcatgtcacttgaagccggttatgactccacaatgcaacattgttgcaagcgttggactatgtgataagacatattgcatagcctactattaatgaatgggtttgggccaattatgaatgctaatagtccgccatttggaaggcttcaacctggttagccggccggccagtcagacagctaccccgctgtcttgcaaaattatggctagcagttctcccaagcatcagcagtggcagcaatgagctctcatcgccttctattcacacagcttca

SEQ ID NO: 38766 - DNA, 474 bp, Oryza sativa
tgagtatatagtaggcggtacaaatactcatataagaaaccgtgttgaaatatctctgtagctttggagaaggggcaaacataacatttcatgaaaattaaaaaagttataaaatcatattttgaagtcagcttatatgaaaactctataagtatatttgcaaagaaaaaattcaattggaaggatgggttattagaaaattccaaaacaatgcagcgctgaaaaaaaaatgaaagtaggaataatgcttgtcaagaaaaaattacaccccagtgtgccctattggaacatatgacatgtctcatgtaaaattgtttgaagtgcatgtcacttcgtcacacacaaataaattgaaataatactttatgatcaaagcagaaaagagaataacacagtacgtatagctagagatactaagggttggattctttggaatagcacatatgtattgttaatcggtatggactacacaga

SEQ ID NO: 38767 - DNA, 1078 bp, Oryza sativa
  unsure (1)..(1078): unsure at all n locations
tcagaatgggggaagtaatattttataacatgagtaatagttagttttatttcagttctattattgtatatctaatttaaatattttgcagttatatacagtaataaatcctatatctttttttcataattttgtaatgattcgaatagcatgaaaaagtcaaaaaacatatcccaaaagtgacatatctctattcaaagtatatttatattgaatatggttctttaaatataaatttagtcataaataatctaaagacataagtggataaaaaattgtatgatttagatatcatagttacttaatctttttttctagaacaaattttactttctaactaatatactttgggagtattactcatagttaggctcattttgtgattgtagatccaatttaattattgtgaagttatgcacgatgataaattcttcatgtttttaataattgtttgaatgtcatgcaaaagtccaaaagtgacatatttgttttcaaaatcgaactatagtgaaatttggtctttaagtaaatttagtcataaataatctaaacacataagcggatgtggtatagatgtcatatttgctaaatttattaacataattttgctttctaacgaatctataatactagaaaagacactgattgtggtggttctgccaccaccactacttttgtacttttggaggttaatgccttatgttttctaatattatataatagtctaatgtttgattgaaactagtgaatattatgtgttcaattaagcaaacatctccatagcatattattacatattttcttttatccataaagcatgggtattttgcttgtaaaacataatatataaggaataggtggtaaagaggagtaagaaattgagcgaagagagggtggatgtatgacctacatacaagcgtaggcagggcctggtttggtacttgactttttttattcaagataagtgtaatagttgtaaataatgggtccaccaaatttaatgagaatcaactacgatatgggtnnnttcgcctttttcaatttccttnttaatttatttgagtgtcatgtaacatct

SEQ ID NO: 38768 - DNA, 467 bp, Oryza sativa
aaaagttggatttgagaaatgtgtactaaacatactgcaagggtcggctctgagcccactaaacatactgcgagggtcggctctgagcccaaccaatggacggataccactccacttacaggctctgagcgcaaccaatggacgggcctacgaacctacttatactttcgtcctcgcttcgtgtaaaagggttaacctagaagtgatatgattggaaggaagatgtcttataagttggttccaaccttgttaaactagtaaggtggtactaaacatgagcacataactcaaggtggtactaaacatgagcacataactcaaggtggtactaaacatgagcacacaactcttataagccacacaggctaaattctaattggactgggatattaaaaaaccatactggcctacaatggtaataagctgtctgaatgatgatttcaattatgttccttggtaataatagt

SEQ ID NO: 38769 - DNA, 1501 bp, Oryza sativa
accgtcgccgccgtcgacccgatctcctccgccgtttcctcctcgccgccggtgccgtccgttcctcctccgccgctcctttggtcaccggtgagttcgccgcgccgtccgctacccattggtgctctccgttcgtgccgaagtgccgccgttcgccggcgagcgtgcgccgtccgagccgtccgagccaccgccggtggtgacgtcatcgccgacgtcatcgtcgccctctcccgtgagccggtcgtggaccgatggatctcggccgtccgttttggatcaagttgatctcggctgtccgttcgcgtgaaccatcgcccgtgcgcccggtccaccgaaaccctagttgctgacgcaataaatccctttttccttttcaaaaataattcattattgcgtcataattcaattaaaatctatataagtgttttaatccgatttaatcttcaaaaattcataactaattcatcttactcggatttagttggttcaagtctctaaatttttctaaaattgagatctacatgttaaaaatatccacatgtactgttcatgcttgtttatgtgctgttttggtgattttgcttctttctgcttagattccgacgtttccggagagtccgttttcacaggagaagaatttgaagagttccaaggccagcaaggcaagtcacacagatcccaaacaaccctttgagcatgttgatcctatttaaagctactgtttctattcaactattgcatttattttcgaatgtcattgggtggaattaacctgttgtttgttatagcccttttgttcttgattactttattccttgataccttgggttaatataacttgactagttgagctttatatatattggttcaactagatattagatataattgcttagccctgcttagaaacattagctcactattgggataactcttgactcactgttagttaatgatggcttaatgatagctcacgatggtcaatcgtgattggttagttaattaatgtgccaactaaaacctgataatggtgggttgtgagcacatggttttgatggtcgtgctcatgacaattaaggaccggttcacgagtttcggttgtgaaacattaaccgtgctaaccacaagccagcatgggcaacggctttatcttttgtatagcatggttcattgcggagcaccagactgagaagtggcggagataagtccacgggggtcgctggggagtccatgccttgtttataagggggtgattatgatccaggaaaagtgcactgcagtggattgtgttgtgcgaggggtattgtcacaactcctttccgaggtaccgtggtggtattgaggcacatggtgacatgatgtggggttgtgtcttgtgggtacagtggtacacctctgatcagagtaaaactattcgaatagccgtgcccgcggttatgggcgggtctaacaatgtctttcatgattagtctcacccttctcaccataatagaagatg

SEQ ID NO: 38770 - DNA, 559 bp, Oryza sativa
  unsure (1)..(559): unsure at all n locations
acggccaggccttccctccgggtncgctagcttcattctnnntacctcgccccgttcgctcctcaatcnctcctccgcctccttcttnntgacgtttcttcnncacgcaggcacngctgactccgcacgccccgcagcgccgcnccccagaccccaagaancccgacccccacaaacccnaacnagaccgaagagggatgccatttaacaacagaaggaactcaaatatgtaattcctatttttttcgaggaatggttctcaaatcctactaagataggatgcaaatggcatttacgttaacaatggaaggaaaccaaattaacctgagagttctcaaaagaagaaaaaaaagaatgctgagtatgaagaaaataatcacagcgagcactaaaaaacaagcaagacagagactgctcaactgaacttgaaagtgaatcatgagaatacaggtcatcaacaatttaaatgtgaaccccaaacaactcattcccctgtaccctgtgacccatatgtgattagatgctctgtccggttcttcgctttacccgcatctacaga

SEQ ID NO: 38771 - DNA, 1501 bp, Oryza sativa
agtcccactgagacaaggagtgcattatgtgcacctataatcaatggtaagtgtgttccctaaatatacacaacagcatgacacgttccttcagtactgattaactttcactatattaatgccgtagtgaccattggatccttctggtcataacacctaagtggagtacatgtcactacctgaactccagaattgataagaacgcatatgattggaccccaattcaactagcgatagatgaagtgtgggcccaatacgtgcaaagaggaggcctcaggaagacaagacatcacatcctcatccacaaaaaagacttcccggtgaagcaacaaataggtgaccagtgcggattccatgtgtgccacaacatgcgccttctgtacaaagaaaaggtgaagactttgacagggtttgaggtcggtggtctcaattgtgatagactaactaactacatcgaagtacatatatatgatcgatcaactaatctcgatctatgacaatgtagggcaaaattaccaagtctctgcctaccagctttgaggagattcgcgaggagatagccggcttcatcctccgcgaaataattaatcccaaaggaatgtttcggcttaaactaaaatgatgaacattgttgaacttttatgtttaggcaatgatgaacattgattatgtaactgtgatttttatatttatttatatatttcttatgtttatgttaatacttgctaaataaatatttgatccaattaacttggttttgcatgtgcaatatgataaatatttaaatagatgtgaaatatgagatcaaaatggatgttctgtgaatgtggttgtgtgaaatatattgatggttgtgtatgtgaatgcatatatatgaatgggtgatgctagggagctggggatattggatatctgtgtttctgtcatttttgcagcgagcatggctagcaaaggcctgaggctagccaaaaaacaaagtttttattttgtggattatactcatctgtgacgggccataacttaatgcctgattgagatgatggtcatctgtgatgggccgtagttaatgcccgattgagatgacagtcatctgtgacgggctatagtttagacccgattgagatgagtatcatttgtgacgtgctctagtttaagcccgattgaggttagtagtcatctgtgacgggctctatttgtggcccgattgagataggtcatatgtgacaggctatagtttgactggtagtctgagtcaaagctatcggtgacgggcttcaattagggcccgattgagataggttcatcagtgacggccgtttgcctgattgagattatttttcatatcagtgacttctagactgttacggacgccgtgcccgattgagacggggcttaccgcctgtttgagatgagggtatccgttctagtgtatgtatctaaatgcaacttggactccaaacaagattaacttgatacaataagaaatcagtctttaccaatc

SEQ ID NO: 38772 - DNA, 1501 bp, Oryza sativa
atagtagggtttcatttgcaaaagcagcatttagcaaatatttgagaatttaataaaacggttaagtattaattaaacaatattaatccaacgctatacaacataccctgttgcataggcccaaccattctgaacaaccatcccggctgcacagttctatctccaaaccaggaatataccattccaaaccaggagctaaacagattattaccaattatagcatcttctattatggtgagaagggtgagactaatcatgaaagacattgttagacccgcccataaccgcgggcacggctattcgaatagttttactctgatcagaggtgtaccactgtacccacaagacacaaccccacatcatgtcaccatgtgcctcaataccaccacggtacctcggaaaggagttgtgacaatacccctcgcacaacacaatccactgcagtgcacttttcctggatcataatcacccccttataaacaaggcatggactccccagcgacccccgtggacttatctccgccacttctcagtctggtgctccgcaatgaaccatgctatacaaaagataaagccgttgcccatgctggcttgtggttagcacggttaatgtttcacaaccgaaactcgtgaaccggtccttaattgtcatgagcacgaccatcaaaaccatgtgctcacaacccaccattatcaggttttagttggcacattaattaactaaccaatcacgattgaccatcgtgagctatcattaagccatcattaactaacagtgagtcaagagttatcccaatagtgagctaatgtttctaagcagggctaagcaattatatctaatatctagttgaaccaatatatataaagctcaactagtcaagttatattaacccaaggtatcaaggaataaagtaatcaagaacaaaagggctataacaaacaacaggttaattccacccaatgacattcgaaaataaatgcaatagttgaatagaaacagtagctttaaataggatcaacatgctcaaagggttgtttgggatctgtgtgacttgccttgctggccttggaactcttcaaattcttctcctgtgaaaacggactctccggaaacgtcggaatctaagcagaaagaagcaaaatcaccaaaacagcacataaacaagcatgaacagtacatgtggatatttttaacatgtagatctcaattttagaaaaatttagagacttgaaccaactaaatccgagtaagatgaattagttatgaatttttgaagattaaatcggattaaaacacttatatagattttaattgaattatgacgcaataatgaattatttttgaaaaggaaaaagggatttattgcgtcagcaactagggtttcggtggaccgggcgcacgggcgatggttcacgcgaacggacagccgagatcaacttgatccaaaacggacggccgagatccatcggtccacgaccggctcacgggagagggcgacga

SEQ ID NO: 38773 - DNA, 1045 bp, Oryza sativa
cctttgcttcctccactcaaatctagagcctatcttgtgagattgagagattagattagagtgtaggagtgttttggagatggcttgaagattaggtttaattgagcactttggatatcttgtgggctgtcacttggacttattactcttggagatcttctcttagactgttaggtgtcgcccgtgagcttccaaagatcttgtggatgtcccgggaaagtttgtgaaggttttcctcacctccgcaaggaaatgatgtaagtgagtaaagattcttgtgctgagttttcagaagttgtcctaggtagagcaacttgcacttgtggtcttttctagaatgaattgtgagttggatcttggtggtcactcaattctagaaaatgacctagaagtgttgagttgaaggctgtggactccttatgggatctttgcataagtgatgcaaggggttaatcgagacccggctctttgagcacccaatggagagtaggatccgtgtgatccgaacttcgggaaaaaatcgcctttgtctctcttgtgcatgatctgtgtttgaatctgctggtatcttgagatctacatcttgtgcaactctgtgcctgatcatctctagctaggacctgttttacttcccctaatttcgcttttctctgttgcccggaagttcctggctcaagaacttcggaagttccgggctactcatcctgcccggaagttccagtgtttatcaccaggaggttccgggccctgtcaatttaaccgctgcaattgttgacaaaatttcaggaaagcctattcaccccccctctaggctacatctctgcacattcaattggtatcagagcaaggtgctcttgattcaagcttcaccgctttgagtgatccacgatgtcggacttagggggaaaggacagggaaattggaaataaagatggagcgagcagcaagggaactccatcacccaagggagccactataccttttgattacagctaacttaccattccctctcacaatttcgtctctgtgccttccggacgtgctc

SEQ ID NO: 38774 - DNA, 1501 bp, Oryza sativa
gaagaaaaaggatacttgagagagaaaaaacatagcactgaccaaacaaagctactggtacctactcgtatcaggtatattgccaatacctgctagctacacatatcatcactgatacgtgatacttacatatagcatcgttattaactagtactacctccgtcccaaaataaatatagttttacactatttatctccaacgtttgatcattcgtcttatttaaaaatttttttatgattactatttttattgttattagatgataaaacatgaatagtattttatgtgtgactaatttttttaaaaaaaaattaaaattttttaaataagacggacagtcaaacattggacacgaattaccacggctgcactttttttagaatggaggtagtaccaacatgtatcatcaccgatacagatacttgtgtgttaagcatcatgattgatacctgcaagtatcaggtatcatcgttgataccttaatgtatcatcattgatacctcaatgtatcatcgtcagtaccaataagtatcattatgtagtatctggtacttataagtatcatcaccgcggcaacatatcctatgcacacaggccctcatgtgtacacacgtgcataccaactaaaaaatgtcacaaaaaaatctagaaaaaatcatacacatactttcaattgtattacacctagggttaaaatattaacgttaaattcattatattttagccgtaacaaaaaaaacaaaaaatctgacagttttaaggttgcaattttgtcagaattttatcttttttgttattctctatgtagaatgaatttgaagatgcgactttgcacgtagatgtaatactattgaaagtacatgtataaattttcctagaattttttgtgataatttttagttggtgtacacggtgtgtacacgcgaggacctgtgtgcataggatacgctcctcatcaccgatacttgtatgtatcaggtaccattgccgatacttgctagctacacatatagcatctttattaactaataccagcatgtatcaggtaccattgatgataactgtagatattattgtcgataccaagcagttatcatcacgtactatcatcgctgacaccaaagatatcatatagtatgggtaatatagatgttcgtgtatcatactagagttgatatcactgtacacgtaaataaaaattctaccagctaagtgtttcatcttaatacatatgattaacttaaataggattagaaaaacaaatgttcctaatatgatcattctagcagcctaactactagactggttcacgtgtggcctaaagtcatagacacagacgtggccaccactcataacgtaacttgctggataggtctaggctctaaagctctagcaccgtctatataggacaatatatagagtgtagtactagtaatagtcaacggatttgtgggccctagttggttgattgactgactaggcacaaatctcgacgctcag

SEQ ID NO: 38775 - DNA, 271 bp, Oryza sativa
ggcgaattcgagctcggtacccatcagagctttgcgtggatctttcgcactaggtaaacctgtattcttattgtgtaaagtagttctcaaggttttgttgctatcatgtgaactaagttttggtgccctttccttgtgctgcgcttaatacttcagttcaatccaccttaacatagctggatgactaatatatatttaacatgtactacctacaagtataccctgaggggactcactttatgattccatggtttgagaggccaatcattta

SEQ ID NO: 38776 - DNA, 1501 bp, Oryza sativa
agtaaattttacaaaactacaggtattttgaccaaattatcacaaaactacagatttaaggagttgtatcataaaactacacatttagcatcaaatttatcacaaaactgcagattttaggttaagtatcacaaaaatacatatttaatattgaacttatcacaaaactataacttttggagtttaaatccctagcaccattgttatggtggagctataaacattattactttgtgattaaattggttctaaacctttagttttatgataatttagtaactaaacgtgtagttttgtaacacttcatctttaatatgtagttttgtgctaaatttggtgctaaatgtgtaattttgtgatataattccttaaatatgtagttttgtgatagtttggttataatatctgtagttttatgaaatttactcttttcgttttcactgcaatttggaatgatggaattgactagatccggcattaccgatgggctgccgaacgctgtgatgcggttgatcttgagcgatccgggacgccacaagcaccgatgggttctgggagttcatacggctggtgcagcagtgtgtcaatagcagccgggatgtgcgcccaaccatggtcgccgtcgagaggaggatcgaagacatcctgaactcggttgtcaggtcatccaccaccgggttcatgactgccggaggcgacacacccagcaacgagccaaatcgtgaagataacggaaacgagccaaatcccagcaacgagatcgccagggactagtagtacgtacagcagtggtgatttgtcatataggtgtatatcggctgttttcgcatctcaaggcctcaagcagtgtgtgcaatctggagtagtatataaatatgtaaaatgttcatttcgatatactgtcaaatgcgtgtaaattaaccaatgctaaaacaacacactgtgactaaatttactgagttggatgatgaggatgattatgttgcgtgcacacctgatcaggaggacatataatataggccatttgggccgtcttggacaccaccgtttgatttgtatgaagttgggccgaactatgcaagcccagaggcgctgcctctgtgccacggcccacgggcatcgctggatggtcaagcaggtgatcggtggagcgccaatggcggcggcgagacacacagcgcggcgcgcgcgcgaacgtgcggacgcgcgcgccccggccacggccgccgcgctcgtttcctggcctcccgcgcccgctacaaatggcggccccggcgtcccctcctcactccgaagcttcccggttgacgacctctccggtctcccccctcaccccaccgcaacccgggacgtcttccatggccgacggcgccgccggcccccgctactaaaccaccctacccaccccctccaaactcccacacattacatccttcaaagagagcatcacacacacacacacaccagcctagcgatcacatttccacgatgacgacgacga

SEQ ID NO: 38777 - DNA, 1501 bp, Oryza sativa
tagcttataaaccgctattaaaatttaaactttaaatttaatttttagttttaagttgattttggatattattttatcataatttatttttttcattaacttttaaatagtatatataaaaaatttacccacattttttaataagcaattacaggttataaccggcatatgacaaatgattagcatatgacaaacgatgaggctaacaatatataaatatttagtgataaaacatcagtggtgtaacggtgatgtcctggatacatgactcgatttcaaattctgatatcaacgaacattattcatatgtgggtgtgctttttcgtgggctgagcgtatgagacggagacctaatggaaatatgtaggaattgtatttctataggatttttttcccatatagccatttgaaacaaataaatgaaccccataaaattcttatagaatatgtctcattccatgtaacttttagaggaaatttaacatgagggaaaacctcatgaaaagttttatttgagtctctgtctctccttaaaattcatgtgtcttttatacggtcattttttgtgttttcttttgttttacaatcatatgttttaaagaggcattcctaacataattctatatttttcatgcttcttcggtttttttatttctgtgatttattcgggtcccgagagtaggatgttgcatgtatggtggtgaacgtgcagttaagtgaaaaatttactgaacgcttgttcgcatctactgctgacgtggaactgacggcgccggaggccgtcaccttaacggcggcgagacgatattaaaggagagccgcgtcgagtggtgtgacgagaaaaaaaaaaaaagagaagaaagagaagcacttcgcccagggaaactctcttcttcttcttcgcgaaaacgaaagaaaaggagaggcaagaacaagaacatctcatccccaattcccctctccctaaaccctaatcccgtccgattcgcccccaccggcctccaagatcgaagctctttcggcatctccggctggtcggagaggagctgcgcgtggagggggggactctcgattccggtgagaaaacggcgcgacccttctcccgatttcgcgatttcggtaccgtacggttgctcgtcggcgtcggatccggacgcgtgtgggcggcgaaaggttggccctcgcggttgatttggtggtggcgcggtgtctgaggtaggttctctctttggattcgtcgtcttctcggtttcttgatttgagtttctttcgagtttttcttttctttttttttatgcatgctgcgcggcattcaattctctcccatctttttcgcctaatccggtgtgcttattcttgttctgtttcagatggttgcgtgagccattcggagaggacaaggtcgaggaggagcagcagcttctgttcgtggcatttctgttgcaaagattagtgctccatttctctgcaacctcgcgcgggggggagggggggagggcgt

SEQ ID NO: 38778 - DNA, 540 bp, Oryza sativa
cacattcccaaaaccaaaacataaatatagcacaaaaaattgacaaattttatggaatatatgaagtagagcaaccattatacgagtttaattgccataataatacgcaatacccaaatatagcggctccctaatctcctctcataattgccggtgcgtgatgcgggagttggttcgaccagcccaaccgcttcccacccgaacccgacctgccacgtcggaccaagtccaacgcatttccgccccctccacccaatcccgcgccgccacgtgtccccgagtgcgcgagaaatttgtcctaaatcccaccattaccgcggccgctttcacatctcctcctcctcgtaatcatcttctcttctctcttccccggcggcgacgcggcggcgccggtcaaaccactcctcgccggcgaggggagcgcggatcgggctcgggaggaggctaggggtttggctcgctcgctcgctttcggcgtgcagctgaggcggtggacttggcggctgtggcggaggtggggaggtggaggtggaggggaga

SEQ ID NO: 38779 - DNA, 1501 bp, Oryza sativa
catatttccattaggtctccgtctcatacgctcagcccacgaaaaagcacacccacatatgaataatgttcgttgatatcagaatttgaaatcgagtcatgtatccaggacatcaccgttacaccactgatgttttatcactaaatatttatatattgttagcctcatcgtttgtcatatgctaatcatttgtcatatgccggttataacctgtaattgcttattaaaaaatgtgggtaaattttttatatatactatttaaaagttaatgaaaaaaataaattatgataaaataatatccaaaatcaacttaaaactaaaaattaaatttaaagtttaaattttaatagcggtttataagctaaaagacgaactatggagttaggtatgttgttaacaacaaacgagcaactaagatttctattattttccttaaaaagtattattatttcaccctcttcagtaactactttttattatttaaccctgatttttccagtgtgtggctgtgagctttcaccgtttgagagcagcttcagtgctggtgtgtttggatcccagccattgaatgccatagctacagtattttcgccacgctatagtgttttacgaaacgtccgccacactcctgtggcgagccacgccgtggcgtggcattccaagccaccaaccaagcatctctcaacatgattactgcgtaatctgatttttgccaactaaccgccacgtcattgagattgagaacgaaatgtgtacagatgagttaatttggatgaagtggcaaaaggaaggtgacatggcaggcagcatcggcttgattaatcactataaaagggacatgatgttcttagttgttaaggcaattaatttattcacgttggataagatagaaccaccggtccatcaatattggtcacaaatagatacggtatccttgatcagtttatatctcaaatagtttttttttaacaactcacacgaaacggtgcgaagttctattcatagagtagaaaaaaatacaagattacaaccctagaaagtcgtaaccaaaaaaataaaaaaattataccaccacccacatactaactgcgccaaacacagacccaggagaagtctagcaccggaccggccaccactcagcgtgaccgaccgtcgctaggccaacaatggaacacatccgagatcgcccaaaaacatgacccttacaaccaacgcaaagcccgactctacccacatcttcaggatttagggagagggggtgagagagaagatggaacacctctccccctagacccttcgacatggccaacttgtagaaactaggccacctccacaagagaatgagaatctagagcgtgcttgcaccaaaagctcgggtggtttcggcaaggggatgcctagacgacgtctccaaggagaggagcgacggaacaccgccgccgccgtccgtcaaggactcaagagagccgatactaggctttcgctcagcaaccgcccttga

SEQ ID NO: 38780 - DNA, 1501 bp, Oryza sativa
tggccacccctccctctgtctccccgaggggtcgggccgctcccgtttcggccccgagggcaggggcgccccgaccccctgtgattttggcgccacgtgtatgggttaggtgagcacagcggggctcacctaactgcatttattgcggcttggacgagcgcgccacgccgcatttaatgcagcgcagcgcgcgctcgtccggtccgtgaccggtcgcagtgtgtgacaccggtcagatcgcgggttaggtggcaacaggcggcctgtcacacgcctcgccccgtcccgtcggaatgatgagagcctccaggcactcgtccctagccggagccggcgtgctaactcctggagttggcacgtcagtcccggccagattcatgccaggcttcatcgcaaccattacaaggaagtcattgtatgaagaagggcagatgtgcggcatgctaaactgacgcgtggtggacaagaatgaccggtctgtgactggtctgacgccggtcacgtcatcggcagacaaccgtgctcccacgctgcatctacttccggcgaagtggaggcgagtgacggcgctgggcctcactcaaggacaagctgtgatttagcttccaggcgaaggcgcgagccaagtttttggtcaagatagggtgggtccccacccaaaagaagagtaggtagaagtggtgcatgtggtatccccttgagatataaaaggaggaccttgcccaccgaaaagggatgatggagaacgaaaaagggagggaggactctgagacgactctgagaatacctgagctcgtagaggagagaaagaggaagaggggttctagagcctgaactctcttgctctccgactctctgtaactccttcacacacagatccaccagaacacaggagtagggtattacgcttctcagcggcccgaacctgtctacatcgcccgtgtctcgtgcgttttgctctctcgcgaacattccacagatcgagggtgaagaaactcacctagcgcccccggccgaaccggcaaaggggggcttgtgcggtctcccggtgaggagccccaagcttcgtcaagtactatttttttaaatacaaactaatcccacacatgaacttttaaacagcttttctttacaaactaaccatgacactttcctttaaaatatttaaacagtttgccacgccagcaaaccgggcgtggcaagtaccgggcgtggcaaaactgccacattggcgcccggttgacgatttcaacagcaacgatcgccatggggcagctcttgccatgccatgaccattggtgccgccactctgtttggccacgccactgctattggcatagtcaaaaggtttagttttgaaaatatttttccgggtggtctcttaataaaattatatttttaaaaggtctaacttataaaaaaaatttcgtcatgatgtgaccggaactctaatgatctcgcgtgatatggtgattagcagcagaaggagctgggctcttac

SEQ ID NO: 38781 - DNA, 1501 bp, Oryza sativa
aattagaaataatgaatattttcaattcttttccgtcctttcagaggcaaaatatgttgctttattaatcttgcgcgttgttgtagccatttccctctccatgttgtgtacatcagtacatgtgtgtttttcttgtgtggaaggcgcccgaatcatttaggtcgttagcttgattgatgcaaccaaggttcgtggcttcattaggttagtactagtattactttattttatgaggaaaattgctggttttcgaatgattgaacattgccaataattcgatggagtccttaatctaaccacaaaatttgccatattgggcattttaattatgaaatttgtcctctgcccgtgccactacccttggtgaggcctagtgggccctttgacgtcctatatagatgtaagaataagttcgtcagaggtcactcaacttaatagtgagattttttttatgttccttaaccacaaaaccagaatatatgatagcttaaagtcaaaataattgtgatagcttaaaatcaaaatgatcaataatgtttttctttagaatacaaattatcaatagtgttatttgtgaaactttaggatcatagtagttggaattttgtgaaatttgaaccatagtaggtgggttttaggaaatttactagagagtaaattgtgtccacgatacataaacttgataggtgggtgcaatctagtgtaacaacttaaaaaatgatcatttaggtgtaacaacttggctagtatgtgcattctggctaaaaaaaataatattagacaccacaccttttaagccacatagtaaaaaaaacagtagtcgttgccaataatctaataagtataatgattatcaaataataatggtctagatgtattttatttgcttgcttataataataaatatcctgtcgatttgaaaccgaaatatataatgatcgttaaaactaagtgtataagaattgttgtaacataatttccgagcgattctactagttaaacatattcaattgtattcatgaccaataatctagtagttatgattataatataacaaacaaaatatgttgaatcatatgtacgtaacaacgttttaaccaaaatacacttgagtgccaatttcatgtatcggtctgcatatttttcgagttgttgcactaaatcgtacccacctgcaagttctcgtactactaatacaatctactctttactaagaggccgttcgaatccaaataacacgctttttaaactgctaaactgtgcgttttatgctgaaactttctatatgaaagttattctaaaatatcagattaatctatttttcaagtttataataattaaaacttaattaatcacacattataatcacctcgttttacgtgaaacacttaatttttatcttcatcttaatcttcgagattcaaacaccaaatataaaattcgtatcgtaattgatctgtttgtataattgcacctggtacagtgaaaaattgaaagaatc

SEQ ID NO: 38782 - DNA, 1501 bp, Oryza sativa
cattaacgagtacagttacatggtacaactatagggtcggtttactcagttacctaacttgcatgccaataagagtagaaaataatgcagaattcatgtgttgtttcaatcctaaaccgtatttaattggcaaaataaatatagatacgcattactcagcacaaataggaatattattataataattattttgtatattggattaaaaggaaggtccattctggctagactctaggggagttcttaaaaggtaaaaggaccttgaatccattataagacagtaacttaaggcatacaaattaaaaaaaattgtacactggtctgtttgtggtctttttctatcatgagatgatgctaatggaacattaaattagcaagaggaagaaaaagtattgaagaaagcaacctcacattgtttagttggtttagtgtcacttctaacttcccctggaaggtaagaaatatgcagttatgcaccattgtccgaactccaaagccttttctccaagaatcatatagggagcgttcggcaggaggagtttgtgagttagtttgtttcattttccgtgcgcacgcttcccgaactactaacggtgtgttttttgtaaaaattttctatatgaaagttgctttaaaaaatcatattaatctatttttgaagtttaaaatagtttatactcaattaatcatgtactaatagctcacctcgttttgcgtatcttcccaatcttctcttttcccctcctctcaaactcacccatagtctatagtgtatgaactctgaatctcaaacttgtagtacaaaataaatctgcatggttaacacgacatacaaacagataccaatgagttgttaagccactaaaacatacaaacaatgaagatgttagaagcacaattatctttcagtggatatatgtacagctccatacgagaggattcttaattctcttgaggtagctacctgcgaaaaacatcggggttttcaggatccatcagtcaatcccctgaacaagaacgatgatgtcggcttgtcgagaataacagaacaatgcatatccatgttctccgaagattgagctccccagcttggatcaaatcgcagacgctcgcgtccgcagctgagcaggagttcatgaaacctaccaatttactgcaagaaaaaaataatctcaaaccggagcctaactggaattacatacagcatcgaagactacccgatagaccaacagaataatttgagacctgtagaacattctgtggcttgagttcattcaaaatcatcagaataaagccccccaccctatcccattccatcaatccctcccccggggcaaccggaaagggagagaacattctgcagattgggttcattcagatcacccaggctggaaactccaacgccaatggcccaagcatctctctaattcgaatgcaggaaaggccgccgctaaatcaaactcccaactccccccaaaaaagaaaaaaaatccaagcacga

SEQ ID NO: 38783 - DNA, 1501 bp, Oryza sativa
gattctcgtcgtaatcaagaagacataagagatcctagaatcatatactctctctctctctctctctctctctctctctctctctctctctttctgttctttggacttgatgcatttatcttaaccgtggattacatggacagattaggacagaatccacaacgacgattcctctcctgcattgtcaactatcaactgcacgggcacaaatgtactccctccgtcccattttaagtgcagtcagccatgattttccgtgctcaactttgatcgtccgtcttatttttaaattttttacataagtcacgcataaagtaatattcatgctttatcatctcataacaataaaatactaattataaaaaaaagaataagacggacgattaaaattgagcacggaaactcatggttgtatttaaaatagaataggacagtgggagtacaatccaagacgacgactaacctgcacattaacctaggcaccttcttcctaagatatagatataccagtactagtataataatgttaacaaaaaggaatatcaaaatgtgggttggattaagcctcacgatcccatttcgcgcgcccgacggccaacacacaaaataataagaaatcatgcccgcgatggctacctgacaccaacagccgacctgattgagagagatcaattaataaactgaacaacaggttaaatggttaactaatccaagtcgacactaattactctatattagcgcaggtctttttttctttttcaatagcactgcctccaacttctaatagatgacgccgttaacttttaaacaaatatttgatcattcatcttataaaaaaaatttatacaaatatataaaatataaatcacttaaagtattttgagtgataaaacaacttacaataaaattataactaattaatttttttaaacaaaacgaacggttaaacatgtgataaagagttaacaatgttatcttttaaaaacagaggtactaatattgattaagcataagcaggtcggctctttgaccaaacggcgcgaggaaggagcagaggcgggagggaggatgtctggctgtctgaacgcgtgaggagctcacactctgatcatccatccgcgggtgggttgacctcttcccggcggcgcggcgagagaagggaagacttcaacccggccgcggttggtggcgccatcactccccggcccccgcgcccaccatatacaccgaggcgtcgtcgcctccccgcaccttgcgcggactcttctcctcttcttcctccacctcctcctccacgatctccggtcaagcagagcacaagcgtgtgctagctctcccggtggcttgcctcgccggcgacggcgcggcgcaggatggagccgcgggtgttgatggctcttgcgctggtggtggtggcggcgggcgttccggcggtgttgtgccagaccaacgcccaggacggtgagtgctcttgcctcgccgccggcgatcacctccgttt

SEQ ID NO: 38784 - DNA, 384 bp, Oryza sativa
tgagttacttattagtgtatattaaggagaagaaaggagtggataagaacccttacaacaaacacaatagaccttacacgagacaaaaaaaaaaaaactgcctcagcctattacaaaatcggacaaaattggacattcttcacccccaactatgaataccggatgaattacccccctcgaccaaatccacggtggttttggtctacgtggtgtacacgtggcagtccagtcagcattctatttataaaaaaaattgtgggacccacctgtcatacactactctctctcactctctcacttctctctcttcctctctctctcgcagccccatctcacgggtcggcggtggtgggggacacgagtggcggcagcggcgcgtgaagt

SEQ ID NO: 38785 - DNA, 354 bp, Oryza sativa
aaaaatgctaaaaaggttttccaccttccataaaaaacgtgcgagaaatattatttccatcgtcggtaaattttttaaaaaaacatgcaaggaaaaaaatgtaacgaaaaaaatacgccatttctaaaaaaatatttgaaaaaaccacgcaagaaaaaaacaccgtctattaaaaaataaatcgttctgaaaaaactgtcagaaaaaaaaacgctaaattgatggacgtttaagtcggataggatctatcgattttttgccatctattacacggcttttatttcgtcatatattctcatgtattgaaaaaaaagcaaaaaaagaacattaaaaaaagcaaaaaacgcgtgagaa

SEQ ID NO: 38786 - DNA, 1501 bp, Oryza sativa
gtggccgggaggccggcggcgccttactctctgctgccgatttttttttttgaatttgtgattcattggatttgatctgtgatgtatgtgatattggatctgatctgggagttgtgatgtatttcttttaggaattgtgatgtatttttttgtttgagattttgtgatgtgatgtattgtgatatgtgatgcatttctttccaatatgtgatgtatttctttccagatctgtgatgctatttgatttggggatgatttgggagtatgatcggggatatttagggagcagatcgatttgagaaaaaaaaaatcaaccgggactgctcccactatttttagtcccggttattttatccgggactaaagatacccatctttagtcccggattcgtagtcccggttatacaaccgggactatagggggtttcctatcaggagtaaagcccttttctccactagtgatatatgtttgatttcaagataaagtgggatataatgagatggtatcatcttgtctttgatcggaaggttgggataaaccttatttgaggacagaaaaggatggatgggacaataattgatgggattttcggataagagaaaagtcgtacacatgtacgtcatgcgtttcttcagcacatgacaagcaccccatccatcatcacgattgggctcaggggagtacgtacactaggagatgggtgtacagttgtaccctattttttttttcaaacaaatgtgatttaatatatttggtatatgtgtacccaaccggttaggcatcaaaacaatcatttgtaagtacaaaattatccttttcaaacaatattactacatccatcttaaaataagtgtaaacatgggtatccgtatccaacatttgaccgtccgtctaatttaaaaaattataaaaaaataaaaaaaattagtcacgcataaaatactattcatattttatcatctaataacaataaaagtactaatcatattttttttaaataagacgaacggtgaaacgttagacatgaacagtgcaaaactgcacttattttgggatggatcggagggagtatcattttcccttagctattttatagtttttctataataaagattcctatttatgctaataacacatattagcacttcaatacttttctcattggataacgacgcttgcttgagtaactgcacctctcgcgctactgaatccgagccaagcctgtacggcccagctcgtcgtcacgcttgaagacgatgaacctcgtacgtgacgaggataaggctgctggaggcgtacgttgaggtgtcaagatcggaggcagcagcgatcgatgtcgaggtccaggaaattgatagatggaggtgaagtagggtcctccttatatgcgagtgatcgcgggacggacgcatgcgcgatcagaaacggcaaaacagaaaaagccccatacacgtgatcgagaccttgtgacccacattcacgtccataccacttcacacg

SEQ ID NO: 38787 - DNA, 818 bp, Oryza sativa
attgtggaattcggccgaccgatgaaaaatggtttctccaccagtgggacctcaaagaatctcgctgttaagttgagggacctccggtgaacttattcctaaattaaacgaaatgccatctaattaatgggccagtctgaatctacagtgtgtgtcaccgtatgcctgctccttcaggactctcttcttagcccatgcacgcccatatatggccgcacagggtaaaatttttatatattcttaccgatttaaaagtaagtgctaaaaataaagtccatgaaaaagaaaaccaaaattaagtctgcaactaagttttaaaatttaaattttggctacagaaatgtccattattgaaccttcttcttgtatcttcatcaaactatgttcatcaggaaacaagagttaacctgttgttcataatctcctgtgagcagagacatgttttttttattactctgaataatcatttaggtttttcctaggactgaataattatttaagtagagacactactacaaatatttgcagtgtggtgtcactactacaacagtagtactccatccgttccaaaataaatcaacctgctatccaaattcattatattcatattctattttagattggtttgtttttaagattgagggagttggtaggaacacagcatcaacggcagaagaaatgttgacagagacatgcacatcgcataaacgatttatagtttactagtcttagctaatcttgatttgtcttaggagatattgatatcaaattatgcgtttgatctctgactactctgtcttgctttttcctctggcagc

SEQ ID NO: 38788 - DNA, 580 bp, Oryza sativa
ctgaaataacagtaaagggttataccctgtgaaagtccctccgcttggattgtgagacagaactgcctccgttggtgttgtcgatcggtgcaccagctcccggatccctaaaaacctgatcacccgcctacccagtgcagatctcaggcgaaggtgtagttccagaggccctgctcgttccaatctctcgtgcgcgcaagcgatcagaactggggaagcagtagcagcagcacaggcagcgtgaggaggaggaagaaccagtgtttggaaagcaatgcaggagatctgatcggggttctctctttccttatagcgcaggagagaaatccgcccgttgccgtagtaacgacgtgatcaatggatattgaatcgcttgcccgttacagcatcgcctcgccctcgccctcggcccgggcccggccggccggctcggcgcgagcgcgcgtgtggctttccaatccccacctcaaccggtcaacagtgagcctctaataactttctatttaagttgagatactccttaacatttattatgggcccttgagatttaaatcgggcctagcccatttattctaacagg

SEQ ID NO: 38789 - DNA, 1501 bp, Oryza sativa
tgcctacgacgaggccaccgccctgaatcctaccggcggagagggtggcgccgccggcgcgagcgcgcgggggaggggtgctcaccggagcctccgccgttgctgctgctgccggagccaggacgcccgccgccgccgcggcgaccgccgggcatctcgagggtctccactctcccggtgaggagaggagaggagaagagaagcagaggagagcaggagagcactagtgctggctgcactgcacagtagtagtagtgaggacgacccgggcccacgcgtcagtgagttgtgggattggacgcgcagcttgacttgaccaatggtggtgtggaaacgaaacgaacccttcgcattcctacttcctactagtagagttgagctgagtcaccctcgacttcacacttgtgcaggttgaaggtccctttgaatcgcagggttgaaaaaataaaagaataagaaaaacataggattttgacaggaattgaagtgtaaaacagaggattgtaaaacacagaaaaaacataggaattgttgtttgattggagcgcaggaaaaacataggaatcggatgagagagatatagacttaaaggaaattttccaagaggttgaagctcttgctaaatttcctccaaaatccacatacaatgtgtcgttccataggaatttcataggatttggaaagtttctatcatttgaatcaaagggtcaaataggaaaattttctataggatttcaatcctatgagaaatttctatataaatcctttaattgaaaggggctcttaaagggaaaagagagtgttttgcatttgctttagtgatggggcagcctagtgatggagtttaaagcagaacaaggtaccaaattgacacctacaatacctacatgatgatgtggagtcgtccttgtagggaaaagctaattggcgcatgctgttgtcttcaaatacttgatagattcgttaatagcagccaaatggactgtattcgttattgtgggtcgaaaactaatatccacgcagttagtaaaatggagtggtggatgaacgcatgattaatcaaatagtattaataaaagaattgaaacatattaatatggatgtaaagaaacttttttatagaaaatttgtaaaaaaaaagtagagtataagttagaaaatggtacattcgaactcacccttaacaaagatactaatggctccatggtttggcttattcaaggcatatttgcaaataaaaaataatttgtgaatacaacttttatatatgtgttcttagcgatctaaaagtaaaggttggaaaataaattacgataaaaggaccccaaaatcaactccaaatttaaggttgaaaattcaaattttggcttgtaagtataagcataagcgaaaaatgagattgtaagttagattacataaaaacagaaaaaagagaaagaaacatcgatatcaataattatgtattgatatctgagaaacggcttaccacggactcttagtg

SEQ ID NO: 38790 - DNA, 1501 bp, Oryza sativa
catatatatacatatatacatatatatatacatctctcaacttacaaaaccgttcactttagatccttttgtggtttttatcctgattttgtcttacatggtggctaagtcagcgcagaacccacatgggctccatatgtcagaatgccaggtcatctctctccctcctcttctctcccttcctcatctctctctctcacttctctcctctctgcatggcggctggtgggtggggacgaggtcaccagggcgaggcgggagaggagattctgtggacgtcgcgtgcgacctcggggtcggaccgtcgacacgagagaagggaggcggcggcggctgcgacggttgagaagggagaggcagacggcggcgaagcagggtcggcggctggcgaccacgcgggaagaagctgggcggcggcgtgggaagaagctatcttatacgtcgtgcccgttccgcccacaaccgcctgctccactcgccgctccttcgcgctcacacactccttcccgccacgccaccctcgctctccccattcggctccccatcgatgccatttgcctccgcctcgtcgatgaggttcgaccattgtcgaggcggagatgtataactggacgacgacggattcgctttcttctttcccctcgcttctcctctctctcccctccagatggtcgacattgaccgtcgcctgccggtgccgcacgaccttctgcacccgcccttccacatcgccggcttcatggcctctgcacagccaaaaccaaacacttcaaatggtgtcgccgcctcccgcgcacgcaccgcggcgccgacggcgtgtaccttgctgccacagcctcttcctctcccgcagcgcgcctgccagccgctcgtctgctccgcagaccaacagctccccgtactgtcgcctgctccgtcaaccgctcgcccggtcctccggcaggccaatgcggcgggcgcagctaccgccgccgctccgcccaacgcccgcccgctccgccagccggctgctccccgcgccgtcgcccgctcctccagctggccgctccaccccgcgtcgtgccctctccagcgatctgcttggaggggaggggagagaggatagagagaagaagggaaaagagactaaggtttcacttacatgtggggcccacgtaggtcctacgctgacgcaaccgccacgtcggacaaaactggagtcaaaaccaccgaaggacatatagtaaacggttttctaagttgagggatgttatatatctggttttgagattaggggacgattttgtaactcgatgataagttgagagaccttcggtgtacttttttccgagacagaaatacccctctattgggccgacccattaaaatgggctaggaaaatgttatcccgacctccaaggattaacttttaatcttaacagtccagtccattcatgtcaccttatttcattctaatgttctattcattttcatttcccattccacccttcataacccatta

SEQ ID NO: 38791 - DNA, 1501 bp, Oryza sativa
atgtcaaaccttttcaacttacataaatataacaattttcagtaatatcatgtcttttaaaacaaattaacttcataaatgttgtaagaaaattagttgcagcagaaattcagttagaggcaagaaattaagtactgaaacaacataaatgttttttttttattttttgaaaatgagatgcgatcgaatatcatcacaattcttgcaagggttaatattactcaatcatggatgtataattggaagtaaacatatatcagctactaaatagtgctaagtgttcaatcaaaactgttactccaataataatgtgattcctcaattatttcgcattaactttattaacgttcaccatcacattttactgtcaatctatagcagatctccttctaaatatctgaagaagatgaactaatcaaggcatcaatagtaatgcttggatgcaaaggctgaggtttgcataacttttaatcagtaagtccttaaattgtcatctctttgacaagtatttagccaaagaaaacatccatcgtttttctgtaaatgttggaaactctacctcgacttggtaaagtgctatgagtgaaaatagcagaagggtaaaattgaggagatccactgtggaatttcctttttctctgactttaattaagctgaacataatgttgtaatccgttacagataagctagtcttgatgatgagcttaccgatcgaggcttcaagtatatcattatatattgttaatttgctagttttcaaaggaattaatcgaatcagctagctagtaaaactaccggaattgcattgttaatttagtcgtgaagggtagccaggtaagtgggtaacatagtctataagcatttgtatgaagggcaaggctagttacataaatattttcttggtcaaaattggaaaattggaaagcaaaaaatcagcattcctgatatggctagcgagaggatgccagtctgaatcagcacttaattcacatataaactgcgtgccaaataagttttgtgttaattacctgaccagccacaacatctttgtagagttcactacttagtactgataaataattaatccttactggaacttctgttctcctaatgcaagtaattattaattcactgcatcctctcaaatcccatcaagcaataaacattgcatttcacttcagatttcagagaccaactcgttgcaagaaacatgtacttacatacaacagcagcttgtgcagcattgctcttatttagcagaataataataatacagatttacacgtccttaattacaccgattaagtacatacattgatatacacatacatatatctatatatgcataggactagctaattaacacagttaattatacaagaagagaagtaaactaaacgaaccaagcagatcaccagcatgagcagcagctagctagagagagtgacccaggtatagatccaagaaccaagatatctgaagatgtcatcaaattaggctc

SEQ ID NO: 38792 - DNA, 453 bp, Oryza sativa
aaaaaagttttggggacggggggatagggatttgaactcaagacctgtcacctcagccctcacacgtctaaccatcccaccaactccacacatctaacttggatagatgtgctttccttttgaactaaccctggaagcatctttactcgggttggtgttaccaaccggtactaaaaatggatttttagtctgggttagtgttatcaagcgggactaaagatcctctatcattagtctcggttggtgttaccaaccggtactcaagatgtatttttggtaactccaaccggaactaaagatgtttttaggacttggacttttagaatcagtactaaatacatctttagtatcagttcttaatgttttttgtaccacaacaaaagatcaattctctagaagtgacccgaccctaggggaggggggaggggatccaacgacagccaaatgcccgaa

SEQ ID NO: 38793 - DNA, 501 bp, Oryza sativa
aatctccaactaaattttgcgacccttctccactaacatgagctaccaaaacagggattgcagctctagctagccgccacagctccgcttcacccgtcataacccttgcaacttccgcccaagttctgctcttctggttgattacctgcttctcttcttcttatgataatgcactctggccttgtttgatttagattgttaagcggattatcgatcgattggattatggggataagttaaatgctttaagaaataaacttaaacaaataacttaaaacaagtggtaacgtatttttcgaagagtggagcaaataaccccgtttcaatagttcgatgaatgagatgaaaagaacaggggaaaaccgccttcagctaataagctagtgctagtagtactatgtatttgtggaattgataggctattagctctgaaggtgatgcagttatatgtattatgtgctcacagcatgctctttcttttgctgtcaacattctttcaga

SEQ ID NO: 38794 - DNA, 336 bp, Oryza sativa
ggggctaaagcggaaactctgtctggctctccggcactctgtattccttcacacacagatccaccagaacacaggagtagggtgttacgcttctcagcggcccgaacctgtctacgtcgcccgtgtcttgtgcgcttcctctctcgcggacgttcctcagatcgagggcgaagaacctcacttagcgcccctggccgaaccggcaaaggggggcctgtgcggtctccctgtgaggagccccacgctccgtcatctggcgcgccaggtagggggcgcgtgtctttctgagccctcgtcctcctttcgtgtgcgccaagcttctcccgctcagcccaa

SEQ ID NO: 38795 - DNA, 1501 bp, Oryza sativa
  unsure (1)..(1501): unsure at all n locations
aagccgctgcccatcacctaaaagaattacagaaacctgaattttcatcacctaaaagaattacagaaacctgaatttattggagtatgtggagtttgattgcaatcataaatctgttcttgttgcatcgcgcaggcacttttgctaggccacttaaaatttattatttcctttttgtcatgcacatgtttttgttttctgaaattgcttagctcctcggtacattattccgttcgatacggccctgtgacatcggatgtttgacgctaatttagagtattaaacatagataattacaaaacacattccataaccttgagctaattcgtagcctaattaatccatgattagcctatgtgatgctacagtaaacatttgctaattatggattaattaggcttaaaaaattcgtctcgcggattagctctcatttatgaaattagttttttactagtttatatttaatactttaaattagtgtctatacatccgatgtgacaggagggccactcacttgttgtcagttgtcacctcagagaatcaccaaacggcaaaacgtagggacgaatctccttcggtgagtctgcacacacatcttcgccacttcgcgatgtcaggcgtggggcgggcccaggattttcaacttgggtattcgaaattggaagagatatttttttccaacacaaagtctaatagttgtataatatataatggtataagcatgatgcgtgtctttcataggaagggagctgactcccgctcccttccgtccatcagggatttattcaaaacctgaaatcgagttgagttgaatggggttcaagtcaactagatgaaatgtttcttcgtagtgagcgaacgagttgtaaagtcatagattcatagaattgaccataaattaaatatgttaagcatattttaaagtacagtactaaagtattaattgacaaaacatgtcaaatttataaagcatagaaaatggaaaaatgataagaaatcttacaatttagagagacttttcgtttcttgatattttgaaaataagtgacgatgtctttatccttcactttcctcttcatgtttcaaacctacaaaacaacactacggtcttctaatttaagtattaaccatgctaactctgctaaatatgtgcactaactctgctacaaagcctcacaaatcagtgaatcacaagtttcaaagttcaattgttcatccataaaccatgaaccatccctgtatggctggattcaaatcctaaataaaatgaaccatcctggattcaactaggaactataaatccgaaactcctaaatcctattcgaacctaattaccaaaatgttcctaaccagttttaccttcatctgggtccagccgtctgggcgtttggcgcggtggagtggtggagaggacagaggaggccggagcacggagcgcggctgcgtgggcacttgggcgccacagcccacaagggcggcggcgcgtgggcgccatanggga

SEQ ID NO: 38796 - DNA, 1501 bp, Oryza sativa
ctcccggacggactccccggcccggcggagtctggcctcctcccgagcggcctcctcagcctggcgaacccggacggcctcctaggcagcctcctcggcttcccggaggcggtctgcggcttctcgccggtcagcttcccgcctccgggcctccgcggtcgccgtctcctcggcctcaaaccggccggacttggaatggcgggggggcgcgacgggatctcgctgaggcagaagaaaaaccagaagacaaaaagaaacgggcgagtgaaaactcgccttgggagatgggagaatgaacacggccgcggtgggcgcggggacgaacctgcggggaggtcggctaaacgaccacctcggaggcgagatgaggttcccccggcatggctcggtcccccccatcttgcggagccgtttcttctttcgctccccctcgggctgcggcgtcggcacggcaccctccgggcgcctgctgctggcacgcaccgccccgccccctcggggaggagatgggggggcgtgccctcctgcttcctcttcccccgggcgtcggcagggcggctgccccccgggcccccgtcgcggggcccagaagcatgaccccctcccggggtagattgtttcctcctgcggctcccgcccgcgccatcgtggcctcggggggcccgctcccccgacgccccgaccgcctgcatgatgatcaggatgttggcgcgatctggatcgctgcagagggggaggacaccttgggggataagggatgcctccacggagctgagattcagcacccgttggaccaccatcctgaagtcctcagggacccagtcccatttgcgcccctggtgggtcctcatgtagtcctcgggcccggtgtactcccaggcgccccgggcgcgccgctggagcggcgcgatccggcgacgaaggtagtcgccgaacaccatggctcccgtaagcccctgggatcgcagacccgccaggcggtcaagaacggcgtcgtagccgtctcccagatctaccgtctcccgccagctggaggcctgcgccgggggctggctcggaagtcggaggcgcgcttcgtcggcgaggggggtgtagaaccaatcgctcttccagtcgtcccacttcttgcggaggacgcagggaatgtagcggtgcagcacctgcccccgcggctggaagtagcagccaccgactaccgtcggcggcgacaccggctgtacggtgaagaaccaccggaacagccggagagatgggcgcaccccgataaacatctcgcacaggtgcgcgaagatggccaacgtcattattgcgttgggggtgagatgcgccatctggagatcataaaactccagaacatccatgaagaaattagagaatggcgggaccagcccggccattgcgaaagagaggaagaagacggaccgccccgggtagtctggcgccaggcgtccctcgcccagcgcgaccacctcccggccggtggcagattccggcatgaatc

SEQ ID NO: 38797 - DNA, 471 bp, Oryza sativa
caaaagttggcttcaaactaaatagacactaaacactattgaaattgtcaaatattggtaagcctaatttaggcctcaaaccaaaccaaccttatattttttctgattttaagtgccacgtcaacgccatgtaagcatcatgttagtcgaaaacgccatctaaactgttttaggactggttttgtaagttgaagggcacttcatatatgatattgtagttcagacacgtatttctgactcctaaaaattgagtaacctaaagtgaacttattccgttggctgttgcggtcggcctagaattggctgacgtactgatccagttggaccatatctgcaaataaagaattttttatttataattttttttattaaaagttttacaaaaataattttctattttgaaaattgacggaaggagtcgcctaccgcccttaaaaatcgccctctcagagggcggcgaaaatgacgtgg

SEQ ID NO: 38798 - DNA, 187 bp, Oryza sativa
aaacgaacacagccttggtgttgtaggacgagccgagtatgatgttgcttggcttgatgtcgccgtggacgacgcactgctcccactcttgctgaaggtagcggagtgcagagcccaggccaatgatgatcttgtacttgttgatgaaagattagcgtagtgaaaatgagagaattgtttgtagcta

SEQ ID NO: 38799 - DNA, 1501 bp, Oryza sativa
atatacaaaagatttgcatattattgtgttaatataagctaaactgtagttaacgagtggatttaagttgtaaaggtgaacatatttctatttgtttattacaactgtataaacaagttgtacacattgcttttattagttgtagacacaactagacatatgaacgtgaaaaaccctggaaaattaccccattaagagacttactagctagaggccatatacagtacgcctgcatgtttgcaaatcaagcagctggtttttttttgcaagtagtgagtgatcgcctgcatatatagctagaccaaatcttgatgaatgttaattatatataaaaaaaattggccttgaaatgaccgaacgtattagtgactctgagatgccggcttatcgccataaacttttcttatctgaacagttgctccgtatctgaattcagaaaaggaaattatttcctcaagttaaaatgcttatagacagcttcatgtgaaacgaaaccaaaataccatttcgccaccattattaccttaatatattcatgacatttcatatccaagatatccaatgcgtgcatcacgctatgcctatactacatcactactgtcattgtctgtactagcgccctgttcattcagatcaggcttgcaggattcagagctgagtgcagacagctttggtgaccaatagaactctcattgttacatttcgaaagaaaaaccatggaaacttttcatataagtttatatttatcaggaaatatattaaacattcaatcatgatagcaggaagaatgaaataagtacagatataaaattttaagaaaaatcctatttctaaattctaactctctcattgtgtacttgttggccacagcaaaaaaaataataattatatacataatttagagttgattttaagatcttttcatcaaattctattttctatcatcaaacctgtagcaatagaaatataaaagtttaagtgaatttaaaaaactgcatatagatatttttcacaaaactacagatttaaggtgttatatcacaaaattacaaattgaacattaaatttatcataaaactatagatttaaggtgagataaagcaaaattacagatataatagtgaagttatcacataactacacatttagagtttaaatctttagcactactattatgttggagttatatatattatagttttgtgattaaattggcgctaaacatgtagttttgtaataattttaccagtatatctatatttttgcgatactcaatcttaattccattttttcataataagtttactactaaatctattgtttcatgattttttttagataaggaaaatgatttatatccccgacctctgccaacaagttgcatgcggccaatgactcagaaaagataaataaatacttgaggttatgagacaaacccacatctctctcctaattatatctagctgaaaaaccgaaaatagaacatataaaatctataacg

SEQ ID NO: 38800 - DNA, 1064 bp, Oryza sativa
caaaagttggcttcaaactaaatagacactaaacactattgaaattgtcaaatattggtaagcctaatttaggcctcaaaccaaaccaaccttatattttttctgattttaagtgccacgtcaacgccatgtaagcatcatgttagtcgaaaacgccatctaaactgttttaggactggttttgtaagttgaagggcacttcatatatgatattgtagttcagacacgtatttctgactcctaaaaattgagtaacctaaagtgaacttattccgttggctgttgcggtcggcctagaattggctgacgtactgatccagttggaccatatctgcaaataaagaattttttatttataattttttttattaaaagttttacaaaaataattttctattttgaaaattgacggaaggagtcgcctaccgcccttaaaaatcgccctctcagagggcggcgaaaatgacgtggcagacggccgtcgctcggcccccttgccgccctccgctagggcgattttgtactgtgggggggccgcctgcaaatgggcggcgagggggcatggaattttgcaggcgacccccttgccgccctgggggagggcgatttttgcctctccccctataaagcccagtccctcctctgtgaaatttcattatattcactaaaaatccaaaaaaaacaaaagagagagaggggagggcagcagaaggggagcggcgaagccctgctggttcgctcaattcatcacaggtatgctcccatacatcttttgcatttgtactaatatgttatgtttaagtatatatgttgcgttttagttttagttccatatattttagcacatctgtagcacacagcacatatgtgtagatccagagcatagaatataatagtatgaattgagacatagacagtagtgttaattgtaagatgtagtttagtttgatctggagaatgtaacgtaattttagaaatttagagaacaatattgtagagaatgtaacttagggcgtagtacagaaatgcgaggttaacgcagttattgttttcatcaggcacaa

SEQ ID NO: 38801 - DNA, 1501 bp, Oryza sativa
cagcgcggatggagtggagtgcaacggctgagtgcggaggagtcaacgtcgcagaggggtggagcgcgtggtgcggcggcggtggcacataagggtgaagcactagaggaggcggcggaggaggtggggaagatgatggaatcaactgcagcgatgggaaggcgttgggcggaggaggaaccagcgtgcggcggcgtgcaggtggagatgacgcggatgaggaatcgggtgcggcacgatgggagtggaaccatgtgctccgcggatgttgggcccacgaaaatttccatgccttggagccttgctcggcctgccaatatttttggcccgccaatatttcctcaaacagttcactgtgaatttgatttcccagtaactaaattcccggcagataaagtgatctcttaaattatctatggcagatcaattgacatgttatatttgtccattgccggcacttaatttgttgtcctatttttttaattcccggctgatgagatgatgtccaagattattgccggcacttgatatattcccggcaaataattcgctactaacttcattttattgccggcagttaagtgccatgaatactaggttatggtgtagtgtagatgtggcaacgacgacaatagtgtggatggatgcgacgctcctcgtcgggctcgtggcacctgggtggtggcgtggatggaaacggcgctccgcgtcgagctcaaggcagagagagagggaagtgaggggaagagcggcgtcggcggcggcatcccttcacgcggaggcgacagagcgaaggatatggaagctagggagcatgatgacccgaccgccgatgtggaggcagcggatcggagaggatgtggacagggcgagcgtgagtctccatggcagccgtcgtgctcctcccacgactaacgcggcttaacccatctctttgcgacgccagtcaagctcggtgatgccgtcgctcgtcccccgccacccaccaactgtgcctagcgcactggcctgccagcccaactcctctccgccggttgccgcccgtggagaggggaggagagaaaggaagaggggtggagaggggaggagaagaagaggctgacgtgtggagctcacatgggttccacgctgacttagctgtcatataggataaagccggtgtcgaaaccgcccaagaatttaaagtgactcggttttggaaaatgagagatgaaataaatctggtttcatggttgggggataattttataatccgattacaagatgagagacctttcatgtactttttcccgtcaattagacttgaggcgggccgtactttgatgggcctaacgctagctgaagagtcgctgacaagaagacccgggctccccgccggccgccggtggatccacacctgtagcggctcgccccacatcgcgcacaggatgtgttcgacgaattgcctgaccgggacagcgcctcgcctatacgcatcggacctagccttcccccggcatgt

SEQ ID NO: 38802 - DNA, 612 bp, Oryza sativa
tcctgcagccctagccattgagatgagggactcccccacttatatcttaggtcctttaccctttcacaaacaatgtgggactattcaaccctactaacttcaccatcaaagttcaatggtttgctagtattttgttgatcaattttcaagttgatgagtgtgcatcatttttattgtgcagtctattaggctatcctgaattggcctggttgttgtcagtgggtctttccagaaacacaccttattaaccaccaaattgatcaagtaagaaactcaaaagatatatcttctattagtctcaaattttagaaatatattacgatttctataaattttgttcgttagaatcgttgtatgatttctataataaaaaatacatatcattacactgcaagtgtgacatccctgagttaacatgagactgcaagtgtgatatccatgagttaccattcgactgcaagtctgatatccatgagtgcaactgttatctctgttctccaggtagaaggtctatctttaaaaggcaaacatattcagcaaaaaatgagttcgatatcgtacctttcggcccatgttaaaaacctctcatttttgtatatatgcttgtcaaga

SEQ ID NO: 38803 - DNA, 518 bp, Oryza sativa
caattgccttctcatgactctatcatgtgcggcaatcaccttgaagcgcctcaattcaacccgatatcatacagttgcattgtcggaatcggttgcatcggcttacctagcccgactcagacccaaccgatcctactcgtagccgatctggactccagccgattcctgatccgcttccgaactcgatctccgcctccgactttgcttcgatccaatcttctttcccgatgccgatattaccaaatttggttgttaacacatgccccccaagtacggaatatttgataatgtttcggatttgctgtaaatcgactccgagcaagtttcgcaccttgccgttttccgaccattactgccgtgctttaaatactaaccgttaccctcgagaaatctcacaccgtcctcctccgttttcaccactgaaaccaactttgccctctctctctccggcgatctccccgacgcacaaggcgatctccaggcgatttcgttcccgaccagatctccgcccgcggcga

SEQ ID NO: 38804 - DNA, 1501 bp, Oryza sativa
tcttagaagaaaacccatgaaaggacataccagcacaaaggatactgcaaacgcaactgaaattgctattgtgccatgtaattaatttaccttgtgatctgggggagctcactttttctgggggcactgctgctcctggtgacattattggttcagagctgacagtttctgggggcacaggtgctgctcctggtggcattactgaaaaatccatccatgttagggtggagttgaatgaccatgacagcacccggtgtacctcaatggagcttccggtagaagcagagaaaccaacagcgaccacctcaggcaagcatcttctcatgtcaacgctggctgtcgaaacaagatttcggcaatactaaaaggggtggctatcaagctaggaaagtggatgggtttagagacaaagaattttatacaggttcaggccttcttattcaagaagtaataccctactcctgtccggggatgattccgccgagtgtattattgattgtatgatctgaggaaaaaatcgcgccctgagaggcatccggacccctccttatataggggaaggggtccgctttacaaaatacagtccatatcccaacggaacatgggattacagataaaatacaatcgtaaccgactaggatcccgagtatttccttgacatacaagtttagaatctaacccgagtcctcgtgaagatattctatctctattcggtaccctgtacccagctggaatataactgccatgtagatatggggtatccataatctccacagtagccctcgagacctttgcagtcgacgaaatagccatcaccccctggtactagacccagtggttcgcaatgtcaagctccggagaactctcatcgatggtggcaatgcactcaacatccttttcactaagaccctggacgatatgtagattcctcgcacggaattaaagccgagtaatgcacccttccacagtgttatcccaggattatcagctacaccacttggccagatcactcttccggttactttcggcactcgggagaattttcgcacagaaaacgtttgtttcgaagttgctgatttcgagacagcgtaccatgctatactcggacgaccggctctagccaaattcatggccgtcccacactacacctacatgatgatgaagatgcctggtcctcgaggagtcatatcactacggagcgacatcaagcaagccgtcacatgtgacaaagaaagttgcgagatggcccaaacccgcgagatcactctcgctcgcgaagagatccgactggctgcgaccacggcaagcgaaggagaaatgcctgtgaccaagctgtcaaagaccgaagaaggcgacgacaaaactaagaagattccactagatccctctgatcctaccaaaactgctgtaataggcgttgagttagattgtaaataggaaagcgcgctcatcacctttcttcagaataataaagatatttttgcgtggaaaccatccgata

SEQ ID NO: 38805 - DNA, 1501 bp, Oryza sativa
cgctctggattaggtcgaggtgggtaatttgtccggtattgaaagttcaaggtggacgatgacaggttttcgggtttatggggtaatttggaggaccgcgatagttcgagggggtaattcgcactttttccttacataaaaataaaatagaagtaaaggacaagatattaaagaaatggcttaccatacatgggctgcaactcaagcttggcttggtgccctggccttccagcgccgtgtattaacatcagtagagagtatctgaccatacagggcctttaaaatttagagacaataaattttagttttaaattcagtctgttctaatatctttgaggataattgcgttctactaccttcgtcctaaaatataacaacttttggctataaatttagacatacagttgtccagattcatagccaaaatgcttatattttgggatggagggagtactttttaactgatcttgctatgaatagggtttacaaaatcgtgtgattatcactattatcacgtccagcaattttcttagtttttaatcactataaaccttgtggtaaccgcacggttttcatagtaaccacgctgttatcgtgataaccgtctcactgtgaggtgatggtaaccacatccaaaacgatttagggcttgtttagttggcaaaaaattgtgcccctgcatatcacatcggatatacggacacatatttgaagtattaaatatattcaaataacaaaacaaattacagattctgccaagaaactacgagatgaatttattaagcctaattaatccatcattagcaaatgtttactgtagcaccacattgtcaaatcatagcgcaattagggttaaaagaattgtctcgcaatttcctggctaactgtgtaattggttttttttctacatttaatactgcatgcatgtgtccaaacatttaatgtgatggcatgaaaaattttatttggaaactaaacaggcccttggtgaaccctggctatgagtcgggctaaggctagctaggagagcctctcacgttagagccacacaatcatcattgtaggtcaggggttcctcatccaactcacacgtgatgtatgcatgtatgcttcctcgatgaaacaaacacatgaagaacagcggaataaagacaaagtaggaactaataagtgatagccttggcccttgaccgggtaactacttgctaggtgactccatgtatgcaagaatgcatgaccacctaccaaattaaacgcgggtggctcggaagaattggatgaagaatttcatgtcattcattgcggagtactatataaattgaagggtatagatggatgaaaaaaaacaggatttgtatggttaattagcactttgaaattaaggtaggactgttgtgagatagtggagatagaactgttgtgagatagtggagcgaaacaaatcttacgctagatgtagacatgtgtgttgtgctccatatgctctcttctttaatactcc

SEQ ID NO: 38806 - DNA, 1501 bp, Oryza sativa
cataatccaacgcttgcgacaatgttgcattgtggagacataaccggcttcaagtgacatccaattaatgtagaatgacctcttttttttttctataacatgcaaagtacaatctacttgctaaggaccctgcttaggaaattaatttctgacagagctatgcagctgtggaggaaaccagttaggccaaagaagacaagcaaatggagccaaaaggtagtacttgtggagatgggagagatgcaaagaattcatcctttgagtcatcttgttgttgtattgcttgttataatgatgaaatctgaatgaatcaaagaattcctgggagagcttgccctccaacaacatattccctccattttaaaatgtatgatgtcgttaacttttcgcataacatttgactatttatattatttaaagacattatatagatatcatttattgtgttgtgacttattttattatcaaataaaatataatcttaacctataattttacatatttataatttaataagataaatggtcaaacgttatgaaaaagtcaacggcgttatacattttaaaattggggtagtaaaacaaaaatgatctccagttgttatgttcagtgatattccaacatgtctctctgtataacttttcaggtttagcataaacatccaacagaaatcagcacaagacgaatcatgtaatgacgagacatatctaacagaggaagaggagagataccgagctcacaatcaccaagggtggcgcctgtctccctgcgccgcccgaacaagcgtaccagagctgcagaacactccgcacgaacgtgctgtagcaaaagcccgagctgcacggcgcgggagtgcacatgccgggggaaggctaggtccgatgcgtataggcgaggcgctgtcccggtcaggcaattcgtcgaacacatcctgtgcgcgatgtggggcgagccgctacaggtgtggatccaccggcggccggcggggagcccgggtcttcttgtcagcgactcttcagctagcgttaggcccatcaaagtacggcccgcctcaagtctaattgacgggaaaaagtacatgaaaggtctctcatcttgtaatcggattataaaattatcccccaaccatgaaaccagatttatttcatctctcattttccaaaaccgagtcactttaaattcttgggcggtttcgacaccggctttatcctatatgacagctaagtcagcgtggaacccatgtgagctccacacgtcagcctcttcttctcctcccctctccacccctcttcctttctctcctcccctctccacgggcggcaaccggcggagaggagttgggctggcaggccagtgcgctaggcacagttggtgggtggcgggggacgagcgacggcatcaccgagcttgactggcgtcgcaaagagatgggttaagccgcgttagtcgtgggaggagcacgacggctgccatggagactcacgctcgccctgtccacatc

SEQ ID NO: 38807 - DNA, 1501 bp, Oryza sativa
taactttccaataatcattccatttacccttatatgcatggacacgccacggacaatcttccttcatgcacctcacttcatacacataatttgttgacttgaccaccctaaactctctctgcaaggaaactgcccaatgcttcaccgcctccttcatctcatccttatgagcataccttgcaccgtcaattacctcgttctccttatactcccagggtacatgatcaccctctgatataacaagtccagagaagtcctcatttgcccaatcagtggccattacatcaccttcctcatcggatgatgcgtcgtcgtccgcttcctcattatccgaatcttccctctccatttcatcaacaattataccgactctctccccctcatccgccatgcccatggcctgctcctcccttggttgattttcctcattttgcatcgatggtccaacaacatcccctgcattgataggaccctctacatcttcggtttgcattgaaacatttatatctttctcttgtaccgacacaaatataacgaggggccatgaccgttcaaaagccatttccacataccgtctccaagcagcagtgctgtccatcggcattagttcccaaaaataaccttctgttgcacgactcactacaactgatactgacattgtgtagacttcttggtctattctaaatcctctcaacaaccaactataaattgactgaaatgttctctccgcaggcctatcgatgcccttagatgtcattacaaaatctgacagatcaacaccatctggaccaaatctaatatttccttcaccgtgaactatctgaaatgtgaccttatttgacattgtgcctgatgaaaacaataactgcgttaacctcgcatttctgtactacgccctaagttacattctctacaatattgttctccaaaattctaaaagtaggttacattctccagatcaaactaaactacatcttacaattaacactactgtctatgtctcaattcatactattatattctatgctctggatctacacatatgtgctgtgtgctacagatatgctaaaatatatggaactaaaactaaaacgcaacatatatactcaaacataacatattagtacaaatgcaaaagatgtatgggagcaaacctgtgatgaagtgagcgaaccagcagggcttcgccgctccccttctgctgccctcccctctctctctttcgttttttttggatttttagtgaatataatgaaatttcagagaggggggactgggctttataggggggaggcaaaaatcgccctcccccagggcggcaagggggccgcctgcaaaattccatgccccctcgccgcccatttgcaggcggccccccgcacagtacaaaatcgccctagcggagggcggcaagggggccgcctgcaaatttcgttgacggccgtcgcccgaaagcgaacggccgtctgccacgtcattttcgccgccctctgggatggtg

SEQ ID NO: 38808 - DNA, 1501 bp, Oryza sativa
gaagggcagagtgatttggcagcggtggacatggatgtgaggtttgggcccgaggagcagatcgtgtggccggcttctgttcttgctgggatcctcatgtgcgcagcggtaagttgttccatcgatctcttccattgcttagctagatacgagagtgcattcccagtaagtcctactttgatttgtagaggaaacataagatacttagaggatttcaatattgtacaaaagaaattgaagaaattcctatgaaggcctttgaaatcaatcttttttaaaaaaaaaaatcctacgaaatggacaatattatagagatttagaaaaattaaaaagagctccaacttttttgaaaatttcctttgactatatttcttttatctcctactgcctaatcaaacaacctgttttgcaatcatgtgtgttttttctatttctccttttttttaatcgtgcgttacaaaatagccctaaaattttgctacaaatttgcatcttcacggtaaagctaaactgcctaaagtgtattttctctagtgagatgagcaatcccatcttgtatttacctttttagaggtcgaactactaaatcaggtttcggtttttcgttataaaaagaaaatttgtgaaatgttcctcagtactgatattaatttatgcatttctatcatccaacttttgagatccaaaaagggcaaagtatcaccatcaatctgcacttgacttccatagctcagtctttctgcttggaacgtcccaccttttcttcttcttctttttttaatgtaggaagaatagtattattcgactgtaaaaactcttgcaatgtatgcagaccagccattacaagtactgaacctaacttctgcagagagcaaagcaactaatagtgacagcttagttggactcgtagacgtttgttgaatgcaatctagccttgatactccctccgttcccaaaaacttgtcaccaaacactattcacaatcaaactttgactaatctttttccgttaattaatttataaaacaattcaaaatatattatattatcaaattaccttatgtgaaaaatataatcacacaattttccatcataagagaatctaacattttttaaaatattcgggaatggaaggagttgctacttgggtgatacatggtgttaaaaatatgaatgaattattacttttttttactgaatatgagtgaattatgaatcactactccttttcaattttgaagactacttatgtcagcatttagtaccacacagtcgaggaggtagccaacggaatcgtgccgtcaataatgcttaaggaccagattacctttataatttgtgaattcctccatcaccaatacggattagtatgtgaagagatataccagattacctttttcattttttttttacttgtcaaaaggctaggtaggtagcttgagaagtacatgcatggtaaatggtaacaagaaaacatagggaaaaaaagaggagggatcaat

SEQ ID NO: 38809 - DNA, 1501 bp, Oryza sativa
tgaaaatgaggattaagtgttgccatggtggcaaaaggaacaataaagatgagaaagaagggcattcactagagcaaaaatgtattttgatgtatcaataggcaaataaagaagggaagttgagaaaggtggtcaatggattggagggcaattttgcaagggcaaaaagggacgaaatcaactttcaagggcaaataaggaatttactcaattttgtatgcttagcccctttcgataaattccttattcacccctaaaagtttgcatatcctcttatttgccccttaatctcacaatggcatgtgggttatgggcccacatgtcaaagagattagggggtaaatatgggattgaacttatgtgcctatggcaacaagggatagatgcggttttgttccataaaaggggttgaacccctatgcctagccgcaattcttggtcttttcacctctcaaccttctcaccaaagtaaacgctcaaggatgggcggccgcaaatctccatcaaagtcgacacaggtaatcctccctttccgccaactcctcaacgactgattttggtaattgttgttgtgatttggttggtacgcatgaggtttggtaggtagagatagtcggcaagtatgtactatactaggtaagacctcaattttccatttattcgggagtggtctacgttgacaagtatttaggattccccgtggaaaagcaattgaatactaatctagcggtaaaacgcatagatctagggttagggttagggatggcaattgggtgtgacgggcacgggtattggctacccatgcccacgcccgcgagtttgttgtccacaggcgtgcccgttactctatgaggggtgaagaactcagcccataactgtagcttgtggacgctgtgtgctcgcaggcatgcctatgtgtccgccagatagcttaacgatatggtttcaaaagttcagcggattggaaagagaacattgaaatagaacaaaaaaaaatcccacatgttagcatgaggatgctaatcgcttgatgtacaagctgaacaattactggcaagcacatgcaactagaggcctagttactggtaaacatgaacgaaaaccaatactccattttagatttctagatctgacaacatgatggtcctaatctgaaaaggcaaaaggggaatcgagagaatatgagagagacaatcatcatcgggaggattaaaggatgcgcggatggagtcctggtggttggtcacaccttgcttggttgtctggttgcctccatagtcagcgcatgctgcaccgtccgctgatgccatggatagctgctacctgccgacgcctgggaggaaggaaccaagggcagagctagcaggcagtgcgttgagggaccggctgggtgtcgtgcgctagggtggcttgagcaggcggcaaacaatggaatcttggaatagttgagcatggagacactgtccgcggcagcggcggttgtgggtaatttggttgaggg

SEQ ID NO: 38810 - DNA, 1501 bp, Oryza sativa
cacattaacaagatggatgagatgtcagtacagaataaataacagctagcagaactatggcaaattgcctcaacagaatggtgtacttctttaataatggacccaattaacacttccattccccagatcaggtaccggtcaaatatgtgcttccttattcttttttgctccagatgactagtgtacttcataggcttaatactcagtccttttttttatatggcgttggctagttcaaaattgaaccaaccaatgtcatataaaaaaatagggagtatgtgatttttaatattatttattttagatcatttcattatcaaatcagaaagaaagacaaattgagaacatatgcgcgtgcatttatacaaggggtttatatgtttagtatataccttgttgatgagtaccacccatttggtttgatcctcggatattaagagccccacttccagacaaattcacaggggatgcaacagtaggcatagacattccggcagagcttatggttctcccaatgttgcccccacccgcaacgctagccacataagttattcgcgggccaaaattcccacaaactggagcagctgccaatccaagagcagaattgtggttaccatctttagtcaagtacgaggaggaagcttgtattgaaccatcaattgcactcatgttaccagtaaaaacaggacttcccccaacatgcatacctcctcggttgctgagagcaggatacccgacctacaaaaaggatgaaagaaaatgtgagctggattagaagagcttcataaacagactcgagcttaggagaggaaaaaagaacctgataaatggatgcttgaagactatttggaggaaaccaagcaccagaaatactacccctaggtggttgaaccccaagggatgaactaccagtcattgaggaaccccttggtgctagtgaacctgacatgtttctaagattgagattcccatatacaacccttccaagtttttcgtgagagttagttttagaaaaacatcactttctaacatgcacaaacggactagcaaaataaacaactgtaatgtcactaaccaggatgacgaaaacctgaaactgatccagattgaccagaaaaggtcggtgtcaacggctttcctgttgagactggaaggtttgatctggcaccactactgcttgactgaaaaagtaacaagacataagttaacctataattgtgacattttaatatgcatttgtgccaaaacaaaataataggatcaaattttaattataatatagacttaaataataaatcatagctagtattcaaagctgcttttcactactctaaagagcactaataacaacaagaaaaaagtgtccttcaacagcatgattcataacactttgttttgatttcagacatagtttaaggtccttgtgaaatagaggaactaaacaaagagaaggtaagttacaagaatacagtatccagaaggatacacaaaccaccaataa

SEQ ID NO: 38811 - DNA, 1501 bp, Oryza sativa
aagccgctgcccatcacctaaaagaattacagaaacctgaattttcatcacctaaaagaattacagaaacctgaatttattggagtatgtggagtttgattgcaatcataaatctgttcttgttgcatcgcgcaggcacttttgctaggccacttaaaatttattatttcctttttgtcatgcacatgtttttgttttctgaaattgcttagctcctcggtacattattccgttcgatacggccctgtgacatcggatgtttgacgctaatttagagtattaaacatagataattacaaaacacattccataaccttgagctaattcgtagcctaattaatccatgattagcctatgtgatgctacagtaaacatttgctaattatggattaattaggcttaaaaaattcgtctcgcggattagctctcatttatgaaattagttttttactagtttatatttaatactttaaattagtgtctatacatccgatgtgacaggagggccactcacttgttgtcagttgtcacctcagagaatcaccaaacggcaaaacgtagggacgaatctccttcggtgagtctgcacacacatcttcgccacttcgcgatgtcaggcgtggggcgggcccaggattttcaacttgggtattcgaaattggaagagatatttttttccaacacaaagtctaatagttgtataatatataatggtataagcatgatgcgtgtctttcataggaagggagctgactcccgctcccttccgtccatcagggatttattcaaaacctgaaatcgagttgagttgaatggggttcaagtcaactagatgaaatgtttcttcgtagtgagcgaacgagttgtaaagtcatagattcatagaattgaccataaattaaatatgttaagcatattttaaagtacagtactaaagtattaattgacaaaacatgtcaaatttataaagcatagaaaatggaaaaatgataagaaatcttacaatttagagagacttttcgtttcttgatattttgaaaataagtgacgatgtctttatccttcactttcctcttcatgtttcaaacctacaaaacaacactacggtcttctaatttaagtattaaccatgctaactctgctaaatatgtgcactaactctgctacaaagcctcacaaatcagtgaatcacaagtttcaaagttcaattgttcatccataaaccatgaaccatccctgtatggctggattcaaatcctaaataaaatgaaccatcctggattcaactaggaactataaatccgaaactcctaaatcctattcgaacctaattaccaaaatgttcctaaccagttttaccttcatctgggtccagccgtctgggcgtttggcgcggtggagtggtggagaggacagaggaggccggagcacggagcgcggctgcgtgggcacttgggcgccacagcccacaggggcggcggcgcgtgggcgccatagggga

SEQ ID NO: 38812 - DNA, 202 bp, Oryza sativa
caagatacaagctcgctatgccccccgccaccaacaccggccaccaccctcctcgatcccgacggctccgccaccggcgccgacgctcgccgcccacccgttctgccgcccaccgccgggccgccgcctcccacgaccatccctctaagcccggcgaactcccctttcttcccctccccctcccaccccatctcaccccagg

SEQ ID NO: 38813 - DNA, 1501 bp, Oryza sativa
gatatagcttgggtaatcccttaacaaatatcaataatatgtagaatgtaaaagctgtgtttgatgctgccatcaaggtagtaatcaagcctccaacaaagcagagggacaggaagaagaagaaaacacggcgcggatgttctttcttgtgagtgaatatgctgcaaaattttagctttctcacgtcaatgtctgtgaatttgtagtcatgtagactgttatttttctgcttaattcttggagagtttttatttaagatgctaagtcctttttctttggcattgcagctgcaagggtgtcatgtccagaagaaggctagtatgcttcaagtgaacaagaggggttctttgatgagcagagcagaggtctgtgagacaaaatgatgtcttgtgtttgataattgctttatctcaaaagttccagtttgatagttgcatttccaacctatatatatcctgtttggcaattaactactacctccgtcccaaaatataacaacttttggctatgaatctgaacgcacagttatccagattcatagctaaaaatacttatattttgggacggagggagtactagtagtagattactatcctgtccatgtaatgtattaggaaggttaatagcactccctacatctcagaatggaagttgttttggttttattccaagtttgataaaatttatataaaatgtagtaacattttataacgtcaaattagttccattaaaatgcagtaacattttataacgtcaaattaattccattaaatccatcattcaatacatttttataatattttttttgggtaaaatgttgttatgtcttttataaaattgatcgaattaaaagaagtttaacttagaataaaaaaccaaaatatcttacattatatgaaacaggagtacaacctaataaactgtcatcttaatttcatcccaacaaaatggcctcataaagctaaaattaattcacctggttatttcagtcccctccactgcaacattgtgacacattttctaaaaaaaaaaccttcagaagattgcaacttggtgaatcaactgcatatcaacagctcctccctccgtcccattttaagtgcacccataaatttctatgttcaattttaatcgtccgtcttatttatcttttttttaaaaaaaataaataaagcataaattatgtataaattattatttatattttatcatctaataataataaaatactaatcataaaaatttttaaataaaacggacgatcaaaattggacatgaaaactcatggttgcgcttaaaattggacggagggagtactcagctagcaaaggaaacctcttcatagtgggcacgcatgaagaaactcctccaacgtgggtgactaacacgtgggtccacaagttatgagatctacatgtcagccactcaaaatcggaggacaaataagtcagaggatctgtttccacgcgcgccactatctcaccgtgcatccgatggcggc

SEQ ID NO: 38814 - DNA, 1501 bp, Oryza sativa
tcgtccatgctgttattactgatgtaaaatgattgatgggttgaaccaacttgtcagcattaacgattgttatatttcttaagcttgcagaaccaatttatatcataggccagttgatttaaaatgctgaaacaatgcgctgagcttaaatattttggttgaaatagaatcctgagggcctgctcttcctttgctagctataagaataaagctaaaagaactgaaacaaaactcaggtaaaaagtgagccaaataaataacttggagccttgaaataacttggagttctcgtaatgcagccttggaaatgagtaatgtgatctggtttttctttctaatgcagatcctactttgatatggttgagacttcataaattagtacacttcctcgatgacccttcaatgaatgcctaaatactagaggtacatatttcttaactgaattatgatcttagatgtcaatttggacatgcatgtacaatattaatggtgaaaatgctatccaatatccatagaactctagcttaattttctcgggggtagagaccagtcaatttggaacttttagcaggctttctacttggtacaaagaagattatttatggaagttcatgctttttatattataattttgtatgaagttgagctttaacaactggttaataaatctttcatggtttctttgctaaccatctttacctaatacatatttgtcctaatcttttaagtaaaagaataaaatcagatcattttggaagtgtctgaaatctaaatttactgctgaaaacaagtacttaatgattctctgaacttgagcatgtccctgaaactgaatgatatgtactgatagatatcttacgacaaagtgcacatagctgtaatgctatctcttactgatttaatgcactgatagatatctcactagctagaaggtttagtctactattgaaggctcttttctattagctaatagcttctcaggtattattttacctgttctattgataggactgatagagctgtcaatttttttcagggtttctactgctctctagggacagccatatatctttgagaatattgattttatccccctatttgagtcatatacagagactgctgttgaccttgaatttatcccacagcatttgtgtgcatggagatatactgaagtctttttttccagttattcacaaatataatctggtacattgaatattcagtttaatcatatcagattttcaacagagaatgtttgctatgtatccctaatgaccccatttcaacaaggttctgcacaaatctgaagatagagttatgattttctcaaaattaaccatgatgttatccttccttgaactattcatgtaactaatcggatagaatatatagcttctatgcacatatttatgcttttaaatcaactgtaagtttcttccttgaacagctgcattctatccttcaatgtcttcacaaaatacttttttttttcatcctatcc

SEQ ID NO: 38815 - DNA, 1501 bp, Oryza sativa
ccatgtttcctcaaactcagcttctgagtcacatccctgcatacacttggtgaacagcttattaaatgctttggaaccattaagtgtaccaagacgagaagcagcattcttttgtatgtgccagcgagagatgcgatggcatgtatttggaaatacttcctcaattgcctttgacataacttgatcttgattggtaaaaatagagcgaggatgccgattgcccattgcctccaagaaagatttaaatagccacacaaaagatgacatagactcgtcagctaatagagcacagccatacatggtgttctgccaatggtggttcacaccaacaaacggagcacatatcaaattatgtttgtttaagcgataagttgcatcaaacacaacaacatcaccaaaacagtcaaagtcaatcctgctcctgccatcacgccagaaaaaattagtcatccgaccgcctcggtctatttgaacatcccaatagaacataccatcttcatttgccctgctcttaaggtgtcttacaaggttctgcaaatctgcattccctatggcaagtgtccttgccatactaatgtagcatgagagtgaatcttgctttgacgtctctacagaacttgacctccctgctataagtgatcttgcagaccgtaaaagatgtcgttcttcaggtcttgccaagttgtggttgtgatcagagaccagccggataaccttccactccccgtggttattcactctgaagcgaaccatggccttgcaattcgtcctagtatgtgggtcattgaagtttgcatcagtaagcctctccccttccttcaggccctccttggagcagaagtaatccttggtcctgatccttttcgtgccagtaaagtaggactgcttcccctttcggatactgaaccccatgcggtgcccatagtcacagtacagcttgtacgccgcctcctcgctgtacactaccttgcggagtagttcctcggtgccctccttgctgccatgaaccgttgctgcctcttcagtctcggcttcatcaccatacgccctcatccccatttcatcaccagagttagtaaccgccccttgtccttccatgaccctgtcgccaccagcatcgtcatgctgcgacccaattccttgatctacaccaacgcccgtctcaactgcgacgatagcattatcgtcaacacacatcggatctccacccccgccttcacagccaccttcaccgtcagtgttcaccatcactgcaaaaccccgagataattgggatcaatgtgtcaaagccacatcataaggcaagtgtaacaacgacacacctatcatcattcctatatatcaaccgaaaaaatcccaaaccctcacatagatagaaataaaataaagaaatgcagcaccttcctaacggacatagtggcggatctaacataggacatggggggttcagtttttgggaaaccatcaaactgttagtagtattaaggttaaggcaaaattt

SEQ ID NO: 38816 - DNA, 268 bp, Oryza sativa
caaaagaacgtaacactttactccatgctaaaaaattacctcagtcctagaataaatacagttttatgagtagaaggataaattaacaacgagggaaaatcatctagctgttccctatcaattggggggtggttgaaagtgtgaagatagttgggtgtaaattagagaacatttaaattagttgttattaatgggacaagtaacaagtagcactataagttttacttattttgggacaaaattaaaatcgagaattgcactttttagg

SEQ ID NO: 38817 - DNA, 1501 bp, Oryza sativa
gataaggggactcgggtccccccagcacccgtactagatccgcccatatctacagcatgatgccatgatgctattgtgggtagaaatatatatatatttgttgttagcgacttaaaagctaatactaaaaataaactgtgataaaaaagatttaaaaatcaactctgaaattaagatttaaaattcagattttagttacagctaataagccgcagagcaaacgagggaatcgaccctgaatctttacaatcttataaaacattcatttcgccatcgtataagcacactaacgaaaataatttaactccatttttcttggatgatgggcgagtttagcgtcaagaatctgctttattgaaaacgaagagatgctaatcagtagtcatggtgcgtatatacttttcagcagcaaacttccaagcaaaagacggcaaaaagagagagagagaggagaaaaagacgtaaagcacaaattgtgaagaaaatccagcttaactacagcttgcgtttgtttcttgcaacatcttactacttgtgtgcttgctaagcaagccactacgccataggatggagatcgaaaagagaagacactgacctactgactacttgcactcagatcgtcggcgtctgaattcttctgttcacttcagaattggcatgcaatctgtcattttgtaactttgcaccaaattgtgctaatccttggcagaacagctatgatgtcaacccttcttgccttaatctacactctcattatatttaaatcgaataaattataatggtccatgtggtctatatattttcagttttaaaatatacttcattgtcgtaaaatacttctttgttttctcgggataggtgaggtgtaagtccgaagttccaaatataatagagacaagggatagtatgggtaatatgaatagtttatagtaacaaaagtcatctttcaaaaggactaggttgctatattcaagtcaaattctaaactctaaaaattagtatatctagagatggaaggagtatttctaaagactgaatactatagcatcatataatggctgaaagcactagacaaccagaaaccaacttatcaactacaggatcatcagacaccatcagggtatcaacaaatgcacaatcaacaacaaacagttcttgcaattctactagcagcctaccagcataactagtggagcagtagaccccattttcagaagatgaacagtagatgatccagatccccccatagcgagaaagaacacggcgtcaggacgccaaagataaaagatggatggatggcctctctagctaatcagtatagacagtagtgagaacagttcagagaggaagcatgtgacacttccctctgtccctctctctctctctagcctccaaccatcgcttcaccaagaagccatcacctcctcctctctatcaagttctctcccctctcttgctgtctctgcttgctgctgctgctgctcgattcggccggcggcca

SEQ ID NO: 38818 - DNA, 1501 bp, Oryza sativa
gttggtgcactttgtaaacacagagagaatcaataaagtcgtcatccactttaagagttcttcggtttgtgttttctcgggtgcggcggtccaacctgcaggacaccagcggtcagaccggcgacataagggcggtcagaccggcagcggcagccaggcagcagcaggtgatttcggcggttcgaccgatcgatctacatcggtcagaccgacttttactaggcggctataccggcgcatacgcttcggtcagaccgcgatccatcgaatttgagggtaacttttatttccgctaaaatttttggtttttgggtataccaaccattcacccccctctggttggcttagttattatgattcgatcctacaagtgatatcagagccttgttttcttctttggattttaaccgatccaaagtttttgcaatggctaaaaagttttcaactaagcctcatgttttcgatggtactgattttgcttattggtgtgataagatgcaatcttatattatggctgaagattatgatgcttggcaaaaggttgcacaaccatatgtgattcctgaacagattgacactattgctttgaaaaccgagtctaataacaattgaaaagctcgcaatattcttttgagtggaatttctcgttcggattttgatcgtgtttcacatcttaaaactgctcatgagatttggaatgctttgaaaaactttcaccaaggaactactaatattaaagagcttcgtcaagatcttttcaaaaaggagtacataaaatttgagatgaaaccaggagaagctttggatgattatcttggtagatataataaaattttgagtgatcttagatctgttgattcttcttatgatgttaattatacacaatatgaggtttctcgccactttttgaatggtcttgacatgtctatttgggagatgaaagttacatctattcaggagtctgttgacatgtctactttgactttggattcgctttacacaaaactgaaaacacatgagatgaatattctttctcgtaaagttgattctaagttgagtgctttggtttcttcctcaacttctttggatgttgattcttcttcatcgaagtcttctgcatttgctttgtttaatgtcatgtccgatgatcaactcgaacagttcgaggaggacttggttttgttaactaacagactttcttgagctgtaactaatgtgaggtacatgaaaagaggtggaccaaatcgttgatttgaatgtggtgctacggatcacttttgttcgcattgtcctatgcttgggagaaataggatggaagataagggtgatgagaagaccaacgacaacaagccgaatagtatagttaaaggagggaagaagatcagggagactctcaagaaggcttttgatcaagtctatgccccgtttgggccactaagcgatgtagatgatgagagtggagatgaagataagggaaagaacatctccggtgtttgcttca

SEQ ID NO: 38819 - DNA, 1501 bp, Oryza sativa
gataacaaaggatggcatagtagggttgcattcgcaaaagcagcatttagcaaacatttgagaatttagtaaaacagttaagtattaaacaatattaatccaacgctatacaacataccctgttgtataggcccaaccattctgaacaaccatcccggctgcacagttctatctccaaaccaggaatgtaccattccaaaccaggagctaaacaaattattaccaattatagcatcatttactatggtgagaagtgtgagactaatcacgaaagacattgttagacccgcccataaccgcgggcacggctattcgaatagttttactctgatcagaggtgtactactgtacccacaagacacaaccccacatcatgtcaccatgtgcctcaataccaccacggtacctcggaaaggagttgtgacaataccccttgcataacacaatccactgcagcgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacggttaatgtttcacaaccgaaactcgtgaaccggtccttaattgtcatgagcacgaccatcaaaaccatgtgctcacaacccaccattaccaggttttagttggcacatgaattaattaactaatcacgattgaccatcgtgaactatcattaagccatcattaaataatagtgagtcataagttatcccaatagtgtgctaatgtttctaagcagggctaagcaattatatctaatatctagttgaaccaatatatagagctcaaccagtcaagttataataacccaaggtatcaaggaataaggtaatcaagaacaaaagggccataacaaacaataggttaattccacccaatgacattcgaaaataaatgcaatagttgaaaagaaacaatagctttaaacgggatcaacatgctcaaagagttgtttgggatctgtgtgacttgccttgctggccttggaactcttcaaactcttctccggcgaaaacggactctccggaaacgacggaatctaagcagaaaagagcaaaagcacataaacaagcatgaacagtacatgtggatatttttaacatgtagatctcaattttagaaaaatttagagacttgaaccaactaaatcggagctaagatgaattagttatgaatttttgaagattaaatcggattaaaacacttaaattgattttaattgaattatgacgcaataatgaattatttttgaaaaggaaaaagggatttattgcgtcagcgggctagggtttgcggtggaccgggcgcacggcggcggttcacgcgaacggacggccgagatcgacttgatccaaaacggacggccgagatcgattggtccacgaccggctcacggcggacggtcccga

SEQ ID NO: 38820 - DNA, 317 bp, Oryza sativa
cggcagggcccaccatataccatgtcttatacggaaacaaacctcgtgtataggagttccagataaggaatgatgagtagagttctatatggaaaagataaggactaatcggattgtatccatattggtctccctagttttacttggacaagggggcacctatgggtataaatacaagcccccctaggaggagaggggacaagccacaagatcaacaagacacaacatatacacaagccaacacacgccgccagatctcgatattagagattagcctagatataccccatccggtgcctgtgaaggttggcaagagg

SEQ ID NO: 38821 - DNA, 1501 bp, Oryza sativa
  unsure (1)..(1501): unsure at all n locations
gtgtgcaagttttgttcattgttatgtttatagttcatatatagttgaaatagcacataaagcatgcattcctttattttattgtttcgtaggtattaacatgctggacataagttcaattggaaaccttgtacacatggttttatatatccagatggaacccatttcatctcttctcacattatcaaaactggacgtgactccggcttggatgaccgaagggaggaggttaaaatcgggcatgacgtcagtgtccgatttacgtgcaaaactactttaaactgatttttctcttaaaatacttatccaaatcatgatccgattgcaccattaaattcgttacaattaaatcttcaaaaaaagatcacacagtgatatattccgacgaaaaaaaattagcttattattgaattatttttaaatgttgcatgatgttccaccagatataccggaattgtttcactaagtagatcgaaaatgtttcactcgtttaaatcgggtgttgtttcaccttatataaaaacaatgtttcagcaaatagcgaaagaatatttcagttcactgcaacatttgattcatacatagtgaaacattataattgcactaggtgaaacatttttcggtagaaaaaaaaatgaaacgaattcccttaataggggtttccaaaatatgtgggtttttttgttgcaatggaatatttcagttcactgcaacattggatctatacgaaacattgtgagtacactatgaacaaaaaataaactaaattcccttaatagagggtttccaaaatatgtgggtgattttattgcaggggggcagggagccagggactgtggtggggcccaggtggcatgcacgcgtgnncagnngngntngncnaagctgcagggtgcagggggcagggggagcgtccgatttttgctccccccgctagtagaccgatccctgtcattctcgagtctacgggtcgggcgcctgatcggtttggagaaaaatcgggcgctgatgacagcatgacgtcaacgcccgatttacgtgcaaaactactttaaattgatttttctcttaaattacttatctaaatcatgatctgattgaaccattaaattcattgcaattaaatcttcaaaacaagaccacacatggatatattctgacgaaaaaaaattagcttattattaaattatttttaaatgttgcatgatgttccaccaggtatatcggaattgtttcacttagtagatcgaaaatgtttcactcgtttaaatcgggtgttgtttcaccttatataaaaacaatgtttcagtaaatagtgaaagactgtttcagttcattgcaatatttgatccatatatagtgaaacattataagtacactaggtgaaacatttttcggtggaacaaaaaatgaaacgaattccctattataataggggttttccaaaatatgtgggttttttgttgcaatgcaatatttcagttcactgtaatattatatc

SEQ ID NO: 38822 - DNA, 209 bp, Oryza sativa
taatacatgttaccttgtattctaataaaccaccaagctaggggattctcaagaaataaattttttcttggctgctacacccgccaaggaaaatcttcgaaaaacttgatatatattaatccgtacatggtctttgttttaattttttatttaaaaataatcaatggatgcacctctgctcagtgctcaccctgtatcgtggacgtagg

SEQ ID NO: 38823 - DNA, 1501 bp, Oryza sativa
gcgctgccctgggctgcggttcgaggtgctcgacgtgacgaggctggccgccatgcggcccgacgcgcacccgggcgtgtacatctacaagaacgcctacggcggcggcccggtgccggagacggcggcgaacgactgcctgcactggtgcgcgccggggccggtcgacacgttcaacgacatcctgatgcagatgatcgccggcggctagctggccgccgccgcccgccgtcgtcgagctcgatccggcacgtgcggcgcggtgtgtcgccgcacgccgcgttgcatggtctctgcgtctgcgtggatggtggatcagatcacgagaatccgaagctgtcggttttgttctgactggttcttgaatcctgacaattgactttggtatgcgttttttataagcactttttcagttccataaaaaatatttcttcaaatacgtattactagagatatataagaatatgtctatattcaatatgagattaatttttgatgggacgagattgatttttgttagatggagggaatgttcttctgccaatgggattcagaatcgcagtttgcagatgcaacgtgtgctgacttcaatctcgatgccattgattggcacagtgtacaatggtctatttcaccttgaatataagcatttttatattatttagcagttaaggaaaaaaagcgtgctgacttcaatctcgatgccattgattggcacagtgtataatggtctatttcaccttgaatataagcatttttatattatttagcagttaaggaaaaaaaggctttagagtgtttgtacttgtagacagaggaaataggatatatacggccattgaaatagggaacttagccctgcaaacaacccaatctgaaatataagcatttttatattatttagcagttaaggaaaaaaaaggctttagagtatttgtacttgtagacagaggaaataggatatatacggtcattgaaatagggaacttagccctgcaaacaacccaatctgaaattcgctccataggagatttgagccctgcaaacaacccaatctgaaattcgttccataggagatttgaactcaagaccatagggtactactcaggtcactataaccactaggctatatccctttcgtatatattttattgagtatgtggtgtgttatggtgctgattttattgcaaggaaatgttacaaatttcaatagagaagtgctacacgaagggatccttttctatctcgtcctatacaaagggattgctagaaatataccattgtcacgtaataaaagtgcgagtacgtgtgatgccacgcggtgaggacgtgagaccgcttaatctcgtgcaacgaggatgcaatacggctacttcgcatccctaagagtatctccaacagcttcttcaaatcacactctccaaacacccatatagtcagctctccaattgatttggcaagccaaactcattcctcacttcaacagcctctccatctacac

SEQ ID NO: 38824 - DNA, 720 bp, Oryza sativa
gggggagggggagtgggaggagcccggcccgggggggtgggcctcgtcggcgccgttcacaccttccggccagctggcgaggccggacagcggcacgctggggcggcggtggaggcggcgcgctcgcgctagggagagtggcgatgtgaggaggaatcgggagatgaggtgatgttttagggtttggttgcctgcacgaatcttaaagcaatcggatggtctaaaatttgcaagatttctaagggggttttctatcaaatgatctatagacagtcccaaaaaaaaaaaaaagagtgtccatcagtcctaatcccaaattttcaaatgaagcctctggagtcttgactggctcttatgaggcgtggctttttattttaatttttatagggttgatatgataggtaaatataataggtacggttggatactgctcgattaggcatggctcatcaaacagaccgtgccctgttggcctacatgctttaggttggagctcaggcatgacctagtgagatgttgagttatgtcatttggcctgacacgatgtcacaccctgaaaattcaaaatatataaattgttgtttaaatggaattttttagaatttattttttaaaagtcttgaagagaagatctaattttaattaataaattccaatataaaatggggccagataaaatttcattaaatactttgcttaattctataattcctagatttt

SEQ ID NO: 38825 - DNA, 1501 bp, Oryza sativa
catccacaacgagacaatcaacaggatcaacacccaacacaatcgacatagaagccacaacatagaagtctacatacgccaagacacgccgccggatatcgatttcagggataggcatggctattcccctacggtatctccggataccgtcaggagatacgaaagcgctatctctgatctcgccggacacggattcgaggaggaaggctaccctgttgtcgactacgagtcagaccttcagaccgccatgtcgacaacagttagataggctacccacatattgtattggtgtgattatggtgaataagagcaataccggcttcggccaacaagatgtagggttattacctgacaactcaggggcccgaacctgtataaaaatccctgtctccatctttttttacctcagtctcgcgtatattctagcaccaacgatcccaatactgtccaaataccgtagtcgagacatcaaacgtcgacacacacctctttagatccaccatcatcgccgtcacatggttggtcatctttgagctgtcgcgccacctcccgtcgcgccgtctcccgtcggcgagcccgctgactgccgccacccttcccgccagatctggcggaggggagggctcctccctgcggtagatcaccgcctcccgctggcgagccctctgcctactgccacctaccaccgatgagcctgctgcccccgcccaccgctgacaccgccccgcctaccgccgaccccactgccgcttcccctcccgccggatctggcggaggggatcggagggcgcggtcgccgctgccgcctccatcggccagccgccagcagcgagagagatagagagatagatagatagatagatagatagatagatagagagagagaagggagggagacggagagaagagagcgagacgagagagacgcgagatcaaaccttatctcctcatcgccttgttgtggtggggcccgccggtcggctcatctgattgccggctcggctcgatttctgtgggtgtcaaaccaacacctatagaataggtgtcagttattatttagaaccggtacttataattgattaaaggtgctgtttttttttcgatttcaacccgcggaaataggaaaaggcctatatatagtgccgatacctatttgatgttttgtgtagtggtggtaatatcaaaaatgaatgaccggttgatgattactctattttaaaatataagatttctacctagtttatttattaaatattaaggttgagatagaacttccatcggtgtccgagagataactctactcgcacgctggttctcgctccagtatgcagcaatctctcacactgcaacttccatcggtgttcgagagataattccgctccctcactggttctcacaccagtacgcagcaatctctcacaccgcaacttccattggtgttcgagagataattctgctcgctcactggttctcgcaccagtacgcagcaatctctcgcacc

SEQ ID NO: 38826 - DNA, 1501 bp, Oryza sativa
agccatccagcagccagcagtgaccatattattctcctcaaacgtccaccaaacactgcaatttcaataacacgtaaccggtcgatcgcaagtactccctctgttaaaaaaaacaaacactgattttcgtgtctaatgtttgaccgtccatcttatttaaaaaaattaaaaagacaagtcacgtataaaatattaatcatgttttatcatctaacaacaataaaaatacgaattataaaaaaatttcatataaaacggacagtcaaagttgaacacggaaacttaggatttgtctttttttttttttggacggaaggacgcacgcacaaatccttcaaaaagctggctgtggctgccggcattttatcgtcgtcatcgtccacacgtacggtgagtcgagtgagctagccatagctagctatgaagaaggcggccgccggcggcatggcgcctcttcctccgtcgtcgtctcctccgtcgtgcaaagccggcggtggtggtggcagcccgaggtggtcgttgcttcacggcggcggcggcgagtggggcgtcgtggtgcggcggaacgtcgtcaagtcgtcgtcgctgctgctgctggtgttctccaccttcttcgtcttctccgtcttgcgctcgtcgcagacgagcttagtcccgccgccgccgccggctgctgccggccccggcgagccggcgctggcgcagagtggtcacgacgttgccggcgatgatggcggcgaacatgtcgccgtcgcagtcaacaatgtggcagctgagacgcagagcacgccggatgacatctcgctgccgtcgacgaactcatcggctgcagctgttccaacaacaacaaacaaagctgaacaacaacaaacaggtgatcctggtaggtgcatttcaatagtgtattcattattttgaagcaataaacactaagataaattctttgtaagcagtggtagagccaaaaagtatcgaagcctaaagctcgaataggactcaactaatgagatattattttttttcaaaaaatatacatgatgatttaagagaatttaaacgtcaagccaagctatcctaggtttgcctccccttctagatgtaaaaccacataaatcttgatgcatattctctcgtttcttacatgtcacaacttctcgttatttcgagggttaaactttttggtttagccgatttaatcagatgtcaccgaaaaattagaaatttcggtccaaaattttaaacaaaattcaattgaatttgaacaaatattactaaaatttatgaaaaaaattgaaaatttttggccgaagtaatatcgtatcggagtggtccaaaattaccgaaatcagtccgaaaattccaaccatggttatttggacgcggttggtaaataactaaataagggatcaaagtaaatttttaccacgacaaatgtgaggcatttaactttgtgatgtttgatgtgtgctctggataatggcaggagcgaacaacatggagg

SEQ ID NO: 38827 - DNA, 1501 bp, Oryza sativa
aaccagatcttacatggtctttcgtctctgaaggatccgacaaggccttatcggctctgggcgtccccagtcgaagatcccttaggttcctcggaggccttgtcaagacggcgtaaagggacagcaggataggtttcaacgctaggtgtcgtcgtggtaagggatctctgggtaaaacacttggcgatattgtgtacctgctaccaactttattgaagtagaggtagtgggagaaatcggtacatcgctggtcgaggaacaggcagtagccgcaacttgaccactgaaagtggaagtagtcggagaaacgctacatcgctggtcgaggaccaggcaatagccgtaactcgaccactgaaagtggaagtagtcggagaaacgctacatcgctggtcgaggaccaggcagtagccgtaactcgaccactgaaagtggaagtagtcggaggagtaaccgtaactcgaccactgaaagtggaagtagtcggaggaacactgcatcgctggtcgaggaccaggcagtagccgtaactcgaccacttgaagcaaatgtacgagagatcactacgatcaactggttgagaaccggtgagtaggtgtccctcgatcacttggagtcgtggtaagaggaccgctacgctgctgtagtcgtaccttgaccatctgaagtaaaggtgcgagagattgctacgtactagtgcgagaaccagtgagcgagcagaattatctctcgaacaccgatggaaggtgcggtgcgagagattgctgcgtactggtgcgagaaccagtgagcgagcagaattatctctcgaacaccaatggaagttgcggtgtgagagattgctgcgtactggtgtgagaaccagtgagggagcggaattatctctcgaacaccgatggaagttgcagtgtgagagattgctgcatactggagcgagaaccagcgtgcgagtagagttatctctcggacaccgatggaagttctatctcaaccttaatatttaataaataaactaggtagaaatcttatattttaaaatagagtaatcatcaaccggtcattcatttttgatattaccaccactacacaaaacatcaaataggtatcggcactatatataggccttttcctatttccgcgggttgaaatcgaaaaaaaaacagcacctttaatcaattataagtaccggttctaaataataactgacacctattctataggtgttggtttgacacccacagaaatcgagccgagccggcaatcagatgagccgaccggcgggccccaccacaacaaggcgatgaggagataaggtttgatctcgcgtctctctcgtctcgctctcttctctccgtctccctcccttctctctctctatctatctatctatctatctatctatctatctctctatctctctcgctgctggcggctggccgatggaggcggcagcggcgaccgcgccctccgatcccctccgccagatccggcgggaggggaa

SEQ ID NO: 38828 - DNA, 278 bp, Oryza sativa
aaaaggccgagaggacaaaggccgtattgtcgaggaaaaaattgataatttaacaatttttcgttgtccaatctatatactaatataaaaaggaggagttgtcccctccaatgctacaagccaaatcatccggactaatctggaccgtccatccgcgcgcttctcttcctccaccgcacgatttcacagccgaggattccacgcgcgaagacatcgctcctcctccacccgcagccgcggagaccgcgcgcttctcttcctcgctcactcctcccagc

SEQ ID NO: 38829 - DNA, 1501 bp, Oryza sativa
ttgaagataaatagttatgaacttaataagtcatgtttggattgttaccctatcaaatattgatgaaaatagctatacatacgacacaactcacgtactactgaatttgatcaacggttgtaaacgactatagtgcataagaacatgttctcttttgattgatatatggttacatatctctagttgtacatgagttgtacaactgaatcgtacgtatagcagtactcaatatgagttatacaactgcatcgtacgtatagcagtactaaatactgatagtgtcaaagcttgggtaagttttggctctatcaaaattacggtaggacaagggttcctagcttatattggtttaattagcacatattggcttcaaccaaaacacacaaaagatactactgaagttgcccgtgttttgctagggcaagttttggaaccaaaccaaacaagctcttaattatttgaagacaaagaaggtgtcaaacatgaattgcgcggtatgttcgacggcctgaagataggagtggtaatggtccaacctaactcagcgcacatatatatattttttactctctttagtcacaaatatttaacacggttgactttggaaacatttgaccattcatctattcaaaatttattatgaatatgtaaaaatataagccatgttcaaagtaactataggtatcacacggatatgtggatccccaataccctcacaaccagattgggaggcagagcatcggtccatttctatgaagttatagaatttacaaattataatatgcaccagcttctcataatctctagctctcctagcgggccttaatttcgactgtaactgctctaaattttcatacatacagttaccttcagtaaacatagcgtgttaacttaactttgttcttttttctctaccgggaaggtagcagagaaacttccaatcctctaaattttctgtctctttcttccctaggttcttatcgtctcgatgtcagtggcgctgggacgcggcgaatacaaactttcctctctcccccatgctccctggcctccttcctactgacaccggtcaatacaagcggcttatcaacggcgtcggccgctcgatcggaagcagcgtcattgagcaaacagcagtttcggccgcacagcaaatgtactccccttgatgtcttgatagcccattggtatccattcttctgtcgagtagtactaatctttgagctgcccaagtgcccagcctgccatccgagactgaagagcgtaatttattcggaaaacatttgtagggaagatggggtacgtacctaactttgatcgaaacattcaaaaccaatccacaatgctggtttatgaatcccagcagatgataccgttgatctgaacaagttgccagccagtcaagtgagcaaggtgcttagccatataaaagaagcacgcatgcttcctgaagcttacatcacaagcacaagtagctgcagccacaccagtagtatgatca

SEQ ID NO: 38830 - DNA, 1501 bp, Oryza sativa
cggtagttcatagttccatcacttatttaggtattgttttttttattacaactgactgaactagccggtgtgtgcagctagctaggctgttgtgcctatcttggtatcggagacactagaacaggatgtccgcacccaccacctgcaaaaagttacaagttacacgtacaaattaaagttatataaacttgacaggtattttcttttataacaaatttcaatagttttgaattaacatgagaattcttagctctctaataggagtaagacattcacgcgaggaaatttatagaatataataatagccaccaattagcattagtaagataagtacaggtcctatgaacaccaaataatgtcatatgcatatcattatgtcaaacttagttatcaattaacccatccattcgtgcgtgtaacatgttttatttagactacgtcgacttcaataacctttggcggcatatgtatcttgggattttgattttccttagaatgtttattctgtcaagatactcggatttcaatctgtttattatatcaatgatttggcatatacagtatgtaataataaaattactttccaaccatgcatggaagagtagcatgtactcatgctttcttcaatagcttctgtaacaaacttgggcaacaatatctaaatgtatatgtttgtatggtggtttgtttgttttatcctttggaaaaaaatatcgtagtgtatactgctaaagtttcatgtagaatttgaatgtaactcaacatcttaattaatgacctttgtataatacactgattaaagagattgatttctatttgtaggatatactaccagctaaatatatttgatagttaggattttttttaattttttcttaactagaaaaatgcccgtgcgttgcaacgggtgaaggctattttaatcgtattattgctagattgttttgtctaaaaagtatatgcgatttttattttgatagtattcatatttaatctaaaatccttaatggctatatcatgcatgttactttcttataacgtggcaagaattctaaagcaattaggactctgactctcatctcaagttggcatatgagttttttaaaagaatttcttatacgactctttgtgtatttttaaaagcgaataaacttaaaaactgatcaaatatagacgatgtagtatcgatgaaaatatcttcaatttatttttataatagtaaagaagataaagatagaaatggagattgcaaattttagttaaccatgcatgtgctcagttttacattgatttttattttaatatccttaattactactacgaacttcactcgttctaaatcgatcactgatgtggctgccaggccatgcatgagtttgagtatgattgggtttcccaccggtgccttgcatggtttccattattggtgtctcacagtttcaaaaagtcctcgtccgttcaacaaaatgtccgtgtccgattccatacaaaatatgatcaa

SEQ ID NO: 38831 - DNA, 387 bp, Oryza sativa
ttcatctggcaagctgaaaaatgacccatctctaacaactaatttcaactcactgtgatttgtcctacaaatcatagcaacaaaaatatacatttagctaattgttgcatgttaccaatagccacaaaaatacaattccaaatatataagtttgtttgagggggaggtttagagatttcaacattgcaaacaacattggtaaattatctcaaccaagtcagcacaaacaacattcacattttgtattactaacagaacaaggatgatctcaaccacattggcacattggtaaattatctcaaccacattgaattgtattactactagctaattcgttgtacaaaccaaactgagaacaactacactcacaaaattagcacaaaggta

SEQ ID NO: 38832 - DNA, 795 bp, Oryza sativa
gagtcagaccttcagaccgccatgtcgacaacagttagataggctacccacatattgtactggtgtgattatggtgaataagagcaataccggcttcggccaacaagatgtagggttattacctgacaactcaggggcccgaacctgtataaaaatccctgtctccatcttttttatctcagtctcgcgtatatcctagcaccaacgatcctcgtactgtccaaataccgtagtcgagacatcaaacgtcgacacacacctctttagatccaccatcatcgccgtcgcatggttggtcatcttcgagctgtcgcgccacctcccgtcgcgccgtctcccgtcggcgagcccgccgaccgccgccacccttcccgccagatctggcggaggggagggctcctccctgcggtagatcaccgcctcccgctggcgagccctccgcctactgccacctacccccgatgagcctgctgcccccgcccaccgctgacaccgccccgcctaccgccgaccccactgtcgcttcccctcccgccggatctggcggaggggatggtcgccgctgccgcctccatcggccagccgccagcagcgagagagatagatagatagatagatagatagagagagagagaagggagggagacggagagaagagagcgagacgagagagacgcgagatcaaaccttatctcctcatcgccttgttgtggtggggcctgccggttggctcatctgattgccggtcggctcattgatttagaaccggtacttataattgattaaaggtgctgt

SEQ ID NO: 38833 - DNA, 404 bp, Oryza sativa
ccaaagcgtggccgggccgggccaataatttttgcttgatcgatcttgcgctcgttttggtgtggtccagcagtggattctaatctctcggggatatcccctagtatacatttttcttccaaattcgatgtaaatagttgtgaaaaattctgaaaaaattgacaatgtagagtataatgatacctactagtccaccaaaattcatgttcaaattcaatctacacatcgagaaacaaaaaagacaaatttagatataaacagtatgctactattcatatgctgaatttgtcttttttatatctcgacgtgtgagttgagtttagacttaaaattctgtaaagttgtatatatgtgttgtatgaatgttgtcaatttttttccaaaatttttcataaccgtttaaa

SEQ ID NO: 38834 - DNA, 1501 bp, Oryza sativa
gattctcgtcgtaatcaagaagacataagagatcctagaatcatatactctctctctctctctctctctctctctctctctctctctctctttctgttctttgtacttgatgcatttatcttaaccgtggattacatggacagattaggacagaatccacaacgacgattcctctcctgcattgtcaactatcaactgcacgggcacaaatgtactccctccgtcccattttaagtgcagtcagccatgattttccgtgctcaactttgatcgtccgtcttatttttaaattttttacataagtcacgcataaagtaatattcatgctttatcatctcataacaataaaatactaattataaaaaaaagaataagacggacgattaaaattgagcacggaaactcatggttgtatttaaaatagaataggacagtgggagtacaatccaagacgacgactaacctgcacattaacctaggcaccttcttcctaagatatagatataccagtactagtataataatgttaacaaaaaggaatatcaaaatgtgggttggattaagcctcacgatcccatttcgcgcgcccgacggccaacacacaaaataataagaaatcatgcccgcgatggctacctgacaccaacagccgacctgattgagagagatcaattaataaactgaacaacaggttaaatggttaactaatccaagtcgacactaattactctatattagcgcaggtctttttttctttttcaatagcactgcctccaacttctaatagatgacgccgttaacttttaaacaaatatttgatcattcatcttataaaaaaaatttatacaaatatataaaatataaatcacttaaagtattttgagtgataaaacaacttacaataaaattataactaattaatttttttaaacaaaacgaacggttaaacatgtgataaagagttaacaatgttatcttttaaaaacagaggtactaatattgattaagcataagcaggtcggctctttgaccaaacggcgcgaggaaggagcagaggcgggagggaggatgtctggctgtctgaacgcgtgaggagctcacactctgatcatccatccgcgggtgggttgacctcttcccggcggcgcggcgagagaagggaagacttcaacccggccgcggttggtggcgccatcactccccggcccccgcgcccaccatatacaccgaggcgtcgtcgcctccccgcaccttgcgcggactcttctcctcttcttcctccacctcctcctccacgatctccggtcaagcagagcacaagcgtgtgctagctctcccggtggcttgcctcgccggcgacggcgcggcgcaggatggagccgcgggtgttgatggctcttgcgctggtggtggtggcggcgggcgtgccggcggtgttgtgccagaccaacgcccaggacggtgagtgctcttgcctcgccgccggcgatcacctccgttt

SEQ ID NO: 38835 - DNA, 1501 bp, Oryza sativa
atctgagtaactgatacaattatcttgatgtagtatttgctaaaaaaacattaggtatgcataatcaagaagcatcgtctgacttttgcccccccttttttttcatagatttgctctttcattgtgagactaatggtatatcaagtcctaccgttttactttatttttctctcattttgctttgtctgtgaacataacaatatatcaagttataactgctttactcaatttgttttctagaaaaagttcgtttatttactgtgagcatcgagacataaagattatgcatctacatggcaggctgtatcaggggtgctgcaagaaaatattttgagggaacgttactacgaacatatcatgtacactaaagtccgtatcaatgcatacaattgctatgccgttatgatgtgcactctatatcaggaatggatttattttgatcccaaaatggacgctaagattgctgagatgaatccgatgaatgagaatgaggttgattgggctatggtttattggttttatcaaagttggtacgacaagatatggtgcaattcttctatgtgcctcaacgatgacttgtatagttatacttattgtcttttgttataagcttttttttttttaaaatggaagcatcatacacatgtgagctgtgtaatttaatattttcaaacattttaatgaacatcagatattggagtattttcggaaacgaaatgcattaccatgtaactgtgtatgcacataatttcctgatttaaggccactctgcaagaacactaggccaatcactgtgagggcgcggcaaagctgcgccaagttttctagtttgagctgaaagaaatgctcaagttataactcaacttcctatatttcattttgctatttctgctgtaaaactgctggatgctactatgtactaaaattagtctcatcaccaggagtttcaaagaacacaagtagcccctgtgacgtttatcgtctcaatttgttttccttatacaagggacgaggaaattactgctatttgtagtaggtaacaattgtgtatgaccatatcctatttcccgagctagaagaacttatttctatatgaattatcctgcttttcccctttaacaaataagcaataagctctgtgcattttatcctattgagagaaaacagctgcctgaatccagtgtagttgcctgaacttttgcagtggcacaggtatttagtttgatcatagtccataccgctttgtctcttgcttctttgtttttagcccttataaatatcacagttggatgcttaggttgaggtgtcagatatcaaattgccaacttgtgaagctctcttatatgcttgacaaaagttaactcttaggccatccacaacaaagaaataaacatacaaaccctttggttggcaaaagtcacgtgtgtgtatgagaacttaaccccaacgtcatacgagaccctccattgaccagcaagtgtatattcagcaagtcctaatg

SEQ ID NO: 38836 - DNA, 1501 bp, Oryza sativa
ttagccaacacgcgcgctgcgagccggtagcaagaagctatctctatcatcaaaacctgcctgttcttggcggcgactagaggtataaaaagaggggaagaacgaccatagggtcgtgctccaaccctaggacgcgcccctaatgggcccaacatggatacacagcccattgggccaaaagaggtgacgcagcaccatggacaaaaaatagtcgggagtaaaatgacaattgcggccgctccagaacagatatggacatgtggctggatccatttgaaaatagacttgataagctttccatgaagtacttgcacgcccaaatcggagttcgcatgaagtcgtggcggccgtcagaagttggcgctgccctgcagtccgaatccaccccgcgcgaatcctcttccctttggatcctctccatcgttcctgagtaaaacacgagtgcacgcgtctccgaggtataaagacgaggaatatgaactcaagaaagaactcacctgataatttagttgacgtgcacgaacgtgggtaataggaccatcatgctgtatatggggggacgtggatgtatcgatggtgttgatgtcctcatcagtttcggcggctgagggggttttgtttccccgatctcgaggcttggccgtccgatcaaaaccctagagatcggacggacagcgtcgaccgggccgatttcggcccgaaatgggatcgagagcgaggccacttttccggcccaagccaaggttgcggcctggggaggggaagtgcacccgcgcatgcgcaaaaggccgtgggccgaccggcaagggtctggaagaagtctattttaggtccctctagccgaagaaaaagagaagtagttcatttttagtgcttctttttttagaagcatttacaattatagttattgaatgtgtttatttcgaatcaaacctaaaagaaaggattttctttctttttccaattaaacaatttgttaaatgatgtttgtattattaaaattagcaattaagttatgaaaattccaataaaattctaaagagtgtgactaatcatggagaatttaataaaattaaatttaaccatgttattttatttctcgcatttgctttacttgtaaatttatttaattatacacatacctacttaaaaataccaaaaatttcaacgaatttgtattttaaataattgcatattttttgatctgtacgcttcccgttgtaacgcacggacacttttactagtatattatattaatctatcataataagctatatgtttgtttcaacttacttctaataatccaaattataataattctaagctgaatcaatcagaacctaaattcatttccttgcttggtacggagtataaacctcgatattagcggggctcataaattattttcctggttattacttattagcgcctaacgcttcggataatggagcgtcgtaaattattttttctgattattagcgcttattaagaaaccctaata

SEQ ID NO: 38837 - DNA, 1501 bp, Oryza sativa
gaataatttgtttttctgcttcatgagatgttctgtttgtctgcttacttgtaacaacagccgcaagtttattaataatctatcatctagcccctggtttattaggcggtttatatataaatgatacgacatcttaggagatcgcatctaaatccggttcaacttttaccatgcagcaatccttaattgaactctggacttggcaatggtccgtggttgtgatcaaaagaaccgagtttagtgtctctgggatcaatgctggctttgcattattcatcctgttattattcgttacgaatgtacgaggtgctcaggcatagtttgatataaattaattggtattggtatgggtattaatttagagaagataatgtagattattttgattcttggatgattggcaagagctcctacctttctttaagctcgtttggtacagagaagtctttgatcatcatgattgagagttttcgggttttcatgtacagagaactctattcatcttttggttgaaagttatgggatccgaactgaactttttttttttcggaatgaccgaaggaggtcatccaatattattaagataaagagaaaatgttacaagaaaagttttacatcgataactggctgtcgaggaaggatgtgcaccagagcacacgtcccgaaccaagtgccaaccgcccaaacacacgccacagagagggaagtcgagcaccgaaccggtcgtcgctatgcgagaccgatcgccaccgagccaacaacactaccacggagcggagactctaaaaaacgacgccctcacgaaggtcgcgacgccgaatgacgccgtcgtcgtccatccaaagactggacaaggttttcacccagaactccttgctgagagaggaggggtacctcaatagtgccctcaggaggattaccactcctgaaagcgtagtcactgttggcccaaagaaacctagtctacatttttagtccaaataagtttgagctgaaagttatacttttggttataactcatcgtaatacatcaaagctacgatgagttataactgagttcagttttccacgtggatcaaagttactcagttttcagcacaaaaactgagtatgtattacgatgagcgagtttttgtgttgaaatttgatccacgtggagtagaaagcgagaaatctcagttcaaataatctacggtaagatttaaaaccaacccatacagaagttgaaacttgggaaggaatgttttctccgaagaaagatatgcaccggaaaaaccaatagggaagttgtgaaaactgaactaattgtaacagcggtactgaggggctctgccgatagtcagaaagctcaaacatatatgggtgtgtttagttcacgccaaaattgaaagtttaattgaaattggaacgatgtgatgaaaaagttggaagtttatatatgtaggaaagttttaatgtgatagaaaagttagaagtttgaagaaaaagtttgtaactaaac

SEQ ID NO: 38838 - DNA, 1501 bp, Oryza sativa
ttctagaagtaccagcttgtgaatattctatgagaaaaaaatgggatctttctgaggagaaaatttggttctgactaggagaaattagataggtccagttccaaaataagtatagtaagtaggagtactaatcaggtgtaaagtatgacattgacaggcaggtggagtacgtcgtgattaagttacccaattacggtagaggttaattaaccttttggaagcagatttaggttgaccaagtaaaccatatggttgcctttgcccctcttggcatttcaatatttttttaaccttttaattttttgtttttcaaaaagaaactatctaaaaattatttgaacattttaaaaatggcactccatttggcgtaacaaaacatgtgataaacattggacatggcactgctgtcaaggtttagatttagtaataagtttgggatggtttatttttaaaaaatttaaaaggttaaaatattttttaaaaaagaaatcctaacggttcttgtatttgaaacactaagtggtttaaaagaagaaaattgtgctcttttgccccataattgagtgattagtgttcatttgctacacctgggaaatcatcaccaaagccacatgtcatacacatggcatatatgaaaaaaagaagaagtaaacaacatctactcatgtttggccaaattacaaatctccttttaaagaaacgatttttttagacaggatcatttagcaaggcctgaacagtgctgttaacctgcaggaataagcaaaataacatatttgcaaacgaaagtaatttgtgaataaaactttatatgtgttcttagcgatctaagagcaaagctgaaaaataaacttcgataaaaaaaccttaaaattggcttcaaatttaatgttaaaattttaatctttggctgataaatataagtataagcgaaaagataaggccctcgctgcctagctgaaaagtatcacaaataccatcgtcgacagtttcgctgaaaagtatcagaaacaaaatattttgacaaaatcatttatatctttgacatttcatatcttattatttcgtaaaaaaaagattataacaagatttttctaataaattgaaaatggtttatagaaattaacacgccaataatacaagggagaagccaacagcatactagtctggtaggtagttttgcttttggatgaaaacgagttcttatcagccaaactccaatttacagatattaaaaaatctcccaagatgatcagcggatttgcgtgatttgtatgcttagtcataacaaaactttattggttggagatttgcgctaggatcatataaaaaaaactttatcttattcaagaacgagagaaaaaaaattggtagtagtacgataacctctagggatggagtaaagtatccagctttgcagccacctgccctctgaacttcttgttcttcgtctcacacttcgcccgaagcaaacgagaacaagacgaccgcctctatccaa

SEQ ID NO: 38839 - DNA, 1501 bp, Oryza sativa
tgtcaattcagtgtagcaaccgtaacgaaaacgttgtagaacactacagagtactgtagcatagttaccgtagtgcacgatttgatcttgatcggacggtctccattgctcctaatgctgagtatacctattcgggcagtgggagcgctcgatgatgttaggtcaagtgctactcgtgtcggcgaggattaggagcagtgtcacttcctcaaagttgatttgggttgggatttgattacgagctaaccggttccagctcacttacggtttgttagagcttagctccaacttcatctctcctaaagttagagcccatttatttcagctccaccataaaagaaaaaaatgaaacggttaagtgttctcacaaaatgaactggagaaatggagctggatttaggctgctccacaactccactttaaactgaactcttggtgttaaatctcgaaattgaagtactctcaaacatgctctcaatccaatcggatacactcccttggcatcaaaatacatgatttttaaaataaagaataaatattataaaaaacccctatgtctcaaggcgttcctatcacaaaactacatgttaagtacttcctctatttcaggttataaaactttctaacactgcccatattcatatagatattaatgaatctatgtgtcatctatatgaatatgggcaatgctaacaagtcttataacctgaaacagaggtagtaaattttatcatacgcacttccttgccccttccgcaaggacgaagtattgacaccgatatagcccatcccctccacttctctgtcatagccaaccgtgtaatacataacttcaatatctaagtattaaccagaactaaaatatgcaggataaaccttaaccaataggtttatctaggttttctaaaatatgactattttttactataaacttagataatatttttagttacaaatctagtagtaatagaaaggagtatataaatttttttacgggaggatggtataaccttcagcgaacaacacaaagaaggttagttagaggcaggactaaagttgcaatcatgttccttccgtgttttcatactcaaagtctcaaacccagcagttagcaacttccatttctaaacaatgcgctggtcagcaagaaaaaaaattacagatatccattgataaagaacacaggagcatcaaaaccaacaccgcttgatggcatggcatgtctgattgtctgtggccatttgcgaccagttgtacccaaccaacagccgctccaaagaatcaacagacgttggtcactgctcatccagagacaaacccctgttagtaatataaaaattgtttctttttctttttcttttttactccccaatcccccttcttcctccttgatccctttcttctccccatccctctttgccatggtttccgcatcttgagctgagcagagcacagcttgtacctgcagccagccatggtgaccaccaatttcgtgcagaac

SEQ ID NO: 38840 - DNA, 1501 bp, Oryza sativa
ttgctccatatattgtatgttgtcaacttgcattctcaaccttctcttgccaatatcttacttggtcttatttacctgttccttaacttatgtataactacgcagcaaaaaatcatacatacaatttgtaatgtctcgcctctcctataccggacccgcttacatctggcaactttcataggtcatagtctgccctcacagaccaacacaagtcttttctgtacactttgtcctcactcgtgtgcatccggaaagaatttcccggtcggtcacctatcccaaattgttctaggccaagcgtgagtacccagaaagaatttcccggtcggtcactgtcggtgacatgggatcaggagtatcatgactagaggtttgaggcagacacaatcgcacacgtggcctggcacccccgagggacgtcgggcccgagggtgatgtgttcgccctcctcttagtcccccgagggggtcgggccgcacccgcctcggccccgagggccgaggcaccccgacccctcgtgggtttttgatccgcgtgtatgggttaggtgagcacagtggggctcacctaaccacatttattgcggtttggctgagcgtgtcacgccgcatgtaacgcagtgcagtgcactcgtttatccggtctgtgaccagtcacagaccggtcaaatcgcgggttaggtggcgacaggcgatctgacgcacgcctcgccccatcccgtcaggacgagggcttctaggcgctcgtccccagctgaagctagcgtgttacctcccagagatggcacgttagtcctggtcagatatatgccaggcttcatcctaaccattacaggcaagatgttgtgtgaagaagggcgaacatgtagattgctaagctgacacgtggtggacaagaatgaccgacgtgactggtctgacaccggtcatgtcgtcagcagacagccacgattccacgtcgcacctgctcccggcgaaagtggaggtagttgtgggccgtctcatcagaaggtgactcggacggcaactatacaaatctccgtccatttatgaaaaggtggggtaagtccccacaaaaaagagagaaatggtgcatgtggtatccccttaagatataaaaggaggacctagcccactgagagaggggactgatttttccagatagggaacccagaacaagggagcggctggctcatactttgtagctccttcatacacagatctcccaaaacacaggagtagggtattacgcttctcagcggcccgaacctgtatacatcgcccgtgtcttgtgtgtttcctgtctcgcgaaccttccacatacagagagcttagaatctcaccctgagtccccggccgaaccggcaaaggggggcctacgcggtctcccggtgaggagccccgcgctccgtcatctggcgcgccaggtaggggtctctgcgagggattttctgagctctcgcactctttcgtgtgcgccaagcttttcctgttcagcccaa

SEQ ID NO: 38841 - DNA, 1501 bp, Oryza sativa
cattcctgtttgggaaatagaaaggacttccgtcttttccagctacaggcaacctttttccttaggccttatttggttgcttgggaaatgatctcaaggggaacctatccagggagggactgagtgaatccctcccatatcactcaatccctgcggggttcgaatccctgcccgtttctaatccctgtcatagaaaccctgctttcgtttagcacggggaaaaataaggcagcagctgtacgttcccaagtaagcaatgaaccaatatgcattctcccagatcaaatccataggacacagtaaaaaaaaacattgtttagcacagggaaaacacacatgtatgctgtacgttcacaaatgcatacatgaaagggtcacaaagtaatcaaaatggttacaattcagttgtttttttagaataaatagaactagccagctaagagctaaactacaaattgaatgcaagtgtttaagcttagcactaatgccaccatgagcttcagtcacccagctgcagtgttcccatctctggaaaaaaaaagggaacaacattggatcaattccaaaaagaaatacaccatatatgttctttcttgtcaaccaaatatcaaattgaattaatgcagagtacagattacagaagagcagacaagtaaagaaaagagccacacttgatatccaaactaaggctgatgcactacatggaatgctaacagtctgatagaacaaaagatgaaaagagacttgaaagttcatgaactaggaagctaacaaaaatacagttaattggcttttgtttttctggaacaagcactactttgtaagtacagctatacaagtgtgctccagtttcacaacaagaaatggagataaaagaagagaaagcagcttgttcatttcttcagttagaccaaaatttacagtgaggactgactgcatttgctgtctgaatctggcgacaacatgatacactacggtgaaaacgatgctcttaataggaaagccctgcaagtttcatcttctatttaagtttcacatatgtaaggttcaccactaaagtatcatcatggttccttgtatcaactaaacaccgtgacattctgaagtttgagcaagagctagctatagataaacacagaggatcctaatccagtacaaatctgattgattaatcaaatatatatcacaataaactaatgactaataaaaaacaactcttattagcacttcagtgctcctgctgatcggcccctagacagatatatgtatgctagtttcactttgatgctattaagcttcctgtatttgttgacaccttattaccagcaaataaaaaaggaaatctctgcactgcaagtctgcaactatatctacatgactctgaatttcttcagattttgcaatcttgagaagaatcaagttcgaaccctgcaactttggaaagtaaaagaaagaagaaactcctctgtactgcacctgcaattgcatgactctgaattcc

SEQ ID NO: 38842 - DNA, 1501 bp, Oryza sativa
taattggctgggacggccggagcaccatccccggggccttgatggcgtcaaaggccgcaggggaaaggatgttgagggccgctcccccatcaatgaggacacgcccctacttcacgttgcaaacggtgggagaaaccaccatcgcaatctgccctccccgggcaacgcacggtgggtggtcggtctggtcgaaggtgagggcaacctccgaccaccgcgcccgacacgtcgcctcatgagtaggggccgcggccagaagctctcgcttcatggccttgaagctccggcgagaaacgtgagcacacgctcccccatcgacggtggcaatggtggccccaggctcttggaaacctaggtcatcatcgccgtcatcgatgtcctcggcgagggccttctgcttggcctcacttcgccgattaccggaaggaaacgccggggatttgccctctcggcgctcctgcctcctctcctcctcccacttcctcgtctgctcagccaaacttttgactgcacggcagtccgcgaggtcgtgaagggaagtgttgtggacggtgcaccacttgccggttgggcgctccctgttgggagcgccggcctcgttctttttgcctcccgcaggcctcccctttcgggtggcccgcgaagcgccctcgacggcgaggacatgaccctcgtcgtcggtatgggctgacctcttcttcctcctcctgtcacgccgccctatctgagcggcggatccgggggcggccgaagctgccacaccggaaccggaggggttccaggtccatgcctcctccttacgagccactcggtccgcgagctgaaaaagctccgcggtagtctggggctctttggaggcgatcttttcgagcatgcggttgtgccgcacaccccccctgaacgcgtaaatcaccgcgtgtgcagggatgcatggtatggtgttgcggacttgacagaaccgctgaatgtacgagcgaagtgactcatcatcccttcgctgtactgcgtgcaagtccgcttcctcacctgggcgcggatatgtgccttggaagttcatggtgaactgttggcacaaatcctcccaagagtggacagacgcgggtggcaagttcattagccaaccccgcgcctgtcctttcagggccatgggaaagaaattcgccatgaccctgtcgtcacccccggcggcctcgatcccggtcgtgtagacctggagaaactcggcggggttgacgctcccgtcatatttttcggcgatggtgggccggaaccttgggggccaacggacattccgaaggctcgccacaaaggctctacagccgacaccaccaaccgggggcacggagggctgatccccgcgtccgtggtgaggtgacactccggacgaggaggcgccctccgttgcgtggggagcacgtcggccattacgccggcgctcgatactgatgcgggcatccggttccccacgcagatcttcccgggtcggaggcgttgacgaagg

SEQ ID NO: 38843 - DNA, 1501 bp, Oryza sativa
tcgctgcgctaattttccgtccgtggtgttttttttggggaataaattcaccggaggtccctcaacttaacagcgaggttttttgaggtcccttaaccacaaaattagaaaatttcacccctatactatacaaaaccgtctaatttaggtcctaaggcagtatatatgtctggttttggttttgctgacgtggtatcctagttagaaaaaaataatagaataaatatgtgagggcccacatgtcagtacatgtcagtgagagaaaatgatgtgggcccacatctctttttttcttttctttttctcttctcttctcaacttctcacacgcgggtagacgtgggtgtgcggtgacggcggagcgggcgcggcttccggcgcagtggggagagatacagcagtcgccgcggcagcggctgagagcggagtcggctgttgaatgaacaacacagctagattgatagaattgttgacgcttttcgtaatttcaagcaatcgataacttgcgtgatggcaaatcataagaacgcaaccatggcaaccacatcgatgtatatcacagcaattcaattcatgaaatacttcagagcgtgggatgatgcccttacgcggatgaggagagggaagttgccgcgggcgaagcggccggcccagcagttgagcacggcgtcgacagcgccggcctcggcgcgcgggatcgcgagcacgcgcgcggcggcctccaacaccttccagtcccgctgccaccggctcccctccacgcgcaggcggtggcgcgcggggaacgccacggcgcccacgccctccacctcggcgcgggcctcgcgctggccccggtcgtagtccacggacacggcggggcggcgctccgcccactccggcggcgtggcgcccgcggcggtcgtgagggcgcacggaccacgcgcgtccgggcagttgacgccgtcgagtcgggcgtcgccgccggtgagcgcggcagcggcggagcagcggaagacatcgcggcgggtggtggaggggagagactatagaggctccaccattggggcagctccgccgcatctccggatggggagaggcggtcacgccggccgactctctccccttctctggcgccggccgcctccactccccctctcccgcttcttccccgcgcgccgcagcgcccgctgcgctcgccgccgcgcccgctccgccgtcggccgcacacccgcatctgcccgcctgcgcgtgagaagttgagaagagaagagaaaaataaaggaaaatggagaagcggggcccaaattattttctctcactgacatgtgggccccgcatttttattttattatttttgctaactatgatgccacatcagcgaaaccaggcatatatactatcatgggacctaaattagaccgttttgtatagtttaggggtgaagatttctgattttatggttaaaggacttaaaaaaatcttgctggtaacttgagtaatctccggtgaacttattcctt

SEQ ID NO: 38844 - DNA, 1501 bp, Oryza sativa
acaattataaatagacaaattataatgatatttatctaaatagacatatttacaatggcacgaatccaatttacactaaaatttagtagtggtttctattattttggatctcctgaagaccaaactaaaatgaccaaaaccgatgggttttcattatcatgcaatgcattttgaactttattatatttctagcgaaccgaaatatattgttttggtttgaccgaacgcccacccaaaatcgtgccttcatgactgaaatcaaaacttttaagtaaaataagagcgaaggcaatatatttttgtattgacatatacaggcatgaagccgttgcagtatttgactggaggggtcaaacctgcatatatatgggcccggatgggcagccactcgaccagccagtacagtagtactaccgcacctactcataaaagaccaaaacatgtaggagtaaaaagctggatccctggcctatccgctcatgccgtgcagcaggcagtgctgtatatgcaatcaggccaggacatggcccatcatatctcctacgaatgtgacttatatgtgcgtgatatatatgcaccagatctatgatccatctggctagccaaacatgcatggcccatatctgcatcttgcctttaatagttcagtataatactaccttcatcctagaatagatattttgggtgtgattagttcacgccaaaattaaaagtttggttgaaattagaacgatgtgatgaaaaagttagaagtttatgtgtgtaggaaagttttgatgtgatggaaaagttggaagtttgaagaaaaggtttggaactaaacaaggcctttgaaggaatgagacatatactagtactacaaatttaaacataaagattgtctagattcatactactagaatgtgtactatccatttaaatctcttatattctaggataaagggattagtcgctaaaagtaaaataatattatatagatacccactttgtttcatgacattatattgttttactttgactactcctgtttcatgaatatttttttaaaagaaacatggcacaaacgtaaacgcttacagcaaacacacactcacccttaaaaacacactcacacataccatacctctataagcacctcctaaaaactaggctggcatatcttaaattgagtaagccatcacgaggcaactcacccctaagaacttacacacgcacaccctatcctataagcacattcaaaaaattgtttcagcatatcttaaaattgatgaactcaccacggatggcacgctgtcgaatgatacattacctactattgaaagaacaattagtcatacacccgtgtcatttctaggatttaaacccaggtgaataggattctagctaaatacactcacttcactttcatgaataaatttgtaagagtgtccaacatactatattattaataaagtatattatacaataagtatataaaaaatcccgttcatcatgattaaac

SEQ ID NO: 38845 - DNA, 431 bp, Oryza sativa
gtgatgttgaatcatatttgtatttttttattgcattttattgtattaaggtgttatattttcattttgactcaatgttgcatacattgatttcttggtgttacaatcagcatgtttgaatgttgcattgttgaaacatttttgctcaagcgctgtatcattttttgttggtagtgaaacatctggagcatagtgttgcaatcagtatatttgaatgttgcatttgtttgaaacattttttctcaagcactgaaacatttttcgttggtagtgaaacatctggaacatttttgttgaaacattttttagcgagggatgaaacatgtgaaacatttcttgataacacactgcaacaccgatctgtagcagtctccgtgtaaattgcgtcgagtacaatacaggagcaggaagggcctcaaggggcttcacga

SEQ ID NO: 38846 - DNA, 226 bp, Oryza sativa
tcggcccacctctcatccgcagcatataaccgtaaataataatatcccgtaatctagacaccacgcctaaactactagatactactctaatatcatcttcatgacatagagtaattgcataaccaaacattatacccgtaccaacgcatctcccagataagctagcagtatattcaatataacacgaacataatgtaaaattcgcattcatatactcggaaagtat

SEQ ID NO: 38847 - DNA, 237 bp, Oryza sativa
attggtgatatttggaggaacacatggaacgggtgcgttgattcggtcaaaaaaaaaaaaaaagcttgcaagtaagaaattaggtggtaaggctggcttcgaatggatcgaatactgcaaaagttgtgcctctttctgttgtttgcttttgctatggcgtccattttggttcagattttgagtcctattgttcggattagattgatcaaaatggataggttgattgggattattatt

SEQ ID NO: 38848 - DNA, 381 bp, Oryza sativa
aaaaagaagttaagggtggtccaaaataacataaatgcaaaattacccggatcaaagtaaaaacattagttaaaatgtggtccaaaacaaaacaccagtagtaataaaaggtgaccaaagtgaaaattactctatttgttactatccaaccaaccactttctcatcaataattcaaatcattgtaaaaaaaaatgcaataataaggaaaaagaaggaccctcatcaaacaaaaaggaaaaagaggaagagaaatgagaaaaaaaaggggcaataatcacctaatggcttgatcgcgatccaacggctgcggagaacccagcgtgagccataaatcatccacccccgcgccgttgtccgcctcccctcgctcccctaaaacc

SEQ ID NO: 38849 - DNA, 355 bp, Oryza sativa
ctaataaaataaatggtcaaacgtgtcttaaaaagtcaacggtgtgatatattaaaaatgatggagtagctatttgatagtaagattgttcaattgtgtcattattttcttctcacttggtttagcaattatagtacaagaggtagtgactagttaaaacaaaaaaccttgtgagactaagcgaaagtaggggtggatatcgagctggctcggctcggctcgctctagctcgttagaataacgagctggctcggctcggctcgctatcctaacgagctaaaagtctgtctcggctcgggtcaattgtaagcttgagccagctcgtttagctcgcgagctagatttggacgacgca

SEQ ID NO: 38850 - DNA, 184 bp, Oryza sativa
ttaacacttctcatgttgtaggtgctagtccatctgtacttatttgagtccatcatactgttgcaaaattattaaattcactagtagcttgcttaaccctatgctcaccaggaataaatgtgcactaaattttttatctacagttatttcccaatcaaaataagcttcagcatcataggcacaa

SEQ ID NO: 38851 - DNA, 560 bp, Oryza sativa
catagacaatcttgaaagctcttctacggcgtggattcaaagtgagccaaaatgcgtcacaaaaataagaacaagggttaaaacattaaaaaaataatcctgctatatgcaatgatttagagaggcaatgcacaatgatttagttctccttcaggctttagtcactttatacaaaaacacaaaaaagaccaaaaaggaaaaaagaaaaccaaaactattttatatataaaaggcccactacaagtaattacccactaggcccataaaggaccactacaagtcattacccattaggcccatcaaggcccatctaaaatttctagggtttcctcatcctcgatggggtttatccttcgagcacatatataatccgcacgccgccgcctccctctctgcttcgcactccattttccctctccccgctcgccgccgccgccgccgccagccaagctcgccgctcgccatgggtaagcctccccctcctctccctctctccggttcatctcgattagttttagctctcaatcccttccggatctgaccgtttcttggacaaatgt

SEQ ID NO: 38852 - DNA, 1501 bp, Oryza sativa
ctcgtcgtcgctgaggaaatgctggtagaggaacaccctgccatggatcacgcatcagtcagtccatccaatgtcgagatcgagacgaaaccaagaaccaaccgatggcggcgcccgcgcgagcgagagaaagtgaacctgggcttccaggagatctggcgggagtggtgcgggtacaccacgggcgccgggtacaccgagctccccttcccgcctccacctccgcctccacccccggcagcaacgccaccgcctccgccgccgccgcagatgaggaggaggacaagaagcagcagggcgccggaagtgggagccccgagccgcaccggagccatggcagcggagaattctccgtctccctctcgcccaacggaggcgaggaggaggtggaggtggagatggaggaggaggcggctgcggcggcgagctggaggtggaagtggtcgccgcgacggtggccgccacgcttcgcggcggagagggaccgagtcagtgatgaggagggaggagatctgagccgtcgaaatcccgcgccgaggagatcggacggccagggcgcaccgggaaatcgtgcaagcagcgaactactagtaacgaacgggtaggtgaggtgagcaacgccaacgcacataccttggaaatcacgatgttttgcttcaaaattactgtgttttttcatataacggacgttttttttactgagaagtgagaaacacagtattaaacatatgcgtcctcagcgcgcgtacacttacaccctacacatacgaacacctttaaaagactaggcgtatatcggctaccactgaaataataattagccataaatacaagcacccgtgtcaaatctaggatttgaatttgggtggactggttccaccacgagaaatctaaccagtcgtataaaagtcatataaaaatggagcctcaattactcctcaattttaagccatatttgttttaaagttatttacaaaatattaagattaaaaaagttctcttttaatcatactaatagtcaaattttagattatttataattgtaccataaaatatgattagccagaaatgtatggatttttatttattggaatcagtgttccataagttatttagactatggtatataagtgctataaatatttatattttgaaatggatgaagcactaccttttacattctgtcttgcaaatgaaaaagaaaaaaacaaaacaaatggggagtctgttccaagctagtggcttcctgaccagggtgtgaaaaaccgccggtaaccgcgcggttaccgcggttaccgcccgtaccgcgggggtacggttacccgtaccgcgcggtacggtttaataaaattcgtccaaattcaaaaatttaaaaaaaaagaaaaaaatcaaaaaaaatagtgaaggtagtgcttgatttatagtgttttatggtgaagaaatttctcaaaaaagagtaatatttattcaaatttgagagcaaaacggagaataaatttga

SEQ ID NO: 38853 - DNA, 1501 bp, Oryza sativa
tttgaaggacaaggtggagcttgagaaggagatggaagagtactacaagttagactatgaggacactattggagatctgaagactaggttcaagtataagcaagttaagccgaacagtttcggcctgagcacctatgagatattggcatcagatgacaaggatttgaaccagtatgtatccatgaagaagatagctccttacagggaggcagaatggaaggtgacgcatcataagaaactgatcaaggattcgatccttggaggacaggataaagaaggcaagaaggtcaaaaagaagaagtctaagtctgaggaaggccctgcttcatcagaaccagagaaggagctgccgaatgaacagggggatgcagatggcaaggcaaaatcaaccagaagtgaacgaaggaagcgtaggaggagggagttgaagatgaccaccgaaaggcaagcagcctatggaaagataaaccctaagcgtcacaagagccattgagctttggagattcggcatagttcatctagaaaattattatttttttgtttatgtgatgcatttttgtctgggcgttgtccttgtggaagcatctgtttagggcattcatgatatatctggagctgtgaacccgttattgtcacagtggtaacatatggttctatggaagttttgcttacatattgtaatttcatgagccatataatctttttgtttttacatttgcctctgcaattttggtttccttatcgatttctatgatgaatggttaagttggaaagaggaaactcatgccagagtgaagatttgtcaatttgtatggcacaaatgtctatcaaaatgattcatttgttcctctccagccgtttgaccagaccatacctggccaatttacatcttgtgttaatttgcatgaggagagcttaccttccatgtttatgatgttgtcagctacagtggaattgtgcttacaactgtctaagacaaagcagtaaactacagttaggcctcaccgagtgaagaccaattcagagcagctccaagcagtggcaaccaggtcaacaaaaactattttggcctgtcatcttcttccaatcatctcatttctctcttcttgtcaccttgttctctgcacaaaaagaaatccttgatagggtttattcccttgtgttggttgttgcacatgtccctttcttccatcgtcacaaccttcagtactcacattactctatataatgctctctcatattgttttgtttactgatcaggtcttcaggagaaggagcttgctttgtactcctaactgctccttccagtttgtgctctgctgttccccaaattctctttctcctacttcctgcagatacccatatgattcatttgttcttcctgcgctactgattacttctttcaggacacagctttgctactggattactgccaattgagtcttgttattcggttcctcaatttatcaagttcttcagagcaggcagtcgaagtccataa

SEQ ID NO: 38854 - DNA, 720 bp, Oryza sativa
cgtgatggtcaacatttgtttcctttctttggtccacgattatggcttgttcagtttgctaccattttcaatcttatcaagttttggcaaagttaaaaaaaaagttgctacatttagtttgttcctaaattttactaagcacatataaaatcttgtcaaaatttgacaaccttgccaaaattttggcaaccttgctaaaatttgacaatactataatttggtaaggttgaaaatggtagcaaagtgaatagacccttagttaatagggaagaccactatgagcccatgatactaccaactacggcacactagtagtacaaaattactaatcccgtgatagctaatctgtgtgcccaattagatggtgttgacctgctcacatcaacttatcagtaaacacgtgccttgttcaaacaaaaaatgtttcacaaaattagttttgttagatgcacttctaacactacaacaatatatagaaactcacttaaattaacctaataaatacacacgtactcctagcattaagtacgctcgtatcacaaacggatgaaccttacaatctgggagataggcattattacgtcacggaatatagaaaagcataaacaaaacagcagctgctaaacggcgataatcaaatcgacaagcaaacgtggaagccacactacgtttccagattctccaggagcagaaaccaaaacggcaatcagcgaatcacac

SEQ ID NO: 38855 - DNA, 1501 bp, Oryza sativa
gttttttgaggacaaagttttgatttttttttttaattaggcaaatattgttcaaacttagcaaaattttgtttaagttttttttttgttttcaaattttagccctctataattgtttactcatccagaaatatagttatatgctggcgcatatgcatgactttactctaatccatttgtcagggacttaaataagaggatcgcatcccgtataattgtggcatcacaatataaactctggtgggtttgagctatacaataagaggttaatgttgtttcccgtattcgatcgtttacatttcaacattaacctcttttttaaaaaaagattaataacccggcctttacatccacaaccaaagttaccctctcttttactctcttttacatgactgttgtttgggtttacttgaaaattttacttttccatgtcatggaagaagattttgcataagaacaaaggatggttctaaagggtcggtgatcatacatcctatcaatgatctatgcctctatggtctaacaaccaagcatgcagttttcaagaacacttgatcggaaagcaagaaaaaaaggcacaagacaaatgaaaagttattggcgatggcgtgtccagatactactttaatttctatttgacatctagtgttggcaatttgctgtagtataataaaagaagctttatgaagattatttaacttacttttcttggatacaaatagccgttttcggcgcctcatatctggaactgccttttcgcctcgttgataataatttttttagataataatggctgttgatagtagtgtctgttagtatagcctgtagttctgtaattattttttcccgttatatcgatatgaaacaccgaatcatattttttgtttgttttaaaaatatgtatagcagttgttgttactttctactctctctgttcgatatcataaactgttttagttttgtttaagtcaaatttctctaactcgtacgagcatcgatctctcgtgtaagatgttttcttagcagagtaatactgattaattaataaatgtgtccactaaacatgaacaattcccttgtacgagcatctcgtataaacagtatacttaatttctcattcaagtaaagactttgaagccatcccagattagtactgtacggtctgtaccagagcttacagccacaagcgttaccgtcagatttcagaagtactgaagcaaatgtcaatggtttcactctgaaaactttaaccaccaccgatcgctcggagtacaagtatatgtggtttgttgagattgtatacgaaatactcttgttgtatgacgttgttaatttttagacatgacgtatgatcatttatttggtttgaaaatttagtgcaaacacaaaatatatttctcatgcttaactcatcatgtacgtgagaagattgaggactatacgcatacatgtagctactcgggtttcatcaatagcactacaaaacgaaaagacaacatct

SEQ ID NO: 38856 - DNA, 1501 bp, Oryza sativa
tccctcatcttatcatcagattacaaaatcatccccaccgcaaaatcagatgtatgccatcattttgggtcctcaggcggttttgtccaacgtggtggctgatttatcgcggacccatatggccccgcatttaagggtgaccacgttgtcaccccttctctttcccatattctctcccttccacctctctctcactcttctcataatctgggctggcggggcgagtcgggaaaggaggtctgtcggcgtctgccgtgaggcaccgccgtagcgaccagctatggagggcggcgggtggcaggagtggagctaggagacggcggccggcgggagaggacagccaccatggcctgctgcgggggtgaaggcgagcactgcggcggtgggtcgccacccgtggacgatgcccgtggggaggacctgaactcgctctgagtcgtggctccttagggcggtgacgtcccgcacgaggtcggtggtgggcagcatccttgatgtggcatcgatggaagtgaacaccttgaggaggaagacaagagaggggaggcgcaagatcatggacaagctccgctgccgctcttccctgtcggctgcgccgcgcgcctccagtctccccagctgtcgtccgtcttcgctaccgagcgtcgtcgccgctcttctccgcttcagctgctggtcgcgccgcgcgcctctgattctccccggctgccacccatcttcgccactgaatgctaccgccgctcttctcccccatcggctgccgatcatgccgcgtgccttcagttctcccccggtcgctgcccgtttttgcctcgaactcgacagactcgaaccccggcgccccgacctgctcccacattgcctgttgtcggccgttggaccttgtcctctcccacttcaccccgccggcctcctccccacccgctagctgccttgcccagacgaggaggagaatgagtgagagaggaggaagggagagaaggggggaaagagagagggtgataacgtgatcacccttatttttggggcccacgctaactcaaccatcacgttgaacaaaactagggtcaaaaccgtctgagaacctaaagtgatctggttttataagctgagggatgacatgtatctagttttacggttgtgggatgattttgtcaccaatgacaagaggacgaactatgtactttttccgagcttaaattggcctgtaacgacttcggccatggacaagtcggcccagtgctttatctaaattctaggagcaaaaaagttcactttacgtccatatggcgtctacatagcactaaaagctcgtagatggtttttggctacggaacaccggctttgtaagtttgagtgacgtgttatatactccagtatagtattgcagtttaaggataatttgaactcgacgagtcgacgttaagatgagggacctcaagtgaacttgtacctatatattttctcgatcggtataccggcccaagtggcttccgatgac

SEQ ID NO: 38857 - DNA, 831 bp, Oryza sativa
gggaacccgcgcgccccggcgcgggcgaagttgccggccccggcacggcggcggacaaggggaagccggcggggcggagggtaacgaaggtaagcgaagggtgcccatctcgtcggcaggtggggagtggtgcgcggcggagtggtggactcgaggagtgcggcttggcttggcttggctttgcgctggcttgggaggcggagaggcgagaaaggaaaagaggggtttgggtgggggatggacgggcggggatctgctggtctcccgatcggacggtgaaggcgctcgagcgcgcggcgtggcaggaggtgtgtggccggcggtggggatgatgcggataaggaacggatgattgtgagtaggctgatcgagacgggaggatagacagaccgccactgcggcaacaacgtctactctgtccatcttattaaaaaaccaatctaatattagacgtgacacattttaatactataaatttagacatatatctagagacgcggtatggagatgaatctggatatatctctaaggacacggtgttgagacgggcgagtggattcttcagagatgggagcatcacgagaggctgcgtcacggaaggatgctatagctagaaaattgaagggttaattggatccatgccactgcaaatgtggcaaatcaaaaaaataccactactattcacgttatcgggtagatgccactgtaatcttctaaaattagaaccatgctactcccgtcactattttcggcctcctctctcacgtggtcatcctcctcactcacgtctgcaaggggaaaaggcgacgtggtgccggcgagcggcgaaga

SEQ ID NO: 38858 - DNA, 1501 bp, Oryza sativa
gcatgaaactttgaaagttcatgcattttgtttcccttagtatcagcaagattatggtccaaaaattacctctggagaattggcatcctcatatttagcttatatagtggcattcgtttatttttgagtcgaatagcattatgaatatatttgtttcttacttgtctcagttttacactgaagacgtgtacctcatgttacccgtctcgcacaccggacgttgtgacagcgacctgcatcttaagccatctatgaaaagaaataaagaatcaaccttaaattcatctatgaaatcagcgagatagcaaaaactggaagtatttgaaataattgagtcttgccttgatacggagttgttgatttcgcaggttcgtcatcgtcaatggccatgtgatcttggcccagcacctcctccttttcctcctattcatctgctaccagcacatcctcctataccgatttgttggcttgtcgcacttcccctactaccacctctttcgccgctacgtcggagcatgtcttgtgcatatggcaaggagcaagaagtcgtggcgcaggccttcttgttgctgctcacagcggtggacttggtgctgctcggtcctccaatcctcgttgaagtcagcacaggcctggatctccatcccggctcagcatggccaaatccggcttctctagcggcgatgctgagagaggactcagaggaagaggaggcgggcgcgagcgcacgtcggcgagagtgagggggacgggaggggattcagcagcggtggccgacggcgacgggaatcgccatcgcggagtagccgggaagggaggtggctcattatatgaggggcgcaagggtttggagagactgcgcgagtgcgaggtagggacgcagggtgtgggccggtgtggcccgatccaagccgtttcgcaagtggaccggttcgcaagtgtaaccggtgcatttaaaaaaaaaggaataagttcaccggagattactcaagttaccagcaagatttttttaagtcctttaaccataaaatcagaaatcttcacccctaaactatacaaaacggtctaatttaggtcccatgatagtatatatgcctggtttcgctgatgtggcatcatagttagcaaaaataataaaataaaaatgcggggcccacatgtcagtgagagaaaataatttgggccccgcttctccattttcctttatttttctcttctcttctcaacttctcacgcgcaggcgggcagatgcgggtgtgcggccgacggcggagcgggcgcggcggcgagcgcagcgggcgctgcggcgcgcggggaagaagcgggagagggggagtggaggcggccggcgccagagaaggggagagagtcggccggcgtgaccgcctctccccatccggagatgcggcggagctgccccaatggtggagcctctatagtctctcccctccaccacccgccgcgatgtcttccgctgctccgccgctgccgcgctcaccgg

SEQ ID NO: 38859 - DNA, 317 bp, Oryza sativa
attaatgggcaatggcgcgcctcatatcatcatcatcatcatcatctatctagctccttcttcctccttccagttccacagttctagtttcagctagctggctccgagaagaggatgaccgatgacactaataactgcacctaccaaccagcctttccgcgtcaatcaattaatgcccctgccctgctttgcatgtacacactgctcctccggcgaactaccggccggagtaggagcatgagaatgacttggcttgattatgtattatgttaatcctaactgattgaatttaccaaaaaaaaaaaaacaggatgagg

SEQ ID NO: 38860 - DNA, 395 bp, Oryza sativa
tgaacttgttttgagctattattgcttacatttgtacacagtatgaagtatgaacatttgttgtccttttcacatcagaatctggcattggttttaattctgcttggtactacaactgtacaagttctatcttgtggcttttaatctactatttagaatacataacttttttagtgggatttagaatacatacttttgcactgttcgttttggactatgattttcattttagggaacatattaaacatgtttgtaaaaggtggaatagcgtcttctcatttattgcagcacttatattttctgtaagctcatgttaataagggacatggagcctctggatgaatatattatatatcaacatgtttatgtaatgcatgtgcttgtttccattcagg

SEQ ID NO: 38861 - DNA, 255 bp, Oryza sativa
tcgcttctcagctcgagctagctcgtttagctcgcgagccaatacatcgaacagatgcaaatacatattatacaaccaaaatgtccacgaaggcaattgtatctccatatcaaaccaagaaatcacatgctagctcaagtgttcaacaaatgaatcagtattcatggtagctctacctttaacaataatcttgttttctggtggcgatatacgagatcgagcacaagtgctcaacctcctggatccattgcccca

SEQ ID NO: 38862 - DNA, 526 bp, Oryza sativa
tctactgcgaaaccagttgaaactgattttaagggcatccgtgaatcgattcttcaggtcatattcttcagggcactctattgttggctatctttcttctttcttgcttgatcctctgccttcaaacatcactgcttatagttcaaaaactcaaactaggttgtcagtgctgactgctgactgtgcttgcacagttaaactgtacaacataaatgacaatacttgcaaattagctaactagttctcctaattgagccaaatgagcatctatttttagaatttgataatgacaggatcagtgcaattactttgcccaaatgaataattcttgatgacaactattattgttgtggatttttttattcgtcatgcaatcaataggcacaactggtccactgcagtgtgcttgtattatagtttctttgttcaaaaggttattatctctataccagaagatgctgtaaattatatttcctgatcttgtcagtgctggtctatctcgattcatgattctctcttttatagg

SEQ ID NO: 38863 - DNA, 302 bp, Oryza sativa
aatggcagagaaaagaaaaaggaagggagctcgggtttatagggggcggcaatgtcggtttggaaaccgactttggcggtcaaggcgcgagctggcgctccggctagcggccaaaacggcgacaggaggcaggcagtatgacgccggcggcaggaaaagggggaaaagtagggggagaaaggggcttgtccccttgcctcttcgggaaaaggaggagggagcggggcgtcgcggcagagggaggagggaggctctgcctccgtcccttggcggcttgcgcgggagtgacggggccgaggcga

SEQ ID NO: 38864 - DNA, 1501 bp, Oryza sativa
actccatatctttgatgttagtgatagcagctattagcctaataatctctctttttttttttctttttaactgttttgaaaagcaaagtcgttctctttcctctcctttaaagaaaggtttcaaaaaaactcaagtaaactgatccataaaaaaaccacccaaaaaacttatgatcccgttatagcatacttgtagtgatcctccaccatcacataaaaacatttttggtctcataaaatccgtaaaccttgataaacagatttctttaaaagccaaccatcgtaaaaagaccgaacaacccaccattgcaactcatgcttcatctctcctggagttgaagcccaaccaaacagtttcagctccacataaactaggagcgaagttggatggaacactatcacaaaatgaactagagaagtggagctaggtttagattgctccataactctactccagacccaacttctatagctaaatttagaagttggagctctaccaaacagagccctataactacatactctctttgttttatattataaattagtttgattaaatacaaaatattttaataatatgtttgttttgtgttagaaatgctatctttttttatgaatttgaaacttaaataaattgaacttgagaaaaggtgaaagtgactcgtaatatgatgaaacagaggaagcatttatgcgaagtgagcgttccgattagatttcttgtggtgaaaccaacccactcagattcaacttagacacaggtgctcggctattttgcggtaggcgacgtatccgtcgataacaaggcacccgtggtgactttgtaaatctcaagatatatcggttcagtcttctggctatgctcataggggtaggatgtgcgtgtgtgtattcataggaggtgagtgtacgcgtgttgtaagcgtcttcgattgcatattgttttaaaaaaaacggaggaggtatgtatgaagtttcagttgccctctcgcccctggcatgtggggcccgtgtttttgattgatgagccgggcccaatgaggctgttgccgaccggagtgactccttttgttgcatttgcacggttgctcacgcctttagactttatcaaatgatgatacttaataagcaaacataagtagtgaacgcttacatgttcttgtagtttaaaactgtcatgatctgttaaagtttatgttttaggctgcagcttatatagacagagacaatgtaatagtaccgttgttaggtaacatcatcacggttttctttatgcgaggataacaccaaaagctttagacctaacctaaccacttccgtcaaagaaatgacaccaccccataaatttctttgggcttgagctaaataaattagcccagtgaataggcttcagatcacaccactgattctcgaaaaaccgctgagtagcagaagtgagatttttttagaaaaaactccgagaaaatggtcaatttatcatattattttcattttaattacg

SEQ ID NO: 38865 - DNA, 173 bp, Oryza sativa
cccttttttttcacaccagtgacggccccaattagttgggccgtttgaggtgactctcacctgtgacgggttttggttgggaccagtcagaggtaactctcacctgtgatgggttttagttgggggccgtttgaggtggctcttaattctgatgggtcttcacccgttacagg

SEQ ID NO: 38866 - DNA, 232 bp, Oryza sativa
gaaatcctgctttgatggccggccaacagcgagacgttggtgcggtggctgcgcgttgaaaggctttagatggtggttggctgctgaacctgataggcattcgcaggagggtaggaaaactacggttaaaagcctagccttcggctagcaacgacgatgcctgcgggtgtcgtattctcgacccttgggggcattgttgcgtgtttactcctcttcccaatgcttttttagg

SEQ ID NO: 38867 - DNA, 613 bp, Oryza sativa
tcacgcccactacagatgatgtgttagtattgttttgccatgtttggcaggtcaaaagatctaggttttaaaaataagttttagaagagtttatttttaaaattaaaaattgaaagtttcaaaaaaaaaaaaccagttcatagacattatctattcatcaactatcatatcagcggaatcaagcagctctgctcaacagtaaccatcgtttgggctgtgtttttttctcccttttctcaacttctatttttttatattttgcgcgtatgtttcttaaactatattttacacaacttttttaataaaaaagttcatataaaaatcatattaatctatttttaaagtttatttagctaatgatacgctaaactatcgctctgttttcggtacctcaccttacagcacgtcaacaagagcagcaagcgtgttaggatagggatcggagtcggaatcggaatgcgatggtgactcgccgagccgcctatattatctctgcgacctgtgtacgtagctgcttcccaccgtcatccaaactaaaaatctttctgccacgcctaggattaaggcgccccgccgccgggcgcgcctcccgcgccgcctcccggcgctcagg

SEQ ID NO: 38868 - DNA, 1501 bp, Oryza sativa
tattaagcctaaataatctgtcattagcaaatatttaccgtagcaccacgttgttaaatcatagagtaaataggcttaaaagattcgtttcgcaaattagtcacaatctgtgtaattagttattttttagcctatatttaatacttcatgcaggtgttcaaatgttcgatatgacagggtgaaaaattttggggtgggatctaaacagggcctcaagtctaggtataaccatataagctagtccttgtttagttccaaactttttcttcaaacttccaactttttcatcacatcaaaacttttctacacacacaaactttcaacttttccattacatcgttctaatttcaaacaaattttcaattttggcgtgaactaaacacaccctagtccattcaagctgaccctaacctagctaaatcttcatttaattagatgtaagaaataagcgaatacacacctttgtacacacacatcgtacttgctttgatcgagggtgtaaaatgtattttttttcgttgtgcatgatcaactgattgttgccgctgatgagatgaggacgatctgtttgttgcaggtgaacgtcttctgcatcaagaagggaggacactgctttttttcccccgaaacttgttagtagctttcttggcaccttcatatcattcttgttttcctttgagttgatcattgtaatattttgattcttccttcacggaacatcattcaattctttttgatgattctgaatatgtttgccagaatgtataagttctattatgcatttccttttgtgatttctgtgaggttgtgacaagcacggtgggcgagctgttgacatccgccagtgtgccatttctttcttttatgtctcaataatccacatctataacctatcggtttataacttgtaaacggaatatttccccctaatatttcacatctataatagtttataattgtgaacctattataaaaccaacaccgaaatagacattggcaatcaaacgcaaaaatacactaagatccaaacgtggtggcgacatcgtgccatgatatttaactaaagttcagctggaacctatatccccgagacactaattataggcgctcctccctaatccaacataattacacatataagggtatcaacaaccattaactggcaattatactgtttgacttacaacactattggtcaatcattccctcatttgctacagtcgtcatgcggttataacaagtgtctctctatttaaagagagtttaggaagagtattactctacttctattagaatacaatacaactttaatcctaatttgtaaccgactttatatatatatttgacacaaactttaacaaaaccgttagagatcaatggatctgtaacgggtcatgaaccattatggatgatatatcccatgccagtgacacaaatactgtaatgggtaaaaggaaccattattgatgatgcttttcacctattagtgataaggtactct

SEQ ID NO: 38869 - DNA, 359 bp, Oryza sativa
aagtcagatgccgtaaggtacttgttcttttttgcactggacttcggacaactctgtctgtttctatcaatgaaactgcggccaatgttttctaacgtaaatgcaatgccccgcgggggtttacttgagtctactaaattttgcttatcatgtatttaggattcatagatacattatgccactggggtacatgtaattcaagtacaataagaaactactcaattgtttggcagcaattttgcatcatcagatgctgaatagtaagcactcctactcaattaggttccagatgatattttggtgacactgaacttgcgaccattgtgcttgtgggatgttatttaggtgctgctgtgctt

SEQ ID NO: 38870 - DNA, 164 bp, Oryza sativa
tttttccagcccaaataattttttcagcccacaaagctcaactgatattttttcagcccatacaattcagcccagatactatatttcagcacatacaaaatcagattcaaatgaattaacattccacaaatgattgcaatgtcacatgcatttcacattccaga

SEQ ID NO: 38871 - DNA, 159 bp, Oryza sativa
gggacgggcagcgcgcgggctcccccgtcggccgcgcccacaaggcagaggaatggtggccaggggagaggagcggcggccggcggagtggagttgggcagccccttcgttcctctccttcctcctcactctctcactcttctctctggactgggcagg

SEQ ID NO: 38872 - DNA, 1501 bp, Oryza sativa
taccagactagtatgctgttggcttctcccttgtattattggcgtgttaatttctataaaccattttcaatttattagaaaaatcttgttataatcttttttttacgaaataataagatatgaaatgtcaaagatataaatgattttgtcaaaatattttgtttctgatacttttcagcgaaactgtcgacgatggtatttgtgatacttttcagctaggcagcgagggccttatcttttcgcttatacttatatttatcagccaaagattaaaattttaacattaaatttgaagccaattttaaggtttttttatcgaagtttatttttcagctttgctcttagatcgctaagaacacatataaagttttattcacaaattactttcgtttgcaaatatgttattttgcttattcctgcaggttaacagcactgttcaggccttgctaaatgatcctgtctaaaaaaatcgtttctttaaaaggagatttgtaatttggccaaacatgagtagatgttgtttacttcttctttttttcatatatgccatgtgtatgacatgtggctttggtgatgatttcccaggtgtagcaaatgaacactaatcactcaattatggggcaaaagagcacaattttcttcttttaaaccacttagtgtttcaaatacaagaaccgttaggatttcttttttaaaaaatattttaaccttttaaattttttaaaaataaaccatcccaaacttattactaaatctaaaccttgacagcagtgccatgtccaatgtttatcacatgttttgttacgccaaatggagtgccatttttaaaatgttcaaataatttttagatagtttctttttgaaaaacaaaaaattaaaaggttaaaaaaatattgaaatgccaagaggggcaaaggcaaccatatggtttacttggtcaacctaaatctgcttccaaaaggttaattaacctctaccgtaattgggtaacttaatcacgacgtactccacctgcctgtcaatgtcatactttacacctgattagtactcctacttactatacttattttggaactggacctatctaatttctcctagtcagaaccaaattttctcctcagaaagatcccatttttttctcatagaatattcacaagctggtacttctagaagataaagaaatgttaaatccggaccgacgatctggtggtctactcgccgatgtcaacgtgccacctgcactttttgggcctaaaatgggccatacatgggccggaacccggcccatacaggtccgtgtgaaccaggccggatactgcggcccacactacacggcctggcccatgaatgatcggagatgagagcaagggtgacgtcagccatggcggagaagccaatccacctcctccctcccctccacctcgccgccgccgccgccgccgcatctgccgaaggcgggagccgtgaggggaaggacctgtggcacgaggtggtggcggca

SEQ ID NO: 38873 - DNA, 1501 bp, Oryza sativa
catcctgctgctggaaatctgtagaattgaatttttgttttctgattccatatgctcgatttctctttgttcctgttcgcaacttgtagaaattatggtggaagaattctttggtttgagaaggataatgagttgtgagaaaggagatttttggcatgaaaactactttttcttttggtatttgttggcgttgtggcgcgggaaatgtttgatttattacttggaatctcttacagtatttacaggcatgtaattcatgagagaccgcattgataatatttcatgagacttactaggtagtggatttttgtacgtcaactgttgctcgaaatggcactgtcataattttagtataattatgatgaatagttgacgatacttaattctgttaaatttttgttcaggcttgatactggaaaaaggagaagcttccatttttttttctctgacttgaaaggggatggccttcccagatgatgatgaaaagatgaaggtttgtgcttttcgctttacatcattcatataacattacaatacactcacaaaaataaaacatagcagcataattctattctcagatccactgtgctctatttgcatgttttggccctaatattttttttttcatactgaacttaaatcaaagtatttactttgtaattggttgtatactatagggttgccggccaaaactttttggaacaaaagataagaaagttgtgaagagggcagattaccaaagctgttctgcaggttagtttttctttctttttgaattgtgcatctagactgaattggtgtcttgtaggatagtgataaattgaaacgaagatgagcataatttatcaaatttcagctcatctagttgaatcaggggaattgctcaagtcagttgggcaatcagccaactacattcataaggtcaactgaacctcgtttcattgtgtataatgagaaatatatgaggagacagccagttcaaatatgtttaagaagatgctaggattcatttattctctagtttcatacttgataacttcgtgtcagaaatttcacattttgcccgaattgcttcaatacaattacgttgatttggcctaatgacaataatatagcgtaatagcaactaaatgtttccatgttttcctgtcaaatgcagttaagtccgggccaagttcctcaaagtcacaatcttcttcccccttcagaacacttacaggtggccttctgtttagcatttttgccacattgcctcactctattcatgtgctgatttgttttgattggattattttttggttctttggactgaaaggaagtttttgcagaagttaggagcatacgcctcagccatttacttggtcactcttcaagtactactaaaactgaacctttcaggtcaaacagctaaacttgcatgttgagtcatactttatgccgtcggtttgtcatactttacattcttagatcggactaggtcgtctttaattttttaattcat

SEQ ID NO: 38874 - DNA, 1501 bp, Oryza sativa
aggggtattttggtcatttggacgaaagtgtacagcaccaacggagactaactggacggcgatggtaaatcgtagaagttaagcaaaaatcgatggtatattatagaacgtgacaaagtcagtggcaaattatagacccatgacaaactcagtggcatacaatggattatctctatattaaatttgtttattttggaatcgaagaaaatacgaataaccaagcaaagcttgtcaagtgccttcctcacatatatggttgtgtttagttcacgccaaaattggaagtttggttgaaattggaacgatgtgacggaaaagttgaaagtttatgtgtgtaggaaagttttaatgtgacgaaaaaattagaagtttgaagaaatattttgaagagtaaagtgcaccagcggtcctcaaacttgtaagggtgtgtcatctaggtccccaaactctcaaatcgtatttacaggtccctaaacttgcttagccgtacattgcctgtccaaaccccatttgactcggtctgctcgctgacgtggcttgccaacgtggaggggaggagacagccggggtggtgcattatgcattaagccccttattttttcgccagccctcagacgataaatcccccactcttttttttcctcggcgcgggaaggacgaaatccccgactcctcgttatcctcggtgtgggaagggcgaagtgggtgacgcaagcgagaggaggtggtgatcgccggtgatcgccgacaaccaacgccaatcgatcataggattggtagagagggtgggggagcgattctgtctgcacccatcgacggacgcgacggcagagaatggtggcaagattgcgtcgactaggtggagacgcgcctgtgtacggtgagtaaaatcaagccctaatccttgtatgctagcaggtttagatcgataataggcagtaatgtaccttgctgttggtagaaaatttggaatttgctggctcggttcgatgcatgttttgccgtacggcaaagctagggttttttgtttgcacaagtttacatgctgtatcgtggattgaaggatttgtttcttccttactaggtgatgggtcagatgagttcacagtgaaggttcaccatgggggttttttcgttgggcatggtaatctccgttcttatttgaatggaaaagtgagttggtttgataatgtcgagatagacacttggtctccactatggctggaccagttcgttgaggatcttggataccttaggactcccaccttgaagatttattggctgttacctggtaaggacatttcagatgggttaagagtggtggttagtgatacttatacaaatgtgatggcatcaatggttgaaaagttcaggaccttagttgtatatattgaccatgatgacaaagttgcagggattgactgggatgatatcatagacaatccaggtacacctttaccaaaggtaatcagccccaataaggtgaattgtgtagagaaga

SEQ ID NO: 38875 - DNA, 1501 bp, Oryza sativa
actattcaaataagagatttaatatttcaaaaatgtactccatccattcctaaatataaggcacaactactctcaacccaaagaccaagaaataattattatcaccttatagattgggttatcctaataaatagaatgcatgcacccaataaaattagattgggctatcctaataaatagaatgcacgcgcccaataaaattagagatcttgatggtgtaggatttaaataatacttccttcgtttcacaatgtaagtcattctagcatttttcacgttcatattgatattaatgaatctagatacatcaatatgaatgtgggaaatgctagaatgacttacattgtaaaacggaggaagtaatattccagtgaaaagagtgctagttaataacatgcatgcatgtctgccttatattatgaaataactttaaataaaagaacgttgtgccttgtattattgaatggagtattgaagttctacggtgacatggaattaaggaagagactattcaattattgtttttcatatcccaaacagtttttttctctatcatgattttgaacagtgccaagattttttttaatttcaaacaaaaacaagctggagtactagtaaaataaataaaatggcccaatgaccaagtgacatgccccatttccacccctcctatttcctctctttcacgcatctcgactccatctcactctcccccctccctcctctctcgctcgctgcgatctgcactgctactccggtaggtctcctcccccccccccttcctcgcgcggccgcggccaccgccggcgagaagcccgccgcggcggcgctgaccccctccgcctcttcccgcgcgcggccccgccagccggccaccgtctcgggtcaaatcgaatcgaatcgaatccaaaggtattctcttcgctcttctcctccgcgggccgcttggattgatggctcggggtcgcgtaggtaggggaatctgttcgcgggttggattgggttgggttggattttcttctccttcccaattagccccccgtccagtttgttctagatttctgtgatgcgtctggtactgatggatgttagtttttgcagaggaaaatctggggttcagttgaaccctaatgcccccaggttaggtcagcctcgctgggtatcgcggctgctgaggttacttggagaggggtagggtggaatcctcgggggctgatttggtgtaattgagagcgccgattcatgattcaggcaatggcttcgcatgctggaggtagtggcggcggcggcggtggaagtggccgggatgctggctcggcgcagcgcgggccgatgcaggggttggcgaggcaagggtcgctgtatgggcttacactcaatgaggttcagagccagttgggggagccgttgcttagtatgaaccttgatgagctgcttaaaagcgtgtttcctgatggcgcggaccttgacggtggcggtggcggtggcggcatcgcgggcc

SEQ ID NO: 38876 - DNA, 1501 bp, Oryza sativa
ctgcttggcccgtgctatccgctcctccttgttcttgcgctgctgcttcctgctgctctccttcttcctcacagacccctcgacaaaccgcgaatgccccatcaccctgtccattacatccgcaccagtcgcggctgcttcctcatgccggaagttatacctggtctcataatcctcctgctctatgagatgctcctcttcgtccgatacctcctggatatcatccggagagtatttcttctcgctgcccgtctcgagatacggcctctcgagaagaatttcttcaggaacttgctgttctcgtccagctcctcgtctttgccgaaaatatcaatcagtatctgctcagtctccttcttctcctcgtcatcatcctccttgttaccaccatctccacccttcggcttcacttggaacaaatcgtcatcatcctcgccgccatcgccatcgccattgcctaatgccgccttctccgccgcaaggaaagcctccagccccttcctctgctgctcgtcgtaggcgatcttgtcgtacttgctgctgctgtggccgccatggctagcctgcgccgcgaactcggggccctcctcgagcaggtggcgagcgttcacgtccttgaggtacaggggccgctccttcttcgtcttcttgggcttctccccctcctcgtcgccgggttcactctccgacgaggaggaatacatcttggccttcgcgtcgaggatggcggcgtcgccgcgccggatgcggcggatgacctcgaacatctggcggtcgacgcggcgggacgcgatggcggcgtcatcgtcgtccgacaaggactcgtcgtcgtcgtcgtcctcctcctcctcctcctccggcgggacgaggcccttcttcttgcgctcctccaggcgctgcagcgcctcccgccgcttgttgtgctcgaagcggcgggcgtactcctcgttgatctggatcttggagagatcctcctcgccgccgcctccatcggactcattgtcggagcccgcgaggatgtccttcttcttcttctcctcctccctcctctgcttcatggctgccgctgcagtggcgacggcgacgacggcggcggcgaagctgggggtaattagggttttcgcgaatcgagaggagcaaaccaatattaaaggaggcaaatgacatatgggtcccacctttactgaaggcccatctgtgaattttacggcccaagaggacggaggcccaggggcaaacgcgtaatttcggcagcgaggcggcacctatatacaccgcgtcgagctaaaccctaaccagccgcccattcgcgccgccgccgcagaagccaccgcgccccgcagctctcgtcgtcgtcgccgcggccgctcgatcacgatggctcccaccaagaaggcggtaaggttcctgatcgattgcgcctccctccccctcctcgtcgcgctctcccgctgcgcatctcaccatttcgttgcgatgtttttgctggtttctgattggt

SEQ ID NO: 38877 - DNA, 1287 bp, Oryza sativa
tgctgttcttggcttcgccatgggggatgattgcaacgtgtccattggtgctcttggtgtgcaagtagatcaaggacctgcggtgggccaatcgtcctcagatctctaggcggagagcgatctcgctagccgttaggtcctacccaccactacctagcgagtcgacatgagggttggcgaggagaggggtgttggccgacacatgctgggggctcatggcattgtcaaggctacctaccccgctatcgtcccctgcgctgaaacgttggccctcatgagacgaggctccgtcgccagccctaggagggttcacttgtgacatcaccccccccccccaacaatgatctccagtccaatgcctagaaggttgacctccttgcacccttctcctctctccacgacatgctctgctaccgtgaagattgtcgtcctcttcggctcccataccgccgacaacacccactactccttcttccctgagctctcgcgtcctcctgcaccaccacaacctcccaagctctcgtcccgacctcgtcgagcgcctcgccggactgccttcctcaccggctgctactaccgccttatcgctgccttgctaccatcgggagagatggaaaatagagtagtccctgacacgtgggtcttacactcttatcttacttgcttactcaccgagtcaatcatgaccaacctgtcacattagaaaaaaaaacgtttcctaaaccatcgaagaagtcgatttgcaccagtttttgtcttggagaggcgttatacccggttttgcgcttgagccttgagagatgcgattcaatcataagcaagataagaagggagttaaaatagacttagtcaaccagcaaatgtatgtccctttgtcagacttggatattcccagcccattaatctctagtctggtctcctcggtccgcgcgctgagaatcgccaaaacctatgtggcccatcatccgccggtccgtgtggccttccaaggagagcgacgcggcgaaagcctcacgcgtttcgttccccccttggccccctccccgctcactcacccagccgctccctcggctcggcagcgagcggcagaggaaaccggcaaaccgcggtgcgcggcacggcgcgcgtcctgcactccagctccgcgccataactgcgatcccctcctcctcggcctccccctcctcaccggcaattaatgccgccaactaccagatccacccctccggaaacctaaaacaaaatacccctcttcccgttttgcccctcctcggctcttctcccacc

SEQ ID NO: 38878 - DNA, 1501 bp, Oryza sativa
tgtgttgttgctgagttgtaaagtacgtatcgtcttgttctttttcaacatatccgaaattgcttttgccccctgaaaagaaaatatcatgttacattgcagtgcacgcgcatgaaacaacacacaaagagtgcaagagagacagagagagggaaggagggagagatacaaacctcgtctccaatatttgtactgttcaataggagcttctggatacctacattctctaccaatatatctgaaagacactgtaagtattcatgagtgttacattcagtcaggaggacttagttaaagttaagtttacatctatacatatcatgctgggtaggttctatcatatttgctcccaatgaatgataatatcagcaagatgagtatttgaataatcgataaactatcacagtgtacaaactccagttaggcataaaggcaaacaataacaatgcaactcgtaaaaggtgctaatgtgaaacagccaaccttttgataacaagttaaaaggtaagtaataacatggttatgtaatcatatgagttcagacttcagaaaatgaaattaagaagagaacattgtctgcatagtatacatcacaccaacaatctacaaaaacaaaatgatacgaagaggcaataagattgagaagaccttagctccttcgtctccaatggcatttccagataagttgagagattttaaggctgtatttatctgaagaatgccatcaaaggcttctatccccacagctgttatcccattgccagaaaagtctacctcttctgcactctgtgaatacagagaacaactcgttttcaaaaagtattcaaaagagctagtatattagtaaggaaaaatcggtaagaaagtaagcatgtactcatgctcatatatggattgcaaccaaaacaatatatgatatatcggatatctgaccttgttataggctaagctttctgctagaaaaaacagaccctcatccccaaattgacgacctgccgagtaagtaaagttttaagtgtacaatatgcaacacaaatctgaaggctcagagcttggtttcagcattttctttcaaatattttaacttaagtacacatagactctagttacctgccatgttaacatttttcagagtcctgatttccttatagaacttatttaaattcttccttgattccttttcagcattaaagcttgcagatgttgacaaattggaaccagcggcaaaggaccacatgatcccagaaggggtagattctccagaactctggtcctttgtcttcccgggaagcaaattctgaaccaccctccatatgactgtcctctgaaacagagagttagtattgattccacacaccgcagaaaaaattacatgctctgtaacataacgtgataaaaatatgaaaagttcggcataataatccctctgtttcattatttcatattataagttgcttcgacttcttttgtaatcaaacatttttaagtttgataaagtttt

SEQ ID NO: 38879 - DNA, 155 bp, Oryza sativa
  unsure (1)..(155): unsure at all n locations
ggcgccccttgaggtgcattgcnnnnnnnnnnnnnnnnnnnnnnatgccattcaccgtcaggcgggtttggttcggtctgaggaggcccagccgctctcctcttggcaggctgggcgctgggctgtaggcaatcacgggcctcctggctactagc

SEQ ID NO: 38880 - DNA, 1501 bp, Oryza sativa
ctagtcatgttgaagtcagtgtagatgtaacttagagcttagagtaagctaattacaaaaaggagaagctaaaaagtgtttcctcttttttgtttacatatgttcagaatggagcttgtacgaatttgagcaaaccaaagaggataagtgcagcaaaacaacataacccagactttagagcccagttagtttgtactataatttataagaccatgcttatacctcagctttgaatgcattttgagaagctatggtttccttagaatctccagaggcactttggctacttgtacacgtgctaggcccctttacaacatccgaatcttcatttggatgtgcaattgcatctcgagattctcgattacccccagcagtttccttccgattctcaggaccgtctgatgatattttgctcctctttgcagactgcaacacacctgaacctgcagcaccaccttccttcttcggcttaaattcctcttcgtagttgatagcaaacttgtgctccggtagcctctccccggatttgaggcactcctccagccactcgaatgacaccacgctctgcaatcaaaaaaaaaatcagttcttatagtagtaaatacaatcacttgatgttagccgagatctctctgcaacaaaaatccagtccttatagaaagaaacacaatcacttgatgttagcagaaatctttccatgttatgaaatctctataactcaatgtagtactactactagcagtagatttgggctgtgaaaatgcagatggtagcaaggcacaccaagcttgccgagaggagattagggtttcaagctagggagccaagccgattaccccgcgaaagcggtggagccaggcggcgtcgagctcccggagcagcgccttggcgtcggcggccaggacgtgggtgaccgcgccgccgccgcccttggcggcgagcttctcctggacgcgtccccccatctgcgccagcctctgcttccacacctgcaccgacgacgaaagccaggaaaccctaagcacaggagagagagttggtgggggttgggatggattgctcggtggagccgcgacctcgaggcggcgagactggacggcgtgggggacgacgaaggcggagacgccgcggaacatgccgtcggggtccaacttcgccgccgccgccctcgccggcggcttccgcttcggagccatggagaactcccgccttctcccttcctcgctgacttcagagttcagagccacaggggttttggggaggttttagaatttcttcttcatcagggttcctttaaaaccctaaaatttagaatttactggattttcgtagaatctactagttcagttattttaaaaaccttttaaatttttcccatttcaaagaaggcctgacaggttgtccaagaaattatttctgaaatttgtggatgaattgaaattcaaaccacaagccacaaggcacaatcaagaacagctccacagattatcagagacaaatg

SEQ ID NO: 38881 - DNA, 338 bp, Oryza sativa
tttatccaataatcaatctcgggcggcctaaggtaccacacaacaacggttaatgctagtaccagtggctattgtttgaagcaactttggcatgcagtctgtcgtattgatgatttaaaatattgtgttttggaagtgttctctaatatctggctttcattttcaggatcatttcgcttatgcctctttctgacccgactctttttggtttttgcctcgtcgataatgaacttgagtacactcagaagcttgcctattagcttagtgtaaatagtaggcttgttggagtttagtttgttagaaattattagtctctggttcatttcagctagcaacca

SEQ ID NO: 38882 - DNA, 319 bp, Oryza sativa
aagtcataattatgaaataatcatggatatccaaataaacaacccgaaactgaaaccgacacagcgtcggccggtcagacagtgggctgcgccggtctgaccgcgcaatacacgccggtccgaccggcaacccgtgcccggtctgaccggacccaaatccagcactacctgtatattcacctatgaaatccaatcatctccaaaaccacttcgtgaataaattccaaataataaaaccaataatatccaatgcccaattgttcatcacagaataataatcaaaaacatctttgattttacaagtctactaaagtgtagg

SEQ ID NO: 38883 - DNA, 267 bp, Oryza sativa
ccaaatcagtggttagtcttcaaagtagggtaaaaaacgcaatcgccctatcatataaagtcacccgattatctccaactagggcttttctaaaagagacatcaagtagtacgcttgtgaacatattggccaacacgacatttttcttgctagcaagattatacaacgaggtaaataacttatcaaaagaaatgtctcccaaaacctcaaaattgagttccattatgaatcacaaaagatccatgtgagagaaagagacgatcgaca

SEQ ID NO: 38884 - DNA, 1501 bp, Oryza sativa
acaatgaatttggacaggagctgtattagaatatgtcacatccaaccgctcctgtctagattcgttgtattatgatatatcacatccaaccaaaatcctttatatttatggatggagggagtagctagctagctagccatgcattaatcttcactgctaaagcctgtaaagaaatatatgtggccagagatatgctcctgtgaataatactccctccgttgtttctaaatatttaacgctattgactttttaaaatatgtttgactattcatcttattaaaaaaaattagtaattattaattcttttcctatcatttgattcatttttaaatgtacgtatatgtatacatatagataagacgaatggttaaatatgtactaaaaagttaatggtgccaaatatttagaaacggagggagtaatagccgaagatattcttctgaagaaatgataatactatgacgagcatcattatttgatttgaagcggtagatttatacgcagacaagtagacaacttgcatgctgctacatctatatagcttcgcatgcagccgcaatttttcaccaattccacttttttgtgctcttgcaaaactcattctgattatcacttttaacatcaaccaagatataataaaaaaatcatgcgacattacagacgtatttatgatgactaacgtagtgatatactatctccgttttaaaatatcaggtgttctggttttgtcataaatcaaacattatcaagtcgactctaatcaagtttactaaacaaaaatattctaaaaaattatattgaatggtagaattaaataaaataatttgatattgtaatattatcgcagttttaatagatttggtaaaatttgcatagtttgataaaggacaaaaccaagaaaaacacacagggagtacttcctatttgtacaaaaccagaagcaatactgcctcgggatccaatgtgatccggttttgtaaaattcgggatgtgttatatctgctattcagggataataattttaaaaacgataacaagataaggcataagggacctcagctgaactttttccttacgccgaacacccggtgtgctcggggccttcgcggcacttggcccatctcgtcgctgctgggctgcagcttagggcctaaaccaactcgcgcggcccaatccatttcccccgcctcgttccatttccctctccaacatccaagccctaacccgcgcggctcgagactcgctgccaagccagcttccgcccacgacgccgccgccgccgaccggtccggcgaatcccccgctctcccgactcgcgagggctctctctctctccggttcgtactccctccccacccctctcccgcttccctctcccacaacaccgctcgcgtcgagtgacatgctcaccgggtgttcggcgtaatgcctctcccagaccaagaagcagctgcaggcggggacggcggcgcgatggcgagcggcgacggcgcgaacggcg

SEQ ID NO: 38885 - DNA, 391 bp, Oryza sativa
acagcctgacgaacgacacatcatcctcatctctaggtagcgctagctgcgcctctcgcagattcactacaaatgaagacttaccggcaccggccgcgggttttttgtcatggttgtacaatggcactgcttttatcatcatgctatgcacactactacatgaaagatttttctggacgccgaacccctttgtttccaggcggaccatatgtggacccgcacatgaaaattgatttttctgtgtgagcgatggcctagcgccggtccccccattttcctgtgcggttccacatatggtccgcctggaaacaaaagggttcggcgtccagaaaaatctttcatgtagtagtgtgcatagcatgatgataaaagcagtgccattgtacaacca

SEQ ID NO: 38886 - DNA, 1501 bp, Oryza sativa
ttggtcagtggccactcatcgaactgtatcaaaataattaagagaccgagctcgtgatgtgatcgtgagatagaagcatccatagcttgtcatatgtgcagccaccattgtccaattatgattcttttcatcgtatattcgtatgtttagttttgtttcgattccctttgtaagcagttgtaaatataggttcttttcaccatatgcttgctgtacataatgtaccttcttccctcgtctggattcctgatgtgtaagaaagacaaaccatttacccagttttggatttgtcattcatgtgtagtttgttgatgcatgctaagctggagcaaagtattcttgcatcgaactaagttgccgtttttgcaaaattctgaagctatggaatgttgccatgagccataggagatgccaactccatggaatctctcttttaacaagcaattcacatctcaagttgtcaacgattttgctagcactgaatagcgtcctttgagatcctcaggcaaaatttattcgttccaaaaggacccaaaatgtaattgatcatgtgatcgccgtcagcccaaagcatgtaataattacaaaatggattaaaacgagggcccaaaatgttattgatcatgtgatcgccgtcagcccaaagcatgcaataattacaaaatggattaaaacgaggtaacatactattatatgattaattaagtatattagattaaaaattgaaaaatacattaatggttttttaaagcaacttttctatattttttttaaaaaaaacatattgttttagtagttcggaaaacgttcgcgcgaaaaacgagggagtagaaattgggaagaggaattatcgaacgcaactaactcttgtttttattgaattactacctccgttccatattacttgtctttttgagtttttgtttgtcaatgtttgatcattcgtcttattcaaaaaattttggaattattatttattttgtttatcatttgctttattatcaaaagtactttacatatgacttatctttttttatatttacactaatttttttaaataaaacgaatggtcaaacgttgcaaataaaaagtcaaaaacgtaagctattatgggacggagggagtataagataatttcaaattattccatatttccattggacaataaaatccccttttcattttcgaagtaaaaaccgctcctcatcaacaacgaagaaccaataaaaatcgacgattttcgatcaatgtcgtacagaacccggttaatatcgatcggtttttacgaaccaagacctaacggtttaacgaaaatcgatcggctttatgaactctgttgacaccaagtcctgagaccattccctaccactctctttccctccatttgctctcctccaagaagctctcccgccatctaatccttcctccatccatggcgagatctcagatacctgaaggtaagctagctagcaaaaggtaggtgtagcatcgcacgctgcca

SEQ ID NO: 38887 - DNA, 225 bp, Oryza sativa
tttttttttgggaaaatcccagacataacctgtgtccatcgtgattctcatttaacttagcttctctggtgcctatataaacctctccatggtgtccatctgcagtgcacacacagaattaaatttaaccatgtcattttatttctcacacttgctttacttgtaaatttatttaattatacacatacctacttaaaaataccaaatatttcagcgaatttgtat

SEQ ID NO: 38888 - DNA, 1501 bp, Oryza sativa
tacgggcccatagcatttagttgtcctattttagatagtgcttactcttggttctgatgtaaaatactggaatcaggttctcagccggttgaaaaaggtgcgccctgaaatacaacagcacaataagcgaccagaagactatggtcactgttcagttccctcaggtcgtatgagtatgaagaatttgaattcatcctcttcatgtggtgaagaacactgtagtatgaagcggcgtcagttggagactcagcaggatgagagcagttattctgcaaagcagaagtcgtactcgtatccatccaccagctattctttccgaggagagtttgtggaaatgagtagagatgctgctgcagaagtccgaccaaagcgactgaaaatccggctaccttcttctagcacgaacagagtggttgagcagggcagttcagggcaaagatttacaagggatgacaagtcgcttggttgttggcctgcaatttagaatttagaaaaaaatgctgacgcaggtgctaacctctgatggagataaagatttccttgtttaggtggggctgttgactacacgaaatgatagggctgggatggatcgatgaggttgaatataaatgattagcacagaagctgactgactttagaaggctggttaatcgattctttgtgcagcagtgcctccaatttgaggcacatctaggcacggttagaagagacagacacatgacgattcttgttgctggaggttctgggtcactgctttgctgctgtttgatgcctgcactgcaagtgacgtacacacactataggacctcgctctaccctttgattatatctctctatttttcttcttctttgtcagcaaccttagctgctgctactctatagctaactgtattctttcatacgcttgttccatcaagttaatctgctgcttaatgccattgattcaatagtgaatcatcgttctttctggatggaatgcaaatatgcaatggtatggaatgatgtttggtggtgactgagatgttgcaattgaattttcccaaactgtgatgatgcagcaaggtaggctagggtaggcatcatctcatgtgagggaatttaggccttgtttagttcctttttttttttcaaaaaacgttacattgaatcttttaagcttaattagtctaatgatggattaattaagcttaataaattcgtctcgtggtttccagacgagttatgaaattagtttttttattcgtgtctgaaaaccctttccgacatctggtcaaatagtcaaatgtccgatatgacacataaaaattaattttcttttcgcgaagtaaacacaccctcgctacaatgtaaggttggctcgtagtgtctgtcgcacggtgttgcatgttactgcaacgtactgtacaaggccaggccaggcccggcccagcccaagaaagagagggaagtgagagagagatggagggagtcatcttcttcctcctgcggtggcggtgctgca

SEQ ID NO: 38889 - DNA, 1501 bp, Oryza sativa
attggttgtcgtttgtgtcaggcgatatttgttgtagttggacggaatttgttcagctagtaatcctgccgtggtcaaaaccctaattctgaacaaaatctttcattggaactagcattagttgcaaaggaatgttttggtttggttggtgacatcacgaaattggtgtctttcaccgtgcctattctctggaatcttgtcagcaaccaatttccccatatcatttctgtcatttctctaaatcaagtgcaataatttggttaatattggaagtgtttcaaggaactgaagacacaagccaaactctagctaaactttgccggactaatactatatccgtaaaccactatcactagcatacgaattctcaaatctcaagcccttaatacatatgccagtcctcacaggagacaaccaaataacaataatgaaaccaatgaactagcaccaaatacatgctagttgtaattttcagtgtatggaaatttattccaatgtatgatgagtggtggaatgttccacgatcagtcgatcactatatatatatatatatatatatatatatacacacacacacatgtgtgaagaaaaacatttgtatatatattgtggaaatttattccgataaaaccatttttttttctaaaagaccacatcagtgatgggtgaagggtggtaattaaaagatgcacgttacaaataagccccatccgtatcgggtgagaatactacttgacacggcccgtaaaagatgacctagttatttgtgtcggttaatttctttcctgtgacctatcaaagatgaagtcattagggcaagtactataatgttccatatgttgcccttaaaaataccatattggatagagtgatgaggtggaggagagaagtgaggagagagaagatgagccatccctaagtcaagaggcaacatctacacaaatttcaagaagagtgtgagagtattagaaatatttgtatttgtgtaccaaatacgatatattgtatgtgttgcatcttaattcatgagtgaataaaatagataaatttggagatggtagtcacatctaccatagcacttgcccttaggaacaggtgatagaacaaaggcaatgtttttgctaatcaagtaagctgatgtacacacaacgctaatcaagttggcttctgttcgaactccatgagaagctctcagggccaggcaggcaggcagataaaacgtacactccacagctcacaccttcccaaatcaatccgtttcatgcatcatcatcctcctgtcgatcgaaaaatctccatctgatgatcattgctactatatatcaaatctagctcggatcagatcatcatcaagacacatcaacactatataacggactgctagctagctagctagctaggtgagctacgtacacaagaacttctccattgcaataatcaatcgagttaattaattagttagtactagcaaacattggctaaagtatatatatggttttcc

SEQ ID NO: 38890 - DNA, 271 bp, Oryza sativa
tttatgcttcgtttgctattattaatatgtatctaatttctcattattttgacgttgtgtgagtctgtcttatttaatcgctctatgcaaaatgatctatgcataaaatttcgctcttatttgattcccttatttgagtcctttattgctttatttaaatttggatttgagcatgcattgatcctactcctttgtcttctctagatggccggtcacccacccaaccaccgcggagaaggcatgatcgactttgttgcagagctggcacgca

SEQ ID NO: 38891 - DNA, 1501 bp, Oryza sativa
ccgcttgcgccgtcggcaacgccgtgccaagctctaccccggcccctactccatctcccctctccgcctccggaaaatcgccgcctcgcgcaccacctctctcgcgctgccgccatctcgcctccctccgtcggccgcctcttgccgccatccccatctacctcacgccgcgccaccgcctccaccgcattcgctgcatcccaccgtccctcggccgtggctccgccgtggtcgggcgtcatcggaacgccgttctcgtcgcctcccgtgccgaccgccgccatcctttccgccgccggtcgcctctccgtggtcgtctcgccgtcgccgccctcggtgagcactcctctcccctccctctttctccccttggccggccgcctcccgtgcttgcgcgcgccgtgtgccgccgccggtggccgcccagcccgtgtgccgccgtcgcttcggtcccggccgccgccgccgcccgctttgtgtgagcgctggccgggccgcgccacccggctgtccccaagccgtccgatcggccttggccgatctgggccgtccacgtggtggacgcgcgcccgaggtcgcggtggacgcggtccaccgtgtgccctccccctttgactcgctgacgtgtggggcccgcgtgtcggcgccggccgccccttgctgacgtcagcaaggaccatttcctttgtaaaaataaataataattgcgcaataaatcgagtttaattctagaaattcatttaaatggctcaaaacttctaaaattcatatctaattcattcgaactccgaattgagccattcaaattgcaaaattcatctaaaattgagctctacatgtttgtttactttttatgtactgtttctttggtttttattagagtttttcctcgttttgcgtgccagcgtgtagtttccgtcgtttcggaagtccgcggtcgcgaggaaaagagttcgggagatcaaagtggagaagcaaggcaagtcacacattccccttgagcattttgatcctaatttacaaatgttttactgtttgcaaacaaatatgcatgttttgctaattacatggggtcagggttttacctatctgctcgcttgtgccatgtttacttgatatctgttctttgtcaaccttgggtaatgaatcgactagctcatgttacttatgtgacctagctagaactatatgcttagccatgcttaattaccactagctcagttgatgggataattgcagtattagacattctagtatcttgatgagctgcgtgctcgagacatctggccatgcttcatggtcgtaattatccaactaaaatgcaactgaatggtgggctgtgggtgcatggttttgctagtcgcacccatggcaattaaggaccggttcgcgggatgccctggaagaacttatcgtacttaccacaagccagcgtgggcaacggctgggcttgtagtgtagctttcctctagccgacgcatccaggcaagggtgggcgtga

SEQ ID NO: 38892 - DNA, 1501 bp, Oryza sativa
taagtatctcccatcatttccttttcctgcaaatataagaattggagatcatgaaaggactaaaaaaataagctggtagatgaagttagttcggacctgcaatgtgttcttgaagggttccttctgacatgtactcatacacaagtgccatatatttctcatccttacaatagccgatcatagagacaaggttcttgtgatgaatccgggttaaaatttgagcctaaagtggtgaaacttgtctatttaatgatgcccccatggagacttttcttgatagaaatttttacatagcaagaaaaagtgcagcttaaaaaattctacctctacaagaaactccttatcaccttggttggaagattcagtcctcactttgactgccacttcagtgccatcctccaagaagccatcatagacttttccaaagcctccttgtccaagaactcgctggaatttgttcgttatcttctccagttcattatatgtaaaccagcggttctcaagccgcagtgatgaattatgcccggagccattatttgttggcccatatctcattgtctcgttttgtcgctttacagaattgttcattgatcctttgtacgtgaagaatggaactagcatcagtagtattcaagaagatgaagtagagcagacaaatgatagcaagacccaccttgtttttttcttctcagtaggcaatagagtagtgtcgtcactgatactatcgcgaggaccagaactataggaacaacaatgtagatagctagcttgctcttgttttttggtggttgacatgagttgccattggtgcaaagatttgggttatttccatatctatatattaatgacataaatatgtttatgtccattttctgaaaaattgatctgcaccttttgctgaagaagactgctataagaagaatgtggtgtcattaccttagatttaaaaagccatcctgaattctcttgagaagtccaggcggaattgttccatttagttggtttcctgtcaaatctctaaaagaagacatacagtaggatattagttcaaaaggattctaaagagtacgtaggtaaaagagtaaagtacatggtcggtccttaaagttggagcgaggtgttacttaggtccatgatcttgaaaaatagacattagggtccgcgatcttgtttaagtgactcattgaggtccaaaggacctctgaccaggttgactggcttacgtgaccgtccagagtggcagtatatttgcatttcgcccccctcccccgcatccgatccaacccttcttccccatatcttctttcagtatgatttctatggtttgcggttgcaggggctggcggcggcagtgacgacgaggagggagacgggtacggcgacgagttggcgagcatgcgcaaagagggagaagggcgagtagggcggtggcggcggctggccagtggagcgagacggcgggcagcttttagggttttggagggttcgacttggggcggtg

SEQ ID NO: 38893 - DNA, 1501 bp, Oryza sativa
tgcagtagtactactcctagcactactaactagtaggagtactactccactctgcaagcagctaggtgatgttgacatgataaatgaatactactggtagtactactcggtatgctattactcactgccaaaagaaaaagaaagtaaagacaggctcgtcaaacaattcgagctcggctcgtgaagctcgcgtcgacgagtcgagctcgagtcgagccttgagcgagccgagttcgagcagctcacgagcctcgagcttttttgacagccctaggtggagttgaccgagggacggggatggcgatggcaagttagaggggcgcacctgtggcgcgagggcgaggagttggactcgtttaggggccaaaagatagggagaaagtcggggaggagttggacgcatgtcgccggcagcggttgtcggcaagtgagggagctcaaggagaaggagggaagagagatggctgggagggagacgagaaaaggtgttgacgtgccgtcatccactgcagatgagaagagggtgggacctactaacatgtgggtcccactttttttttttactaacatgtggggcctatatttttgttttaattcttaatttttatattttgcttccagtgccatatcaccggctcactgccacgtaagacgaggacaattcaaaccatccacgtaggcatcacggcagctgaaaagtgaaaacgctattcaaaccgtcgtgaggccttatttgcactgattttgatagttgaggaacccgttgtatctggtatttcggttcagggacgaaatcgaactcgttgtcaagttaagagaccataaatgaacttattccaaacctctaatcatattcttcacctctgcagtttcattcctttcaggctttcagcaaaagttgctagaagctaaggaaggtcacacatgggccattgggtggaacgtgagcaacaggacgcaatctaggcatctagcccgggtcatgtttcactatatgggctgatgggccatacatccgctaccacggagcagtaggcaattccgccgcaacccaaatggagtacgctacgtcgtcagtcgccactactagtggtggagagacgaaacacaggacgccgaaattctctcgcccacggattcccctccactcgcactgtcagtctgtcactctctccgccgccggccgccgaatctccggcgccgatggaggcagaccccaatccgatggtggtgctgcacgcctgcctcggcgtgggccacctcatccccatggttgaactcgcgaagctccttctccgccgcggcctcgccgtcgtcatcgccgtgccgaccccgccggcctccaccgccgacttcttctcctcgtccgcccccgcggtcgaccgcatggcggccgccaacccttccatctccttccaccacctcccgccgcccgagtaccccgacccggatcccgacgccttcctgcagatgctcgacacgatgcgtctcaccgtgccac

SEQ ID NO: 38894 - DNA, 1501 bp, Oryza sativa
aacgaggcaaagataccgataaataaatatgtgcctatcgacaactgaatatcgaagtcgttgtagtgtagtggtgagtattcccgcctgtcacgcgggtgacccgggttcgatccccggcaacggggaattttttttttccccaattatcatgtgctatgctatattgatcttctcatcaacgcgtggattggaatgcgatccctctctaaaagccatggtatatcctcatgcagtcaactagtggaggaggccgagatatatattaggaaaaatcttattttgcttccctttacaatagcccaaatctggtttccatttcttaaccgcaaatcaaatatgaaatctcccacaactgttaagactggaccaatttaagtatttaactctcgtcaatttgaaaagcggtttcatcccatgtgtcgcctgatttccatttcttaagactagaccaatttaccactatcgttaatttgaaagccgtttcatcctacgtgtcagttatatgatacattgaccttatctttatcctatacggctacgtggtgtttatgtgacactataaagaaaaaaaaaacactaatgtgacacacatgtcaatggcagtccgattgaaaaaaaaatcaaataaaaacaaaaaatatggccccacatgatccactagtggcaggagagatattgaggaaggggaggaagaaatagagtcccggccatgtaggttccactgttttttttttctaatagaaatactatgtactccctccgtttcaaaaagaaaatctagcacatcctatactacgagtatcatctagatgccacatcaaatgaaatcgttgtcccctgtccaaactaccccaagagagggaaaacgaaccggttgttaaatgaataaacctccgcattcgattgtatggataaacgatgaaagttggagtgggggagatcaaacggacgttttgcacgatattacgacatttccaggtttctaagctctaaaaaggcccaatcgatcatgtgaccttcgtacatagcctactaggaactaactactcgatcccgacccagctaacaaagtctgtttccctccctcatctcttctcccgattgaatcgcatccctcaaccgtaaaactaggtataacgcctcctactagggtttcccaaactgccggggctagggttaccgcgccccggcggtaagcacggttaccgcgcggtaaccgtacgaaaccgtgcaaaatttatcaaaaattcaaattattttttaaatttatttgaatttaagaaggttaccgcggtttttctattaccgtacccccgcgataaggccggtaacagtggtaaccgcgcggttaccgacggtaagtcgaaccctacctcccacattttcaaaaaccggtgcaaatcgacttctttgatgttaggaaacgtttttcgctgacgtggcaggttgactcgctgagtcagtagatgggaggctctcggcgcgtgcaagggaagag

SEQ ID NO: 38895 - DNA, 813 bp, Oryza sativa
gtgcgacttgacgtgtgctactccacactattgccttaataatggaaaagatggagtaaaactaggacctctattacctcatacagtaagtacttttatttattgttaatagtagtgttttatgatagttttgaacccaacagatagataatgaagtctaaaattcactgctcatttcattgcagcaacaatttttaaatgttaaaatttaatgttttttcccttcttcactacaatgtgctgacagcattgttttatactttcctgaacaaggttgctgactacatattggacatcgctgatctagcagcttcatcgacagaaagtgatgatacagatagcgattctgaaaattatccccaggcacgcttttggtcgttgtcatagtaaaaggaaaacaatgtatacatcgacttgagatgtggattgtgaacttgttataactctttaatttctggtagttttctgagtgtggtatgtgcatcgttggtagcgactgaatgaaacggcacaccgagttaaaacttagaagtataagctaatagaaaagctctatcattataaggtatacccaccgtacaaaatggaagccaaataactgtatgacgcaccacgcaccctatagagccttaagactattgtttttgaagaatggatgctcactatagtacttaaaaaaactcaggtagcataacccatccataagaatcgtgcatttggacattatggaggccaaagcaaaacaactcctactcaacggtcaaacctctggattagcctacatcaaacaaccactttaccataggtcccaag

SEQ ID NO: 38896 - DNA, 1501 bp, Oryza sativa
taatatatatctcggcctcctccactagttgactgcatgaggatataccatggcttttagagagggatcgcattccaatccacgcgttgatgagaagatcaatatagcatagcacatgataattggggaaaaaaaaaattccccgttgccggggatcgaacccgggtcacccgcgtgacaggcgggaatactcaccactacactacaacgacttcgatattcagttgtcgataggcacatatttatttatcggtatctttgcctcgtttgtaaatatgacatgatagactagtgatcggccatgccagcctggagtaatagcatatgctattacgtatttgcatgtaacacaaaagggttttaagtgtttatcgtcgcaattagatgacacaaaagagtataataagatctaggccggctatatacaccattatacttaaaaaaaagctaaatcgtactttatttgttttacattataagatattttggataaatgttagagcaaggtcaatagtgcagcccactgctagctccaaatcttctatagccaattcatacaatagttacttactatactattaatacttggtcccacctgtcatacacacattacgtcatggagtccgtgctgcagctagttacagatctgtagcccgctgcttttctctctcttcctttatctctttaaaatatgtttatagctggcttatagcctgctattgtacctgctcttagtgagtttagatgaaacatagagagactaaaacatcttccgtataatgtataaaacggagggactacgtaacagtgtcgcccacacaactgatggtacactttgtccctttgcctttgcgatgccttccgaagagacactgggctacgagcctacgagagcacttgagcctaacctggacttggcccgcaagaatcagccagccaggcccacaccacaaaatcctcctccttttcaaactccgcaccttcgtctagaagcttctaactcgcccactagctcccttccccttggactctttggagttgttggaaggaacacgcgcggacgcgcccacgacccctccccacggacggatgccggcgaaagcgcaggcacgccacgcgtcgtcactcgtcacggtgccagtaacctcctcgtgatctccacccccttcattacttccccgtgctaaaccccaacagaggtcccacacgatcgctgacaggtgggccctccctgcgcgtgcaagccgattagcgctaattacccgtcgtctcgaggagttattaccacgcttaaccgcgccaattacttcgccgggttaacgcaggacttaatcacgcggttgatcgtgcccgatccaacggccaggatcgcctcactccgcgcataaaacccaacgccacgactacggagaaaaggaggaaaaagaaaagcaaaaaggcaaaaagagttcgtgcgaaaaaaaaaagaaagaagagttcgactgttcgagcgaggagggag

SEQ ID NO: 38897 - DNA, 1501 bp, Oryza sativa
ttcttagtactctaacacttcttttcatttttttaaaaaatagagtaattttatagttctttagaaagtaccatgagttaccactttttcaattataaatttggtacctaggtaggtatcaagaggtaccaaactttacactaatttttttatctcatgatataaaacttctcaagaactgtaaaattgctaaataaaactatatgtatgtctacgaagagagtactagtttatacttttctgcaccgaaatcttgctagctaggggactttcaatttcgtagtactgcttttgttgaatcagtggagaacaaactcttctacctacctcgcattctcgcaattgcataataatctttctttcttttagataatgattatattaaacctgacctctaacctcatgagaatgtacataagactatcatgttattataggtacaacgtaaataagttttaaaaggcagacaagcaagaggaactaaatctttcatggcaaatgattctatctgcatgttttccagttcagagcggaaaggctaatgggcgggtgatcgctcccccacccgcccagcgaaaagttagaaaaatttatgtatagaaatattatatataaaaaatttgaattcaaattcaaatttgaatcgggtatgtaaacttttgacttataaactttgggtctataaattttagatgtatagaaatactatatatagaaaatatttgaattcaaattcaaatttgaataagatataattcaaattcaaatttgaatcgggtatataaactttagatctataaacttttaggtgtataaactttagatgcatagaaatactatatatgaaaaatatttcaattcaaattcaaatttgaatcggatatttgaattcaaattcaaatttaaaatgggtatataaacttttgacttataaactttaggtctataaactttagatctatataaactttaggtgtataaactttagatgtatagaaatactatatataaaaaaatatttgaattcaaattcaaatttgaatcggatatataaacttttgacttataaacttttggtctctaaacgttagatgtgtaaactttaggtgtataaatttactaaaataggaaagtaacgcggtgccaaaaaagaaaaccaggttgagggagggaggggggaggtggagagcgaatctgatcgctaccctatctccacggcgatccatagcccatcaggggtacccagttcagagaacaagtcaagcgcctatgggccgtggccagtggccaccgatctcgggcctcgagtcgtgccccagccaagcagttgaccagctgccatccaagtcaactacgtgcccatgtgatctgctcgtctttgctctcttcccgggcttgcagccttgctgacttgcagggtcattgacatgccggtcctacaaagaggtggccagtaaaatgtcagaaaaggcccactcgtcagtgacagtccacatatatg

SEQ ID NO: 38898 - DNA, 1501 bp, Oryza sativa
ggtctgcgtgtcatgctcgtgtttgggtgggctctggataatggaatggtaaaggtgcaaataaatgctcccttagtaggcaatgataatgctgagagtacatgttttatgtaccaaatgtctaataatccattttcttaaacggttaaatgaatattagtagatgctatcttacggtctaactttattgacatgacaggttcctatttaaccttgtgttcgtgtgatgcaacatttacggagccatccagcgaaacagcttatttgcaaatggaaaataattcgtgaataaaacttttatatacgtgttcttatcaatctaaaagcaacagctaaaaaataaatttcgatgaaaaaacctcaaaatcagctccaaatttaagattgaaaatttaaattttaacttataagcataagtataagcgaaaagaagatgccttatttgcatatgtgttcttgtctaacgatcaataattttacgtttgacaaaaaaaatactttcttttacgttgggaaagttgtttttttctattcacgcaagtgatcatactgcttgaaatgtaagagaaataaaagaacaacttgttaaaaaataattataaaacagtctagaagtatagtaacaatgaatgaaaaacactaccaacacatataacgctatggatcattgatgagcacggacaaccgtttatactagcgcgtaccatctataactgataaagcataaaatgcattggacaattcacatgtattcatctatgggttttccattctgttcaaaatcacacagacaatattaggtcaaagtttaaaggctagtagagagaggcgatccttcgcttaacttcatgtgtagttagtgtcactaacatagcacatcatactatgcatgtctctagtagggcagtcgcagtctcgcagataattatggccccgttaatatggggaataggtcgagcttattaaccgcacgtaaaattgatctaaaaaataatttgtaaataaaacttttataaacgtgttcttagcgatttaaaagtaaagattaaaaaataaaattcgagtaaaataaaccttaaaatcaatttaaattaaatttaaggttaaaaatttaaattttactagctgataagtaagcggaaagatgaggctcttattcctttttttctcgtcggagtgcccgtagcatttccccttccctcctttttgagcgcacgccgcacccactcccccgtctcctctgcgctgccgttccccgttattcgccaacgcttccctccacccgccccctccccaagctgagctgtgctgccgctgctttcgccttcactaatcatcatcgcctcctcctcctccttctcctcttccccaccaccttcctccccacacacacacaacctcgcgcgcgcgcggcgagaacgagaagcatccagggcggcgcggaggcggaggcggaggcggaggtggagggggggggggggggaagccgggatggcggcgg

SEQ ID NO: 38899 - DNA, 1501 bp, Oryza sativa
tgatgcaaagacacctgaaagcaggggaatgggcaaaagattgtggcagcgcaatgttccaactgaaaagcaatcgcaaagcggtgcgtcggttgtgacaccatcacaagttagtgtggctagcaccaacccgctccaaagcagcgtggttgtgaaaaagccatggcaaagaagcgtgtctagagaaaaagagccagagaaggatatatctagcaacaaaccgttacaaaaccgtgtacttgctgaagaagcagagaaaaccaatgtgactgctgataacaaatcacagatcattcaagataaaaagaacaatggtgctaccacagagaattcatcacaaataagtgaaagtgccaaaaaactaccacttactgcaaataaatcgcaagctgatacttccacagaaaaattgtcagaaagtgacatacttgctgtagcatcatctcagatcactgaaccatctaagaagccatcagaaaacactgctgaaaatgagaagccatcacagactgatattgctactgacgagctacccctgacccaaagtgtagaagccatgtcagaaccatctccaagtgatgcagctcatcaggaaatctccgagagggagatactgacagataaattaccagaaagtaccatggctgttgagaagctatctcaaactgctactctaaccgaaaagccatctaaagaagatgctgcagagaagctaccgcaaaccaatgaaccttctgagcagccacacgagagtgaagagactgctgagaagccacttcaaaatgaagctaatgctgaaagcacaacaaaacaaagtgatctcagtcttgagaagccacctcaggttgatgccaatgttgggaatcctaccgagcctgaaagtgatgccacttctggtgtgaactcatcagatgctcaaatcaggccaactgctgagcagttagtaggacctcaaggcattgtatctgccgagaagacatctgaccagatattagaagctaacaccgatccagctgctgaccagtcatcagagtcccaagatgttgcacctgctaaagttgcaacggagcaaccattagaaaatcaaaaggctgcagcttcagagcagccattggaacctcaacacgaagcatatgaagagaatccacaagagcataatagtgatgcaactgccaaggagtcatcagaacctgaaagagatactgcttctgatcagttggctgagcagccatcagaatctcgaactgcaggtgagaaggcaacactgcgtgaaagtgatgtggttaccgaggatccagcagaacctcaaattgatgcagctgctgaaaggtcagctgaggtgttatcagaatctcaaactggagttgagacaccagtgctgcatcaaagtgatagaactaacgaggttccatcagaacctcaaactgatgaagcttctgacaagtcaactgagcagccattggagcctgaaaatgatgcatctgtcgaggatgagaagcca

SEQ ID NO: 38900 - DNA, 619 bp, Oryza sativa
tcgagtgtgctgaccctgcatcttgagcataacagatcccaggtagaaacgtgagcgatgcgaaaacatcgaaaaagtccggataatatttttgcaaatccgaagttgacacgtgctagcgttgacatgggcctcctaggtatcaaccaatgttatctgctgatgtggaaaaaatcatgtgtggcatgctctatgataaaaacacgctacctgaccagtctttttcacctggaggctcattttcaaattcttgcaccagattctacccatctgccaagttattagagcatacataatttactcatctgtatcttaccatacttctataggattgacacttttgtaccaataactaataaataaagaaatcaattcttcaatttatttattttttattttgggttgactcttgaaggcatttaaatatactatgtgtgaaggtggtatgacaatattggtcatgttttctcactacaaaaggagtatttttccatgactatgcgcctttcctttttgccatcctaagttaatattgatgatttgctttgttacttcaagtcatgatttacccaaatttatgtgggatcaaatggttttgtttcttttaatgtttttcagg

SEQ ID NO: 38901 - DNA, 1501 bp, Oryza sativa
tttcgtaagtttaaccaagtttatagaaaaatatagtaatattttcaacccaaaagttttatatgatcacaatatatttacattcaatgttacatttattgaaagtaaatttaaagttatagatattgttaattttttttgaacctaaaaaagtttaattatacaaaagacaaatcaacttataatacgaaacgaaagtagctaataacatgtctcagtttcatgtgcaagaaaacagctcagtacaaccgagtatatgtcccttttcaagtcacattcaaaatattgtaaaatattggggattctaaaaagttaaaaggcagttcagattgtaatcaaattaaaccttatcaaattttgtcattggcaacttagtaatattgccaagttttaacatgatttcttatgtatttattaaagtttggaactccctccgtcccattttatgtgcaaccatgattttccgcgctcaactttgaccgtccgttttatttgattttttttcaaaaaaattttaaaacataagtcacgagtaaagtactatttatgttttattatcacataacaacaaaaatactaattataaaaaaattcaaataagacggacaatcaagtttgtgcggggaaacttatggttacatttaaaatgggacggaaggagtaaaaactaagggcttatttggttctctaccctacctatttattggtagtgccaaaatctaggcaaattttggcactaccaattttttggtagggaaaagttaattagactacttttggtttaataccaatatggagccaaattttagtagtatggtgaagaatattctagaatatgtccaaattgagtatgggcactatcaattgtttggcttcaaaccaaactagcatatttactatttaaattaccaaaattttggtagggcacagttttagcttcaatccaaaacggtcctaaatagatgcacatctttaacgacatttcttaaaaaaaattggtatagtttaaaatgacatcaatctgaacaatccatagaaacatcactagcctaatgctgtatagagaccatgatccatggagtagttttttctgaaaaaaaaatgtttttttcatttttttatcacatctccttccagattttgttcctttccaaacggtgaaacggtagaacccaaaacctcaactccaggagcttccagctccagctcacccctcctctttcacgataagaggcacccagacgaacacctaagctacgcgcgcgatgctcccatgggcgccgccgccggcgacggcggccaccacctccccggcctcgtcggctccgctcctccgcgccatgccccggcgcgcgcgctctccgcgcctcccaccgcccccgcaccacccttcccctcctccgccgccgcttctctcggttggccccggggcggcgccgcgcgccgcgcgcccttcccacggcgacgtgttctgggaggagccggacgacggcggctccgg

SEQ ID NO: 38902 - DNA, 348 bp, Oryza sativa
gagattgaaattaaaggagacagagatgtagacacacagctcgtgtacatacatgcatggaggcgtttcatcaaacaccttgcgcctgcgggagaggaggagaggatccaatcatccaaaacgaaggcaactgaagaagttgtaaggtgtggtctgccgtctgcggcggggcgaaatgtgtggtgtgggctaaaatatgtagtgtaggaagtaaggcccaaggcccatccgatatcgactcgactcttatctgtgtgggccgtcgtcgtcttcaaccctcctcctcctcggactaggactaggactcggactctccccttcctcctcctctctacctctacctctagg

SEQ ID NO: 38903 - DNA, 1501 bp, Oryza sativa
tgtgatgttagcgcctatcacattgatctggtttctctctctagcaacataagtacataacaatttccactccagtttgagatattttttatgtcatgttggcccttgaattaaatctgtctgatttgcaggatggagccacaccattacattatgcagttcaagttggtgccctgcaaactgtgaagttactgattaagaatagggttgatgtcaatgttgctgataatgtaatgtgctatggtgcttttttttttcttattagttcaacccttttcagtgccattgatttttcttttattttgtctcgtttcatgcaggatggctggacaccgttgcatttagctatacagagtagaaatagagatatagcaaagatattgcttgtcaatggtgcagataagacgagaagaaccaaggtatgttatgcccctatggtttactgggtttttttttccggaattgcattatcccaaaaaattagacctataacagctgcctcttgtgcactcagagccttgattttatttggcaaattggcatacattttcatgtcatttttagccgcttcacagaaattgacttctatggcattgtcatctcaaatgctcgtatttccatggacatcagctttgtattacagtctataggccaatactgctttctgatctcagatttggttacaggatggaaggactgccttggatataagcttgtgttttggaagagatttcaagtcttatgatttggcaaagcttgtcaaacttgttccggcaaatagaaaaatgtgactcagctctgtcacaagaatcagagaaaaaaaaaagatttagatgttagcaactgttgatttgggtcattcctcctattgtttttaatgggatgattcctccaatttgctatagttgcttgttcaatccatttttagaacctgtttattttagagaagttgtctaatcctgattcatgatcaacttatgtaaaggggttcgaaaaagctaatgccacaatggaagaaatagccaaatttagatgatctttttcttatttgcaaaccgaggttcctcagaggcgttattttaaacgtttgatgtgttaccgttcggctatgtgaatacaaagctggctaagcaaacaggacacctccataaaatgatctcactgagattgcataacagtcgttttgtaattggattaataaaagaagtaaggatcaccacatacataagcgagcgttaattataaatatatttttttcatatcgaagccaagttttaaacctcagatgatttcatttggcgtttagaaagagttgagaaatgcacctgtctaggcaatgaaacagaatgggattgcacataaacctcaaattttctgaacatgcaattatcacacgactagctacagtaagggcgcatgtttctacagctacagataagacacatgtttctacagtaattcatggggtttggcaacatgtcactgcaaacttccaaacaga

SEQ ID NO: 38904 - DNA, 1501 bp, Oryza sativa
gtggcctggcttgtaacagttgaaacatacctgctgctcccttccactactgttattctcttgaaactgaccctgctgaactggcaccggctgattagcttgctcgatgttaacttctttgctttcattagtctctgatttgatctcaccaccgatgttcaactgctgcgactgtccttgaccagcggaagaagattcaccaatttggagtggcttgatacactgcctctggctactaccttgtgcctcctggaatacagtcattttccttttacggttatccatcctgttcttcttgtcttcaagtcgaattgctttgtcaaccagctgctgaaaatcaacatagtcatgagagatcaacgtaactgacagttcatccttcagaccttccaagaacttctcttgcctttcctcgtcagtacacacatcttctggagcatagcgtgccagacgattgaactcatgaagatattccgtcacggtacgatccttttgcttaagtgcccggaactcacgcttcttcaaagcaacaacacctgcaggtatgtgtgtcttcttgaatgcttcagtgaactccgcccaagtgattggttgtccttctgctctgttcatccggaaatgatcccaccattctgatgcaggtccttgcaactgatgtgaagcgaaaacgactttctcctgatccgtgcactggagcagttccaacttcttctcaatagcgtgcagccaatcacctgcttccactgggttggtagtgctagaaaatgtaggtggcctcacacgaagaaaatcagctaacttgttctgcggcggtggagcattgttgttcccttggttgagctggttctgcatctgctgtatcatcatattcattaactgagtctgttgagccagaacttgagcaagagttgggttcccttcattgttattatttccacttttattggcgcgagtgttcaccatccgttgcagattagagaagatagaaggagaggggttacgctaaagttaagaccttaaccatgttaccactgatctggtgtgtgtagaccattatattgttcaagttgattaagcaagcaacctagtatagttacacactcatcattgaactactccaatgatgggaatgcaaccatacctacacacaaagcaaacaacaagcgttctaccctactaactattcttcaaagacactttggcggcataggttctaaggtaggatccaaacttcattccatcttgacatctgggcacttcagtccttccttgatccacttgactgacctccataagtagacctcattggcgtcttcaagttccaatgtcttagagctactcaagttgaaagcaggaggggagaggatgataaaatgatttgcaaagaattctggagaaggaagaaaggaaaattttaacaaaacatgtttttggaaaattagtccttaaggtttgaccatttggcttatcctacagtcgagatggctctgataccaacttg

SEQ ID NO: 38905 - DNA, 1135 bp, Oryza sativa
  unsure (1)..(1135): unsure at all n locations
attagtctcacacctctcacataattatgaatgtaanacctgataataatttgctagcctcctggttgaagattagatctgtacagccgggtatggttgtccagaatggttgggcctgtcaagcatgggtgtgctgttcagtgttattanaatttctgattaattactccactgttttacttctcttaaatgttttgctgaatgctgcttttgcaaatgagcctatattaggccatcctttggtattcttgtgcacttgcatatttgctgtgtggcttgctgagtatgtcatatgctcaccttgcaataatcaatcaacctcagttgaagaaaaaggatccagaaggagaagacgtttggcttataccccagttgagctgcctgtgggagtggagccggagcttcgctagattttattttccgctgcagttttcttcttggtgaggactaagtgcctcttaagtaagtatttatcgttttagttaatttgatgaatctgtatattaaattgtcagtttgtgtacctcggctgattcctggacgaggattttatgcacaaataagttcggaaattactagtgaatttccgggcgtgacaagttggtatcagagccatctcgactgtaggataagccaaatggtcaaaccttaaggactaattttccaaaaacatgttttgttaaaattttcctttcttccttctccagaattctttgcaaatcattttatcatcctctcccctcctgctttcaacttgagtagctctaagacattggaacttgaagacgccaatgaggtctacttatggaggtcagtcaagtggatcaaggaaggactgaagtgcccagatgtcaagatggaatgaagtttggatcctaccttagaacctatgccgccaaagtgtctttgaagaatagttagtagggtagaacgcttgttgtttgctttgtgtgtaggtatggttgcattcccatcattggagtagttcaatgatgagtgtgtaactatactaggttgcttgcttaatcaacttgaacaatataatggtctacacacaccagatcagtggtaacatggttaaggtcttaactttagcgtaacccctctccttctatcttctctaatctgcaacgga

SEQ ID NO: 38906 - DNA, 1501 bp, Oryza sativa
aacattatctctggaaacaaaaaggaatggtgcaaaatcaaattcttttgcacgcaccagcatacgagctttttttctgaagtttcaatcattgcaatttggaaaaatattatagcataccctcagcctgtaccatcttgcactcctacaaactattatctaattaatcgaccatgataatatgatatagctacagataccattatctatataatttgcccaagacattttcctgctctaacctgaagaacaatatgggcttgtgttcaacatggcacaaaaaccgtagacaagtgtgggggtttcaccaggagcaggacaccggtagttcacaaataagcggaacaaaagcaaaaatatcaaaacctcgctaagttaaaccgtaatttcactgtgaaatgcattgctttgaggtggaaaatgaaaatccgcctacatttttcatttagataaacggtttataaggattgcatggtactgagctttaagcctagctgaacatgctggtgaagtgttttgatttttttcttgtctacattacaatggcatgaaaggattactcataccaaatttgggtgcaggacacaaccgcaatggattgacaccgggtcacagttccttgattcccttcaaacagatgcctggtagaattctggacttgtaaacttgcagaggcttccctggaagacacctagttcctagaaattcctcgtcttcttggatgcttgaccgaggtcagccaatttttcctgctgcttgcgtaggtaaccacctgaaattcttaagatcctgaatcaaccactaattcgcagcgggcgatggctctaactccaattaaataagggcaaagtaagctggtggtcaactactagacagtaagctatatcttattcgtaaaccacaagtaaactgagtgagctgagagctgtagtttcgtcgatgttaccagacatagagacgaggttgatgcgggagcggggcgcggcgaacatccagctgtcgtcatcgagcgacctgacctccttttgcagcgcctccatcacctccgacttgagctctgcggggaagcaaccacaaacatagccgattcagaatccaaaaggagaggaggagcggaaaagctagggcttgcgtgagggtttgcctgccatggcctcatccttgcggtagagcgcgtcgatggagtcggcgacgtcgtcggaggccgagatcgcgcccgcgctggccgccgacacggtcgacctcgccggagagctcatcggaatcacgcgatgcttttccccttttctgggtgaaatcgaattggagtcagtctctactgtttgagaaaagggagacgacgagaaattaatgggcccgcgttattgggccggcctgttaacgcgagatggagacggcccatttagtgtccactagttgcgtcttcgcagcggagatcgaacagaagcagaaatccccaacccaatcggaggaggaagagaagggcggcggcggcgagcgg

SEQ ID NO: 38907 - DNA, 1501 bp, Oryza sativa
accaaattagggagaagcgttttaaggacttgtttgattaatccctctcacgaaaaaatttaaagaaaatttattccatatctattatatctattatggtgttaaattatttttctcaatcccgaccctcgaatccctccatattaagaattaaacaaacaaacaagatctaaaggagctacaacggaacactatgcccctcctagaaaatgatatccatagataagataaaattacgataaaacacataagattacaaaaatgacccatttcaagataaagtttaatatattggatcatattattatgctagataaaaacattgcttctttatttgctgactctcgttcgatagaaaaaatcaaaagagagttcttatacattttctactatccaattcgaatcaagattatgctatatgtttcttccttctgactccagcaatatctgatggagagaatgtggtggtgacccctcctgatttagatctttggttgagaagggacaaaatgagggttagataaagagggtgagtttagagggagattaaggtgagatctagaggcttaacggcggtggtgctgtcggtaatagccaaagatgaggaagggatggacgatacaaaattaaggcaaaatttgtgtaggagtatgcatgcctgcacaaataaagaaaaacaacggttacggctaaacctaaaaataatggttgttagatatatattgcggttcaaggtttataagatgaagacactcgagctatattacgtactacctctatgacgtcgttgattttttatccaacatttgaccaatcgtcttattcaaaaaatttatgtaattatcatttattttattatgacttgattcgtcatcaaatgttctttgagtatgacataaatatttttatatttacacaaaaaatttgaatgaaacgaatagtcaaacgttgatcgaaaagtcaacgcgtcatatattaaaatattaaaatatggagggagtattttgtgaaggcaaatctcatccattatttcatttgcaactacgttaatttgatacgaaggatgccagtagatagtactagtatctgtagatggataaggtagtgctctctacaaatgtaaaaatgaactaatcaacgccatacagtacatggttagggatgatgtagtagtatatataattgtaaaatgtactactagtataagtgacgtgacaagagtggtgcagtgaagtgtacgggaaggccacgaggaacctggttcatatggaagcaaaaagcgaggagaagagagccccccctctcccactcccaccttctttttatctgtctcgtctcttctgataaaataaaagaaagaaaaaaaaagaaaaaacaaaggaaatcgcgtgggcgaggaggagggaggagagagagccgcttccgcttgattcgattcgaagcaaaaccaacccaacccaacccaactcaaccgaatcgatggccggcgacgagcccctcc

SEQ ID NO: 38908 - DNA, 1501 bp, Oryza sativa
catctacctcgccggagccatgccgggagcacgcgagccgccgccggaccacccacgtcgatgggttttggtgccgcgccgggtggccgccgctcgccgtcgctgatggaacgccaccgaccctcgcgtcggcgccgttgcgggaaaccgcctacgacgaggcagaccaacaccccatgtcgccgccgccgcaggacctaatgccgaggacgggcagccgccgccgtcaacctcttgccgacgcgccctgagccgtggtgggaggaggatgggacgaccggccgccgacttcggattagcttccgtcgggacgccatggccggacgcgatcggttgtcgtcgctggtgttttggccgtcgacgtcgagcacgctccgccgccgtcttctggacgtgtgggtcgtggcggagctccgccggacgtcgccgaaccaccgccgcaccgaacgccgctcgggagcgacaccgccgtcgccgtcttgccgccgggcgaagatgggtcgtcggccggagtcctcgccgtgcgccgcctcaatcccctccgacactgacagtcggcgccttccgtcgccgccaccgtgcctctccggccggcttgctgggtgacaggtgccggtgggagaggggaaaccctaatcccctctcacccccctcctcttgcggttcctcattgggccggctgggccggcctgctctctcctcggaccaaccgcaatggcccatcagatcgagacagcccacacaaaggaatctaaaaatagtaaattagaaattctaatggacctagagtgtagcattcggtccaataggatatttgggccgctacggtaaaaaccgacccaataagaccgtagaccgaacggcgtttcggcccggttattctaatctactgaaaatttgcgtataaatcccttcgggatggttgattttacgcctaaagttcactgttgaaagtatttttttactttttggaccctatttttttccctttgtgtacataggctacaactttgtagtttaggccttgttctagttggtttttttgcatgtgagtccctggactcgttaacaaccatgtaatggtgtttttaagcaatttaattgcttttaactctgatgcaactccaactaaaatctagataaggtttctagattaatgcttccataaaattgtgctcacctagtgtaagtgacccctccccggaagcattatttgggtttattttcttgcatatgtaatgttttctgtgggcataattcttgatattaaatgccataaggccaataataatcacagaaaatcaacaaatgcaagacaaactccgggaaaataccagtaattacatatgactatgctactttgttctgtgactttgttttcatgcaagttaacccggcgttgattttttgcatgttaaacaggccatgtctgatgcggattacgccaagaaagagttccccatcctcaccgttaacggtgggaactaccagacctggtcca

SEQ ID NO: 38909 - DNA, 1501 bp, Oryza sativa
ccttccacccttatctatacagtatttaataagggtattatatgtagtttttttggttaaatcttaatatatactaaacaacctacaattaccatttatataagacggagatagtgaattccttcctcggtacattagctgctttctattcggtttacctgctcaactgggcctgtagaaatacggcccataaactcaccctcctcaatttccctcttacattttgcctaaatacgaccaaaaaatagtcaacactatttttcttatgcaaatcttaatcaacactaaatcctaaccctaatcctactcggtttattagtctcaaactcaatgcttagtcatctcggattttaacgccaccaagctaatataatcaccagattagcggccgcttaatccgtaatcccgtctcgattttgaggtttttgttagcgatttggcgccactcgcgaaattagccgagcgatttcgatctcgtcgtgttctagaacgcacccggccatggcagcggccgccggcggcggaggcggaggcggcggagagagccagcagcagctgttcgagaggctgcacggcgagctggtcagggaagctgaggacgtggcggcggcgtcgttcggcgccgacatcaccgtgctggccgtctccccgcgctccggcgagccgcgcgtcagccgcttccacggcggcggcggcggcgccggcggcgaggagttggagcgggcggtgggcgtcagcacggaggagatcgcgcgcatgggtcgggatgaggtggcggcgctgctggagaggctgcggctacttcggatggtcgtgctgcggaggatggtggtccagaggcagaggagacggcgactccggcggcagcggccggcggcgccgccgcggagcatcatggtcgtccagaaaagacgacggcggcggcagatctgctagctataggtcgtctgaaatggttgattatttggttctagtaggtgtattaattgtgccatgatctataattcattgtgtaaataacaacgattgatcgatattatgattgaatttgtgtgttagggcaagtacataggtagagtctctactttaattaaagactatcacgttacaatatttaagataatacggtctctaaccattaatgtaccaaaatacttttttactggtcacctttcctttattatactcaatgcaacgaaaaatttcctaataaatgctaagagtcgactctatgccgttgtcatgcgtagcaattatctttctatttccttcttcctctctctttcacgtcaccaaatatgtttgcatgataatagagagaccgctaataaagaccattatacatgccctggtcaaatcatcaggtctggtctcttctactccctccaattaatgcctccatttcatattataagatgttttagtctcatcatgttttagattcactgatatccatataaatttgaacatatatatatgaattacatatatgaatacatga

SEQ ID NO: 38910 - DNA, 1501 bp, Oryza sativa
ataactcaacgggaaaactttattaatgcaaaggaccatcctaaacacactgaccaggatgctttgctaaagcatcattattacatagatgactcaatgttctgaaaaataaatcacactgactcagtatgatgagctaaatcatactaacacatgatagcctagacttaagacacatatttgataacttgggaactactgcatgtccccatgtatgtcctcattcatgaggtcatcggtctcgccgtccccgtcgaattccccgaggtcaatatcgtcatccccaaggctgttatcagctgcagcagcagtcttgggatcaacctccatgggagcatcagcaggaggggtatcagttccagtcactttaacaaagtgattttccggcccctgcttcttcttccaatcctggtacatctcaatgaggtgaggttctgtgttgcaattgcgtgcccaatgcttctttgagccacaatggtagcaaccctcaccgccctgttgggatcctccactagcatcgtcagcagcgccactcgccgggttgcccttgcgacccttgcgactgcggggcttcttgcccctcttgacgaccctcttgaagtgtcttccattaggtagtgtgcggctaccggatcccttccccttggaggaaccttgtccagagttgttacccttctaatgaacaacgtgagcctctggaataggctgtgaaccaacataacgattgttgaagttggtcatcagaagtttactgtggacttcagcgtttaacaacgactgaatgagcttggagtacttagtgtacttagcctcacggtactgctcctgcatcatggaattcttggggtggaatgtgtcaagagtcttttcaatcatgtcttcgtctgtcacaacttggttacagaaacgaagtttgctgacgatgcgatgcacggcactgttgtagctttccacggtcttgaaatcacagaaccgaagctgagcccattctgctctagccttcgggagaatagcagtcttctccgcggtgtaccgttctctcagggcctccaacagcaggagaggcccacgcagctcgaggtactcaaccttgaggtcctcgtgaatgtgcttcctgatgaacgcaagtgcctttgcccgcttcggcatgggaagcggggcaacaccggctccttgtcgtcggatggattctgacagttccatcgcggtaaggttgatttcacagtccatggaccaggtctggtagttcccaccgttaacggtgaggatggggaactctttcttggcgtaatccgcatcagacatggcctgtttaacatgcaaaaaatcaacgccgggttaacttgcatgaaaacaaagtcacagaacaaagtagcatagtcatatgtaattactggtattttcccggagtttgtcttgcatttgttgattttctgtgattattattggccttatggcatttaatatcaagaattatgcccacagaaaacattacatatgc

SEQ ID NO: 38911 - DNA, 1501 bp, Oryza sativa
ctgctccgggagctcgccaaccccgccggcgcgcgcatcgtcctggagaccgagcgccgcgcgccatccacggacgccgccgccggcaagcaccggagggcgccgccgctgctggacgtggcggcgtggaccatgttctgcaacgggaggaagaccgggctcgcggtgcggcgggaggcgacggacgacgacctcgcggtgctggagacgctgcgccccgtctccatgggcgccggcgtgctccccgcctccaacaggtcgtcgtcgtcgtcgtctcagtcgccggagaagggggcggcggcggcggacgacgaggtggcctacatgcgcggctgcttcgaccacttcgtcggctcgcgcgactccgagtcgctctacatgatcgcgccccagggcggcggcaccggcccggagctcgccatcttcttcgtcaggctatgaccaccaccaccacctactcgccggctcgccggcgatgcaccgatcaatccatcgccaccgccatcgcgcgcgccatgcaaagcaagacgaagggcgcgtcgtgattcgtgcagccctcttgacggcctcgagattcgtgaggagcaggcgagccacctcgactccctacgtcagagatggcttagcttaaatttaatcatctgattaagcactaatcttgtgctcttagtgggtgattaggttgtgaggaggtcattgcataaatcgggtttaatggtggtgcccaacacctcattgcacacacaatctagtggagtacggagaaaattatattaattaattaagttgcttgcttttgctttcttctctctcgcgtttaattatcggatggtaattttgcataatttatttgtcagtgcaaagaatttgagaattacatataaactccattttggtttagattaactaaatttttgcaccaaaaaattgtacatatatatatatatgtcacatataatctctatctcttctctactattataaaaaattaaagatctttttgccgatattttgatacggcatccgtgtttgagtcggttcttaagttggttccttttagaaaaaaaatccgtgtttgagtcagattttaagttcgtttgcatttggaaataaaaaagagttgtataagaaatctcttttaaaaaaaatttgcatgctaacttgagatgaaagttggactcatgattgcagctcatgattttctaaaaaaaataatatccaagcgaattcccccagtgaatttcacactaagtgaactgtttctttacctctactattataaaatttgaaaatgtgtttgtcggtactttgatatgtcatccgtgtacgaatcaatttttaagttcattcgcttttggaaacacaaatacatattcgagtcggtttttaagttcgttcgcttttgaaaatacagaaggaatcgtataagaaatctctgtaaaaaactcatatgctaacttgaaatgatcggactcctaatagtagctcatgattttctaac

SEQ ID NO: 38912 - DNA, 1501 bp, Oryza sativa
cctccgccgcgccacctccgacgccgacatcgccagatccgcgcccgcgacggcatcatcgccgctgcccctcctcctccgcgacatcctggaggaggacgtggtcgtggtggtggacggcgccgggcgcggcaagggcaacgacgacgacgacaagacgtccgggcgcggcggaggcggcggcgggcacatggacatgggggagtactaccggcgggttctgagggtggagccggagaacccgctggtgctgcgcaactacgggaggtacctgcaggaggtggagggcgacctgggcggcgcggaggagtgctacgccagggcgctgctggcctcccccgacgacggcgacctgctcagcctctacggccagctgctgtgggagacgagtcaggacaaggaccgcgccgccgcctacctggagcgcgccgtccaggccgcgcccgatgactggtactaattattactactaaatttgctgattgattgattaaagacagagaatcaaacaattaacgaaacggttggatttgatgcgtgcgtgcgtgcgtgcagctacgtgcttggatcgtacgcgagtttcctgtgggacgcggaagaggatgaagacgacgaagcagaggatgagatgaaaccgccgctggtgccggcgtcctgctaacccaacccggcgtttgcctttgcttgtgtacatatgagagcttgcttttgtcaaaggcagatcgagacacgatccatcctggtgtgcctgcctgcctgcctgcgcttgtacaaattaattactagcacatcgatccttgctccatcagtttgcttcttctgtacatactccagtagctagcgccttcttgatgatggatcgttggctacatccatcgtcaatacacacactgatgaacaccagagatcaattcaactgcagtgcaagccagggcgcgcggcggcgagcagatcgagcaatttggaagatgcaaatcaggccgccgagcagagcagagcagctcagttcaagtgcggacggacggctggatgattcatccacaccgtaccacactttgcacatggataaccagacttgttgcttctttatgtaacacctcataataaattcactctgctaattaattatactcgagtcaaatgctagctactactacctctttcaagctagtttcatttcatctccctcctcactgccaggatgtattccttcctaattgtattgtattgtatactcctacaatacaacttttgttttctatttccatgtccatccattaatacatccatccgttgggacattggtgtgagtgagatcatccatcgcacaacacagcatattcaggaattttttttatttataattttttttattaaaagttttacaaaaataattttccattttgaaaattgacggaaatagtcgcctaccgccctctgggagggcgatttttaaaaatcgccctcccagagggcggcgaaaatgacgtggcagacggcc

SEQ ID NO: 38913 - DNA, 1501 bp, Oryza sativa
accctcttgcagcccttgtagagagcggcaagggactatttgtgtaaatattttggatggtataatatttttgtaaatatttaaacaataaaaaagaaaaaagaaaaaaaatcgagataaatctgtaggacttccatggcccataaacaaaggccccatgacagcatgcgtcaatagaaaagtctaccgaagagaaaaatatcgcttccccttccttgtcatccatctccaaactccaatccagatcgagtggccgtccgccgctccgcgcctccgctctgctacctgcgcctgcgcgtcgtgctccctgcgtccatccctcgccacgccttgccgcaccaacagcgctccctgcacctccgcctccctccccaatccgtcccatctcctcgcccgccgccctcgcctgccatcctgccagcagaggtggcgccgccgttctcctgctcccgctgcattcgctcaccggtgagcatcctaatccatcccatccggcctcggcctcgtcctcgaatttcgtctcctcgcccggcgtcctcctgcatccaccgcatcatcgctcgccggtgagcatccctcccttcccacacctcatcaggtgttctgcccagttccacctactttcaacttgttaattttgatttttgtttttagcggatgtaatttggttactgaatctcatccaaacacccttagaatagttgcattagaacgaaaaatgtaagctcacatcatttgtactcatccaaactcacataatttgtaatatttattaagtatcaataagtaaaacggatgatttaccatgtgacaaattaattattaaaataaattgtattcatccgttgtaatgcacggatatttttaaatgatttactagctgctgccattaggtaatctttcacatttttttacttactatgaaatccaaatctctgattcttttctttttacaattaatgtttggttcaaaacttgcccactaggtaatctttcacatttttttacttctgaatctctgaatttttttttaccattaatgtttggttcaaaacttgtgggctaaactgaagagaggtgtgctgagtggagggaggtagcgaactagattaggactaaaaaggaatgaaagaatggactttaggcccaaaactaaggaaaagaactaaggaaaattttcattaacttttttaattaaactgtatagtgatcctaatgtttcaattcattacttgattcctaattacggtggtatcactatgaaacatttttatctgttgcaatgcacggatattttttttgggaaatttaactatttgccacttttgggatatggcaattaatgatttgccactcgctgtctatgacatgtgggctctcatttgtctatgacatgtgggcctagtggcaaattgttaagcaccactcgtaagagtggcaaatagttaaaagtcccatttttttttccttagttgtaactaaatccttcacctgaagggaa

SEQ ID NO: 38914 - DNA, 553 bp, Oryza sativa
tcatgtcgtgcacccagcagatgagttgaccagctgccatgaaagtcaactccctgcccatgtgatctctttttgtctcttccaagctatagttacaaggtcactgacatgacgggcctacaaagaagtgaccagtggaagttcagaaaagtctcactcgtcagtggcaatctgtgttacagccttacagaggatggatgtgttgacggcgctaaactaatcacaatggagtcgttactcgttagtgatcatcgatagtctaatatagtttaacttttcacataacatttaaaatattctttttattggaaatttagtataaatatataaaaataagtgaagattatggttttaagtcgcaacaaaactaataatacatatgtaaatttttaacaagataaatggttaaacgctaagctaaaagccaacaacgttatatattaaagggggctgctatataacggaatcccgttttcgaacaggatgatcccgagtaggtatcaggtgtgatacctattaggtatcagacgattctacataacatgatgatcct

SEQ ID NO: 38915 - DNA, 1501 bp, Oryza sativa
aacatatgtcctttattttagtctcatctcataaaacacaaacagggagttttaatctcgtcttggcatatcgcaaaccttggttacgcaacagagctaaactgtaggcggcctgtaaccatgccattggactgtctctcacgtctagtcagtgtcagcaagagtccggcaacccggctgaacaatggtaccgttggccatcacgaaagcgttgtcggatggtattggtaccaccacggtctcttttcccctggatgcatgcacccccgtaagatatttccgccagccaataaggaggcggattgaactctctaacatcgcacccacagataataaagcggctcctccggctaggaatccagcttttcagaagctccagagacggtcaggccccgcatgtcatccagtgcaaagcagttagtactccccccgttgtaccaaccaccagggccttgtcgtgacagcacaaagcgaagttgaaacgggaaaagggtaacgcacgttgcagcccaacttggtggccgaacaatgggaactcgccacctgaacgcaaccggatcggcgtcgtgcccgcacgcaaagcgacggcacacccgcacacaccccctccgttgcgccgggggcgagccaaccgaagcgaagctggtgtggctaaaccgtggtcgcgcgtgggcgagaccacgagagatccggtgaaaaagtggctgccgacttggacttccgcctcggtcgcgcgcccgcccgccaagttgccggtggtgccgcgcgtgggcgtacgagtcaaagggggccaaagggcgcacccgttgtttttcccctaatccggcggcgtttcgttttcagggctgggctggctatccggcgcaggctgatctgatctgatcggatcggatagctctcgcgctcttcgactagtcatgcgtccgtcccgtggtccttttgcttgatcttagccgcaaaaggccagcctgcgtcgcgtcgatgagtcctttcggacgactacgcacaaaccgaacgaaattcagctgaaaccgccaactgaatcgtgtaatctgaatttagaagccacgctgttaaacagtggatttttgtaagatatttttaggtagtgattaaaaacgattgacgctggcaacatgaatccgtgcactccctgttctctttttcagtagggaggaagctggttggcaggagataggaatcgagacaacttcgcgaagcctgcctatgatggcattgtactatgttatgccggggaccatatgggttatctcaaatttcttcgcttttactccaaaaccggaaccgccagggggaatgtttctcgtaccttgtctgactcagcgatggtgacattgatagatctctatcgatagccaagccgaagcaagaagaactatcttctccgagcaccaatcgtgtattccgtcgaatcgaattcgatcaagacatgcagtaaagcagctgatgactcgaaacctggtgattaaccacaggaaga

SEQ ID NO: 38916 - DNA, 1501 bp, Oryza sativa
acaagccgaaatacacttcctcctctgtttttataatgctatgtatctactgtactaactctacagatttacatgttattcagaagccggtataaagtacatgtgttctagttctagttaggattcaggagcgggacccggctcataaaggtacagtacaggctttctgaagggaagagggagtacaaatagaccagtagttcatcagtccatggttccgtgtatagtccttgtcattctggggcacgaagaaaaaaatgctccctctattattttgcaatacatgatgccgttgatttttaaacacacatttgaccattcatcttattcaaaaatttacataattataatttattttattgtgagttgttttattattaaaagactttaagcataatttatatcttatacatttgcacaaaatttttaaataaaacaaatgatcaaacatgtgtccaaaagtcaacggcgtcatctatttaaaaaatgaaaggaggctttctgaagggaagagggagtacaaatagaccagtagttcatcagtccatggttccgtgtatagtccttgtcattctggggcacgaagaaaaaaatgctccctctattattttgcaatacatgatgccgttgatttttaagcacacatttgaccattcatcttattcaaaaatttacataattataatttattttattgtgagttgttttattattaaaagactttaagcataatttatatcttatacatttgcacaaaatttttaaataaaacaaatgatcaaacatgtgtccaaaagtcaacggcatcatctatttaaaaaatgaaaggagtatacttcaacggtctgtggctccgtccttatcatttttgggccatatcgattcttttcagtgaaggttctctgaagttatgaaatatactcccatttcatattgtaagtaattttagttttgttgagagtcaaaattctctaattttaatcgtcttatagaaaaatacaccaatatcaacaaacagcaaataaatgcactattaagaactaaaatactcactctgttttaaaatataaggactttactcttaattaaaatataaggacttagagctgggtactgatattaagaataaatctaaaataaaaaagaagaatagatgtaattattaaaataagacattaggtagagaaattaaattaaagttcctggagttttcgcttgctcaagaatggtatagacatgtctcacgggatttcatgcttctttcggatgcgaacatgcggtgcatgcaccagctattgagcatgtccatcgcattaatgatagattctctcgagttgtcgtgctaccgtatcgtggcaagatagcttctatccagaagtcatgatttttctccgggggctgctatataacggtatcccattttcgaacgggatgatcctgagtaggtatcaggtatgatacctatcaggtatcagacaattctacacaacaggatgatccc

SEQ ID NO: 38917 - DNA, 1501 bp, Oryza sativa
atccgtcattagcgtatgtgcgttactgtagcacttatggctaatcatggattaattaggctcaaaagattcgtctcacgatttcccccctaattatataattagttttttatttatctatatttaatgcttcatgcatgtgttcaaagattcgatgtgatatttttgggaaaaaaatttaggaactaaacggggtctaaacctataagctaaaattggatctgcacgttagaaaaaaaacaatttttactggaactatgcgttaaattgggagtcaaatttgtttgttttttaattgtataaattaattttattttttcttatttgtatagtgatatatcacatatatcgatctaacttattaaattaaacgataatttttttatagtattttagacaacacaaaaaattaaaagacaaatagatgttggattgagatcctctgacttaaaagccaccgtgcctttatcatgttgatacgtgaattcatggtttatcacatcacgtgtcaatgataaaatacttattttaaagtttatcggactcatataacaataacaaagatacatagtatgtttgaattgaaggtagatgtgccagatccataggtgccctagtgagactgtcggctgtctgcatccaacaggaactcggcaaacgccgcgcgcgacgatccgccgtcgccccatgcaacggctgcggcttccttgtgcgtcgtgacccgcgccctgagttggttgcctgcctcggattccatgaccagcctcaccttggcctcgacctcctctgccgtgacaaggccctgctgccacccgaccatctccacagcgatgcccatgtcctccaccatgagaaccttgttcatcttctgctcagagtagagcggccagcacagcattggcacacccgcggtgatcccctccagcaccgagttccatccagagtgcgtcacgaacgcgccagtcgcccggtgatggagcacgtccacctgcggcgcccattgcttgactacggcgccctggccactggttcgctccaagaaccccgccgggaggagcgcttcgaggtccggatcggcccgagggtcgtatggtttctccggatcgttattgacgacgatgggggcgcgcactacccacagaaaccggtggccggatttctctagcccgacggcaatctccttgagctgctttttggagtggttgcccgtgccggtgctaccaaagcagaggaacacgacgctgcggtccggttgccggtgtgaaactatattgtatacatgcgtgtgagatctgttagattggataagatagagtttgttaggttgttagcctcttctatccatcaaaacagactgcatgctatatggatgtaaaaaccacggtgatggttgttatcaccatatattaacaaaggtgcggcctctaacgaggttcaacgcttctgcacctctgattttcacatggtatcagagcctatccatccacaaaatcgcatctaa

SEQ ID NO: 38918 - DNA, 1501 bp, Oryza sativa
aaccaaacattaatggtaaaaaaaaattcagagattcagaagtaaaaaaatgtgaaagattacctagtgggcaagttttgaaccaaacattaattgtaaaaagaaaagaatcagagatttggatttcatagtaagtaaaaaaatgtgaaagattacctaatggcagcagctagtaaatcatttaaaaatatccgtgcattacaacggatgaatacaatttattttaataattaatttgtcacatggtaaatcatccgttttacttattgatacttaataaatattacaaattatgtgagtttggatgagtacaaatgatgtgagcttacatttttcgttctaatgcaactattctaagggtgtttggatgagattcagtaaccaaattacatccgctaaaaacaaaaatcaaaattaacaagttgaaagtaggtggaactgggcagaacacctgatgaggtgtgggaagggagggatgctcaccggcgagcgatgatgcggtggatgcaggaggacgccgggcgaggagacgaaattcgaggacgaggccgaggccggatgggatggattaggatgctcaccggtgagcgaatgcagcgggagcaggagaacggcggcgccacctctgctggcaggatggcaggcgagggcggcgggcgaggagatgggacggattggggagggaggcggaggtgcagggagcgctgttggtgcggcaaggcgtggcgagggatggacgcagggagcacgacgcgcaggcgcaggtagcagagcggaggcgcggagcggcggacggccactcgatctggattggagtttggagatggatgacaaggaaggggaagcgatatttttctcttcggtagacttttctattgacgcatgctgtcatggggcctttgtttatgggccatggaagtcctacagatttatctcgattttttttcttttttcttttttattgtttaaatatttacaaaaatattataccatccaaaatatttacacaaatagtcccttgccgctctctacaagggctgcaagagggtagtccgtccctcacatcaccctgtcgctctccccgagggcggcagggtctacttctgtaaatattttctccggcacaatatttctgtaaatattaaaaaataaaaaattaaaaatgaaaaaaatttgatttatctctacatgtaagcttgttaagcctcgcgagcaactcgtgagccagctcgagctggctcgttatgcctaacaagttgaaattgcagctcggcttgtttcaaaaccataacgagccgagttcagtcgagccaagctggtcacgagccacgagcttttcgtccagccctatgggtcatatgcacaggcccatgaagctggaattttttcatcacccaaaaaaagttcatctaatgtccccttatcgttgagttttaaacggtcctgaaccctctaatcttgtaaaaccggatcacttttgataccaaaggtagtattgttt

SEQ ID NO: 38919 - DNA, 1397 bp, Oryza sativa
ctgtctcctattcacatgctttaaaatagatttgagtttaataattgcgcgtagtcttttatgagagtcgatggttttccatatccaacttgttatgagaaatgtgagaaaataaagttctgttgagctgtattttatagtcaacagtactgcagaaccaaatgttcgaagcaaatgcacagaaactttggtgtttttcccttacaaagcaagttactgaaaatttataaacacattttcaaatatgtgacgatacgctttgactttttagatggcttgctagcagacaagagcgaaaatacagcttcgtccgagctatttgatgaacgcacaagcacctcttctttatgaaactcaacagatccaactgatcctgtgtgccctaattaggatatttctctcaattaatttaaggctgttaccagaatttttatttcaaatgcttccttgaactacaacagttcggatatctctcaaatgcagctgatgtagatagccctaattgaagaaacagtatatttctttcgaagttgcaactcaattttttcttgcttttttacgtaccttcgtacatctaattttaggtttctactataccatagatacttgtaatccaaacatcctttttaagacgtacatgcaattggagaccactgaagtgaccagccactgccaggttgtggtctctgcttcttctaataagtaaccgggtttcttcagaaccgacggatcaaattctacactcattccaaaatactggcatggttatattatgcataaaaattcagaataaactgaaaggttgatttcaaatactacagagtgaggatggttattataaaaatttcagaacatgaaccagttgctaatccacggctgaaatccaaccagcagagtgagggttcaccctggagcaaagcagctgtgcatcattagttaccatggttaggccctgcaagtcaaatacgaaaatgaatcaatcaattaagctgaaagtagcgtaaaagattctaccttgtatctgaactctgaaggaagcagtatgattaaagaggatcacaccatccattatgcacttcatgaacagcatagatatccttattcattcaaaccccctgatctgataaatgaatcgatggagtcaacatggatagcagttttcatttcattttttaaacaacgagtcccccttcagcctgaaacaatgaacagtcacaaatgtatcaactttgatttaagaaaaaaatcatagaagtaatttagtttgttatgatagaccatcctctataaaattgcaactatcagtctcacaaatagagaactgattaatgattaggtcatgccatagactattcaattttagttctgggaagttcagttttctaaacatagctcaa

SEQ ID NO: 38920 - DNA, 272 bp, Oryza sativa
ctgtctcctattcacatgctttaaaatagatttgagtttaataattgcgcgtagtcttttatgagagtcgatggttttccatatccaacttgttatgagaaatgtgagaaaataaagttctgttgagctgtattttatagtcaacagtactgcagaaccaaatgttcgaagcaaatgcacagaaactttggtgtttttcccttacaaagcaagttactgaaaatttataaacacattttcaaatatgtgacgatacgctttgactttttaga

SEQ ID NO: 38921 - DNA, 1224 bp, Oryza sativa
cccccccccccccccccccgagggggtcaggccacgtgggtgaccgcggctacccaagcctctagtcacgatacccccggccccatgtcaccgacaatatgtatatatatatatatgtatatatatgtatatacatgtatatgtatatatatgtatatacatgtatatgtatatagatgtatatacatgtatatatatatatatatacatgtatatatatatatatatatatatatatatagatatatatatgtatatatatatatatatatgtataatgtatatatacatacatatatatacatacatatatatatacacatatatacatacatatatatacatatacatacaaacatatatatacatacatatatatatggcaacatatcctatgcacacaggccctcacgtgtacacacgtgcacaccaactaaaaaatgtcaccaaaaaatctagaaaaaatcatacatatactttcaattgtattacacccagggttaaaatcttaacgtcaaattcattatattttagccgtaacaaaaaaacaaaaaaactgacagttttaaggttgcaattttgtcagaattttatcttttttgttattctctatgtagaatgaatttgaagatgcgactttgcacgtagatgtaatactattgaaagtacatgtatgaattttcctagaattttttgtgataatttttagttggtgtacacggtgtgtacacgcgagggcatgtgtgcataggatacgctccctatatatatatatagttagactattctatacccccctcccctcccaatttccccccaccccacgcgcctccccctccccacccgagtgctcctcgcgattcctcctcccccccacccccggagcgctcactcctcctccctccttttttgagagaaaaaaaataaaggaaaaatttgccttcaatgggaatagaactcaagaccttcaactcaaattaacacatggcactaaccaataggctatttcttagttgtgatagagttttcttagtaaaacttatcttctcatacatcacgaaatatagtagcgcgtccggttactacaaatatataggttcttattacagccaagtgactagtattgctgggttaaagcctcacatactaaccatatacttgttactgcacaaaaatagaagtgttactacatgataggtgcatgttaccactttcaagtaacta

SEQ ID NO: 38922 - DNA, 1501 bp, Oryza sativa
aaacgccggcataaaagatagtataaggtgatcttagtactagtctaggctatagttaaacaaatagttttactcattcatcattcatcatgtcacatatccaattatccaaattaatctgatgagtcgtatcggacggcatcgacgcctccctcccgatcgcgcccctcccacgccccctccccatgcacctcctcctcccacaaccctcccagaaaccgcacctccctcccacgcctccctccgccgtctccgccgctgacgccggaaaccgccccaatctcctcccccttttcattcgcacaccctcctcacgcccacatccatcccgtcacccgcccactcgccgtcgcacgagcctccccgtcgtcgatcccctcccttctcaccctcatcctcaggtattgttgccgattgtcctgtctccgctcgtcgccggcccctcatagcgcaaatcgtcatcctgcatcgtcgattccccatgcctcgatctcccgttgggcttcctgccgctcgccattgaccatcgcccatggctcctccaagagtcaccgccgaatccggttctttcatcttatgatggtttgcctgttctctgcagttcagcttggtagatcagtttagcgttgagaagcaagctgttaaaacatccacttaatgcagaagaggtcataagctccactcctgaaaattccacattttttagatatcctcacattattcaccctatatatgttttcagttgttcctgtatatttggtacactattctcgtttaagttgtatgtcagttcaaatagaatctggagcgatgctaacttatggtgccagcttcgaaatttgattgctcatggagacaggggacagattattattttgtctaaacatttctgaaaatataattctgaaactatggtgaaatgaaacactctcatttctgaaaaattcagctgctgtatgggttgctactagcctacggaatacatggttcagttttaacctggcaatgttttcttcgggttctggtcattatggtgtcataagaaatagtcaggccactccattcaaaaaatgggaaagacaataaagctttttcagtcaacaagagacgataaaggactatttttgcatgtgctcttttgcttggagtattgtgtgattatatagctgattgagctatgtttagaaaactgaacttcccagaactaaaattgaatagtctatggcatgacctaatcattaatcagttctctatttgtgagactgatagttgcaattttatagaggatggtctatcataacaaactaaattacttctatgatttttttcttaaatcaaagttgatacatttgtgactgttcattgtttcaggctgaagggggactcgttgtttaaaaaatgaaatgaaaactgctatccatgttgactccatcgattcatttatcagatcagggggtttgaatgaataaggatatctatgctgttcatgaagtgcataatg

SEQ ID NO: 38923 - DNA, 326 bp, Oryza sativa
gggcgtcgggcccgagggtgacgtggccacccctccctctgtctccccgaggggtcgggccgctcccgtttcggccccgagggctggggcgccccgaccccctgtggttttggcgccacgtgtgtgggttaggtaagcacagcgggactcacctaaccgcatttatagcgggttggactagcgcgccacgccgcatttaatgcggcgcagcgcgcgcttatccggtccgtgaccggtcgcggtgtgtgaccggtcacagaccggtcagatcgcgggttaggtggcaacaggaggcctgtcacacgcctcgccccgtcccgtcggaa

SEQ ID NO: 38924 - DNA, 1501 bp, Oryza sativa
tgggattgctcattcgctcgatccccttcctctcgctgtctagccttctaaccacaagcttgctttgtccctgctaccaacgctggatcacctccctcctccatccttacggcttcaacgcagccgcttgtggctcatcgctcgcccatatccactgcccaccgccacccatggctatccatctaagcttgactttctcggttcgagaagtgcattgttggaactggattggctctctcccgctctttcctcgcccccacctcccccaatctctaacccaacccgggatcctacatccctaactccaccacctttgtcggtgtcattggagccggcggacccggagaaaaagctaataccagagcatgaatctgtaagattttggcccaataattaatctatcgaatgccatttagcatttcactcatttatttgttatttatgagttatatctatgttactgtcaaattggataaagagtacacttgtagttaaattgagtgactctatattctatactctccccgctcaaaatattatgcgtattctgaccgtttaattttacattttagttaatgatttatttaatactatattcgttttaaaatatagtaccataatttagataaacccttgtccaaatatataaccagaaattattatattttacaacgcacatagtactccctccgtttcacaatgtaaatcatcctagcatttcccacattaacatcaatatgaatatagaatatagaatatctagattcattaacatcaatattaatatagaaaatgctagaatgacttacattgtgaaagtcattgtgaaacggaggaagtaatatttatgttttgccataaaattgatattgtcaaatttatgtcaaaactactttctcgtgactataattttacaatcgtaagcgaaaattgcgtaagagaaattacagtagacaaaactgaaataagaaagaaagaaagaaaataagatcatttaactacggagagtcatgtaacataatttagagcccacaagcagatcaaagtcacaaaggcaaaaactcctttgatccagacatccagtcacttcttctgtgtcccacattaattctcactgatggtggttagaagcagatccatctctctcagcctacagtagtaaacttttttcttcactgcgacaataattcgcagaataatctgttccaaacgtttgccaaaatcttcataagttcctatgtgtggagattatgggtaccccatacccacacggtatggttatccgactagttataggggataacttatatatatatgaaatatgtaacagatcatgacttgggtattacgtttccctgaatattatggaacggcctaaagtcctggtttgataagattgtaaagtagatttaggaaaccgataccgtattggttaaggtttctatcttgtaaccctgccccccaacctatataaggagggcagggagcccctctaggggca

SEQ ID NO: 38925 - DNA, 615 bp, Oryza sativa
ctcccctatacgatacactcctccctcctctccccccttcctcctccccttcttctcttcctactatagtataccacacaaaacttttttaaaaaataaaaaattagaaaaatttatgtatagaaatactatatataaaaaatttgaattcaaattcaaatttaaatcaaatatgtaaactttttacttataaactttgggtctataaattttaggtgtataaactttagatgtatagaaatactatatatataaaatatttgaattcaaattcaaatttgaattggatattcaaattcaaatttaaaacgggtatgtaaacttttgacttataaactttaggtatataaactttaggtctataaactttaggtgtataaactttagatgtatagaaatactatatatagaaaaatatttaaattcaaattcaaatttgaatcggatatataaacttttgacttataaacttttggtgtctaaactttagatgtgtaaacttgaggtgtacaaatttactaaagtagaaaagtaataaggtgccaaaaaagaaaaccaggtggaggggtggtgggagggaggggggaggggatcgatcactaccccgtctccagg

SEQ ID NO: 38926 - DNA, 738 bp, Oryza sativa
cttatagacattttataaaatgtctcttcgtttgtagagacaattcaccataagacacttattagacattttttttaaaatgcctctataatattgtaaagtcatttgaaaagtgcctctacagtataaaaaaatgtctatgcaaagctttttttcttgtagtgtttgtagatatagcatgaaaggtttaaatgcaagggaggaagagaagatcatttgtagctcagaattaacaccactttctatgatacgcattcaatagcatgtgtggatattgtggtcctaaagactatgttgaaggatgcttttgaccgacaatcgtgtggaaggatattttttgataaaggacatatgtacaaaagcaacaaatgacccgatttataaacttgacgcatagatttttgttttgatatggacgagagagtgtgggaagagacaagggggattgactttgacccaacattcgtatgggagggtacttttgataaaggggtatgtacaaaaacaataaattaatggaccgatatatattgctgacgtgtagattttgttttgagatggaggacagagagcgggaaaagacaggggagattaactttcgctaagcatcgacgctatgctccaagtacgatgaagtatgcaaccttgaggaggaaccatgcgcaagaaaaaaaaacacttgcaatggaatcttagatccactgctagcgggcatgtgggaggggcaaaggggcaaca

SEQ ID NO: 38927 - DNA, 1171 bp, Oryza sativa
atccatagattttacattaatctttaaacatacaccttttacaagcaaattaattgctactattgctcaaattttctttgattctgtattgcagcagttcattccaatgttgataatggtgaaatgaatacagttcaaggttacaccccactttatactgtctttttatcagaagcagtaaccattgattactgaggcctctcatctcgcgattactgaggcctctcatctcgcagcatatgttcatgctgggaatcaacaatcttgggtagcaatagtcagcatgtttttcctcatctccttttttcatgatgaaaaaaattacatgctggcgtgctgcatacacgaatcaaacaaaagtagattttgacctcatactctaggttttattagttggatttgactaataactgtaagcataacactctaggttaattgagtgtcagtagcatcttctaaaaaataaagaaaaaaagaaaaaaaaatggaggcagcctatctttacatctacacagattttacattagtcttaaacatataccttttacaagcaaattagctgctctatgaaatgttcaattgtacaaatttccattgattattcttattgcggttcatttctattttgattcggtgaaatatatacagttcaaggttacacaaactttttactgtctctatatcacaagcagtaacataacagaacaatgaacctgatggcatgctgcatacacgaatcaaacataaatagattctgtgactttctgattatactaatgaagccagtaaatttctgtttcctccacttcgagaaccacatggacaagtgattgtttcataaaaacgaggtttcttccggacaatgcatctaactaaaaaaacatttttcgaatgaaaaaatgttatccagtgaaagactaattaggagataataactcgtcctctgtagttcagggttaagaaattccaaaacacttgcaaaaacatagataaaattcaggtcagcaaccagagtgtcttcactcttcagtaccaggcttcaggaccttaggccctatttggtagaattccaaacttaaactctcaactctaaattccaactccagtggaagctgcctcctatagaagctgagtgggtatataaaagtgtttggccacatccttctgaaca

SEQ ID NO: 38928 - DNA, 809 bp, Oryza sativa
tacttttttgtttatttttaacgaactctgataaagcttgcagttcttagggattttcgtatgatttgaggcaatactcccatggatctgctggtttttttttctctagaatttcattacaagctttatactggtagcatggaatttatcctaaagatctttaaattttggctgctagtttgaataaatccctcactattcgtaagtattaatttcttcagcactctaagcatgtcactatcctcctgtcaatgaatgctttattctgtgataatagtaattttgttgttgtttggactgtacaacatttatgttcctatgagagaatagtaattttagcacaattgagcttgtaggcagtgaataaactttaagcttcataaaaagagtgattttctcttaaaggatgatacaccatcatcctggtgcatcttagtataagcatgacatacatatttttcttgaaagtttcacctttactatgcaaaatggaactgtaatgttggctaatatttacagattgtgtcgaactcatctgaagtgctgacaagttattgcttaccatcgtctcattgtcaataccaaatccgaggtaaccaggattttcaacttacttcactgtaatatattttgtgcagtaagtgatagaacaataacaaccttcacatgaaccttttcattctaaatgttgattatattgtacataatttctttttgtgctatcctttgtgacgtgattaatcaagtagatgatgttatttatggtgtgataaataagagtgacatatatgcacgttaaaataatttat

SEQ ID NO: 38929 - DNA, 1024 bp, Oryza sativa
aaaactttagctcctaatttctttcttgtcatacctttgattcctattatatacataccttagtgaatatatttataccctgaatactttaatccattttcaaattccttggctacaatttttaactcaactggctttgttaaaacgcttaactctacttctctagatattctgtataacccatttttattctcaaaaatcccatgcaatatatttgttgaggtcttattgccctcagagtatctctttgatatctttcgagctgtttgtctacttctgcaatatcttcaagctcatctatgtcttcatttttacctttttgtttatcaatacaacttaaagatttatcgtctctgcttgctattcttctaaacaaactcctagataggtccatttttctgaattaatagcttgagacgaggtaattatgcctgttgaagccaagactatctcttttcctttactagaatttattatttctaataattctttgatatagtcactgttttgtaatatcttattctgccttatcttataatcctctagctcttttagcactgaatttaatttattactgacaagcaaatattgttcttcagattgctttcgttctttaaacaaatcttcaaaccttcgctctaaatcttcttgctttttatcccaatttatataaaaattatatatcagatcaacaattaaatttaattgactattgttagagtgccaactatggtcttcaatgtgatttaatctacaccttatattcaaattatctttggtagtaattatctttccaatattagcttctgaatttgatttctctataatgactggctctgataccacacttatgcttcagacaaaaaaaaacactgttcaaaacactatttattcggctgaatactattcagtttactgtttattcggctgattactattcaaaaacactattcagtttactgtttaaattactgttcaatactgttcacttcgagagatattttaactttaggatctttgcagg

SEQ ID NO: 38930 - DNA, 1296 bp, Oryza sativa
agaagataagcatctccatggtgcgagccagctcgtgaaaatacagtatctagaagataagcttgaagcacagtcgagcctcccgagctcctataaaaggaggggtttgctcagctgagaagaacaacaacgaagacaccattcagagcaaagcttccaagcgcgctctcaccctccattccaccattcttagtagtagtgactttagcctaccttgcatagtatattgaagcaaggagttgtgtaataacgctgtgtaaggtaagaacagcttgcttgtacctaccttcgggtttcccgaaaagcaaaaccgtatgtaagcttatctgtttaatatgaagtaattttccttaagtattcctgcacgtttgttctagacaagtgtttatgctaaggaccctataggagaaacctcttccgttttttctcgtttttagcctgcatcttgcataggcgtctggagaatcggtatccgtagagaagtgttcccttcgggtggaactgcctggggagacgataaactcttggctagaacaagtgtgacttggaatatctttttaagttgcttctaaaaagatagataggtgaggcatacggtgagtaccgagtaggactttacatcatccgaagcaagcttctgaggctgtctaaataggattcgccaccctgcaaagatcctaaagttaaaatatctctcgaagtgaacagtattgaacagtaatttaaacagtaaactgaatagtgtttttgaatagtaatcagccgaataaacagtaaactgaatagtattcagccgaataaatagtgttttgaacagtgtttttttttgtctgaagcataagtgtggtatcagagccagtcattatagagaaatcaaattcagaagctaatattggaaagataattactaccaaagataatttgaatataaggtgtagattaaatcacattgaagaccatagttggcactctaacaatagtcaattaaatttaattgttgatctgatatataatttttatataaattgggataaaaagcaagaagatttagagcgaaggtttgaagatttgtttaaagaacgaaagcaatctgaagaacaatatttgcttgtcagtaataaattaaattcagtgctaaaagagctagaggattataagataaggcagaataagatattacaaaacagtgactatatcaaagaattattagaaataataaattctagtaaaggaaaagagatagtcttggcttcaacaggcataattacctcgtctcaagctattaattcagaaaaa

SEQ ID NO: 38931 - DNA, 1454 bp, Oryza sativa
atgttaatacatcttcttaatttttttcaatttttttcataaccatttgagtgatatgcaaacaacgagtggatatcccctccagggatgaaaattcactccctatgtacaactgtacactcatggacactcttgggctggagaatacacgataactgacagcaatttggcaggaatgaaaattgaggtcagcaatgagcgatgtgtatccccttttctgtagaatccacggagtagtactcttgtaagcttaaatcatcgggaatgctaggggacggtatcccgtccccgaacgggatagctcctcctccacaacgcgattcctgctcactcgctgccgtcgtcgtcccccgccgctgccgcgactgtcccccctcgcctccgcctctgccgccgccgccaccgccgccgccgccgccgcgcccgtcccccgctgccgccaccgccgccgtcctcgtttacgagggacggctgcagggtactgaccgcgcgtgtcgaggtgctcctcccccaacaggatgcccagctatatccagtaggaatcacctgatacttggtaggtatcatccgatacctcgcaagtatcacgcgatacatggtagaaatcgtctgatacctgacaagtatcacatgatacctcgcgagtatcacgcaatacgtgatagaaatcgtctgatacacgacaggtatcgcatgatacctcgtgagtatcacgcgatacgtgattgaaatcgtctgatacctgacaggtttcacatgatacctcgcgagtatcacgcgatacgtggtagaaatcgcatgatacctgataagtatcacatgatacttgcaagtatcacctgaaacgtgtgtagaatcgtctgatacctgataggtatcacaccatacgtactcgggatcatcctattgtgtagaatcatctgatatctgataggtatcacacctgatacctgctcgggatcatcccgtttgaaaacgggattccgttatatagcagcgcacagtgcgagtttcaaacctgtaggctgagcattgaagttttgtagaaattatacgagcaaccgaggcttaaactctcccctcaagtggttcgcgagaaggcacctcccttaacactcgcatagactcaccgtgtcgccggctcgctctaatggagcccaattcaaaacagagtcagaccgtggtgctgcacaccatccttggcgccggccatctcgcccccatggtggagctcgccaagctcttcctcggccgtggattcgcagtcatcatcgctgtcccgacccctccggcttccaccgccgacgtcgccgcctcgtcggcccccgcggtggcgcgcatcgccgccgccaacccttccatctccttccacaacctcccgcctccggactaccccgagccggaccctgacggcttccagcagctgctcgacgtgatccgcctcaccgtgccaa

SEQ ID NO: 38932 - DNA, 1501 bp, Oryza sativa
accatggactgatgaactactggtctatttgtactccctcttcccttcagaaagcctcctttcattttttaaatagatgacgccgttgacttttggacacatgtttgatcatttgttttatttaaaaattttgtgcaaatgtataagatataaattatgcttaaagtcttttaataataaaacaactcacaataaaataaattataattatgtaaatttttgaataagatgaatggtcaaatgtgtgtttaaaaatcaacggcatcatgtattgcaaaataatagagggagcatttttttcttcgtgccccagaatgacaaggactatacacggaaccatggactgatgaactactggtctatttgtactccctcttcccttcagaaagcctgtactgtacctttatgagccgggtcccgctcctgaatcctaactagaactagaacacatgtactttataccggcttctgaataacatgtaaatctgtagagttagtacagtagatacatagcattataaaaacagaggaggaagtgtatttcggcttgttctttcctagccactctcctatccgactagatggattctaattgtccgaatgaacattcgcttgtatgtcaacaaaatgctttcaatatttttaaatgataagatagattaatatgtaatatttcgctccacaaacatgtaagttaaaattcaattttgtataaattgtaataaatataacaatttagacattaactagcatatgtatattcatgttaaatttgttatttttttactcataaaaatcaaatttaaacttatatgtttatggtgggtgatatattacattgttttgtttcttttcgtgctgactccgttctgacttccgaccacttcaccaaactgggctaattgaccgctttactattgaggcattgaccaccgtcttttgatccacaagttttcttcgtctccctctagagaacttttatattggcagaatatactatcaacaaattgtaccatagaagtcatcttgttaacgtgaaggaaaaccgtagtgcgatattaagtacgatgtgtattgctatcaataggaagcagcgatatataatattcatcagtttttaggtgaaaatctttgaagtgtaaaagtagtataattggggtataattacaatgtaactctcgtatgtaattgagtaaaacatgttggtgcttgactagctagggttgcaagcttgctactcccactagcgcacaaatgtgcgaattttttaatttcctctcttcacgcaaatctcggtacaatattccaacgatcaaaattcataagttttgaggggaaaacatcggcgtaattttttttagcaattccgatcaatgaatcaacgcaatgcccatcaagccatgaacatcgaaaataatgagtgaatgacaacgttgtaccgaccgcgccgatgtgcaatcctggtccaacaatgccctccgagcctcccctcaacatattt

SEQ ID NO: 38933 - DNA, 1501 bp, Oryza sativa
gtcgactcgctggaggcacgggtggtgaacacgctcaggcacgcacgccgtcaaggcggccgggcgttgccgccgttctactgcgtcgggccgttggtcaacaaggccggcgaaaggggagagcgacccgagaggcacgagtgcctcgcatggctcgaccggcaaccggaccgcaccgtcgtgttcctctgctttggtagcaccggcattggcaaccactccacggagcagctcagggagatcgccgtcggcctggagaaatccggccaccgtttcctgtgggtggtgcgcgcccccgtcgtcagcgacgatcccgacaggccggacctcgacgcgctcctcccggcggggttcttggagcgaaccagtggccaaggcgccgtcgtcaagcaatgggcgccgcaggtggacgtgctccatcaccgggccaccggcgcgttcgtgacacactgtggatggaactcggtgttggaggggatcaccgcgggcgtgccaatgctgtgctggccgctccactcggagcagaagatgaacaaggttctcatggtggaggagatgggcatcgccgtggagatggtcgggtggcagcagggccttgtcacggccgaggaggtggaggccaaggtgaggctggtcatggagtccgaggcaggcgtcgagctcagggcgcgcgtcacggcgcacaaggaagccgcggccgtggcttggaccgacgttggctcgtcgcgcgctgcgttcacagagtttttatctaacgcagacagccgacagacatcgtgagttcgtggccgtatcgtgaactccggacatgggtggaggcataagtctaacgggtgaccgttcgagcgcagcccggacacgctagcgcattcggcccagtccacatgcattaggccaatcatgatatgctattccaagaaaaacgtactacctccgttttttaatagatgacaccgttgactttttctcacatgtttgaccatttgttttatttaaaaaatttacgtaattataatttattttgttatgagttgttttatcactcatagaactttaagtgtgtttatatcttatacatttgcataaaatttttgaataagacgaatggtcaaacatgtgagaaaaagtcaacggcgtcatctattaaaaaacggagggagtataaattttgttgtatatgtaaaatttatatatacttggtacttgctgaatacccataatttaccaaaaataaaaatatattataatattgtctaaaagaaatacagataagattcctataggatgtgttataatccttttgctatagtaaatattcaccttgttttggtttaatatatactccctccgtcccaaaaaagacaaaccctggtttccgtgcccaacatttgaccgtccgtcttatttgaaaaaattatgaaaaaaattaaaaagacaagtcacgcataaaatattaatcatgttttatcatctaacaacaatgaaaatacgaattataaaa

SEQ ID NO: 38934 - DNA, 1501 bp, Oryza sativa
gttgcagtgtcaaccatttctgtataagcaaattaaaataatgcatagtcttcaaacctgaccaatactagcgaccaattattcagagccacacaaacaacatgaacccactagactggaaatcactggctctagtcaaatgcaaattctctaagctaactgaaatgcgaaattaaaaaataaggaatactagaagaagagtatagagtccatatagaaatacaatttaaaaaatagaaaataggaaataaaaaaaggaatattagaagaagagtatagaatccctacaggaatttagaattgaataaatttcagaataaaaataataaaattaaaagtagagcttagagtccatatagaaataaaatttgcaaataactaatattcaaaattaaaaaaataatatgggaagaagagtttataattcatataggaatataatttagacatactgaaattcgaaatttaaaaaataaagaatattgaaagatgagtttagagtccacatagaaatacaattagagatcattgaattcagaattaaaaataaataatattagaagaagagcctagagtctatgtagaaatataatttacaaataacaaaaattcagaattaaaaaataagaaatattaaaaagacgagtctacagtccatatagaaatacaatttagaaataactaaaatttaatattaaaaataattaataactatcacgtatatacagtacaacatgaatattacacattgatagtttggtaaagttagtacaaaatttaaaattatgttatcattttaatatattttaataaaaaaagaaaatataataatgctagcctcgcaatttgcgcaaacctctatactagttcttattaattttttaactcatccctaattatatggatctggtccgttacaccgtacagaataaaaactttcttttcttcgtcattgctcacgaaaacggccgtgacgtgagctacctggtctctccttcctcacgtagacttctacaaagcccatgtgaaatttgtgtcgatcatgcaactcaccgtgaaacgtttcaatgttgctcgccatggccttctttgccaagaaatgggttaccattcaacgccgctcgcactatttagcttgtgggttgcgagattatattggtaagccaatttgagagcatttgctacgtttttatgcatactgtttgatcggaacaactcgtagccatgacgacaaagacgtttgtcatgtacccgtcgctgggcgtcggccacctgaaccccatggtggagctagccaagcacctgcgccgccgcggcctcggtgtcgtcgtcgcggtgattgacccgcccaacaacgacgccgtgtcggccgacgcgatggcgcgcctcgccgcggccaacccttccatcacgtttcgcctcctgccggcaccggacagtcctgacgtcggcgcgcacccgatcaagcgcagccacgacacgctcaagctcgccaaccccg

SEQ ID NO: 38935 - DNA, 1501 bp, Oryza sativa
gagctgcatcccgtccaccacgagcaccttgttcagcctctgctcggcgtactgcggccagcacagcatcggaactccggccgtcgccgcctccaggatggagttccacccgcagtgcgtcacgaacgcggcggtcgcggcgtgccggagcacctccacctgcggcgcccacgacatcaccaccattcccctctccctcgtcctctccaagaacttctccgggagcagagcacccaggtctggctcagaacgcggcagggagaacttggccgggtcctccggtggtgggctccgtaccacccagaggaaacggtggccggaattctctagcccacgagcaatctccttcagctgctccgccgagacggcgcccatgctgccgaagctgacgaacacgacgctccgctccggctgcgcgtcaagccacgcgaggcatgcgtggcgctctcctttcgccgcgtcctcgcccttcacgatcagtggcccgatgcagtacaccggcggcgtggggcggtcgggcacgcacgcgccgtccccgagcgccgtcacggccttcgcctccagccattcgtaggtgttgatcagcatgccccgcgcctccggcatgcggcggtagtgatagaccagcgaagcaccgatcacgtccgcgcagtcgagcacgttgtgcggcatgtccgacgccgggatcggagggacgccgggaaagtggaggagcgccttccccatgtccttcaagtcgccctccgtggtggcgaagtagtgggggaggtggaggaacgcggcgaggacccccgcggaggaggtgaagtagaagtacgccgggacgccgaccgccgcggcggcgtcgagggcgtcgacgcagaagaggtccagcacgacggcggcgacgggcgggagggagcggaggaaggtcagaaggattggcacggtgaggcggatcacgtcgagcagctgctggaagccgtcagggtccggctcggggtagtccggaggcgggaggttgtggaaggagatggaagggttggcggcggcgatgcgcgccaccgcgggggccgacgaggcggcgacgtcggcggtggaagccggaggggtcgggacagcgatgatgactgcgaatccacggccgaggaagagcttggcgagctccaccatgggggcgagatggccggcgccaaggatggtgtgcagcaccacggtctgactctgttttgaattgggctccattagagcgagccggcgacacggtgagtctatgcgagtgttaagggaggtgccttctcgcgaaccacttgaggggagagtttaagcctcggttgctcgtataatttctacaaaacttcaatgctcagcctacaggtttgaaactcgcactgtgcgctgctatataacggaatcccgttttcaaacgggatgatcccgagcaggtatcaggtgtgatacctatcagatatcagatgattctacacaataggatgatcccgagtacgtatggtgtgatacc

SEQ ID NO: 38936 - DNA, 1501 bp, Oryza sativa
aagttgaaggcatcaagaatcatgaaaaggttgaggtgaaagaaaatgtcacagacatgatttcaagggagataacgaatcaagtatctcatcgcaaggcagaaatagagaacttcaagagcaaagatgacattgatgctgaagacatgccagagtgtcacttccaggggttggataatgagaaactgcatcaaagcggttcaagtaaacatacatcaccatctttgaagaactccacagggtctaaagcaccatcacaagtgtttcctccaattactcagaaatcttatactccacttgaagtagaagacatctcttctggtcatgatccaaatatgccatctggatgtctgaacataccaagagatcaagtctcgtttcctcggcatcctccacctgcacaaggggatcaacggttagcagctcggcatcctcctgtactagcagatcaaggttatgttcctcggcttcctcctcctgtactagaagatcaaggccttgctcctcggtgtcctcctcctgcattagctggtcaaggcttcgttcctcggcatcctccacctgtactaccaaatcaaggcttctttcctcggcgttgtcctccatttgcaggtcaagacttatatccttggcgtcctccgttccatgcaaatcaaggcccatttcctcgtcatgctcctccacatccttgtcctccatttactccaggtaattttcattccccgtgaaaccatggaaacaaaaatggtacttttcctgatgaacaacatttgatttaatggccaatcttcctgcaacttcaggacacgtgaggccacctagcaattttgctccccctggcccttggcgtccagttctgcatccagggcaagaacaccatcaccatcactacggacatcctggaagatcaaatggtccatcaggctctggcaacaaaccaggctaccataaccccagctatggaaatggaccaggaggttgcaggccacaacaccaagctcaaggataacattctgcatgattggttgcacagattatacccattcccaattgcattctgaacaactagagaaaaaaaaacatagaacaactcctccatttggtggacaacaaagagctcctcaaactttctctagatgatgttgcctttatggcgaatttaccaataagttgtacagtacatagccatcttgtgttgctgaattgtgaagttttgttgttagaaaattcatggatttccagagtgattcaattgtggccactagactagagtagagtgagagagtggctcacctgcggttgtgcacgggagccacatgagaagtgatcttgtcggccccaccgcaattcgcggagaatcttctttcttcccgaccgttcgacgcggctgcgccaaccgaaagcgtctcgccgcgccgccacgtctcgccggagcgcgcgcgcgcacacccacccgaacgccgccgccatgtcctgctgcccctgcaccaccaccacctcg

SEQ ID NO: 38937 - DNA, 1501 bp, Oryza sativa
aaaaaatgaatatctagctaccaatagctaagttagttacaagaaaaaaataataagaattacatatgtaactaaggtatatttccactgtaactagactgtaagtggtgatgagttgaactgtaagtatgatctaagttatactagtgatgaatggtgctgcatgaaacacaaggcaacacagataatagaaaataacggtacaaaacttagcctacattactaactagcaaaaacaagtttgtgcctagggttcctcaaactacaagtttgtgcctaagaaaatgaagatgcctagggttcctcaaactacaagtccctcagttttcacacaattcattgataaaaccaatataaaaaaagttacaatctaattaccaacagttagttacagtgagagataacataaattacaactgtaagtgaggtatatttccactgtaactgcactataagtgatgatgagttgtactgtaagtgtgttttaagactacatgaaacctaaagtattgacttcatctgataaacaaaattcataactaaaaataccatttgaaaacttaactaaatcaccagatgtaagaagagggcattaaatacagatttagatcagccattcaaatgcctcaagagatatttttttctggggtattttcctaagagaaaacatctaaacgttacaaaagaaataaaaaaacactaataaaccataaaaggcacaagttctccttttctgtttgaatgaaaggaattaatagacacataagagttatgtccaggcgacacttgttatgcaaaaatcaagcagaatctacgcaaagacaaagaaaagaaagttaatgttggttgcatacactaacaggcaacataaatgaagtggcctcacacttgcaatgacgcaagaagcctagctaatttcagtaaaaacatataactaattcaaaaatggatgatgaccctacacatcattgattggaaaaaaacctacaacacaaggggaagcagcgcaaactcacacatattctaacttttgcatgcacaactgacaaaaggagtccctagggttcccaaacaacaagtgtcctagttttcacacaaatcagtaataaaccaatgtcaatcaattacaaaatctaactaccaacagtcagttacagtgaggtataacagaaattacaactgtaagtgaggtatatttcgactgtaactgcactgtaaatggtgatgagttacactgtaagtatgttttaagttagaattactataatttcatactacataaaacacaaaatatttaagttaggtagtctacaacatgattctaatgctttcaattacatacaccaaccatacttgtgttaaattacatgtaggggttgatagaacaaaggctcaagtaacaaggacagttgaaggttagaatatcatgcttacctattattatgcatcatatctgatcttcgtagaaaatttcatctagcacaaatttatatataaaaaa

SEQ ID NO: 38938 - DNA, 1501 bp, Oryza sativa
tatccaaacattatctacaacttcctagttatacacttttgcagaaaataacatttagagccccgaaacatcgaaacactgaagcactgcaaatctgcccacatgcagaactacaataaaccgaaccgcaactacccaaactccttctctagctttccctaaccacaaattaatgcactaaagccatgctagaacaactgatacaacaaggagataagcctcacctagggtttctttagagaacttgtgaggagacaataggggagactccggtctaacccctcctactcctctcctcctcctcgttccgttttctaattcgcttcttgatccaacctatgaaggtggagatctagggagagcaatttgctgtagatgggagagatgcgaacacaggaggaggggaggaaagggcgctggccagggagaggggtggcggcactatgaggggaggtgagattcggttcccctctctctaggttttaggggagaactaatgggctgggtttatgggccttctcatgttggcccacttctaaagatatttttcttttatttatttctgttaacatctttattttaacaagtcaacccaaactaaaaaaacctaaatatcttttaatatatagggtattacagcctcatccttgggttcatcattattagctttatcacctttagccttgccatctttagatgtgcctgattccgaatcatcattgggaaccatctttagtttatacctttggatgaccgttcctgagcgagtttgcttgaatgaatgtaagcactgactcttcaagttgttcatcatctgctcatactctaacatctgttctggtgttagcttatccagtgttattggaatgatgttgtcagggccaatgtcagatggtggtttagaagtctgcttgttgtccaccatgatgaaaaatgtcacaactcgcatcccaccgagcgtgccaaaagcgtgttgatgcgaaaaacacacactgacctgggagatctgcttaactccaatacaagtcctaaatcttgctcttgggttcaaaggcgtgccagttgatttgatcctacaatcaacaagaaagaaacataaagaaaccgcggttaaatccataaacgatagccggtcggctaggagctgatgacatatcgtcaatcattaagccgattttattggcaatagatcggcgatgaggaataaagcaatataaagttatatttactcgatcggctgtagatatcaacgatatataatccttctcttggaatatatttaaattaagtgattgggatagatcgagcagcaagtcgagacagtataaatcacttatatttaaagatactttaagataacgattatacatacgtttatagcatagccgaacaaatagatctaacatgtatcggctaatactccgataccactctatattaagatattaaaacagacaaaatatattaaatagccagcctaatatactttaatgcaataaga

SEQ ID NO: 38939 - DNA, 176 bp, Oryza sativa
tacatcggctcttagcgtttagaaaaggaaactttgctgcatcaggatggggaaaatgaaagaatggtaataaaaattttctcggtgcattaattgcactaagagcatgtaccagacccttggaaggtaagaccagtaaaaaatcttatccattgatcaacagtaaaatacgccat

SEQ ID NO: 38940 - DNA, 1501 bp, Oryza sativa
acacggcaattgggcgtcggcaatcgtaggctgctgcaggcggtggcgccagcccttaagatttggggaggaggggtggaacgggcgtggagggacctaattgcaaatatgcggccacgatggagaaccacgcaagacggaaattctggtcagactgctttgaaccgcaatgattcacttaaacaagttcatgggtcttaacgtcgattttacaagaccatggaactaagtgacaccacgctctaactctaaggaccggcagtctatttttcagcctggtcccatggtccatcagcaatgaataagtctatttagcctcccttggaaacaggaaaagcccatacacatgtgattgggcctcgagcctcagcgtgcgtgcgccctagccagtcgatctccccgtccccacggccttcccgtctccaccgcctccatccagcgaagggagcagcgccaccgccgccgccgccgccgccgccaccggtgagcacccatacctacctccacactatcccctccctctacccatagaactagcttctcttgtagatctgggggcttctgtgtcagcttcccaaaaagaatccattccagtggaattggaatatttccgctgcaatatcgtagagcatatactaggttttagttggcttgcgtgcgtcgtcaccattgacttgcgcgattggtgagttttggagaagggttaaggcgtgcgtaggccaatatgggggagtttgaggagggttaggacttgaacaagtgtagccaacggtgcaggttcttgggtgaggggattgcttagaaatgtctggtttgctagcgagttgattcattcagaggtagtaatgctgttacagcactcttgcaaccagaatgcaagttatcgaatgcccggcttgagaaaaaagaaggtttacttatgggttcttagaaaaggatgaacgtggaaaggataccgctgattcatgtctaacagtcttagcataccacaaaatctaatgcgaacttccccttgtcttggggtgcttgaatcacctactgagattgtggatatgctcttttcgattcaactgcaagtatttgtttttaatcatgtgatgtgaacaacactaatgtttaaattttcgaaggcataacatgacacttggtttaggtgtaactgtcttacaaatatatgctcttttttttgtttgtctatgctgtcctctttgcacagaccatagcttttttttttcttaaaaaaatatatgctactttggctttgatttcgttgattatttgtgatgattcctatgcaaatgcagatggctaggtgggatgaaattttgactcttccagttcagaatccacccacgccagagttttcggcatcagatatcatgtggtccagggtggagggatggaaggactcaatggacaggcttgcgcttattccattttcaagggtgaatgattttgttagaggagaatcaaacaacaaagagtgcccaacaagatttca

SEQ ID NO: 38941 - DNA, 1501 bp, Oryza sativa
gcgggagcagcggcgggagagagggaagcaggctgtgagtggaacaacgggtggagggagagaggaatgcgcatgcggtcgtgcggagggagagagagagagggaagagaggggtagaataggaaagagaggaggatgagagaaatgggctattttgggttgggacactcattgggctaccagacatggcctgcattgtagatgtgagtacacctagagtaccctcagttagtgattgtagatgcccttagggggagtgctaggaggtagtgcgctgacggaggaaaacggaaatcatgttggtagtttaacataatggtccacttttaatttttgaggataaaatttaggcttttaataagttattttgcttcatattttcagtttagaaaaccaaaacaaatttttgggaaagattatacgttcagttactttgcttcatattttcagtttaggaaaccaaaaacatttttttgggaaagattatatgtattcgcttgacgcttgctgatgcatatgttgatgacatttttatttttttttattaaacatctttggacttataactgtcatattgggtctgttgttacgaacttactattaagctagcctgtttccctctgcaacgtggcgcacatccatatgttgaaaaatccgagtgagatgaatgaaaaaatcattcgaatgattgctaggcactcccattcatttttcatccatcccacacatactaatactaatatataatacaaaactaaaaagactatacccctactttatcaaatgctaatgtaactattcttcaatttaactactctcgatacaattatatttcaatacaattatattcccaacgttcataaactccgatataatattgctctaaaaatgaacttataacaaatggaaaagctaaaagtgaacttattatgagattatcaggagggagtatcagattgggaatagcattcccgtgatcttgataattgcttctgctctgaaaacgagcatatccctgcctgcagattccctccaaaaactagaaaccctgaatccctccctgatgcaccacagagtagacgaaccaaggaccaaatatcccagcagacaggactgttccacagtacacaccgagacaaaccacagtatatatgcacagtgacagacagaaacttgtagagagaaatcaatgtcatgcagcaagggaaggacataccaaattagaaacaaggcatgaacaaatttcctctaaaggctacaatgtaacagtatccatatctcaaatgaacaaccacaacagtaaccgaccagtttatgaaacaaactatcctgtaaagtttcttcttttttgttttccagcatctaccacaacagtgcgcaatgttctagagcaaattcttcacatctgccgccaacttgggactggaagagggatggcaagtatcatttgattgatcagcttagtcagcagtagagagccacagcagcagctccatggttt

SEQ ID NO: 38942 - DNA, 1501 bp, Oryza sativa
ctcttcttaggatggggaattcatgagaaataattggttaattttgtcttagaaaataaaatctcaagtagttaactagcaagctagaaagaccttctgcaagtagtgcttaaactttacaacagcatgctctgatttaaatatttaaggaaaatgtagatgattatatatgcagcaaaaaattgtatatatatgaggatatttgtatgagaaaaatattgcatgagttctttgtagaaaataaaaaaaaatccgtcaagagggaggttggacatttgaggttacatggctaggccacatgatctcaagcgacgatgaactcatatttgatataaaatatttttcagtctcaattataaccaaatgaaattatagtttttaaggtacatagctaacgtagcgaggtttatatggcatatctttaagagaaatatgggatatatatgtattcttagtattaaaattgtattactcatttgaaaaaaataaacggatggatatttaagttagagtgctacaaaatctcttccactatcttgcatactcctttgatttgcaaaggtgattttcagttagtttctaaccttttctggatacattttgaaattcacactgacggagcccgtggctcctcaccgggagaccgcgcaggcccccctttgccagttcggccgggggcttagggtgagatctcaagctctcgctgtgtgtggaaagatcgctcgcccggaagaaacacgagacacggcgatgtatacaggttcgggccgccgcgaagcgtaataccctactcctgtgtttttgtggatttgtgtatgaatgagctacaaagtgtctgcccacttctcccccgctctaggctctaaatctggcaagaatcaaccaatcccttctctatgggcaaggtcctccttttatatttcaaggggataccacatgcccccttccctttccaaactggacttttcttcttttcataaatggacggagatttgcacggtcgtcctccgatgggacggcacatacctacctccacttctgcctgaggcgggcacgtcgtgggaaggtggctgtgtgctgacgacatgagcagtgtcagaccggtcacaaatcggtcattcttgtcctccacacgtcggctcagcaacgtgcatgtttgcccttcttcaaacaacatcttgcttgtaatggttaggatgaagcctggcatatatcgatcggggctaacgtgtcatctctgggatgtaacacgctagctccagccggggacgagtgcctagaagctctcgtctagacaggatggggcgaagcatgcgtctgaccgcctgtcgccacctaacccgcgatttgaccggtctgtgactggtcacagaccggataatcgagagcactgcactgcacttcgtgcggcgtgacacgcttagccgaggcgcaataaatgcggttaggtgagccctgctgtgctcacctaacccatacacgtggagtacaaaacgcgagg

SEQ ID NO: 38943 - DNA, 1501 bp, Oryza sativa
ttattttgcttcatattttcagtttagaaaaccaaaacaaatttttgggaaagattatacgttcagttactttgcttcatattttcagtttaggaaaccaaaaacatttttttgggaaagattatatgtattcgcttgacgcttgctgatgcatatgttgatgacatttttatttttttttattaaacatctttggacttataactgtcatattgggtctgttgttacgaacttactattaagctagcctgtttccctctgcaacgtggcgcacatccatatgttgaaaaatccgagtgagatgaatgaaaaaatcattcgaatgattgctaggcactcccattcatttttcatccatcccacacatactaatactaatatataatacaaaactaaaaagactatacccctactttatcaaatgctaatgtaactattcttcaatttaactactctcgatacaattatatttcaatacaattatattcccaacgttcataaactccgatataatattgctctaaaaatgaacttataacaaatggaaaagctaaaagtgaacttattatgagattatcaggagggagtatcagattgggaatagcattcccgtgatcttgataattgcttctgctctgaaaacgagcatatccctgcctgcagattccctccaaaaactagaaaccctgaatccctccctgatgcaccacagagtagacgaaccaaggaccaaatatcccagcagacaggactgttccacagtacacaccgagacaaaccacagtatatatgcacagtgacagacagaaacttgtagagagaaatcaatgtcatgcagcaagggaaggacataccaaattagaaacaaggcatgaacaaatttcctctaaaggctacaatgtaacagtatccatatctcaaatgaacaaccacaacagtaaccgaccagtttatgaaacaaactatcctgtaaagtttcttcttttttgttttccagcatctaccacaacagtgcgcaatgttctagagcaaattcttcacatctgccgccaacttgggactggaagagggatggcaagtatcatttgattgatcagcttagtcagcagtagagagccacagcagcagctccatggtttttattgcctactcttcttggagctgctgcaatcagggcacttgtagtgctttatgtgttccgctttcgctggtgttatcctaacgcatttgccgtggaaccaccgctcgcaaatgtcgcacccaatccaaaactcgttggcgttgtagcggccaccgcaggttccacatagggtttcactgtgttcttcttcatcgtacccatcgtcaacaactgctggcctcgaggtttttgtctgcacgtcatttgctcgctgcataacaaagccagctttcagttcgtaaaaactcaaatgggcacagttcagaaatggttcatgatgaaaataaaaactaagagcactggtacggcacctttcctgag

SEQ ID NO: 38944 - DNA, 1501 bp, Oryza sativa
tccattgcaacaattgtacagtgctacacaatgcagtgctactataagtacagtgatatatactagttgagaatttagattgtcctggccgacagtccactacaattcttcaaaaaaatattaaaaacaaatcattcaccaccataaccatctgtcaccacgtccacaggtagtcaagaacgagtttattcagaaaaattgactggtactctactactgagatctcctctactactcaaccaccacaccacatgaccaacttcaagttttttccagaaaaatcaatggggcagcggcggtgtacaggctccggccagtgaaatctgaaaatatgatcgggcagaggccagcgtgggggcaaacaccatgcaagtgggtgatgtgcgtgcgggcagtctcagagggcacgcgacggccggcgtatggccaggcggatggggggaggtcggtgaccaggcgtacgcatggaccaccgccgccggccttgtggacgacgggcgaacaaatgtgtggaaaagtcttaccttttggggcaggcttggcggagatgctgggagttcgccggtggtcgccggagaagatccctcgtcgcagccgcgcaggaataacacgaaaaagcgcgaagcaaaattgttatccacgccaaaaaaaaagaatgatggggccgtgctcggagcccctaggactgaggccttaggggaggatttgagggccttcttattttggggctgtaatagggtccctgctggatctagtttttttatcttaactctcaaaaattgaataggggctggatttaaggttcctgctggagatgctctgaaggcgtttttttttttttgacgcttgcagttcagacgccctcctcccatacgagaatttccacccttgcccttttcacccctgtatggacgaaacgcattagtgcaaaggggcaagagtgaagggcaaacaagttaattcacagcttccttagtttaatcgggcctgtgggaagcgtaaaaaaaaaaataaaaatggaggggagtacttaacgatacataagactcctcgaacccatttgtcattgaatagatcgagtaccttcatccatgtggaatgggagaagacggcgacggcggtggaatgctacacttccggtcgttacgcgtttcatggcctgaaattctcacacgcgtaccctcgaatgctacacttctctctcctactcagcatgtcaacacttcgtgacaaatagtgtcgtcatccttgcgtaattagtaattctacgccgtaattacttgccaaaacaaaaactaaaatatctccctcaaccaaaaatttcaccccgagttactgtcaagtgtcgtcactctgtgttactactaccattcaccttttaatccccccatttaaaccgagcgactaatccaaggtgattaaaaccctaattactcccttcaccttcaccatccgaatctataaaacccgcgaatccgcgatagcagcaggagcagaagag

SEQ ID NO: 38945 - DNA, 1501 bp, Oryza sativa
caccatccacatgtacttcaaatacaattttctcttaaactactcatccgatctacgatccgactacaccgttgtgtttgtaacaattaaatctttacaacaagatcttacatgattatattttgatgaaaaatcataaattacttttataatatgtctaaattacttttagattttactaagttacttcttagatatataaaagtaaattcagtaaagcctaaaagtaatttacatatattatataagtaacttagaacaaaacgaaggtaactttgccatgtcatttaaagtaaatctgttggagagataaaaacatgactctatctagaaattgaattaatcagcacaaattatggaattaactaaaaacaataataaaagtaatcacctcagagcattatgaatatataggaagtattttaatcaaaagtaacctatatatatgataattatatatatgataatttgttcaatgaaaaaaggaattaattaaagttactttctttttgttataagttagttctataatatatgtaaattacgtttaggctttactgaatttacttttatatttctaagaagtaacttagtgaaatctaaatgtaatttagacaaatcataaaattaatttgtgatttttcatcaaaatataatcatgtgagatcttgttgtaaagattttaattattacgaacataatggtgtaatcggatgagtaatttaagagaaaattttatttgaagcttagatgataggaatattttctcaacttacttcatggattagtgctatagtaaagtaagattcttcaagttagcacatatctaaataggggtcactcgttatgactaaatcgagagtgctctcgatttagattttgcgacataaaaatattactccgtacgtgaatttgccatttagtaactaataacaacaattgggctgggccatcttgggccagagggaaaggccgagaggtagaccaaagcccatcaatcatagaggaggccacaaaaacatagccatgagatcgaatggtgtcacgcatggtgtacgtaaccctaagcgccggcgcggtcgcggacaatgtcgcggccgatccttcgccggcctgcgcagccctctcctctcccatctccggcgccccgtccgccgccacgacgccaccgacgtcccagcatttcttcgtccccgccacctgatcataggcccacgatcaggcaactcctcggatgccacaaacggcgccgccggcgagatcgcggcgaagaagcacctgtacctggcgatcgatgaccggaagaacgcgtacaacaggacatctctacgacggcggcgacgccgtcgacccatggtgttggcggagctcagagccgaacacgcagatgtcatggagtcccgtgcgagaaaagcacgccgtacgtgcaccccgggggacgcgcctagcttcttcctctccgcgatgaaccagtttcggtcgggcggcgtcgacgtcgagg

SEQ ID NO: 38946 - DNA, 252 bp, Oryza sativa
aataagcttcctttaatagattaatttccttaaccaaatatagcagaaatccgactattggcgatgtgataattctcttagggcttaccaaatttcaatcttaacacacggttgtattcgttttttattaaatctttacaatattatgttaaaagaaaaacatgtgtttcaaacctttaaaactcaatgtttcatactgttgatgcgaaaaacacacactggcctgaaagatctacttaacttctgtgcagg

SEQ ID NO: 38947 - DNA, 664 bp, Oryza sativa
cgaatcggttcccattcgagccgtgcgttttatgctccgggcacacgttggctgcacctataccacacgattcggccggtgagtggaattttttgttttgtttttgtgaacttattttaatacgtattcgttatatctaattgcaaatgctggtttttctcataaaagctgccgtaatcactttacaaacacgccggtgaaatacgagtaattaatttcgcgtaatcaactggacatggtcatacagtaggcttgtactccctctatactcaaaaaaaaaaaaagtcgtttagaataatatttaagtcaaaccttgagaatataaatcataaataactctcaagttattgagtttgaaaatgtaaaaattatatgaatatatttgtcttgaaaaatactttcataaaagtatacatatatcacttttcaataaatatttttatagaaataagaagttaaaattatattttggagaccgtgtcactgtcctagacgaattcacatgttaggagggagtacttgtaggctcccaccgacgccgcggctgcttgtgggccgatgtgaatagccggcccgaaagcccaacaaaaaagcccggtataaatttcagctggcccattcggtcatgggcccgacgccgccgcctcttcccgacgcccctagc

SEQ ID NO: 38948 - DNA, 228 bp, Oryza sativa
ctcaacgcagcagcaacagcagcatatgccagcatccacacaaatttttcgtaaccagcagaagagagatcaagaacatcaagaacaaggttacgaaaaatgccggtccatgcgtgcatgcatgacagattcgacagaaagctaatcaaactgttttgtgtgtgtgtgtgcgcgcgcgcgcagttggcttccggctcgccaccggcagccgcgcgcggtcgtacgcca

SEQ ID NO: 38949 - DNA, 1501 bp, Oryza sativa
gccaataaatagggaaaagggaagcactgaaggtgtaccctagccgactagccctatgccacctaatacaatgtttgcctatatgggccttagtgcataacaagtaggttgggcttatgagagaagatcaaatcgattgtttcttctaggcccaactatagtcatagtcaaatgaaacttgtggattgggcatacattgtgtactattattgccatagaaagttacgacactactttaaaagaggcttcatagctagcccatcacgatcagttcataatggattctcgcctaaatcattatgaattggcaatgttattgagtatcaccaccgatatgctctagctttgaaactacagtcgtgcaactgattcccgaaccattgccaattcgtcggaacttcgaatacttaacgactcagctctagttgctaggccacccgaatattgcaatgggcctgatgatatgggccaccaacggtaagactatccagatcgtcaatgattcacccctacggccaccgctagagcaccatcaaaactctaccagtaactaaaaaagggtgagctaaaaacctgtcatgaaagtgtctcactatttcttttttctctcatccttttttatgaaactggagagctcctatgttagatttaatttggcactggcccatttaaatcaactaaatcaaataaatctcaagactcatggaatgctaggagttatggtgtttaattcatcatggataattaggaggaaggtgtaccttttctgagaattattccaagaaatgattaacaaattggcaacatacgtcaattgtatctaattgatggttagttgatggtggtgtagtggaggatggttgatgacaataagttactctattccttttcctatcacatgagtctctttctcttcattttccttctatcctataaaaggagaatggatctgatttcccatgcgcgatagagaacatatactttcatccattttcactttcgttgctgataaggtgatcccattctgacaagtgcgtacacatgcgtgggagagcatgcctctgaaacccccatctcctgatcttgcacaggaggaggcgaattaggtttttggtgagcacatcgcgtgactcctcgccggtgttcatgaatgactacatcgactagactacttccttttcatcatggctagtggcgagaatgtaaacggctacggttatccttccgctacaactattgttgaagcaccgcatgttattttcctcttctattcttttctgttagttccgtttatatgcgcaaacgagttagatatgtttgtttcgatggtctacactaatagcatgcctatttcgtgtattcttcttgttgagagtagttcatctatggataacgatttcattgtttacatttacatcgctatggtttactctgtttatttctaaattaagtattacgatgtctgacatcctgtattggaagctagtaaattaacgtgcaa

SEQ ID NO: 38950 - DNA, 1501 bp, Oryza sativa
tccctcaaaaagtttgggggttcaaccgaaacagggttagatctgcctctgcccagctccacctactttcaagttgttaattttgatttccgtttttagcatatgtaatttggttactgaatctcatccaaacacccttagaacgaaaaatgtaagctcacataatttgtactcatccaaactcacataaatttcttaagaagaatctagaccacaaactacccatagtcacacaaaatatctttttatcaagatatattcttataagtaatttttattccacaaaattttctaaaggacatactgtgacacttggcattaatctaaacatatagactattgtttaacattgcataaatattgacttaggccgagtttagttccaaattttttcttcaaacttttaacttttctatcacatcaaaactttcctgcacacataactttccaacttttccatcacatcgttctaattttaaccaaacttttaattttagcgtgaactaaacacacccttagcaaagttgagctacaaaccaaaccaaccctcgtttgcccaattggatttcagcacagttggtgtcccgttttgattcttgaggcccatgtagcaaatactactcctaccagaggagaaaaccgtgaaaccggcatagctcctctcaaaaaacaaaaaggaggggaaaaagaatcacgacatatagctgatagctccggtccaaactccaaacccggccgtctttgctcgaccggagcggagcgcagcgcagcgcagaccagcggcgcggacgacgcgcgccccctctggatcgccgctcccccgcgcgccacagcttccatccggcgactgcaaggccgcccaagccaagaggttattattcgtcttccgttccatgattctgattttgttttttttttctttgcctgaagatgattcgcttcgctggatattttagtagtttctacctcgctgtttattggattcgttcaattcgtctcctccttgggacgaaattctctcgtatgtggttattgggacgaaattcttccgagtattccctcaaaaaaaaattcttccgagtagcctagggtttggggaaccttttccgcgatttttatcatcgtgtcgattagttctttatgtattagaccgtccattcaccgattcgaggtgcacatattttgtacttgcaaaatagggttaaatcatgattcgacaagactgttagcctgaagatgcaaaatacctgtttaaattgtgttatttgtgttcaacacagttcttttatagtaaggaatatatagcatatctgatgtaaggcttcaatgcggggataaattctatgtaatagtgtgtagtgtccattatgttcttataatctcttgagttcgatggaagagcctgaccgtgtaaatgttttgcattgtgaatcttacacctactctatgtcctcagggtttctttgcaagctttagcccctcgacgttcattgagagaaca

SEQ ID NO: 38951 - DNA, 305 bp, Oryza sativa
cattgctgtccctcaaaggccatgagcaattgtttaagtttctttcaatttcctatccaacttgtttattgcatatccaatttcaaaactagcatcttgtttcagtagtacccgcgccaccatgacttgtatcttttaaggaaaggtttattttgatgtctagacccacagaaacagtcttttctgtatatttcaatccgtttgacataatgcatgtaactacggacaacttcaatggcgtatttgttatgcatatgatcccgtgattcagttaacatgaattttcatgcatttctttgaacaac

SEQ ID NO: 38952 - DNA, 1501 bp, Oryza sativa
tcgcctcccctgacgtcgtccacgccgcaggcgaggccgcccctgacgagcttgtcgcagaccttctccagccgctccctcgacctcctctccctctccagctccctccgggacgccgccagctccctctccgcgtcggccagcgccttcccgagcttggcgttcaccctctcggcgcgtcgcctcgacctctgctcaccgtcgagctccgccgccgccacgcgcaccatcgccgcgaccttctccctctgctggctcctccactcccgcgccttctcgacgagctgcgtcctcatccgtgccgtctcgtcgccgtgccgccggtcctccgtggcgaggtgccgtacgtgagcgcgtgccaggtcgagctcggcgcacagcgcggagagcagcgacgccgtcgacgggtttaggccatcgtcagggccccagatgccgacaagagccttgacgagctccttggacgtggcaaggctgctgcatatctccttcagttgcggcacatctccttggacatgtaatctaaacggcggcggcgacaggcgctgcactcgctggcgtgcggcgcggtgaggaagcacaggctggaagaggacaagaaaagaaaataggggagaggctgacatccttgaccacatagggcaatctagtctttttcgattgtttctctctccattttctccgaaaataataaaataaggccgcgagtgtccgatagctaattaccagttttttttcgtgcctgacagcaaattcgtgtttttccggtgtccactagctaattacaagttttttttggatgccccgtagcaaattttgccattttttatgtggcgtaattctaaataggattatcttaaaaaaactgctgcaagtttttttaaggaaaaaccttttcaatctaactatagtattatagtataattgtaatataattccactataattgtaatatgacttatatataagtgttataataatatatacaactttatatctaacttatataaagataacaatatagttatagtgtagttacgtggtagttataatataactatactatataattgcattgtagttacactataactattactatatttatatttgaaaggttttttttatcaaaaaacttgtgacagttttttaataattccgattctaaatttctccaaaaaatactaaccagctcgcaggagacagagacatgacccatgcgcagaagatctccaattgccaggtcagcctcccacggccccatccaccacgcagcccccaccccgactacgttcctagaccctgtcttccacgtgattcagtgccccacgtcactgatagctgggccccacccaactgtcggtccactgcacccgtggacgggtaacccgcagccttaaatctcggcttgtgtcagagccgctccgaaccccctctctcccatcgccgccgccgccgccgccgacacagccgctgacctcgccgccgccgacgccgatgg

SEQ ID NO: 38953 - DNA, 1501 bp, Oryza sativa
ttttttttttacgcttcccacaggcccgattaaactaaggaagctgtgaattaacttgtttgcccttcactcttgcccctttgcactaatgcgtttcgtccatacaggggtgaaaagggcaagggtggaaattctcgtatgggaggagggcgtctgaactgcaagcgtcaaaaaaaaaaaaacgccttcagagcatctccagcaggaaccttaaatccagcccctattcaatttttgagagttaagataaaaaaactagatccagcagggaccctattacagccccaaaataagaaggccctcaaatcctcccctaaggcctcagtcctaggggctccgagcacggccccatcattctttttttttggcgtggataacaattttgcttcgcgctttttcgtgttattcctgcgcggctgcgacgagggatcttctccggcgaccaccggcgaactcccagcatctccgccaagcctgccccaaaaggtaagacttttccacacatttgttcgcccgtcgtccacaaggccggcggcggtggtccatgcgtacgcctggtcaccgacctccccccatccgcctggccatacgccggccgtcgcgtgccctctgagactgcccgcacgcacatcacccacttgcatggtgtttgcccccacgctggcctctgcccgatcatattttcagatttcactggccggagcctgtacaccgccgctgccccattgatttttctggaaaaaacttgaagttggtcatgtggtgtggtggttgagtagtagaggagatctcagtagtagagtaccagtcaatttttctgaataaactcgttcttgactacctgtggacgtggtgacagatggttatggtggtgaatgatttgtttttaatatttttttgaagaattgtagtggactgtcggccaggacaatctaaattctcaactagtatatatcactgtacttatagtagcactgcattgtgtagcactgtacaattgttgcaatggatcgattataaccatatatatatgcactgcttttcatagattgaatgttgcgtactgtatatgtgtagttggatacgtgtgtgtatatgctctaaattttcttattaattttatgatcttgtgatggcagtgttttttacatggacttctacgacggtgacgacgacgacgacgacgatcttattaccgaatggtgggatcaagaggagttgtttgacgatgatgactactacattgcagctgctcttcttacggacatagagcataagaggaccaaaagaaagcgtcgtggttcagtcccaggtcgtgagataatttatagggataggtttgctggcaatttgcgcatagtggctgattattttgcagatcctcctgtatataatgcaaaattatttaggagaaggttcagaatgtcaagggagctcttcttgcgcatcgtggctagtgtggaggctcatgatgactacttcaggtggagaccgaatgcag

SEQ ID NO: 38954 - DNA, 1501 bp, Oryza sativa
ttatgtttgtaacaattaattctttataacaatatctcacatgattatatttttataaaaaaatacaaattacttttataatatatctaaattacttttagatttcattaaattacttcttagtcataaaagtaaatttaataaagcctgaaagtaatttacatatattatagaagtaacttaaaataaaaagtaaagtaacttgttacggtattaaaagaaatctattgtggaggtaaaaacataagtctctagaaattagatttaatcaacatatcatagttacccccacaacggatttattctaatgtcatgacaagttactttctttttgttttaagtttcttctataatatatgcaaattaattttatgttttatttaatttatttttatatgtctaagaagtaatttagtgaaatctaaaagtaatttagatatattataaaaataatttataatttttcatcaaaatataatcatgtgagatcttattataatgatttaattcttacaagcacaacagttgtcggaaggtgaactcctcaagcgggggactgtgaggccccctttgttagttcggtcgggggcagcaggtgagaattgaggatttggatggaatggtgaagtagagggggtcgagcccctcaagaagatgagacaaaaggagtttatacaggttcgggccgctgcaaagcgtaatatcctactcctatatatgatgatttttctgagcttagaaagtctctgaatctctggagtataaactggagttggcctccagagattgccttttcctccgggatctcccttctcactaggcatggacctccttttatacttcaagaggttaccacatgggtccgaaaagctacctagggaaaaggaaaaatattctttacattaaatgtgtgtcttgtgccttgacttggaagccacacgcacgtcggctgctgtatagggcccatcacatcaggccggccgacacaggggacgcccgcgtcattctctatttaatggatgaggactttgggtgcatgcatgcatcgggaatacaaatccgggtacagctggagtagttaggccggtaccagataggatgaggagtagaaaagctcctcatcatgatcgatgggatggggcgtggcatgccacacgccgcctgacacacgggcagcaagtgggcatgttgccgtcgtcctatcaatcacttggccggtcacagaccggtcatagcgaccagtcaggcgctctgcctgccgcatttaatgctggttgttaaattgaaacacaagtacgatgcacaattaccggattgtacaaacacatttggctaattctatgggacaaatgtaacgctaatgaccacttcttattccatcatttaaggggaactcccctgggcttcttgttgatggttgatcattccttatgttgacatgttcattcactagttttagttactaacttatggctcttgtgctatcattgtgatgtgcagg

SEQ ID NO: 38955 - DNA, 1501 bp, Oryza sativa
ttaattacttgcatttaattatacgcctcgctcactagcttaactgctaataaagccgcgccatgaggagagaagatgagaagatgaggaacagcgaaagcgacggcaggattaataaagccgtcaaagatttcttacttgttcccccttcttcctcgccgcgaggggaaaatagattcgagctttctcgtagcttcccctcgaaccaaccgtccattcccgtgggtacagctcgtgggttcttcccgatttcttccagtaggagattccctgaatccgctcctttccctaatttaatttttatgaagagagggagtaacttgttcttgcctaatttgattcgagctcaggtccataatttgatttgaattttcctggattttcttctgctgggtacatttgtgagcgattttaaaggttctttttttggctggtactttggtagaagttcagctactatcgctttaatctgctcgaattcttggttgcgtcccgttcaaaattcgtccccatgtcgtgtatttgtgggtttcattcctgcgacttccgttatttcaggactgttcggttctctcaggactttatccaactggggcagtttgagattttgtgaaaaattgtttttttctttccttctctgcgataatcttgggcttttggcgacgggagagcaatggtgagcagcaacatgttctaccggaggaagcgctcatggcgtgccggtgatctcgtgagcaggagcaccctgcaattggtgagggctttaccccttcctttttttccccctcaaatgctctcattagcagtgatgtttttctttccttgtaatatgaaaatcggctataaagattgtttagttcatattgtgaaagtaacaagattgtgatattatgttgttacttgttactgcattctctaacttagagaggtttcgctaacaagtgtaaattgtatagttagtttacctgttttattgctgtgtcaagtctgttaccttgctgattatgatatagggtctctgtcccttttcattttcaattttcgatgcatgtgaagtgcttatttggctgacgattgtagtacccaaagttgcactctattcatcagttatatctttactcttttacagtggaaaactgactagttctggtaaaatgtatgccaagaataacacaatatgacatggatttgtaagatcatattgttttgtttggcttctttcatgactgacttcattttgtgatttccttttggaatactgcagctggactttgatgatggctcaccaccagaatatgcttggagaagaaaactaagtagtcatgccaatagattgaaggagttcaatgttacctttagagaagcaattaagatggtacaggaaatgcaattatcagcattcccagttcatggaaattctggctgtgattgctcttcattctgctgaaatcttaagattatctggttatgtatgtcaacatgattgagttgtgtctcctcg

SEQ ID NO: 38956 - DNA, 242 bp, Oryza sativa
tgaaattcagtagtcgtgacgccgaaatttttagttctttgcttctatgcatgggtttttactgattttcaccagttgtatgctgcgtagttgtaagttttttggacccattttttctctattggtcaactctcttttacttaatgaaagcataagctccctatcttttttgaggttcaaaagaatagatgaagttttaaaaaataaattaattctgagttgcctctctatgtttccatagt

SEQ ID NO: 38957 - DNA, 1501 bp, Oryza sativa
aaaattccactaaaaatattgttaatgtattgaagcatggggaactcaagaaaaaatccaccacgccgaatttgattattaaatgcatttattaattgaggattagctctaggttaaaaaaacaatttcttcgggcaatttatttaaccaatttttttaaagcaagaaaaagggggaaacttcaggacgtgacaatgcacttccttaatctacaacatcgaggggcccagagatatctcttcataggaggggcaaaatcccatcttgattattcatatcccactacatgtgtcatagcatacccgaaaactacttttataactacccaattacggagtagcgtttagcagtccctaagtaagctactacatatgttgggaactatgataatctcaggtctaaggattcaacaccaacactaaatgagatcactgatgacacaacacatatggctcttgcagtgtctcatgttcggtctatccaacaacatgttcatcaacatatgtccacattattaatttggtatctctataccatgatccatgagacatgatcatcgattaatacatgtgctgatcatctaaatatatttgttccacatataatatttgatcagggatcctttagaaatagcaacacacaacataaagagtctcgtgaaagaatcacatattcattaaccaataatgagtttatctatttcaatgaacaaagtcggataaatatgtaaacatagtgtgtgatacaatcatctctataattgcctctagggcatatcactaacacaagaagcaccgctgcagccgcgcaaccaagcgctcagcgctgcagcaagaatggcagccgaacaggcccattgaaaaggagggagttcctttctcaattcccatccccatcccaccaaaattcctatgtctcctaaccaaacaaaacactcaatagcctcatccctctaaactcccaatccctaccaaaaactccgtctaaccaaatgggctgcaagtttactcacagaatttatctttcttccgcgataaaataatctgccgttagaccacgcagggtgatgctgctgctgctaccttaccatcctgacatcctcgcgcgagataccggtggcgcctctcaccgccacgtcgccgccggcgaggtgaaaaaaaactccccttttaacttgcccagccacctccaaatgcctgcacagtgcacaccctccggggagctcagcaaaatatgatggctttcgctttgttgatttggtcgccgggacacctgcccggctgatgtggcggcactgctgcctgcctcactaatcctgcagttaattaattacttgcatttaattatacgcctcgctcactagcttaactgctaataaagccgcgccatgaggagagaagatgagaagatgaggaacagcgaaagcgacggcaggattaataaagccgtcaaagatttcttacttgttcccccttcttcctcgccgcgaggggaaaataga

SEQ ID NO: 38958 - DNA, 523 bp, Oryza sativa
ttcctgcagcccatttgttcaaaattttgtcacatgccacagctggtggtcaagtaagacatttgccttcagcattagctattcttgtgtacaaaatttttttcagagtcatcacgagaaagtggctccattttataaaacacaacccacatgtgtggcaatttcaaaaatacgagtagttacaactactctacttccaagcttactatcctgcactgcacatctgattaattcccatgatttcctatcccatatgtcatcaataataacaaagaacctgcacatcacaatgatagcacaagagccataagttagtaactaaaactagtgaatgaacatgtcaacataaggaatgatcaaccatcaacaagaagcccaggggagttccccttaaatgatggaataagaagtggtcattagcgttacatttgtcccatagaattagccaaatgtgtttgtacaatccggtaattgtgcatcgtacttgtgtttcaatttaacaaccagcattaaatgcggcagg

SEQ ID NO: 38959 - DNA, 1501 bp, Oryza sativa
ccctcttgcgccgcggtgaatgcggcagctggacaaccggacaccccggccgacctgtcacgaccggaaataacccaacgggcattccttacgtgcgtgtattattccttgttccaggaggcaaggtacaccaaaagttgatacattttagagtttatcaagcggaagcataaataattaatttattacatgggcagcgaaggcccagcacacacaaagacaaacgggaaatagcggaagactagggcgacgaccacaggcgcttgacggcaggcacgagctagacaccaaagccttcatcttccaggaactcctcttctgggtttgggaaaaattgagcaagactgagtacaaccaccgtactcaacaagacacacccacaagtgcagaataaatgcaagggagtacaagggggttataatataagggttagggtttgcagtaaacagcattaaaagacacttagttgctcaaagctatattgtaaatacaatcctagagctatacaatatttttaatcaaggccgtgaacccaaacgaacctgccttaacccaaggcctacgatgattcagaccgaactggcaacccgaccatgggtcccagctcgtcccaagccaacccaggccaaccattccacattttagttgttaagcaggttttaagaattaaaacactaacttgggtacattgctcggcttgcccataaccgagggcgcggctattcgaataggttatactctgatcagaggtgtacatctttacccaaaagacacatctttctcacgtgtaaccacgtgccacacaccaccacggtatacgggcggaagacgtgacatagtttccaacccatcctagccatagacaagagtaccgacccaaccccacctacggccggaacctccgggacaggtaagtaggactgagcccctagcagcaggacaccagccctgtgccatgacatctcgactaccgggccgcagcacgtgtagccttcatttgccctagagatgtccatcgacccccgacttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccctgagcccagcctaaaaccattttgaagattttgaatagagggggaggtgtgaatccaattccacaataatccaaccattccatagtgtccaggtgatgagaatattcccaaagtctagagttgtaaaaccacctaatgttgcctaattaaccagcgaagcatctacctaaattcatactagtggtaccatgagtagagggtccactagttggggttttgtttattctagggtgaacaaggtaataataacaatagcaatactaataaggtcataacaaaggtaaataggcatggctaaataaaacagtgataacgc

SEQ ID NO: 38960 - DNA, 770 bp, Oryza sativa
gaggatcacagtgatcaagatttgtccataactgctgcaactcactagcataactgttaaatttgttgtattccatgtcctccatgcttggctctccttatcagagggctcttcacaaccctcttgcaaaaaatgatccaccccttttgctctcaacattatgagctctcctacaccaactcaaataatttttgctcccttccaacctcaactcacttggcatcacttctagtttcagtttagaccctcctgctacattcctctgacctatcatgcccatcttcaacaaatcctctagcaaatccttcatatcacccttagtgataagtgaggaagcatctacaacctcctttccaaccactgaagacatttctttcttctccttctctcctctcttcagcaagcagcaccaaatttactagcagcaagcagcaaccatacacaacaacaagatcccaatctactagcagcaaccacacacaacagcaaaatcccaaatttaccggtgatagtactccttcctcctcctcctcctcttcttaaatcaaccacacaaaatcccaaatctaccggtgatagtactccttcctccttctcctcttcttgctgttctcttccttcttcttcttctcacccttctccctctttttccctccttcttcctctcctcttcttcctgcacgcacgcgcgctgtggacaccgctgcctcacgcacgcgtgcctggccttctgctcgcgtatgacgctgccactctgggcccaacgccta

SEQ ID NO: 38961 - DNA, 1501 bp, Oryza sativa
tttccccctttgcagtatcatggtgatacttcggggcatggcgacatgtgtggaatcgtgtcttgtgggtacagttgtacacctctggccagaataaaactatttgaatagccgtgcccacggttatgggcgatcaaccagattcaccgtgattagtctcaccctagtttagcttaatgaactggtgtagttcaggtggttggttgggcctgttgcaacgtggtgtagcgttggacagtgattggttaatattgattaatctactacaattgttttactgctttcaactactgcttctaaatgcctgctttatgcaaatgaacccttagcctcctttggatatatcctgcatcatacctcctcttccggtatgacttgttgagtacagtgggtagtactcagtcttgctctcttttcccccacaccagagttgaagttcttcccagttggagctaccttagaaaggttggtttcatcgctgccgtcaaggatgcctgtggagtggagtcgccccgctgctgaagtcaagcttccaagtttagttcgttttatctttttccgctgcatttgtaatcttttatatttttttgtaagacgtggatatgtatgtcaacaattgtcgtttgtgtaccctggctggtcctagacaggggtttaatgcacattcagcttagaaattctggttcgtgaatttctgggcgtgacaagttggtatcagagccaaccttgaccgtaggacaagccaactggaaccctaagagccttctgaaccccttttcatctgcatatgcctttttcacttggatttgtttcgggaaaatttggggttttgcctctttggtttgcgggaaaaatcttggtcgttcattcggattggatctttaaaattagctcagtctagggttttagtaaaattttatttggagtttattcgacagttagtcaggaatttatcgggtgatatgcattaggtcgtgtctatgtttgatggggcaattttatgcgcatcattttccatgcatctattttatgcattaagttattgtttagtcagttgcattagtgtctttatctgggttcatgaaaaatgttctatgcataaaaatcaccatgctcggttatttatttgagtcatttgttgctttgtttatttggatttgagcatgcattggttcctatcccttgtccatctttagttgtcagacctgttcctcgatcgcaagcgccgctccgagcttcagagtagccgcccttagctttatcgtcttcttagtctgtttgcttgctagtttccgtgttttaggtttgttgcttgtgggttagtcggcagtcgatatcatgtgtcagtggtatgactgccttaattaggagttatttgcttccttttcagtgttttattcaagattgagataattgcacttaaatttataagaaagattagtttctgagccccctgtttttcttccttttctcatatttctacctatcccccttcagatgg

SEQ ID NO: 38962 - DNA, 551 bp, Oryza sativa
gtattttgcattgaaattaggtatgtccatgagacatgttaacaactcacttactccgtcccaaaaatgccaacctatgctagtataacaaatatgtccagatttattatattaataggggttaatgtgtttaggttggaagcactcaagatagatttaaatatcgagttttaaaatttcatgccaaaaatcataataaaaagttagaaaatattttctaacattgataacggtgtcatctgtgggtctacaaaattgcagcctaaatatatagcctatagaaaacaaaaatgttaggcatgagggagctgagttaaccattttcaatagtatatataagggtaaaataagaaaaaaattaatttaaggtgttcgatccaatgaaatagttagtttgaatagttagtttgagtggacttttttctttaagaaaatagttctatatttaataattctaagaaaattgggttgtcactaatttatgaaagtcctggaagcatcgaaggacctcattcttatgcttaagcatataaatccaagtcatacgagta

SEQ ID NO: 38963 - DNA, 1501 bp, Oryza sativa
gtttgcttcttctcagttttgtacagtctcgatttatgggagatgatggatcttcggatttggtgagggaagaagtacaacaattgtgatggtagctcaagatgtcttgatctgtgacatttgaaagccgaagctgacttttatggatgccatgtctgcgatgacggcaagctgcgttggatttgtagttcactaggggtgtgtgtttagttcacgcaaaaattgaaagtttggttgaaattggaacgatgtgatggaaaagttgaaagtttatgtgtgtagaaaagttttgatgtgatggaaaagttagaagtctgaagaaaaagtttggaactaaacatggcctagaattgtaggtggtcaccatagatgaaacatttattgacaagccctccaatactggactccatgtcactgactcactgcatgctcttgtgaacatgcttcattcaacatatatacctagctacacatgctagtcatggcatctccaaatcattttttcatatagtggataaaaatccaaccacaatatttacacacagccatccaaatcataacctttttattaagttgttttcttttagtttggcagtagtagttgtgaccgtagtaaatacttggatcgattgcatcttaaagaagcagttgtgtatgagtgccacctaaaatagtactcccccattcaaacaaaaaaaacctatacatcataatacaacgaatatatacatattttatgtccagatttgttacgttagaatatatcgaatgtcttttttgggatggagggattactacttttgcctatctacatcgggcttggcatgtacgctgcttaggtcatatctcatgctatggcttgggtgaaaagtttttgcgtgtcacatcggatatacaaacacatatttgaagtactgaacgtactttaataacaaaacaatttacagattacgcctgtaaactgcaagacgaaagtattaaacctaattaatccgccattagcaaatgtttactgtaacaccacattatcaaatcatgacactattaggcttataagattcggctcgcaatttacacgctgtataattagttttttttctatatttaatactctatgtatatattcaaacattcgatgtgacagggtgatcgaaaagcttttatttgggaactaaacaggcctatatccatcttgtcctggggcgctgctacacgtcacggatgggttatgccacgaagaattttttttatttataattttttttattaaaagttttacaaaaataattttccattttgaaaattgacggaaatagtcgcctaccgccctctgggagggcgatttttaaaaatcgccctcccagagggcggcgaaaatgacgtggcagacggccgttcgctctcgggcgacggccgtcaacgaaatttgcaggcggcccccttgccgccctccgcgagggcgattttgtactgtgcggggggccgcctgcaaatgggcggc

SEQ ID NO: 38964 - DNA, 1501 bp, Oryza sativa
cgtgcccacggtcatgggcggatgtgaggtgattcctagcgtagttttgtttgactactgccttgtgaaatttgctgttgtggaatgggtttgatgtttggaaaatcggcggctgatgggatcagccaggcccgggtggccgtttgaaagctgttggccgggtgccaatcttgatcaattcaaaagactgaaacattgcacatactccgaccggacgagacgcactgtctcatccgtgtcgtttaagaagcactcccttagttgtttcagaaaagagtttaaataaaatcaatcgcaaaaacaacagcctttctttgaagcctgcattaaacatttatttcccatggcttgctgagtactcctgtactcacccttgctctatataaataatcccccccccagttgctgaagaagatgaagcggatcccgctgacgaggagttcttccaggagcaagccggctacgatgagttttagggtttcggcctagttcccaagtcgcgcctgtcatgtgtggtccaagtcttggcttccgtttcccttttgtaatgcagttgtgagctcgggatctatccgcagcccaacatgactgtactcctactctataataaagagacctctgttgctgtgatattctgtcttcctgtgatatcagcactgtttcatgggactggtatcgattaacaggttaatttggagcgtcacgggctagttccgctcaggactagttcggagtgtgacatcatgacttgggtattacgtttccttttatattatggagcggcctaaaatcctgatttgataatattgtaaaatagatttagaaaaccgataccgtattggttaaggtttctatcttgtaatcctgccccccatcctatataaggtgggcaggaggccctctgaggggcataagcacatatgatcgtcagatctatactacatccggcggattcaaatccccaaacaggagtagggtattacctctcattgagagggcctgaacctgtctaaatccttgtctccgcatccatccacttttaggtctcgtgcgctacccccttttattattgccgaattcatgtttcgacagttggtgcgccaggtaagggttgcgtcgagctttccattgagaagtgcgatggaatcaatttctggagatgtgctgagatcgacctcaaagagtcgtcggcttcgtcttcacttcgcttcgggatttttgcttcgtcgtcgccgctgacaactttaacaagttttcacactctgacttggatccaaaccagtcaggagagattcaatctaaggcagcgacgatctgatggatcagatggtcatccaccaccaagcctactgagccaatcaatctaccccaacgaagatgccatgatgctgcaagatggatctacagacacaaggcatgacaaaaccgatctaatcagcatgcatgggagacggttgcagctgatggacaccaacgacgccagggccgcgcacgcagctac

SEQ ID NO: 38965 - DNA, 467 bp, Oryza sativa
agagtaatcgcaattcgcaaaagcatcggtctgtgtcattagcaactcagcaaatgacagtggcaaacgcaaacgagggtgagattaatggaaacagtaagattaatctgaaactaaaatatagagaataaatggacaatataatttacgatagtactgtataaatggacagtataaagcatatctcttcatatgctacgtacagttatgttgtataagtgattcacttatttactgctttaaatatggcctcaaactaaaacctatgctttcgatcagcacatggccctaaattttcattatttctttttctgaaaattatgtatctacgctagttgcgctccctgactattgtagtagccattttgaattttcgtgcaagtcgtgtaataattttgtgcaactaatgtttttttaaccaaatttccgtttactttgataaatagcgtttgttgtttgggaaaaca

SEQ ID NO: 38966 - DNA, 1501 bp, Oryza sativa
tttaatgcaggcttcaaagaaaggctgttgtttttgcgattgattttatttaaactcttttctgaaacaactaagggagtgcttcttaaacgacacggatgagacagtgcgtctcgtccggtcggagtatgtgcaatgtttcagtcttttgaattgatcaagattggcacccggccaacagctttcaaacggccacccgggcctggctgatcccatcagccgccgattttccaaacatcaaacccattccacaacagcaaatttcacaaggcagtagtcaaacaaaactacgctaggaatcacctcacatccgcccatgaccgtgggcacggctgttcgaacagttttaataacctctgcagagggggtacactttacccacacgacattactaacccggatcatccagcccgtgcagaacggccacgactagagaccttaaggctttcatgacaaggcatttcgaaagccgacacaggttcaccatatgccaacgagaggggtcccagaccaacaccagattaggtcccagaccacactgtgccaggaagcccaggggtcttccccgacaccagcccggcgaatccacatgtctcttagcaccatggctcccccgataagctagttactcagccaggggtgtcccattccacccatgtggtcgtacttgtcttatgttcggatgaaattccaaggaaacggtccttaagtgcaagagcgggaaaccgtacacccggtacgttccccggtccgtggttttggaaattcatttagttcgcaagcaccgacccaggtgtcgggttttccaagtcttttgtaaaacccaagttttacccaagatgtttctcagattttaagtttgaaggcgatcatcgatacccgtgcagagtgcacgattaccgaggcgcaactaggtgggtacaagggaacatggtataacaattacaatggaagggtcaaatgcaacaaattaggtaggtccgccaatctgccttgcagacgggacaagcagattaagtgcgatcctatcaatgcataatatttttcaagcaacataattaagttcaaatataggctcaagatgttcaaaggtggcttgccttgctcgagatcttgagattgatcctcgaaatcctcgcactgcgggtcttcgggctccgaaactacacgcgaaacgggacaactcaacaagcggcgaaaataaagccctattaatgacctctaagtgtgacattagatagatctcgagatttgaggaattttggaagctgaacggagtcaaacggacttacggttgggaagatattgaatttctaagattattggatttttggtctaaaggaaaaaggatttatttaaatctttttgaaaaagaaaagaaaagaaaagaaggagggagggaaattagacttccctcggacggctagggcgcggcctgagagaatggggcggctcggccgagcttaatgggccggccggcccaagaaggcggcccaaggcg

SEQ ID NO: 38967 - DNA, 1501 bp, Oryza sativa
gtgttggcgctgtcggtgtgtcggtggtggtatattttttttcctttttcctggttacaacccttaatcttgtaattttttcctactctatcagtagaactaagacactcatataaaataccactacaaacctaacctagtattttagagatacttatagagagataaatatacgtttgtacttttatagaaataagtgagtgtccgtgtttatactatatttaaataatccttctgcgatcgaaaaaaaattgactgtaatgcgatcgaaaagcatgcacctaaaatctatgcttaaccgaaaaaaatataattaaaaccgagactacggtttgccgtaatccgtgttttttttccggcgggagaaaaaacacagcctatttgccgcaactaattatcagcgcttaaacgtcccgatccaaattatcagcgaatcaaaggtcgatttaattatctttcgccgattcgatttaattatctatagcctccccccggccgccggcatcgacgaccgatggcgaccggcgacgaccgcccggcctgtccgaactccccgacgacctcctcctccgccgtggaggccgccaccaccacagcgtgctcttgcggcgcgttcggcgcgctccggccagggtttcaaatttcgaaattaggtttctgccgagggggagcgatagaaccgaaatttcggaatttttttcgtacgaaattttttaaaattttgactgattttgaatggatttgaataaaatttgactaaattcacaagaaaattgtaaaaaaccgaaagtttcggatgagatatgaacattttggtggggggcgaaaatttcgaactgaaatttcaaacactggctctggcgctccacgggcgccgtcaacctcgccgcgcgcgtcccttacggcagcatatactccgtacatcggaaccacagctctgctcgccccgccgcgacgccttcgcccgtgccgctgccgccgccgacgaccgcgtcacgcggcttagcttccacgtcgagagcgacgaacatgatcatgatggccatttggccaatacctgatgtacaggtttcgtccacggcagggagaacgtacgggcaggcggcggcggcggagcccgttcacgacgtggtcgacgccttgtcgcggcagcgttggggacggagtagtaggttgtaaaagttcactctgcaattgttgcgaaattaatagatgaatatacgttaaatattatagaaataatgaattttgaaattttgtgaaaataatatgagaaagatgatttgtttgggctgtgttcagatatgggaagttgggaactaaactccccgcacggaaaacagagcggtctattagcgcgtgattaattaagtatttgcttttttttaaaaaaaggatcaatatgattttttaaataactttcatatagaattttttttgtaaaacacacaccatttaatagtttaaaaagcgtgtgcgtgaaaaatgagggagatgaggt

SEQ ID NO: 38968 - DNA, 1501 bp, Oryza sativa
tctaaatatgttagttatatatggaattatggaagctttataattattaatacaattttttaattatgatgatggaatacgaaggtgagagctattattacgtgctattattaccagatacaataaatattaaaattatgattatattctaaataggaaaagtctatacgtactaattttttcttacaaaatgtttacaaactctgatgtgtcaagctgtgagtaaatctagatttcttgcaacttccatctagttaaattaaacggttgagaaatttgttagtaaaagttttgtaaaaaaattttagtacgtgtagcagtactcttataaatatgttagttatatatggaattatggaagctttataattattaatataattttttaattatgttgatggaatacgaaggtgagagtcttagatatatagatccgacttcatatttattaattttgaattctaaattattagaaaaagtcccgtacagggattttccgtcaagctgaacatcgccgtcattgttgctcgcgctcgccgtggtcatgacctcgccgcctgtcacctcctcgctgcgtcaactgtcgttgtgtccgtggtgaggttctgctctccgatccctcactcctatggtcctcgccatacggtgcactgctgggccgccggtgccggttgtcgcatccctcccttgtgtagctgggtgttcacacatgtggctgcttagatggtgtcccgtgggatccactcgtcggtctcttctccaaaacttatacgtgggtctcactctgctttcccgtggaccgtcttggtaaaccggtccatggtgaactaccgtttgacctgtgggtctcacatgccagtcgtttgatcgtttctctcctcgagggctaatgcattacacataatttaatggtataataataattaaacaattcggaaatatccaattaaactgtatataaacttcagatagccatatctcagagctatagccttgtttaaattgcttaattttgttgtaacttaaagaatacatgtatgttgctttgatgtgctgttaccattttttctcagagctatagccttgttttgtcgttcatgcagttgctgtcgttcggaggttcctgaagtgcaagtccagtccattgcatgagtctcctaagtccgttcgttgagcaaggtaagtcaggctctccttaatcatattgaatgctaatttgtgaaaaatattttaatttaaattattgtattcgctttattaaatataccacgttataactattttacttagcctttcctatatttccttgttatgatctgatttaattgatattatctaattacgtttgacaatcctaagtaaaaaaacaactagtaagaactctgtatggggtgcttacattatactcagcaatgctctattagaaacatttacttcctctatttcatattataagtcactttgacttttttctaagttaattttctttagatttgatcaa

SEQ ID NO: 38969 - DNA, 1343 bp, Oryza sativa
cgctacccctacctggcgcgccaactgtcgaaactagatttcggcaataataaaaggggtggctatcaagctgaaaaagtgtatgggtttggagacaaaggatttatacaggttcaggccttcttattcaagaagtaataccctactcctgtccggggatgaatccgccgattgtattattaattgtatgatttggagaaaatcaacatctgcccctagaggcacccggaccccccttatatatgggaaggagtccgtgttacaaaagataatctatatccctaacggaatatgcagatacagataaaatacagtcgtaaccgactaagtctcaaggtgtttccttgatgtacaagttgagaaacaaacccgagatacaaataagatattctatctatattcggtatcctatattcagtccaaatatcatcgccgtgtagatatggggtatccataatctccacactgatatttaatccagtgagtcgatctcatgtcatcgcagtgttatggtcgacacttaatttctttcctatggtcatacatgtccggcaatgttttaagagtagggtcaatcatgccttacaaaagctaattgagcttatccgatagttctactcgtaaagcttggaagtcagtctcatagcgcaccactcttttatttgtccacccgcgaaaaagaaacgtgtggatcagcatagcccaagaaaataggaatatgtgttatgtttgttcattaatagtcataaaatggcacccttgagagggtaatctatttgtgcctgaaaattatgtttttttaacataatacagacgcatattcatgtatacacgtgcgcattctcattcttacgaacatcatctattcatctatcactgaaagattatgagcattacatcatctatgactgaaagaaattagctgatttacttgttggacaatttccagcacaaaagttatgtaaaatttatgtatgagttgcataacacaacttcatgagaggcaatagttcctgccatttgctcattagttaactttaatactatgaaatatcataataattcttattatttttagtatcgaggtaaacattgttgcaccaaatacaacaggcttaataagatatgataaaaaaaagagtcgggcactaatgggcttttatcaaaaagagaataaattatgcccaattttaacagtttggcacgaatttggcccagttgtgctctccaatcttaaaccgacttgtattcccgcaatcgccgccgcgatataaacctccactacatcgatccgtacaccgatcgcgccatggatcgccacgcgccgccgccgccgccgctgg

SEQ ID NO: 38970 - DNA, 801 bp, Oryza sativa
attcctgcagcccatgtatactattgcatggccttaactattttgtatatctatatgcattttatcttgaacatgcaggggatcggcgcatcacccaccaagccacacggcattcttcttgaattgctccctgaatttatttaattttacagaatattccatatgttatcttttttttttttttggtcttctaagctggtccaaatgatgtgcatttatatttctatatcgaaaatatctgtttttttacaaggtccactagttaaataaaattctatttcattccctgctggcaggaggtatacaaaattttatggaacttctccaaggtcagctataaacttggtgcaagattctttgatgagtatgttttccataaacttctattatacattatatacacatctttgcaaatattgagatggatttagcattatggtgattatagttgtcttctcattcttgaagaccctgatttgattgattgattcatccagctgctactttcatcccatttgatatttatttctttatcctgttacgcccttatgaaaatatgcctattgatatgattgccagagtataagcactgggaagaggaaattgataagtggcagaggccaattctccatgatgagaggtttccggagtggtgtgtacttgtacatgacttaccagttggctgctgcaaggcagtattatccttgtgttaagttatagagctttgtgttaagttcttagttttctttagtctacacaaaagataatatccttgtgctttctggtgcttaaattcttgca

SEQ ID NO: 38971 - DNA, 1501 bp, Oryza sativa
tttagcggcactgaactgtatcttgtgggtaaagttgtacaacctctgcagagtgtcaatctattcgaatagtcgcgtcctcggttatggacatgctcggtgatttcacatgaggggtagatttgtgaaagttttacttttgggaaagagctgtgtgcaggataaattaatgaatatagctgtgtggtcctgtgtggacgcaatatcctttttgggttggttggttggttaaaaataccgtgattgcaaatgttgtttaaatgaaatttatatctatttattgtatttaaattcacaaatgcctttacgcaaatgaaccctagctttcctttgaagccttgtatcatatattacatattcccgtacacttgtgagtactttatgtactcacccttgttgtctcacaaaatttcagagaatgccagttgtttctagaagttctgttgctaaggatgtcgaataggttgcgtgccccagttgattgcctatggtgtgtcgttggtgcctctcgcttcttgtcccactgtttatctctgtttggccctgcgtggcaaagaaattgtaaaatctggtcataagaccaatgtaaaaattatatttgtttcctatttattaatataatcgtgatgtggttgtgatattatcttttgttactgtgtgtgctagcgttgatctgggactagcacattatacacagagggatcctagttggggtcccgacatgccgaatccacttcgattccaatgttgaacttggttcatggtttaccaaatttggtcattaacagaggtgtaccagtttacctaccagacacatctctctcacacgttaccatgtgctacatgccaccacgtcatttggacggaagtcataacaaacccatcgcttaagaccgccctaggtcaataagacaatctatgccctcgtgcatcttaaacccgtctaggacttcatttgcgccctggctaggaccttatatgtcccaatccgtgtcttatttgtttataattgtggtaaacgatgtattaagccttacccattagacatgtggttgtacggagtatactttgcaacagagtcctaaagactggtccttatgattgccaatgtgcaactaacaaaaccaaacacctcgagctaagttgaaaacaagtttgagaatattgaggtagagtccatcaggtccaggctaacaagcctctaatccatcattaatcaagattatagtgtcaatcctaaagtctatatcattacaaattaattactccttcgtttcatattataagtcattttgactttttaaagttaaacttttgaaagtttcaccaagtttacagaaaaataaagtaacatttatagcaccaatttagtttcgttacatctaacattgaacatatttttgttagtttctttgttctgtgttaaaaatattactatatttttttatagacttgatcaaatctaaagaaaattaacttagaaaaaagtcaaagtgactta

SEQ ID NO: 38972 - DNA, 798 bp, Oryza sativa
caggtaatatttttgtagggtattgagtacatctggatttgtgtgtgcctcacacaacgtgtgaaaggtgaatgatcaagatacgtatggattgcatgtttgctcactgaagttggattaatgtagtgttctcatgtggatttgatggctaatttacggttattgttgcggttatatttttagcatcttgtggaaagtggaaacacgtggttttgtaaaaaaataaaataaagtgcagtgtttgggaattcaaattaaatatgagtaaacctatgacaatcaaccttttgactgtcatactagctccattttttgaaaaaaaaggtgcagtgtttagtaattcaaattaaatatcagtaaacttgtggcaatcaacttgtggcaaggcgtgtgtggtttaaatataaacttgtttgcaattttttttcctgctctatcaatataaacttcacaccgtgtgatgtgagttgttttttttaaaaaaaaaacaaacccatcaccctcataatttcgtcttaaaaaaatattttgaggatgtctctctcttcaaatctcgtttttttcttttaaattaaaactgaaattacagtccttcttaaccttctcattttttcttttaaattaaaactgaaattacagtccatcttaaccttttttttcataaaaattacggcctagcccattttagcctaatgggcccagcccgatttggcccaacgccgcctcgctacagagactatctataacccgaaccaagatcgatctcaacaaccgatcgccgccgccgccgacgtcgac

SEQ ID NO: 38973 - DNA, 1501 bp, Oryza sativa
tggcgttaaatatttagaaacgaaggtagtaggacgcattcgtagcagaaaatacgaccagaaactctttagttacaagcacaaactgtatgttgaacgatcgactacgtgattgatacaattaattagatatttattgctataactcgatctaagctagcggcggcagcacaaatcaaacgtgagaagtaaaaatcggtcaaagtcgatgttgtctacgtaatcacctaattactttggtcaaaataattaacctttaccttttcccaatatcgctagttcttgctgcgcaagcacctccgcatatattacgcatctatggaattggtaattaacagcagctactaattaagacaattttttttaaaaaaaatatggaagtatagcttttggcctctgcactaaaaaatatgtgcacgttatatcatggacatcaaggtttaaacagagcacaccaaaattaagaggaaattttggcttcaaaccattcagatggtggtgaaatttgttgcatatgacaaaattttgtctgaacgtcaaagcaatcagtcttaatctgcacatggttctactgtaattacagtgaagagagtacaccagtatctacaattccatacatcctcttgtccctaattgactttgataatgtatttgtgacaactgagacaatgagactagtagtattatttagaggacagcatgcaagaacaaaggagtaaacttccttctgtctatataatatgcaacaagtacgcagtaatgatctttctaatgccgatttggtcaaggaaatatatcattgacagcttcctttctgggaagatgccttctagttggtgtaattttttcaaagaaaaacactcggagaggacaaactttttgtgatcattattgtctgtaacactgtatgtaactgaatagttcaatcagctagcaaagcccgggctactcacggcgtctaccttgagataaactcagaattaacagtaagatcaatgtgtgttttgattcttattctgtgatgaataattagcatctgtgattattggtttttgatatttggaatttattcacgaagtggttttggagataattaattttcaggtgatgaacagagtttgttgttttgtcgggaccagtcagactaggcggaggttgccggtcagaccggcttgtgttgagcggtcagaccagccggcccgtggtctgaccggccgacgctgtgtcggtttcggtttcgggttgtttctttggatatccgtgattgtttcatggttatggcttctagatggatactatacgtatgtaatactattgtttgctactaatgagtcaagttggggatagcttggtctcggaatatggtttctttgtttgtttcatgtgtaggtgactcgatacatcgggagagtatttgcggtgatggaccgggagtcggtttggtggtaagacgatgtccgtggtggtcagatatcatgcgggatactaaggctagagttga

SEQ ID NO: 38974 - DNA, 1501 bp, Oryza sativa
ccgacgaagacgaaggcgccggcgccgccgccggcggtggcgatcgccaacctactccattgctgccctgctctggtcgacctcagtctgaagctcaagatgctcaactacgcatggtcgaagaataatagtatgtacttgagttcatttcatgcgaaattcaagccagatttcgacaaatccgttggtctgttcatgcgtcacaaatcgaagatgacagcggtttcatcatccttgatcgatgaacaccatgatgataagttttctaacatctctggattgagtggaaaatcattcgcctgcttgaatagaagtctcagaagagtaaatctgcagtttcagttgggttcggcctccaactgttttggagtccggcttatcagattcttcgctcaaaatgcgatggttttggaagaaatgtgcatcgacagtggtaacagaaaactctgtgagcacatgaatctcaatgttgaaagatgggttggagttgattcgtccaagattcgtttgaaagacaagaatttaacagggagttcatgggagttttcaagaattcatccagattcggcaccagagttcgagaggaatgcaacaagctttaaggtgttaccccttgaaagacgatgatgatcgtgcaattgttacccattgatggtagtaacgatgaatataagatttgcatctgataaatagtgcaatcagttaattcaattactagaggactatgatattttgaagtttgtattatttgcaagggagtttttaataaatactccctccatttcatgttataaaatgctagtcaaactttattaagtttgattaagtttatagaaaaatttaacaacatctaaaatataaaattagtataattaaatttaacatttaatatattttcataatatgtttattttgtgttggaaatactaatatatttttctataaatttggttaaattaaagaagtttgacaagaaaaaaaaatcaaacaaaaaacggagggagtacataacaagatgcagatgatcaagttgtgcttttcgtgaccttggcctgaagctgatgaccacatggcctggaccggcttgtgcacgctggaatttaacatgtacgtcttaactaatgcaatacaagaataaaatgccccaaaggcaatgccattatctagtgaatactggcaaagaggaggaaggtccttgccatagttgttaggataagttgtttcaagaggcatcacatctcttgaactccggcggcggtggaggcaggctcgtctccggtgttggcccatcctccacgatgaacgccgtcgccatgcccataatgatgtggaactcaaagtgacagtgcaagtaccacatccctgttaacaagaacaaaacaaacaatgacacatcagccactcttttcacccaattcttatacctaccaacttaaaacgacaaaataatatcatgttatataacataatagtgaattccttatatgccattgaacgttta

SEQ ID NO: 38975 - DNA, 1501 bp, Oryza sativa
gcggttgacatgggacatgggtggtctttggcgcagttcatgacgtgcagggcaggagattcgaaacggatgttcagtggaggagcattccgaatttgatctccaggaagagaacaccattcttctgtgctccgtcaaagttggcacggttcagggctaagcacacgggactagctatatatatttatcgacaaatttactcggaaaaaaattatcagatgtaaatgtaaaataattataatgtagttatagtgtaacctgcatgtagctacaatgtattttgtgtataactttcaaaagtcctacaacaacacgttatttgcatgaagcgaaagtcgcgagaccaaatttcctcacccgctcgcactgtgtatgatctttttctttccaacatgcacgaatcttaaattaaatctaatggtttagaactgtatgaaaagttatattcaaattaaattgtagttatatgcaacgcaacaattatattgtatttacatttaacattttttgggagaaaacttagtataatttatagcaaaatcgaaacacaacatacttgcgtcagtctccaattcagtatttctccccatatataccagcatctgaagcaaacttgaaggcctggaggcaggtctctgcctctgcctctgcctgagacggttcagaaacattttgcaggttgcccgaccccgctgagactgcgatggctatctctgatgatgaagccccagccaccagattctgtgctattcctgaaaaggctccatcaacatttatcttcaggtatccctctcccggtttcttccatctaggttgactgccaccaacattagcaaggggtgatggagaaaccgtaccaacatccatcccaaaatctgcaaattcgccaacaggcatggctggccctgattgatatctcccatatgtgaagaaatcatgaccttcggggatgcagtaggtaataaatagcgtatagcgggttgttagcggattagtgtccgtgcagcggattgcggatagtgggcgctattgcggacgctaagttccaatagcaaatataagaaaataaccataaatatatcaatattatcatcaatttcacttaaatattagaatttataatacatttttaattactcatatatttcataacataaaaatatgaaataacatatagatatataagataaataaaataaacaatgtaaagttttacaattcatatatccatatatgaagaacaacatttaagcgttataacggtccaataaagtcaatagcgatcgcgaagcgctataacgggctgctatagcggtaacgaagtgctatatcgggcgctaagttacaacatgctatcttcagtccgctaccgctattgcgggcgctacgaacgctatttattaccttgataacagtgttgctaacgccatccgatgataggggcgtaccccatatcatttttttaaaaagaaaatttatatatagtactctctccatatca

SEQ ID NO: 38976 - DNA, 1501 bp, Oryza sativa
caggaattccaggttagggcagtgtgatccaacagcatgcaaggatgcatcagtcatccaagcacaagtggcaacgccaagagagacaagtgattgtccacagttctttattagtccaatcaagccttcatctgaagtgccttcaacaaaacgcaagttcaaattacgaagtaacttgcagccttcaccaatagcaataagtcctggatctccaatatagcaagcctgcagaaaaaaaattgtgatttagacaggtcaaaaatttgtgtgcataattagtctctacattaacagcatatttggcatgcagatacaccatttcctcataattagagaagactgctgctaatcaccaggaataatgcttgttccaagtattgtgaggtttcatataccgtattacaagtaaatattacattggacactcacagttaatacagaggcatagaagtcttcaagaaaaaaaaaacatgaaagaattcagagatgatgaagtaaataactgagaaaaaagcaaaggaacgggtagcatgacattacctgaagatccaacgaactcaagttcttacaattctctgatattcttactaagcctgtcgaagttatggaagaacaccataccagacttagtttttcgagccctttgcaacccctggcaagactagttaatccaacatcagtcaagcaagtgcgctctgtctcattatcactgcccggctggtccaatggaaatggggacatgtgggctccgaaatttgagctgcgggacatcctcctacggcgcccggaaggactaacatcatacatctgtatcgcatcagtgcatcagtacaaggctatgttaatctactgcaaggagaaagttttcattaaagaatctagcggcaggtaataggacgacatcgaggcacatcagttcatatatattgccgtataataatcattaatcactactaagctggtggacacatagcaatggtttttcaaactgatcatatgcaaaactcacacattacttatttgcatgcagctgttgtacaagtcatggaaatgcagatctcatacaactatgtacaaatggataccacaactcaatccccaggagaattatcagttatcacgattctgcatccaaccaagagaaatgcggatttgtaaggtccaaatcgatcaaactaccttcaaaacaggataagaaatcgatagtttgcccccaattcccctacaaaaccttcgacagatgcgaaccttctcccaaaattctaaatctcctcataatcccgattcggaaaacatctctacgatcctctacatttcctgcaattcgcgtacggagccacaaaagcaaggatagggatggagggaacccaccgggcggcggcgcgatctagcggcggcacaggagggcccggccgcggcggcctcgacgctgatgcgctcgtccaccgacacctcgacgagcgccgggaaccgctcggcgacgaggcggagcacctcgtcg

SEQ ID NO: 38977 - DNA, 1501 bp, Oryza sativa
tcgtcttcttgccgttccgatcactgcgttgtttcatggattatatggatcaattaagatcttgcacgaccaactccgacgaggatgacatggtgttcgatctatggattgtaaaatgataatacccctacgcgaattatttttcctagacgaaaacacctctccacatttctacttccactaattctggtgggagtagaactagatcttaaccctacaattaaatatgatcgagggtccagattactttctactccgagtagaaagcaccggagtgggactgtaaattttagggatagattattggtagactgttggtgatgctctaacacaacgatatcacatcagttatcaaatatggaaaccgaacatgagccacagcaagtgcaacccactctcttggaccttcatgtctggcaccaatatttcaactaggcacctacaaattgggcgcaatcgggcgctatttcaccaagtagattgaacatgtttcactaaatatatcgaaaatatttcagtcttttaaaaagctgaaacataatcaaatcaccttatgaaacattttgctacaatgtatgaaacagcggtttcgaaaaaaaatcagacgttgttcatcctatataaaacaatatttcagcaaatagcgaaagaatgtttcaattctttaaaaaaagtgaaagacgatcaaattgctagatgaaataatttggttcaatatatgcaacaaaagatttgaagctattgcaacacttaaaccctgtgtacatcaacaacccacgtatctatcaagatgaaattattaaacagtatcaaaactcactgcaacatttgattcatacatagttaaatatcacgagtacactagctgaaatattattggtagaaaaaaaaatgaaacagattccccttaattatagaacgtttctgttatatccgggtaaccgttgcaacggggcacactgtggtggagacacgtggtgagcgcgggtgcgcgtggtggcggcatgttggcggcggacgcgcgggtgcccgacttatattggcgcgcatcgggcacccgacgcaaaggattttccatatttcagtacgcggagaaccgctggcggcgatggatcgatcaacaacgtcgacggcgtcgtcaaatgttattggcaaacgtgacactcttcttgattttctcttttaattattttgtcccgtacattgcacaattaacatatgacgtgtccatatcagaagcgtcctcttaatctttcacatgtatttaaaaacatctgtgtcaaaggtactactttgtcaagttttatttaggaccattcggtgcatgcatgcgtgatgactgatcgacacgcaaatccatcgtcgacgatctttgtttactgttttgcatagaaatagacgatattaattagtcatcggcgtgttatgacttttaagagtcaatgtggtactaagatctttacactggtggagaaaccctttgtagtcccggttcgtaacc

SEQ ID NO: 38978 - DNA, 265 bp, Oryza sativa
ccataattattgtgagaggtgtgagactaatcacgaaaaacattgctcaacccgcccataaccgcgggcacggctattcgaatagttttactctggccagaggtgtaccactgtacccacaagacacagccttaacatcatgtctaccatgcgtcgcgatactagaaagtacccgaatagaggctgtgacaataccctctgtacaacacaactcaccacagtgcaccattcctggatcataatcacccccttataaaacaaggca

SEQ ID NO: 38979 - DNA, 349 bp, Oryza sativa
ccatgcttagaaacattagcacattattgggataacttatgactcattattacttaatgatggtttaaagatagttcacgatggtcaatcgtgattggttaattaattacttgccaactaaaactgataatggtgggttgtgagcacatggttttgagagtcgtgctcatgacaattaaggaccggttcgcgagctactattgtgaaacattaaccgtgccaaccacaagccagcgtgggcaacggctttaccttttgtatagcatgattcattgcggagcaccagactgagaagtggcggagataagcccacgggggtcgctggggagtccatgccttgttttataag

SEQ ID NO: 38980 - DNA, 160 bp, Oryza sativa
attacttatccaacacttaatattttcatctaatacataaatcatcgctaaatctatacttcataataattaaagtactaaaatttacctctattttcttcgacttatatccctcttggcttggaccattacctcttcatttcttctctcttcctcaagc

SEQ ID NO: 38981 - DNA, 1501 bp, Oryza sativa
catgactggcagactgggtagcaaataaacatagtaggtgaatcacttgtaaggcccagagtagcatctagttgacatgcttcattaatcttgatggcttgatgcatgaatgtaatgcatcttgaaccagcgaaacagcagatcatatgggctatcgtgctattctgtattgctataagctcacagttcatcttgactgttcatatgccaatgatatgataatatcgtagtcgtaggattgccatcttgtatctggtgagctatctgaaatgaacttctgtataagactaacatggccatagaaactactcccactgccccataaacaataagttcatttttagcctatcctatttgtcccaaaatacgttaatttttttaatgaaccggcacaaaactatgccaatctcattgaatagagtaggataaaaaatgtacagcgtatatggaatatatatttacaaaaaggggaaaaccgcaaaccctaagggactaggtctcgaaggccctttgctcctttcaagctccaagtctttgccttctatttgatcttggcgaccaggcttgttgccgacagctctttatgtctgaacacctgctgatttcgttctttccatatttcctaataagtcaggaggataaggcttcacaagcaaataagttcatttttgagtaaccattgcatcggagtttgttaaagtagggtataaatgtattggtagtagataaagaggggggactaattgcattgagatttgataaaatgagggtattatagttttttaggttttgtattagggtatgtgtgtaatatgtgaaaaataaacttattttgggacgaatggagtacaaagtatatgccattcttaaaatgagaactgaaatgcacttagatatacaatacaacgaggcaggagattttattcaagcaagaaacttaattctacacatcagttcctggaatgtaactcggttatattttttgcataaactaattgatcgaacgccttaactggaaattcaggagcacatacattttgctgctaatagtacaaagagatttggaactcgtacaggagcccgtcaagaccttcagctaaatcaggttgaagtaggaaattgtctcagactttctgagagtgctctgatgcttttgatacttcaacctgaagtcccaagctaatggctctgcgttgagatgttaagcattcagacaaggagatgctctgttcttgattcagagtgcaagacagctgtgagaaatcacgccggcagtagaaaaaacgcgccaaaatacaatgcctgcctgtctgcctcgtccaatccaacaaaaccattccgccttgtgcctcccgccggccggccgtcgggactcgggacgcataaatctgctccgtaaaacaccagcatcgccgagagtgagcttgacgtcttacagccatttttcctttctgcaacccatggccgcctctacggcgcatctccttcccctcctcatcgt

SEQ ID NO: 38982 - DNA, 258 bp, Oryza sativa
ccatcgccgccgccgccaccactggtggatccttccttgtgctgctctcgcgggatacagcgccatcgacggagccaacatcctttggtcttaatcaaagatcgccgcttgctgcctgctagtgccctcttcacatacgaaacccccaaatccggtctctggcgattaccattgccgagctcgagccgtgacttgtcgtcgcaatccatcccctctctagcaggcggcagtagggaggcgctcagtggcaggcggcga

SEQ ID NO: 38983 - DNA, 1501 bp, Oryza sativa
gcgcgttttttctactgccggcgtgatttctcacagctgtcttgcactctgaatcaagaacagagcatctccttgtctgaatgcttaacatctcaacgcagagccattagcttgggacttcaggttgaagtatcaaaagcatcagagcactctcagaaagtctgagacaatttcctacttcaacctgatttagctgaaggtcttgacgggctcctgtacgagttccaaatctctttgtactattagcagcaaaatgtatgtgctcctgaatttccagttaaggcgttcgatcaattagtttatgcaaaaaatataaccgagttacattccaggaactgatgtgtagaattaagtttcttgcttgaataaaatctcctgcctcgttgtattgtatatctaagtgcatttcagttctcattttaagaatggcatatactttgtactccattcgtcccaaaataagtttatttttcacatattacacacataccctaatacaaaacctaaaaaactataataccctcattttatcaaatctcaatgcaattagtcccccctctttatctactaccaatacatttataccctactttaacaaactccgatgcaatggttactcaaaaatgaacttatttgcttgtgaagccttatcctcctgacttattaggaaatatggaaagaacgaaatcagcaggtgttcagacataaagagctgtcggcaacaagcctggtcgccaagatcaaatagaaggcaaagacttggagcttgaaaggagcaaagggccttcgagacctagtcccttagggtttgcggttttcccctttttgtaaatatatattccatatacgctgtacattttttatcctactctattcaatgagattggcatagttttgtgccggttcattaaaaaaattaacgtattttgggacaaataggataggctaaaaatgaacttattgtttatggggcagtgggagtagtttctatggccatgttagtcttatacagaagttcatttcagatagctcaccagatacaagatggcaatcctacgactacgatattatcatatcattggcatatgaacagtcaagatgaactgtgagcttatagcaatacagaatagcacgatagcccatatgatctgctgtttcgctggttcaagatgcattacattcatgcatcaagccatcaagattaatgaagcatgtcaactagatgctactctgggccttacaagtgattcacctactatgtttatttgctacccagtctgccagtcatgcataaagaacctaagcaaccagatgttgatacaccaataagcatatattgcatagttggtgtccccttctatagttctgtcactcattcctaataacccacctataaaatcatgaacctaggtatgaagtcatatctaccaatgttatcccgatagcaacaaaattctacagctcgtaaatgataaagaacagctgataagtacgaagaagc

SEQ ID NO: 38984 - DNA, 1325 bp, Oryza sativa
ggaaggtggttgtaattgttggaaatatggtcatgaatcggcatattttaatccaaaactttaaagcaataatcatgacataagcagtgtatggtgatcttaatataaccagtagcatactatacgcatcatgaatgtcaagaacaggaacattacaataacgcaataacatgctagaggcatcatgaatatcaggaacaggaacatagcgcacatagcagtaaagcgctaacagtggaaacaggaacaggagaaggatataccccgagaatggacctccgctagactgtgaggcagaattgcctccattgatgttgttgttcgcgccatcggctccagctcctagcgcaccacctccggctccagctcccggcggcgcaccacctccgccatctcctccagcagcggtggcggcaactccagacatggcgagcagtcgtgcgggaggtactccccaaaaacctgatcacccgcttacccggtgtagatctcaggcgaaggtgtggtttcggaggcactgctacttccaatctctcgtgcgtgcaagagatcagaagcgaggaagcgagaacagtacaggcgcggaggaggaggaactaacaccgggaaagaagcaagcgatcagaatagatcggactcgcggcctccttatctatcaggagagagaggcagtcgtgggaacgtggacgcgctgttgtgaagagagtcgtgggaacgtgggttagtggctgcaaaagaatagcgacgtgacgcacgcacgccgccgccagccagccacgcctcgcctcgccctcgcccacgcccacgcccttcggcctcagcccggcgcgcacgcgcgcgcgtgtagcattccgacccccacctcaaccagtcaacagggagcctccaataactccctatttaggttgagatattcctcacttaaatcctgagatagtattattatccttaacacttattatgggcctttgagatttaataggataagttgggcctagcccaattattctaacaatccccaccaaatttcaaggctcataagaaatgttctcaatgttgtggctgtttgatataccagggttttggtggagactgttgagttgaacttccacctaggaaatgagctacatcagaccacaactgaacaatggactgtgccttgaattgtcagttttgtgtgatcaggtttcactcagaaccttgactggtactgggctgccgttcgcatcccctctgtttggagcatataagtcaaactccaggcctttcatgagtatcttgagatcgcccaaacctcatagactgtgactacagtcgaactcata

SEQ ID NO: 38985 - DNA, 1501 bp, Oryza sativa
  unsure (1)..(1501): unsure at all n locations
gaacagcatgccattaaacctcgagtttaataaattacanatacaagcaggatcgctgagaccggcggccattgcgacgaacacccaagattcacctcgagcatctcgaacgacttcctgatgtgtccgacctcgtcggcgaaggtctcccggtacatcatcgtgattaccaccttcagcagcctttccgccgagaccaggccgtcgacgtcgccgtcatagccggacaatgtcgacctcgtccttccagctgctgtgccgacaggccgttccctgcgaacaattgttatgtggggaattccctttcagcggcacgggcgaacggacgaacgccgtgcctgacgggtgatctagcgccaactgaattcggtggattcggatttgcttcacagtttgtttctgttatcccttttaattagcaagtttgttagcatgtaaggctactattgacgtaaaacacgtggcctgggagatatgcttaactctagtgcaggtccaaaactcgccttcgggtatgctagcgtgccagttgatttgatcctgcaatcaataagaaataaagacaaagaaaccgcggttaaacctataaacgatagccgatcggcttgagtgccgatgacatatcatttatctttgagccgatgtcatataggtatcgatcgacaatcatgaataaataagaaggaactaaatcaactcgatcggatgtagatattaacaatatatactccttatattgatatatacttaaatcaagtgattgggatagatcggtcgccatgccgagacaatataaatcgctttgatcgaaatatatattgataatgggactatatatgttcatagcatagccgatcagatagatctaacatgtatcggctaatactccgataccactctatattaagatattaaagcaagtagaatatatcaaacaaaggcctaataaacttaaatgcaacgagatcttaacataaaggacagatttaacatatcaacgaagcatatagagtaaatatagttaaatcaggtaagatctgatgaaaccctgatatatactatcctaatcggcaaccaagaagcaggccagatattggaattttaatcacgacttataagatcaaactcaactgatgcagctatcgagttttatagagtggtggataccttatataatctaagtcaacatcgatatctaacctaatcggctgccctctaccgacaaatgttagccttttgtaggttagatagcaatattgccagagattatgatatatgataactcgatgaattacataaacaagattagagtatcataaagatggaagcactaatcccgagaacgcaagccgccataacaagttttacctcttgttgaagatcgaaaccgatgcagctcaacctgaaagcaaaaactcgtcgaaacacaacaaaagtaaaagggtggcgatgcgcagagattgtattgaacatgtattaattaattacatggggttcgggg

SEQ ID NO: 38986 - DNA, 718 bp, Oryza sativa
atccattttttccaattccctcagccaccttcaattatccaatcaaaatctcgttctctcctcccactgatcaaatatcttcctctcccatgaatcaaacttttcccctccctaatcaatttctttctttaacaccaaaaattaaatcgccattatgagctgaattcattttttttccaaacacccaatgacttgtcatctcctagctactcaccttcctcctccctcaaacggccacgttcctgctcaaccttgaagcagtgccatctcttccaattcctccctcccattaatcaattcctatacttaatgccaaaaactgaatctctatgataatttggatccgtttttctaattaccttgggctctccatctcccgatcatcatctacccttcttcttcctctggccagcagcaggccaaaagcccccctgtccctcatattcccgcctgcagcgccgccagaacagaagtgcattctccatgaaggctatgccgcctcctccaactcccttcactgatcctttcctctccttcatcaattttcgtcaccaacactaaaaattgaatcaacttgttgatctaaatccgtttttgcaattcccggtgacttctcatctccaggacactataacctttccccgccatctctctccatcttcctccaccggggcatcgtcaactacgtcgtcttgctgctgccgctgctcaccacagt

SEQ ID NO: 38987 - DNA, 1501 bp, Oryza sativa
cattaggggtgtgaatgtttgaaagtgtttatcaatgggtgtgaatgtttattatttgatcaccatgcctcatgcaattgagattatcttttgttacttgaaattgtttacaaacttgattactcatgctttctcaatcggtaccggaatcaattgcatagaataaagtttttgcaattggcatcgagaatttcatttgatacattttgaatcggtgccaagatttgagttgtgtgtgttgttataattttggtatctccttcacacacaatacaccccatggatgcaaagagttagggggagctctcacattttcaaaaatatgtgcctatgtgttcactttataaacttgtatgcaccgatttaggggagctcaaactaacctttggattcaaaatcatttattatcaatcttctgtaagctttaaacgtgttgtcataaatcaccaaaagggggagattgaaagaacatttatgcccctagtgggttttggtttattgatgacaaacgattaaaggactaatgcacttgaagatgaagaagctaggaaaatggacttatagatggatgagaattaaagagaagatattgaagatgcggtatgaagtgactacctatgtcaagatggtgaagcgcaagcgacactcaactgcgatggaccatgcggtggtgaagggcaagtgaggggcttggcgccgacgaaccgaaaccggtggtgaagggcgagtgaggattgtgtcgtgatgaaccgtgcgaggccatttgaagccatggattatccgcatcaatcatttgagaaaaagaagataaaatgtcaaagatcaagaagatgagatcttcccgatgatcaaatgaccttgacgttggtaaccctccaagtgaagaaacaatatggtgtgaaggtactcctattggtataactttgccttttaaatttgagtttaggatgccgtactattaagagggataccacatgcatataattggttgaatactagtgctcaaaatgcttcatttttatgtgagttgaaaaacctaagccaaaatttcaatcccgagttgtttcacttgtcacaacacttacactgggtttctttgcaagtttttcaacatctcttgaaggttttggaccatgttttatgttgggtttgatagcccatgaaactagctttccatagagtacaagatcttcgaaatcggagttcggagtaaaaagttattgcatttttacttgagcaacatcacactatccgatttgaaatcagactatccgatgtatcggactatccgatttttaacacaacttcactctctgtctttgtttgaaaaatcctttcgagtgagtttttctaagtgtcggagtattcgatgttggatcagatagttcgatgatacagagactccgaaaattcatgaaacatcagtctctgtttgacgacgaagtttttgcttctaaaatatcggatactccgatttaacatcagatagtccgatgtctcg

SEQ ID NO: 38988 - DNA, 1501 bp, Oryza sativa
ttcacatgaatggtaattacggttctgctgagctcaaatccagcatattgcatgacttgtgatacatcgattctagtagcatgtccattgatataaaaaaataattttgtggggtttaatttctagcttcgcttctcggttatctgcgccacaaaatttgaatcaagaaccccactacaaacaaaccgacagtgacgctattgtttctgctggttaactgattattgcttccactttgtcattgcctattcaaagccatcactgatgccacttatttaccagcaatcactaatacagaacagtaaataggggatggctctatagatgccaaaaatattagaactgacagtatagtgattttcccactcaagtgcgtgcctgcggggcgccgaaggagacaaccggcatcattatgtgagcctcgccaatagttacttagtcgtgaccgatggtggggcccacataaagatgtcggttagggttcagaactggcacctttgatccaccatatatatataagctctttccatccttcttgagctgatcgggtatagaatacatcggtgccttttgttcttcctcaaccagttgctttagagggaaatggttttgcttaattttcttttggttttcttggagatatttaattttgatttctagaaggttagtttatataatttctcacttcatttctctcttgtttatggaaatcaattgtttgctatattgtgtcgtttcttttatgtatgtttttcatggggaaattgtgttattttccttgctttccagtttaattatgattttacccctgtttgttttttaggttttgtgattttgcccctacttttttgaaatgaagcaaccgtctgtccttggttttgacggtagttaggtgggcccggaaatttcgaattaaacgaaggaattgaagaaaatgatattgtaatttgtgaatgacaatcgtacccttgtttcagtaaatcacaatgttataatacattactgaagatcttgttattccaatttgcctataaaatccttattgtatttattctacactgcttttaataaacgataaatgattcatgaactaggttaaaaatatattattgttgaactcttcttgccatattattcagattatgacacgtacgtaaattaaatcattccataggtactcatcggttttaatggatcaacgatgggtgtttgatgcgacgcactactctatggagtatataaggggagtaacatctcttgttgccgaggtgacgagcacaaaataagtgaatggtccggattattgcctgtagtgtctatgcattaattgcaagaaagactgacaatttctagcacaactagtccatgcacatctacttacaagggctcttatgacaaacttcagatgtccttacaatcatgatgaacgagggaagtgcaggcaagaccgacgttccgaatgaggatgtgggctatgagcatgatgaccaaacatgaattg

SEQ ID NO: 38989 - DNA, 1501 bp, Oryza sativa
agagtctcatcggtggcacatatgcatcgataaaattaatttaaagacccgaaacgtcttattagaaaataaaaataatttatagataaaacttttatgtatctgttcatagcgacttaaaatctagcgttaaaaaaattacgttgaaaatatcataaaatcaacatcaaaatcaagtttgaaaaattatatttggcttttgctttggcttattaggccaaccgataaggctcttaaactaccaataagttgggtactactttttcagatgttcttagtttagtgtagctttatggtatggttttttctgtgtattgtttaacctattttttctcgggtgttcctttttgtcctagaattactatacaattgtcaacaatttttctccaaaaagccttcactttttggacccttagatcatccttgagattcatgtaaaacctaggatgaaagtttcgacaccacacgcttgaggcagggatcgaccccctgtcacctcacaacgcacataaatatgcacagctaaccaactggcccttcagggtagttattatacaacagttacacataagttacaatacaattgtacagttataagttataatacagttacaatgtaactataccacaattatagtacagttatattgtatttgaaagttttccatcaaacacggtcaaaattcagaggcggagccagggcccggcaaccctggcagctgcccaggctccgccggcttcatgcaatcatgccccattgtattaaacctaattaccttgctaatcatctttcttaatcaccgtatgaattgaagcagcagtagtatacatgtatatatacttaagtaacggcttaacgtagaatagcaaagcaaatgctcactctaaaatgatactccctccttccctaaatgtttgacgccgttaacttttttaaatatgtttgaccgttcgtcttatttaaaaacttttgtaaaatgtgtaaaactatatgtatacataaaagtatatttaacaataaatcaaatgataggaaaagaattaataattacttaattttttttaaataagacgtacggtcaaacatgtttaaaaaagtcaacgacgtcaaatattttaggatggagggagtatatggatttgtctactatgtatttgttgttaaaacttgtccagactcacaaaaatttctggatccgcgtcactgtgtcaaatgttatatagccactgttccccttttgtttgtatgccacgttgcgttacgtgagctagccaagctagctcttgctcttccctataaattaagccatgcaaacccccatgaccacatcagccaacgcaaggtggtagcgcgcacacactatacaaaaacacatccaatatattgtcattagaagtgaccttaatttcatggcagaactactgatcatctcctcgctgatgatgctgcttgctcttgtcttgtacttgtgcataggctggccaattctcagcaccctcg

SEQ ID NO: 38990 - DNA, 1501 bp, Oryza sativa
gccatccataccaccatggcgccatgcattcggcaataatggatcactgcagaggttatagaaaatacgctctgtagtcattcaatccaaatactgagaaagcataagattatattctcaatttctatctcctttttgtattgactctaaggttacatgccaatggatttatccaaagagttatcttctgtttgaggaccatatatactgtggaggagcaaagctatcacaatcccaagatatataatttcattgcctagttttcggttcagttacttcttttcatccatttgatggaaatctaaccactctcatcagtcatcactcctctgattccctgtttaactttaagcattatcccttacttggataaaagattgaacaatgaattgctctaacttctaatttagaactgataaagacttagttacacaagacatacaataaatttacaattgatggagacttaaataatttaaatgtaaaatattaagaccttgataaaaataaaggacagcatttataaaatttcagtaaacataatctaagcttacattttacgtaaaattggaaaaaacaaatcaagtcgaacagggggagcaggataccagtgcgcagagacgccgacaagatggccgccatcctggacggctggacctgccgtcccggctcgctgaagcctgaaggggagctaccggcgagcgtggaagcgaggaggggagtggccggccgcggcggaagtagtagggacgccatcgggggcgggcgccggcgacaccgggcatctgtggcggcggtggcggcaccggcggaccctctctgcttgggggaatttttttcggttttagattttttttaaaatatttacagaaataatctatcggccaaaaaaattacaaaaatagaccctgtcacccacctctagggcggcaagctgacgtggcaaacgggggaggaacgggcggtgacggagggagggttttttgcaggaaaacccttgccgccctctggtggggcggcaaggggcccgaatgcaaaaaagccagtcggggccggccattttgcaggcggccccttgccgccctctggccgggcggcaggcctcgctgcctataaaaggcgtgctgcccagcccccagccctcattcctcccccctcaaatccagtgaaaaaaaaagaagagaggggaggagaagagaagaaggggcgaagccctgccggattcagacaccgatttcaggtaatattcatagatcctatatgtgactattgagttaaatagtgtgtattttttaaaaatttgtttgaataaatgcattatatttttagggttttagttgtactaatctagaagtgcgtattgtagatatcggtaactacgtagatctgctagtttggaatcaatacattaccattgcattggcttacacaagaagatattaagttgtagatgtttattgcatgaaagagtaatatgatctagttatttcgttgacaaata

SEQ ID NO: 38991 - DNA, 884 bp, Oryza sativa
ccctcccctccccttccctcccctcccctcccctcggcggcagcggcgggctggcacggtgacctcgtggcttcgcagctcctcctcccctccctctgcctcccaaaaccctcgtggtggcacagctcgtggtagggcggcggtggccaaatttttttttacgctgaaaatattttcgcaggcgggtggatttggccgcctgcagcgttttgttgcagacgttatggacacctaaaaaataagttttggccgcctgtaaaaatgtttttttctagtgggtggaaatcaatcgacctaaaggaggctcgtccgaccactcacatggctggcttatcctgctggccatttgaagatgggagcacctcaagcttgttaatttaagtaaatattgctatcgttttagggttttattaatggttagccatttttgttaatttgtactacctcagtttcaggttataagactttctattattgcccacattcatatagatgttaatgaatatatatatatatatatatatatatatatatatatgtgtgtgtgtgtgtgtgtctatatccattaacatttatataaatgtgtgtggcaatgctagaaagtcttatattctgaaatggagaaagtccaagtttgtttattgatggttagcttaatagtaatgttaatttttgttttgttttttgttaatttgtaaactcacatgactttttctatcgttttagggttttattaatcccacacatattgctacgtttactgcgtttagccgaatgttgtccaaaataacaaacgatcgaaataatcgtaatatgcactgctaaaaaattattcttgctagctgctgaaatcgatcagtctttgcgcaaccaaaggtcagaga

SEQ ID NO: 38992 - DNA, 1501 bp, Oryza sativa
ccaaccagtacactgcatgatatcgttattgatatttaaaatattaaaagatatttttattcaataataattattaaaattcctaattagttgagatgtactcggttttaggtctttgcatgattgagttctaaacagccattcgaatcggctacttcctcatttcctgtgagcatgctcttcttcaacggctaaacactactggagaaaccatcttaatctacaatagtcctgattcaactaaaaactgggactaaaaaccattttagaactcccctgggccagggccgccgggctggggagacgatgggagaagcggtggcggcagcggcccccggcatgcggcggacggcggccggcgatgccctcccatctaccagaggtgaggtgggaggcggcagcggtggcaccggatttcttttttttttaagaatttgtaattcattggatctgtgtgatgtgatatgtgatatatatgtgatctgtgatataatttttttagaatttgtgatgtatttttttgacaatttgttatgtgaatcttatgatttgtgatgttgttactttgatttggggatgtacggagcaactcgatttggaatttgtgatgattttgtgattttggtgagtttggcgtgaaatcaatatgcaaagaagaatgaaaataaaagagaagaacaaagactagaccctctttaatccctgttggtaacaccagctgagaataaagatgaatctttagtcccggttattttaaccgggcatctttagttttggattcatagtcccgattgtataaccgagactaaagggggttacgaaccgtgggtaaaaaccctttctccagcagtgaaaatttggctaaaagttgaaaacaatggtatcatcccacaacatgcagaatatagatgtgctttaacttttaacatgacacacaatgttaaatgtagagctacggttatccatcaaatcgatggccagatattttttttagcgtgtgagcatctgcgaaatgatcattaattttatgttaacgtgtgagcttcttgaaaatgttcaattagtattactgtaggtgtagatagaaagatatatatcaaacattagtgcagataaaagtgtaacaaaatttgccatacaacactgaaacaacatggaatttgcaaatacaccgcaaaactgatactttgttcttggacactccaattttgtgtggatatttgctaatggctatagaggggataatataatggcaaattgctgtaggatattacaactctgtggttttagctcatgcagctaaagtcgatctttgagagaagacattctcaaatatggatatgtctattaaaaatattcatatttaaataggagagaaaaataatttgaaatgccagaaatgcctatagcccacttgtattcttcctccacctcccttctctcatgtaccctatagttaacaagttgtttcactcatcacttatcactcgttatttcattc

SEQ ID NO: 38993 - DNA, 1501 bp, Oryza sativa
atgtctattaaaaatattcatatttaaataggagagaaaaataatttgaaatgccagaaatgcctatagcccacttgtattcttcctccacctcccttctctcatgtaccctatagttaacaagttgtttcactcatcacttatcactcgttatttcattcatcactcaacgatccacagcgatccagattatctcaccgagttctaacgctcacacgatcatctccacctcccacatccgtataggccgcttttcctccctgcgcgttctccgttcccccgtcagcgccgccatcgctctccctcctgactcccacccgtcgcccttctttccccaacctcatcgccaaacctaacctcccctctctccccgccgcacgccgtcgacccccgctgcgcatatccccatcgcacagcgccgccgctcgggcgccgcactttctcaatcggaggacagcacgatgaggaaggttgcgggagaggcgccgtcaggcgccgctgatctggtccctcgcaaccagatcaccgtcgcataccctagagtcgacgtcgccggtgcatagccccgtcgatcccgctttcccagttcgctgtcatcgcctccgatcccgcgggttgcgcctctatcccctggtacagcagcgtcgccaccgccgacgggagcagcatgtcagtccgcaactctgcattatcagcgcacaaccagtttattggattggagatgttatttgctttgggtaatttgtttttttgcctagccacaagaaagaatgctcatgtgccatagaggaacagcaagctaacacaccttcttgagattctttaggcaatcaattatttacttgttggtaaattatgcatgtagggttagatttgtggttttcgtaattacattacatcacccgaattaatcaaaagatttgagcattttgtgcgtatgcaagtagttgaagaatttcaccaacgaagatcccgagccctttcagccagtacagcagcaccgccaccgccgacgagaacgggcgtcctgtctggatcgtcagaaggtggccaggtcattggattggttttcattttttctttttggattggattctgaaattggaacaaaagcagtagcattctccattctttgatttggttgttttcacaaatgagaaatgggcagtacatcataaatctgagtactttgatctatataagtcgatttttattgctccgtacacaacacagttcacctcctgagtcatgaaatgcaactatagaagaactgaacttggttcaaatttaggggatatatgctaataaaattacaagggaatggtgtgcattcagtttgatatagttcatatgaatgtcactttcttgaaaatattgacgtttggtattagttgtaaaaccttcatcaaaatgcagaaaacacgggatcaaactaatctaaattcaacatctctccttcaagttttctgaagtcaggtaatagctgacttgagttaattta

SEQ ID NO: 38994 - DNA, 1501 bp, Oryza sativa
aatcggtgtctgaatccggcagggcttcgccccttcttctcttctcctcccctctcttctttttttttcactggatttgaggggggaggaatgagggctgggggctgggcagcacgccttttataggcagcgaggcctgccgcccggccagagggcggcaaggggccgcctgcaaaatggccggccccgactggcttttttgcattcgggccccttgccgccccaccagagggcggcaagggttttcctgcaaaaaaccctccctccgtcaccgcccgttcctcccccgtttgccacgtcagcttgccgccctagaggtgggtgacagggtctatttttgtaatttttttggccgatagattatttctgtaaatattttaaaaaaaatctaaaaccgaaaaaaattcccccaagcagagagggtccgccggtgccgccaccgccgccacagatgcccggtgtcgccggcgcccgcccccgatggcgtccctactacttccgccgcggccggccactcccctcctcgcttccacgctcgccggtagctccccttcaggcttcagcgagccgggacggcaggtccagccgtccaggatggcggccatcttgtcggcgtctctgcgcactggtatcctgctccccctgttcgacttgatttgttttttccaattttacgtaaaatgtaagcttagattatgtttactgaaattttataaatgctgtcctttatttttatcaaggtcttaatattttacatttaaattatttaagtctccatcaattgtaaatttattgtatgtcttgtgtaactaagtctttatcagttctaaattagaagttagagcaattcattgttcaatcttttatccaagtaagggataatgcttaaagttaaacagggaatcagaggagtgatgactgatgagagtggttagatttccatcaaatggatgaaaagaagtaactgaaccgaaaactaggcaatgaaattatatatcttgggattgtgatagctttgctcctccacagtatatatggtcctcaaacagaagataactctttggataaatccattggcatgtaaccttagagtcaatacaaaaaggagatagaaattgagaatataatcttatgctttctcagtatttggattgaatgactacagagcgtattttctataacctctgcagtgatccattattgccgaatgcatggcgccatggtggtatggatggcaagatacgtctagagcagtactgagtactgataaaatagaataaacagaaatgccctgtacgcatggaatcagtggatcacactccagtctttagcatcattagcctttaattataaactaataccaaagattaaaaggcagagacttcagatccgtttccttgtgagagagacacagttgttcagattcttttcttcactgttatcacacaagcatgcacgtcccccaatacccatctttcttcctgttggtgctcaaggttcc

SEQ ID NO: 38995 - DNA, 1501 bp, Oryza sativa
atctaaaacattttcatccgtacgacttggcgagaagtatatcagacaacttgttgggatgtctttccttcagcgttccatattgcacactgtgagttatcatatacctcaatagggaagcaatgttttgcctgtcttaagtcaattataaagtaccatgcatttgtaaataactaataattataaaaaatgagtccgagcatactcagctgcaaggctaacacattacatgtacgcatgtttaccccaaataatatgttaattgtattagaagtagggcttgtataatttatcttgtcaagtatgtttatatcttttgggatattaagagctttgcctttctaaaataagaaatggaaatgtgaagaagttgttacaagtaccgaataatgcccattaacataacgagaaaggtcatatttgccacatacttattatttactctacagttcactgaattattactaaaactgaaactaacaaaaaaatgatagtactttacattgccaaaaaaaatatatttaaatttataatatttaagagatcaaacacaattcgtattgatgattttgttaggtgtgtgtttataatgaacctgatggtactttacatttttctttgttcatgtaaggaacaagaagttttcaccatgcacgatatggttcatgatgttgcgagatcggtcatggatgaagagttggttttctttaatgacacaaaaattagcagtaccacagaacaaaaattttgccactatgctttgcttgaaaattatagcaagtcatcaaatctatcaactatattgcctgccacgttaagggcagtacatacttcgaattgcagcaaattggtgctccaaggtgatgaattttcattcacaaagttcttgcgtgttctagatttaactgactgctccataaggatcctcccaagctctattggcaaattgaagcagctgaggtttcttatcgctccaaacataggagataatgtgttcccaaagagtattactctgctcccaaaactaaaataccttgacctccatggatcttttcgaatttcagcattgcaaggatcaattagcaaacatgcttgtctgatacatcttgacctatctggttgctctaatatcagagttatacagccagaagctctatgtggcctcaccaaactgcagtttttgaacttatcgtggtgctccattcttcaaatactgccagaaaatattgcaagtcttactgaactgcaatatttaaacttatcaaactgcttccttctcagccaattaccatctcatattgggagcctcactgaactacaatatttgaacttatcaggttgtcagggccttgtaaaattgccaatgtcgtttcggaatctgaagaatttggtacatcttgacctgtcaggctgctccagggtacaagatttcaaacaagtctttggtgggctcaccaaactgcagtacttaaacttatcaaagatatttggtagaaccaga

SEQ ID NO: 38996 - DNA, 1501 bp, Oryza sativa
tgagccatctaaaacattttcatccgtacgacttggcgagaagtatatcagacaacttgttgggatgtctttccttcagcgttccatattgcacactgtgagttatcatatacctcaatagggaagcaatgttttgcctgtcttaagtcaattataaagtaccatgcatttgtaaataactaataattataaaaaatgagtccgagcatactcagctgcaaggctaacacattacatgtacgcatgtttaccccaaataatatgttaattgtattagaagtagggcttgtataatttatcttgtcaagtatgtttatatcttttgggatattaagagctttgcctttctaaaataagaaatggaaatgtgaagaagttgttacaagtaccgaataatgcccattaacataacgagaaaggtcatatttgccacatacttattatttactctacagttcactgaattattactaaaactgaaactaacaaaaaaatgatagtactttacattgccaaaaaaaatatatttaaatttataatatttaagagatcaaacacaattcgtattgatgattttgttaggtgtgtgtttataatgaacctgatggtactttacatttttctttgttcatgtaaggaacaagaagttttcaccatgcacgatatggttcatgatgttgcgagatcggtcatggatgaagagttggttttctttaatgacacaaaaattagcagtaccacagaacaaaaattttgccactatgctttgcttgaaaattatagcaagtcatcaaatctatcaactatattgcctgccacgttaagggcagtacatacttcgaattgcagcaaattggtgctccaaggtgatgaattttcattcacaaagttcttgcgtgttctagatttaactgactgctccataaggatcctcccaagctctattggcaaattgaagcagctgaggtttcttatcgctccaaacataggagataatgtgttcccaaagagtattactctgctcccaaaactaaaataccttgacctccatggatcttttcgaatttcagcattgcaaggatcaattagcaaacatgcttgtctgatacatcttgacctatctggttgctctaatatcagagttatacagccagaagctctatgtggcctcaccaaactgcagtttttgaacttatcgtggtgctccattcttcaaatactgccagaaaatattgcaagtcttactgaactgcaatatttaaacttatcaaactgcttccttctcagccaattaccatctcatattgggagcctcactgaactacaatatttgaacttatcaggttgtcagggccttgtaaaattgccaatgtcgtttcggaatctgaagaatttggtacatcttgacctgtcaggctgctccagggtacaagatttcaaacaagtctttggtgggctcaccaaactgcagtacttaaacttatcaaagatatttggtaga

SEQ ID NO: 38997 - DNA, 1501 bp, Oryza sativa
tagaaccagagtgggtgataattgggatggttatcctgaaactatcagtactcttaatgatcttgagtatctaaacctttctcggaatagcaggattgattatctaccaagaagccttggaaacctcaaaaagcttcaaacattggacctttcatactgtcggtctctgagatccctcccacacagcatagaattaattgacagtctggagtttctaatagttgtggggtgctcagatcaacttaaggagtatttgagaaaatctcaattcaagaatattccaatatcattaccacacttcattgttcactctatttctggtgattcccgcagcaaccttcatatgcttgaagatataaatcctgtcagacttgaaataagctgtcttgaaaatgtgaagtccatagaagaagcacgaggaattgagttgtcagagaaacaaaatctttcaacattgacatttcattggacttcaagggctgaccgacttttggaggacaaggatgttttgggagaactaatgccaccaagaggtctgtggaatttaagcatacaagggtatgatagcacaaccttcccaacttggtttgtaggcatctcacatcatcttccaagtcttgttaagattgagttgaaggatttgcacagatgcagacacctgccaccactgggacagttgccaaacctgaatgaagtgcatctccaacagatggacagtctcacaaaaattgatggcggtttctgcggtggcgacaaaggcgcattccgcaaactgaaagtcttcaccttgagggatatgaaacagttggaagagtggagcaccacaacacacagtaaaggtggtgaggatagcatagagttcatgttccctatgctagttacactgtcaatagagctttgtccaatgcttagactgaaactatgcccaccgatgtttcacagctggctcatatcagagagcgacaaggttatatcttcatggggtgagatcagacaccaacctgcagccagtgtcagccattccttctcttcttcttccgacaccaacttggagatcaaaggagtaggggttgcagcggacgagtggaggctgcttcaccaccaccccaccctccaacagctggagatctcctggtgtaaaaatcttttgcatcttccagacgccatccgacatcttccatcactatcttatccaaattcctaatccgtattttcactacatatatatactcgtatactccctccgtcccaaaaaaaatttaaatcctagggatgaatctagatatacatgtgtctaggttcattcctaggatcgatttcttttttgggcagagggagtactgcttaattatttcacatcacatcaaacaaaattgaaaatgtctttgctaagcagtgttgtcttatgtttaggctgtcgacacgggtttaacggaggctctgatgaagattttcgctgaagatttcatgcctaccgactcttcagagtaattgttccttt

SEQ ID NO: 38998 - DNA, 1501 bp, Oryza sativa
aaagatatttggtagaaccagagtgggtgataattgggatggttatcctgaaactatcagtactcttaatgatcttgagtatctaaacctttctcggaatagcaggattgattatctaccaagaagccttggaaacctcaaaaagcttcaaacattggacctttcatactgtcggtctctgagatccctcccacacagcatagaattaattgacagtctggagtttctaatagttgtggggtgctcagatcaacttaaggagtatttgagaaaatctcaattcaagaatattccaatatcattaccacacttcattgttcactctatttctggtgattcccgcagcaaccttcatatgcttgaagatataaatcctgtcagacttgaaataagctgtcttgaaaatgtgaagtccatagaagaagcacgaggaattgagttgtcagagaaacaaaatctttcaacattgacatttcattggacttcaagggctgaccgacttttggaggacaaggatgttttgggagaactaatgccaccaagaggtctgtggaatttaagcatacaagggtatgatagcacaaccttcccaacttggtttgtaggcatctcacatcatcttccaagtcttgttaagattgagttgaaggatttgcacagatgcagacacctgccaccactgggacagttgccaaacctgaatgaagtgcatctccaacagatggacagtctcacaaaaattgatggcggtttctgcggtggcgacaaaggcgcattccgcaaactgaaagtcttcaccttgagggatatgaaacagttggaagagtggagcaccacaacacacagtaaaggtggtgaggatagcatagagttcatgttccctatgctagttacactgtcaatagagctttgtccaatgcttagactgaaactatgcccaccgatgtttcacagctggctcatatcagagagcgacaaggttatatcttcatggggtgagatcagacaccaacctgcagccagtgtcagccattccttctcttcttcttccgacaccaacttggagatcaaaggagtaggggttgcagcggacgagtggaggctgcttcaccaccaccccaccctccaacagctggagatctcctggtgtaaaaatcttttgcatcttccagacgccatccgacatcttccatcactatcttatccaaattcctaatccgtattttcactacatatatatactcgtatactccctccgtcccaaaaaaaatttaaatcctagggatgaatctagatatacatgtgtctaggttcattcctaggatcgatttcttttttgggcagagggagtactgcttaattatttcacatcacatcaaacaaaattgaaaatgtctttgctaagcagtgttgtcttatgtttaggctgtcgacacgggtttaacggaggctctgatgaagattttcgctgaagatttcatgcctaccgactcttcagagt

SEQ ID NO: 38999 - DNA, 1501 bp, Oryza sativa
ctccaacagctggagatctcctggtgtaaaaatcttttgcatcttccagacgccatccgacatcttccatcactatcttatccaaattcctaatccgtattttcactacatatatatactcgtatactccctccgtcccaaaaaaaatttaaatcctagggatgaatctagatatacatgtgtctaggttcattcctaggatcgatttcttttttgggcagagggagtactgcttaattatttcacatcacatcaaacaaaattgaaaatgtctttgctaagcagtgttgtcttatgtttaggctgtcgacacgggtttaacggaggctctgatgaagattttcgctgaagatttcatgcctaccgactcttcagagtaattgttccttttggtcgaaagtatgcaacaggcaagtctacagtaacctggtgttgttccattgatgtacactccatttcataatttcaacatgattcactattatcaactgatgccactctgtataagattatgcgtgttttcctatagtccttaaaaaccaactagaaggcatgaactatcatgataactgtatgtctctttcttccaagacctgttgtgtttgtgtcgtggttggcattacctaccaggggcacgccaaacgcatgatgtggcaccacagtagccagaggccagtagggctagttatcaattcaatttgttgcattagtttggatcctttgaatgttttattacattctattgttaggcgctagtaatttgaaaatcacatgagtaataaatagataaacaagtgttataaatctatctctctttttgtggattctcttcttccttgtgcaaccttcccccctgcacatgttcctgctatcctcactacagggtatgcaattttcaccaacaatgaccaagtaataataacccaaggattcagaattgccatccgtgattaccaagtcacaaaccatgcaaaaaaaaacctggttgttttatagtccccaattgtacaagttgttttgttactttcatctaagggcttgttcggttaatccctaaccgttgccgggcttgttgggaagggatttaccaaacaagcctaaacaggaataggtaagtatacagaaaatttgatttgctttaacttgcactgttggaaatttaagtgtataacacccaactggacagctggaaatttaagtcctcaatatttttccagttatatcccctcagtttcgtgatttgaattctttcctctttgactgctcatgtatctaccgtatgttctatacgtccatggctcctacattgttttcttggcaatactgtgttgctccttacataatataggccatttctgccataaaatagttgttgggcatgcttgtcaataagcaataatttctattacataacagtgtaaattaatcttgccatctcatgccaatgtttattttttgtttgtgaatgaacagtcatctcaagctcagagtttggtatatg

SEQ ID NO: 39000 - DNA, 1501 bp, Oryza sativa
gtctgatggcgtctgttagagggagagcctgcacaacatgaagtcacgacgtgatctcgagaagaaagatgtaaaggaatcatcgagtacactcacgttaattgcagtggcgcgttcagccgagtccgtgtcgcagagtgagacaggaatgccgttcgcctccgaaggtgcgctcatcattatctggccgacacggcaccccacagtgtcactatccagacctgtaaatcgagaacgagaactcgataagtcagaagaaacagatacagttggaacaaaaatagaaatgcgaggataaataccccaaggagagacccgggtcacgtcatctggcctagagtaattgaaggccggatgggtgtaggcctgtagcggttgaatctgccgaactacgaagtcggcagcgacttcatatcccgacaacccccattttcggagatcatcaatgatgtcgataatggattggagggagtgagggagtcagggcgggtttagcagtccactctaggatcttttctggctggtcctcaggaataacaaggacggggtctgagttctctatttggagatagaaccatctcgtccgccacttgctacgagaagtggggcactagaaggggatgtaacgcgacttcaggccatcccgaaatcggaatccgacgcatccagataccctgttggattccatccaacgcagcccgtaataaaaacggaagaggtcaaggaaaggcactaccccaatgtaggcctcgcaaagatgagagaagatgctcagaaaggcgatgaagttggggttcaggtgaagcaaagaaaggccgtagaaattcaagacaagaagaagaaacttggaaggcggaggaagaaaaccgcaagaaacataatcttcgactacaaccatgcggcccaagatgggttcaggttctgtacgtccagcctccctctgcatggtcccgtgaccggggagggcaccgtcgtcctgcagcttcttcatggacgtggtgttcgaggaagacttctcaaggtccatcaccgtcggaggatcgccggagaacaggatgaaggaagtgagctagggtttttcttttgcggggagtggagaggacaaggagcgctagaacgcaggagagttttctggcaaacggacttcaaatggatccccaaaatccctttaaataaacacgcttctgatggtgcgtattcgaaggaaaggagagagattgccgccggaaaattctgggtccgttgcgtgcggtagttgtgcggtagtttttcagacttcaatttaaattcactcatgaccattgaacttcacgcggtgttgtcgatggctctttgtctctatggttttcacaccgagatcgactagatgagagcgacaacaattccgacatcagaagccacgatcgataacatgagctcatttaagcagaagtcgggggctactgtcagggttacggataaggtataccctctatccttggatgtgcgttgtatattgata

SEQ ID NO: 39001 - DNA, 228 bp, Oryza sativa
ttgttcaggatggttgggcctgtgcagcatgggtgtgctgttcagtgttgattaaaattcctgattaattactccactgttttacttctcttaaatgttttgctaaatgctgcttttgcaaatgagccaatattatgccatcctttggtatccttgtgcacttgcatatttgctgtgtggcttgctgagtatgtcatatgctcaccttgcaataatcaatcaacctca

SEQ ID NO: 39002 - DNA, 440 bp, Oryza sativa
ggatgaagaaatgaccaaaataaaagttatagatattgacgagttatacacttttgttgttgatgatttttttagttgaaatcatttattatttgaaaatactgtttgaagttgtcataatttgaaattcaaatttaaattattgaaaacaaagtcatatagaaaaatgacaaaaataaaaattatagatattgatgagttatacaactttgttgttgatgaatttttcagttgaaatcatttagtatttaaaaatattatttgaagttgtcataatttgaaattcaaattcaaattattgaaacaaagtcatatagtaaaataaacaaaacaaaagttttagatcttgataagttatacaactttgttgttaagaattttttcatttgaaattatttactacccggaaatttatttgaattgagaggagggactcaaaa

SEQ ID NO: 39003 - DNA, 1501 bp, Oryza sativa
ttttttttaaaaggataaagaagaagagatgcatcatatcacaaagatgcaagccacggagtttataatgatttatggcttttacggaaaggaaattctagctggtcgacaaagaggtggccaacccatgtttgcctgtttggagacgggattttctcataatgctactacctctttttaaaaattgtaattactgttgatttttagcatgccatttgactatttgtaatgttaaaaatattatttacattatttttttgtgacttcttttattactaaaattatcactcatatattttgcatatttacactgattttttaataagatgagtagtcaaacattgggtttatgtcaacattatattgcattattattttcacctgcttcaccaaattattgtcacagattattttttccatgtttccttataaaacttccttccactgttttatttagatgtcttagaagctatcagttacatttatttatcaaaatatttagtctatttctaaaatagtgtagttaataatccacttataatttggccaataatctgtttcaagctaggttgagggagtaattatctgataagttgaccacattttagatgattagaaatgtttagataataattgtttttttaattttaatactatgctggtaattccattttagagagatattatctaagttcggtgtaaattttacccctcggagagagatagggagagggagatatgagaattatcaagctaataaaaactcaacagagttttttttttatacctcataagtcataaaagactcatattaattatatttattgttgttaattaaattgtggtgcgataaaaaaaagggagaagagtctctataaaagcaccgacatctggaggaatgttttggtccgactccaacatatatcgtgtgggtcactgggtcactggctcactcagtcactccttggggaagcaagcgactgcagtgacctaacctttcggtgcaccaagatgcgcacactagtgctaattaagctcgatttatcactaacttggtgctaaactgcagcatgcatttgcttactgtcagtgatgatgccaccattgccagctgtgtttgtttcgttatgcaaatttaattatgcacagcaactcctatatatgaacttgtctaccatgcagagttgcatattagaataactctctaatgctctgttcgtttgggcaggttcccaactcctcctcctcgtcttccgcgcgcacgcttttcaaactgctaaacggtgtatttttttgtaaaaaatttctatacgaaagttacttaaaaaaatcagattaatccatttttgaaagcgagatcgactagatgagagtgacaacaattccgacatcagaagccgcgatcggtaacatgaactcatttaagcagaagtcgggagctactatcagggttacggataaggtataccctctatcattggatgtgcgttgtacactgata

SEQ ID NO: 39004 - DNA, 1501 bp, Oryza sativa
ccactactgttattctcctgagactgatcctgctgaactggcaccggctgattagcttgctcgatgttaacttcattgctttcattagtctctgatttgatctcaccaccgatgtttaactgttgcgactgtccttgaccagcgaaagaagattcaccaatttggagtggcttgatacgctgcctctggctactaccttgtgcctcctggaatacagtcattttccttttacggttgtccatcctgttcttcttgtcttcaagtcgaattgctttgtcaaccagctgctgaaaatcagcatagtcatgagagatcaacataactgatagctcatcctttaagccttccaaaaacttctcctgcctttcctcgtcagtacgcacatcttctggagcatagcgagctagacgattgaactcatgaagatattccgtcacggtacgatccttttgcttaagtgcccggaactcacgctttttcaaagcaacaacacctgcaggtatgtgtgtcttcttgaatgcttccgtgaactccgcccaagtgattggttgtccttctgctctgttcatccggaaatgatcccaccattctgatgcaggtccttgcaactgatgtgaagcgaaaacaactttctcctgatccgtgcactggagcagttccaacttcttctcaatagtgtgcaaccaatcacctgcttccactgggttggtagtgctagaaaaggtaggcggcctcacacgaagaaaatcagctaacttgttttgcggcggtggagcattattgttcccttggttgagctggttctgcatctgttgtatcatcatgttcattaactgagtctgttgagccagaacttgagcaagagttgggttcccttcattgttattgtttccacttccattagcacgagtgttcaccatctattgcatattagagaagatagaaggagagaggttacactaaagacaagaccttaaccaggttaacactgatctggtgtgtgtagaccattatattgttcaagttgattaagcaagcaacctagtataattacacactcatcattgaaccactccaatgacgggaatgcaaccatacctacacacaagcaagcaacaaacgttctaccctactaactattcttcaaggatagtttggcggcataggttctaaggtaggatccaaacttcattccatgttgacatctgggcacttcagttcttcctcgatccacttgactgacctccataagttgaccacatcagcattttctagtttcaacaactagtttcagaactactcaagttgaaagagagaggggagtagacaatgaaacaatttgcaaagaattctagataaggaagaaaggagaaattttcacaaatcatgttttcggaaaatttgtccttaaggtttgaccatttggcttatcctacagtcgagatggctctgataccaacttgtcacgcccggaaattcactagtaatttccgaacttatt

SEQ ID NO: 39005 - DNA, 262 bp, Oryza sativa
cgggggacggggagctcgccggcactgaggggggagacgaggaggtagaactcgatcttatcgccagcaccgttctcgtagtggaaggagagaagagagtgaaaaggaagagatattgggtaggagataggtggcatctgacatgtggtaccaattatttgtttttaatttttttgcctgattggatcaccacgtcagcataatttaagaaaaaccacccttgtttgaatggaaggggtaaattaaacatcatttacccggt

SEQ ID NO: 39006 - DNA, 1501 bp, Oryza sativa
ggccgtcccatcagaaggtcattcggacggtaaccatacaagtctccgtctgtttatgaaaagataggataagtccccacaaaaaagagagagatggtgcatgtggtatccccttgaggtataaaaggaggaccttgcccacttagaagggggatttttcggatccagaacgatcagagagggagagagtaagagctctctggttctccagctcttttgtagcttcttcatacatagatccaccaaaacacaggagtagggtattacgcttctcagcggcccgaacctgtatacatcgcccgtgtcttgtgtgtttccattctcgcgaaccttccacacacagactgggagcttagaatctcacccatggcccccggccgaaccggcaaagggggacctgcacggtctcccggtgaggagccccacgctccgtcactcgggctcggagagagagagaccgatccgaatcgacctcgaatcaaacactttccaagcgattttagccgatgattccaaaagagaaaaggtagaggagatctcgggaaacatttcccctctattgatttcaccggagaaggaaagacgcggccgaatttggaaagagacagcggcggcgcacgctagggtttcgggcggcggcggcggcgcgaggaagacgaagactgacaggtgggacccacctgtcagcgacagcgagcgcgcgcgcgcggctgcggactggactgggccgacttgggccgggaagagagagagagaaggttttgggccgactttcggcccaaagccaaaagagacttttaaaaacatttttcaatttaaattattcattaaatgcaattccatttattaaaaatacttccttagctcaaataaatcccagaaaaatctaggaattatagaataaagcaaagtatttaatgaaattttatctggccccattttatattggaatttattaattaaaattagatcttctgttctagacttttaaaatcatttctaaaaattccaattaaacaacaatttatacatttaggatttttagggtgtgacacgggggttccggccgtaggtggggttgggtcggtacttttgtctatggctaggatgggttggaaactatgtcatgtcttccgtctgtatgccgtggtggtatgtggcacgtggttacacgtgaggaagatgtgtcttgtgggtaaagatgtacacctctgatcagagtataacctattcgaatagccgcgccctcggttatgggcaagccgagcaatgtacctatgttagtgttttagttcttgaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccttgattaatagtattgtatagctctaggatcgtgtttacaaaatagctttgagcaactaagtgtc

SEQ ID NO: 39007 - DNA, 216 bp, Oryza sativa
gtattgtttcccagataaaaaagaaaccctgttcagcttgttcatgtatcagatgaaagatgtcaacaaaggaaagggtttcaagaaagttatcagtaatatattaaaaagataggcaacatacagaacccaatggacgatagtttactgcagagacattgggatgtgcaatgcacctttcgtgaaatggttacaaaaggttgagtcaggtaaaca

SEQ ID NO: 39008 - DNA, 411 bp, Oryza sativa
atttaaatgtgcaccttgtttgcaaaaatataaatattattgtgctaagtacttaagtagcactccctctagccacaaatacttggacgttttagatacgatccagtcaaaattttaaaactttgatgtttaaaagttttattttaaaaacattaaaatgacatgtgtagatttgtctggttgtccagaaaggtacttccataatctcataaacttgtattttactacctccattcctaaaaaaatttctttttagctatgaacctagactgtgttgtccatgtttatagctaaaaaggcactcttcagaaagggaggtagcataaaattattgttaagagatgcactttaaagacattaaaaaaggtcaattttcaaatgtcaagtatcttttactggatggagtacaac

SEQ ID NO: 39009 - DNA, 1501 bp, Oryza sativa
aacaaaggatggcatagtagggtttcatttgcataaacaacatttaataaacatttcagaatttaataaaacagttaagtattaattaaacagtattaatccaacgctacacaacataccctgttgcatgggcccaaccattctgaacaaccatcccggctgcacagttctatcttcaaaccaggaatatactattccaaaccaggagctaatcaaattattaccaattatagcatctgttattatgatgagaggtgtgaaactaatcacgaaagacattgttagacccacccataaccgcgggcacggctattcgaatagttttactctgatcagaggtgtaccactgtacccacaagacacagccccacatcatgtcaccatgtgcctcaataccaccacggtacctcggaaaggagctgtgacaatacccctcgcacaacacaatccactacagcgcacctttcctggatcataatcacccccttataaacaaggcatggactccccagcgacccctgtgggcttatctccgccacttctcagtctggtgctctgcaatgaaccacgctatacaaaaggtaaagccgttgcccacgctggcttgtggttggcacggttaatgtttcacaaccgaaactcgtgaaccggtccttaattgccatgagcacgactctcaaaaccatgtgttcacaacccaccattatcaggttttagttggcaagtaattaattagccaatcacgattgaccatcgtgaactatcattaagccatcattaaataataatgaatcataagttatcccaatagtgtgctaatgtttctaagcatggctaagcaatcacacctaatatctagctgaaccaatatataaagcccaactagtcaaattataataacccaaggtatctaggaataaagtaatcaagaacaaaagggctataacaaacaataggttaattccacccaatgacattcgaaaataaatgcaatagttgaatagaaacaatagctttaaacgggatcaacatgctcaaagggttgtttgggatctgtgtgacttgccttgctggccttggaactcttcaaattcttctcctgcgaaaacggactctccggaaacgtcggaatctaaatagaaaagagcaaaaaaaaaccaaaacagcacataaacaagcatgaacagtacatgtggatatttttaacatgtagatctcaattttagaaaaatttagagacttgaaccaactaaatccgagctacgatgaattagttatgaatttttaaagattaaatcgaattaaaacacttatatggattttaattgaattatgacgcaataatgaattatttttgaaaaagaaaaaggggtttattgcgtcagcggtggaccgggcgcacggcagcggttcacgggaacgaacggccgagatcgatcctatccaaaacggacggccgagatcgaccggtccacggccggaccacgagggacgacgacga

SEQ ID NO: 39010 - DNA, 753 bp, Oryza sativa
taatatttataataataataataataatagtaaaaaaataattttctttcatgagttttcctttgaggtgttcaaaagtattgttgtttcaactttgaaccatgcatacaatctatatggtattttggccctattggcaagagtgctcttttgcgaaataaaatcaaatgttgtttaaaaaaaaaattttgattacaaaagtttttagttgccatgttgctttttgttaaacatatgtatgattatacaaaatcttgcttgaaaaatctattttcaaattatatttggtgagaaactgcatctcttgaatattttaaatgttttgcaaacatcacttccaaaggatatttctgcaaaatcattttgaaaaaaaaaatcttctttgtgaacgcaaaagcatatctccttttaaattgctttcaaaatttcttattttaaggggggtagcctatgatggagaaacctcgaggaaatcaataacttatgggaaaatatggacaaggaatactatatatcaaggtatatttgcccttgtacagggaatttgaagtatcattggatagtaaaactgcaaagggtgtgaccttaactctcgtcggcaagattcataataaatattaaggaacgaaggattgaacaaatgaagaagaaaaacaacaattcagcattgtcatgctactattgatgactagtataatagtttactaactttcaacctactaacttgtaacaagagaaacctaccacaggaca

SEQ ID NO: 39011 - DNA, 1501 bp, Oryza sativa
tgttgatcccgtttaaagctattgtttctattcaactattgcatttattttcgaatgtcattgggtggaattaacctattgtttgttatagcccttttgttcttgattactttattcctagataccttgggttattataatttgactagttgggctttatatattggttcagctagatattaggtgtgattgcttagccatgcttagaaacattagcacactattgggataacttatgattcattattatttaatgatggcttaatgatagttcacgatggtcaatcgtgattggctaattaattacttgccaactaaaacctgataatggtgggttgtgaacacatggttttgagagtcgtgctcatggcaattaaggaccggttcacgagtttcggttgtgaaacattaaccgtgccaaccacaagccagcgtgggcaacggctttaccttttgtatagcgtggttcattgcagagcaccagactgagaagtggcggagataagcccacaggggtcgctggggagtccatgccttgtttataagggggtgattatgatccaggaaaggtgcgctgtagtggattgtgttgtgcgaggggtattgtcacagctcctttccgaggtaccgtggtggtattgaggcacatggtgacatgatgtggggctgtgtcttgtgggtacagtggtacacctctgatcagagtaaaactattcgaatagccgtgcccgcggttatgggtgggtctaacaatgtctttcgtgattagtttcacacctctcatcataataacagatgctataattggtaataatttgattagctcctggtttggaatagtatattcctggtttgaagatagaactgtgcagccgggatggttgttcagaatggttgggcccatgcaacagggtatgttgtgtagcgttggattaatactgtttaattaatacttaactgttttattaaattctgaaatgtttattaaatgttgtttatgcaaatgaaaccctactatgccatcctttgttatcttgtgcgcttgcatatttgctgcgtggcttgctgagtatgtcatatactcacgttgcaatcattcatcagaggaagagttctacagtgaagctgatggtgtggaggattaggtgtaggcctggtcaagctgcctgtggagtggagtcgtctgcgccgtttatcttattttccgctgcttagatctttattgattgagaggaactatctacctctataatgacattttattcgcttattaattagagtaataattgtactatattatcaatttgttattgtgtgcctcggctgattcctgtacgagggttcacacacatgtaagcgtttggaattttggatagaaattccgggcgtgacaccccgggacaggtaggcaggactgagcccctagcagcaggacaccggccctgtgccatcacatctcgactaccgggccgcagctcgtgtagccttcatttgccctaga

SEQ ID NO: 39012 - DNA, 1501 bp, Oryza sativa
tactcacgttgcaatcattcatcagaggaagagttctacagtgaagctgatggtgtggaggattaggtgtaggcctggtcaagctgcctgtggagtggagtcgtctgcgccgtttatcttattttccgctgcttagatctttattgattgagaggaactatctacctctataatgacattttattcgcttattaattagagtaataattgtactatattatcaatttgttattgtgtgcctcggctgattcctgtacgagggttcacacacatgtaagcgtttggaattttggatagaaattccgggcgtgacaccccgggacaggtaggcaggactgagcccctagcagcaggacaccggccctgtgccatcacatctcgactaccgggccgcagctcgtgtagccttcatttgccctagagatgtccatcgacccccgactttgtccatctccatccgtgtacttttgtttataaccagactgagccacaaactaagccttacccactagacatgtggaagtatggtagtactttgcaacagaggcccgaagaccggtccttatatgaccgaggtgctactatcaaaaccatgcaccccgagcccagcctaaaaccattttgagggttttgaatagagggggaggtgtgaatccaattccacaataatccaaccattccatagtgtctaggtgatatgaatattcccaaagtctagagttgtaaaaccacctaatgttacctaattaagcggcgaagcatctacctaaattcatactagtggtaccatgagtagagtgtccactagttggggttttgtttattctagggtgaacaaggtaataataacaataacaataataaggtcataacaaaggtaaataggcatggctagataaaacagtgacaacgcgggaatttaaataaagcgataatgcaataatttaaatcaaaataattttataaactaggattcaatatgttcaaggatgatgtgacttgccttgctcgctttcccaaacatcggcttcaacctccatgaagagaggatcttccgaagctgcagcgtctacacgaccaacggaaaataaaagggcttttactctaataaactccatataacaagcaggaacaaagcacaaaaatgggttcttgacttcttaaggaaaaattagagacttgaacagtccaattccgagttcaaatggccaagttatggccatttgaagtttatatactcttaaaataaatatttgcgaatttcttcatttaaattttaatttaaaaagggtttatcgcgtcagccgaggggagggggcgcgcggaccgggtccatgggagtggggcccacgtggcagcctcacggtccacggtggaccgggtgcacccgggctcacaccggccggtgccgtgggccccacacgtcagccgcacccgagggcgcgggcggctgacggccaggccccacacggcagccactcggcgcgcccgagggcggcca

SEQ ID NO: 39013 - DNA, 208 bp, Oryza sativa
tctctctctctctcccctcccttctctcccgcagccagcggaggcggtagcggcaactgcgccctcccctccgccagatccggcaggaggggaggcgtcagcgacaggcgggggtggccggatctggcgttggcggcgggtggggtggctcaaaaaggggaggtggcgaagggctcgccggcggggaggagccctcccctccactaga

SEQ ID NO: 39014 - DNA, 1501 bp, Oryza sativa
tgcttgagcaagagtccaaggaggtcatccaatacatcaaccaaacctcaaccacaagcattaagaaggaagacttggcattgaaggcgaaggaagaagaagaagagagtcgcaagagcaagagcaagagcaaggcggagatcgatgatgaagagatggctctcttcgtcaagaagttcgacaagttcatgaagcaaagcggcttcttcaaggaaagttcgtccaagtattcctccaacaagtcaagtggaagacactccgcaagggtgtgctatgtgtgcaaagagcccgagcacttcattgacgattgcccccacatcaaggattgcccccacttcaaggaagacaagaagaagcttgagaagaacgagaagcacaagcatagcaagcatgatcgctatggccaagctcaccttggggtgatcttcggctccgacttcgagtcaagctcaagtgatgaagaaggagttgccacattcgccgtcaagccttcatcaccaccgagactcttcaactactcaagtgatgaggatgctcccatttgcctcatggcaaaggagcctaaggtaccctctcccctcaagtcatttaatgttgatcttgttagtgatgaggaggaagatgttgaggatgaggttatggatgacgagttgttcaaatccatagccaaggaatccataccacacttgagtgagttgcttgggagaattgagaatcaatatgcaaaccttgagaggcaagaggaattgctcattcgtgagaaagagcggtctcatgaactcaagagtgaacttgctaaggagagagagaaaaatgaggctttggtacggctttacaagcaaaccaaagagtctcatactaatcttgaggtggcgaacgctcaacttcaagagagagtggatggcttggacaaagcttacctctctcttgaagagaagttcgaaaccttaaagaatagtgtctctctccctagcgaggcatcgtgctccaaaattgtcccaagcaacgaaccatgtgtgaggtgcaaagatattgatattgaagcttgtagtactaactctacttctttgagtgctttacaaaagcaaaatgagaagcttatgggactccttcataatggcctacttaagtgccatatgggtagtaaggcgctaaaggagtacctaggctatcaaagggacaacttcaaccatgaaggtcttgggtatgtttctccacctaaaggaaaggtggacaagagtgtgatgatcaagaatccccaaggtcttagcaactttgttaaggccaaatgtatccttcctaatgattatgcttctcattgttcttttgatacatcttatgttcttaggaaaaatgctaatggtcgtgctgttgctaagtatgttggcccaaggggcaaaaatatttctatcaagagagtgctttgggtgcctaaggcacttgttattaacatgagaggacccaagcaagtatgggtacctaaaactagaaattgatctct

SEQ ID NO: 39015 - DNA, 439 bp, Oryza sativa
tgtgaccgtttgcccaccgatatgcctccccctcctcacctccccaattctaccgcgtgcatgttattctgctctttcaaacatcgctgcatgccccctctctattgctcctccctcctcgacgcagtgtaggagacggtgcagggaccagatctgatatccaaacctcggggctgctcagggttaccaccagatctagtccttgtagcgcttcctccactacgcgggggaggagaactgtttgcctaccgatgtctctcccacttgtatccccaaccctaccgtggggatgtccttttgctgtcccaaacatcgctgcatgcctcctctctcttgctcctccctcctcctcgacgcagtggaggggcgatgcaaggaccagatctaaaacccaaatctcggggctgctcagggttccactagatctggtccttgcagc

SEQ ID NO: 39016 - DNA, 1501 bp, Oryza sativa
ctctaaggacatgaccaatgaggttgtggtcaagaagatggttcgggcaatcactccaaggaactctaccttggtgaccatcattcgtgagcgtccggactacaagactctcacacctcatgacttgctcgggcgtatccttgcccatgacatgcttgagcaagagtccaaggaggtcatccaatacatcaaccaaacctcaaccacaagcattaagaaggaagacttggcattgaaggcgaaggaagaagaagaagagagtcgcaagagcaagagcaagagcaaggcggagatcgatgatgaagagatggctctcttcgtcaagaagttcgacaagttcatgaagcaaagcggcttcttcaaggaaagttcgtccaagtattcctccaacaagtcaagtggaagacactccgcaagggtgtgctatgtgtgcaaagagcccgagcacttcattgacgattgcccccacatcaaggattgcccccacttcaaggaagacaagaagaagcttgagaagaacgagaagcacaagcatagcaagcatgatcgctatggccaagctcaccttggggtgatcttcggctccgacttcgagtcaagctcaagtgatgaagaaggagttgccacattcgccgtcaagccttcatcaccaccgagactcttcaactactcaagtgatgaggatgctcccatttgcctcatggcaaaggagcctaaggtaccctctcccctcaagtcatttaatgttgatcttgttagtgatgaggaggaagatgttgaggatgaggttatggatgacgagttgttcaaatccatagccaaggaatccataccacacttgagtgagttgcttgggagaattgagaatcaatatgcaaaccttgagaggcaagaggaattgctcattcgtgagaaagagcggtctcatgaactcaagagtgaacttgctaaggagagagagaaaaatgaggctttggtacggctttacaagcaaaccaaagagtctcatactaatcttgaggtggcgaacgctcaacttcaagagagagtggatggcttggacaaagcttacctctctcttgaagagaagttcgaaaccttaaagaatagtgtctctctccctagcgaggcatcgtgctccaaaattgtcccaagcaacgaaccatgtgtgaggtgcaaagatattgatattgaagcttgtagtactaactctacttctttgagtgctttacaaaagcaaaatgagaagcttatgggactccttcataatggcctacttaagtgccatatgggtagtaaggcgctaaaggagtacctaggctatcaaagggacaacttcaaccatgaaggtcttgggtatgtttctccacctaaaggaaaggtggacaagagtgtgatgatcaagaatccccaaggtcttagcaactttgttaaggccaaatgtatccttcctaatgattatgcttctcattgttcttttgatacatcttatgttcttagg

SEQ ID NO: 39017 - DNA, 1501 bp, Oryza sativa
caaacatcatacacaaatattagatctgttaatgaaatgaaggtctaaaattattttatttgagtaaaaatatatttaatacacatattattaacaaacgatagatagaagtaaaaaaataaaatcaaaaagtgtgtgtgaggcacagagagctgagcaacattaaaatttgaaaaaaaaaatggaaaagaacgtgccttcctttgcagtatgatggcacactgaccagaagatgagttcgatactcttatttctcatctagtgcatctgacaaggatgatggctagtaaatagttgagcaggtatatggcagcaaaatcattggagtatgtttgtacatagttctgaaatttctcccttactctacgcaacctgaaacagaatacacgaaattttctcatgtgggaattccatcaagcagctagtacatagagaggatgttacctgaggagaatgaggctagtacacagaggaggcaaatctttcacccagtagtaagttgagaactgaagaagagatcgctgtggccttggaggcggaagctcggcgtggatcgagggtcacaacggcggcggtgcgaggtcttgctggtgatggcgacacaggagaacgatggaggcgggcggcaaggcttcgtggcggtgaaggagacagccagcgagatcgagcagaggaagaggccgagtgaatttgttgaaggcgaaatcgtgtgtaggtggcgcgtcatcgagggcgagatcaagaggaagaggaagctatcgtcagagtgattgaggaggaagcgacatgcggatgcggtgatagagggagtggggcgacggggttagcggcggcggggacggcagaggaatccgtggtgatgggatggggattcgacgtgtttgtgcgtgggccctggttttccttgatttcacccgtaggattgcaaggaggcaactcctcctttttatattagtactagttatcgtgcacgtgcaaggcacgttttagtattatatacataaaagatagaataataaatataacttatctatgtagtgcactttttaagaataaaaagtaaatgttttatagatcatgaaaatcatcatttgaactctagcctgatttctgagtagcatgctcttttgtattcatgtccacgtagaacacaacatcactatagaatacataatgttgccctcaaattatagcattatttaccatcattagctaatgagaccacttggagtcctggagaaaacaacaacaacatgccaatgtgagtgatataaattggtccgcaagtacagaaattgaactcagaaataaaccaatatgtcacaatataaacttcaggcacatcaccggttaaaattagtcagcaagttcagcaaatgaactcagaaattaaccggcatgtcagaatattaagttcaggtacaacccaggataagatcataaaataatatagcaaatgttcccaattatgtttctgaattgtccttccaataaaaatttc

SEQ ID NO: 39018 - DNA, 1501 bp, Oryza sativa
tggctctaaggacatgaccaatgaggttgtggtcaagaagatggttcgggcaatcactccaaggaactctaccttggtgaccatcattcgtgagcgtccggactacaagactctcacacctcatgacttgctcgggcgtatccttgcccatgacatgcttgagcaagagtccaaggaggtcatccaatacatcaaccaaacctcaaccacaagcattaagaaggaagacttggcattgaaggcgaaggaagaagaagaagagagtcgcaagagcaagagcaagagcaaggcggagatcgatgatgaagagatggctctcttcgtcaagaagttcgacaagttcatgaagcaaagcggcttcttcaaggaaagttcgtccaagtattcctccaacaagtcaagtggaagacactccgcaagggtgtgctatgtgtgcaaagagcccgagcacttcattgacgattgcccccacatcaaggattgcccccacttcaaggaagacaagaagaagcttgagaagaacgagaagcacaagcatagcaagcatgatcgctatggccaagctcaccttggggtgatcttcggctccgacttcgagtcaagctcaagtgatgaagaaggagttgccacattcgccgtcaagccttcatcaccaccgagactcttcaactactcaagtgatgaggatgctcccatttgcctcatggcaaaggagcctaaggtaccctctcccctcaagtcatttaatgttgatcttgttagtgatgaggaggaagatgttgaggatgaggttatggatgacgagttgttcaaatccatagccaaggaatccataccacacttgagtgagttgcttgggagaattgagaatcaatatgcaaaccttgagaggcaagaggaattgctcattcgtgagaaagagcggtctcatgaactcaagagtgaacttgctaaggagagagagaaaaatgaggctttggtacggctttacaagcaaaccaaagagtctcatactaatcttgaggtggcgaacgctcaacttcaagagagagtggatggcttggacaaagcttacctctctcttgaagagaagttcgaaaccttaaagaatagtgtctctctccctagcgaggcatcgtgctccaaaattgtcccaagcaacgaaccatgtgtgaggtgcaaagatattgatattgaagcttgtagtactaactctacttctttgagtgctttacaaaagcaaaatgagaagcttatgggactccttcataatggcctacttaagtgccatatgggtagtaaggcgctaaaggagtacctaggctatcaaagggacaacttcaaccatgaaggtcttgggtatgtttctccacctaaaggaaaggtggacaagagtgtgatgatcaagaatccccaaggtcttagcaactttgttaaggccaaatgtatccttcctaatgattatgcttctcattgttcttttgatacatcttatgttctt

SEQ ID NO: 39019 - DNA, 1501 bp, Oryza sativa
tgcaagtgcacagaataacaaaggatggcatagttgggtttcatttgcataaacagcatttaataaacatttcagaatttaataaaacagttaagtaataattatacaatattaatccaacgctatacaacataccctgttgcataggcccaaccattctgaacaaccatcccggctgcacagttctatctccaaaccaggaattaaccattccaaaccaggagctaatcaaattattaccagttatagcatcttttattatgatgagaagtgtgagactaatcatgaaagacattgttagacccgcccataaccgcgggcacggctattcgaatagttttactctggccagagatgtaccactgtacccacaagacacagccccacaacatgtcaccatgcgcctcaataccaccacggtacctcagaaaggagctgtgacagtacccctcgcacaacacaatccaccacagcgcaccattcctggatcataatcacccccttataaacaaggcatggactccccagcaacccccatgggcttatctccgccacttctcagtctggtgctccgcaatgaaccatgctatacaaaaggtaaagccgttgcccacgctggcttgtggttggcacggttaatgtttcacatccgaaaatcgtgaaccggtccttaattgtcatgggcacgactatcaaaaccatgtgctcacaacccaccattatcaagttttagttggcaatttaattaattaaccaatcacgattgaccatcgtgaactatcattaagccatcattaaataatagtgaattataagttatcccaatagtgtgctaatgtttctaagcatggctaagcaatcatatctgatatctagctgaaccaatatataaagctcaactagtcaagttatagtaacccaaggtatcaaggaataaagtaatcaagaacaaaagggctataacaaacaataggttaattccaccaaatggcattcgaaaataaatgcaatagttgaatagaaacaatagctttaaatgggatctgtgtgacttgccttgctggccttggaactcttcaaatttttttcctgcaaaaacggactctccggaaacgtcggaatctagacagaaaggagcaaaatcaccaaaacagcacataaacaggcatgaacagtacatgtggatatttttaacatgtagatctcaattttagaaaaatttagagacttgaaccaactaaatccgagctaagatgaattagttatgaatttttaaagattaaattggattaaaacacttatatgggttttaattgaattatgacgcaataatgaattatttttgaaaaggaaaagggaattattgcgtcagcggctagggttcgcgatggaccgggtgcacggcggcggctcacggaaacgaacggtcgagatcgatcctatccacaacggacgaccaagatctaacggtctacgaccggtctacgacggacggcaacga

SEQ ID NO: 39020 - DNA, 1501 bp, Oryza sativa
agcctccatctttgtcgctgctctgtgagtcctctagtgttgccgccattggaaggggatagactcagcagctaggcctcccagccgtgtgcctccctctcttatgttggtgatacctgattcaactcaaatcgactcttttcaatccccatttttcctctttgtgaattttccccattagttctctagctgaattttcttattcaagcttaatggtatgcatctccttttagttatgttattcggttcttctttacctttgtggataattgcaggctatatattacgtgattggtgctgcagtttcatacatactaacattatagttgtcatgttgaatatcttgcagattgtcttacagagagcaaattcaaccatgcctagtctcttatcttttttatttagtcgaaaaataacagttcctttcttactgaaatggaaaatgcacgaaaccctacactgcaattttctgcaatgacagggtaaatagccatatcaagcccgtttgttgctgttgggctgcctgcctcttatttttcttttttatttctgtgatcatcaacaattactggattgtcgtcccttatggtctttcatttgattcactgcacggttgataagttcactcatttgctgccaattgttgttgactaatttctttttcatattttcttttatctaaatatatttattctgtacttctattgggccatatatagtctgatttagtgtttgtcatttcaggtgacattgcttcttagccaattggagcacaaaagaaaatccaataaacaggaaaacatgatttagtattggacatcatttctgaaagcttttgcacttaagaaatgcaaatggacaagaataaggtatgcggtaaacatgatacttctgtgtggcttactacttcactggtcctactactttagagctatatatttttgtgtgactgtagatgggttccattaatggatggctgtgagaactaacatttcaattttgtatatatggtagagcttcctcgggtggttggtagcagaacaagatagtataagttttcaagtggatagaactaaagcaaagctaagaattaaacatgtgtaatggaagtatcaggaattcagaatggtagttggcgcatatggaatggatttgatgactgaaaattgtgtaccctgtgaagaattcattgctggttttaagttttaacttcataccgttatcatttcaaggaaagaaggtcttgcaatcgatcttctgaagagctgagaaaggtacagcttaaaaccattatttgttctatagtgaagttgatgtgtgtatactaaataacatcgtcagaatgagcaaacgctataaacgaaaatcaaccttcaaatataatatgtataagctttaaatgttaatggccacttatgcaaaatgcactaggtaatgttgttcttcattttcaggagcgatttgtaaattaggttaatgaaacaaaatattccacgttttg

SEQ ID NO: 39021 - DNA, 1501 bp, Oryza sativa
ggatgtgaaacattaaccgtgccaaccacaagccagcgtgggcaacggctttaccttttgtatagcatggttcattgcggagcaccagactgagaagtggcggagataagcccatgggggttgctggggagtccatgccttgtttataagggggtgattatgatccaggaatggtgcgctgtggtggattgtgttgtgcgaggggtactgtcacagctcctttctgaggtaccgtggtggtattgaggcgcatggtgacatgttgtggggctgtgtcttgtgggtacagtggtacatctctggccagagtaaaactattcgaatagccgtgcccgcggttatgggcgggtctaacaatgtctttcatgattagtctcacacttctcatcataataaaagatgctataactggtaataatttgattagctcctggtttggaatggttaattcctggtttggagatagaactgtgcagccgggatggttgttcagaatggttgggcctatgcaacagggtatgttgtatagcgttggattaatattgtataattattacttaactgttttattaaattctgaaatgtttattaaatgctgtttatgcaaatgaaacccaactatgccatcctttgttattctgtgcacttgcatttttgctgcgtggcttgctgagtatgtcatatactcaccttgcaatgattcatcagaggaggagttctacaatgatgctgatggtgtagaggattaggtgtagccctggtcaagctgcctgtggagtggagtcgtctgcgccgtttatcttatttttccgctgcttagatctttattgattgagaggaactatctacctctgtaatgacattttatttgcttattaattagagtaataattgtactctattatcaatttgttattgtgtgtctcggctgattcctggacgagggttcacacacatgtaagcgtttggaattttggatagaaattccgggcgtgacaagttggtatcagagcctccttgaccctaggttatgccaaatggttacccatagaagccctctaaaaatattggaaaagtagaactgttctcctccccttctcttttaattaaaccaaactaatggcacatgcacttcataatctcttttaatggtcctcattcaaaatttattccagtgttattagtactgtacatctattactgtactaatggctcattttaccagcaaaagttttacaatattgttttatttaatcttgctgcaagaaaataaatttagcatgttgattttataactttcttttatctctgttggaacctgttgttcaaaagtacaaaatttgtgaccttatttccaactgtttcaacttatcttgcaagcttggtttactttatttacttaccttttactttgattttctaactttattcaaattaatccaaaaacttgtgctattaattggataaatgtcttaactccctcctttcacttgtctttaga

SEQ ID NO: 39022 - DNA, 1501 bp, Oryza sativa
tgcgaactttcaaacatttcacaagctcactacattgaacatatatgaatgtgatctgggtcaaaatttacatatattgctgagttttctgcagaacactcctaacctcgagaaagttatattgcagaactgcgaggtactacttatagtttctttcagtttgtcttgttaatctgctttcttgatttatcatcctagagtgatcctgtgtgatgccccaatagatttcagatcattcgagaaagaggaaaagaacacccaaggcaaacaggaaccagattcattccaagagcagaagtctgataacttccaagtctgagatctcgaagataatgaagatgacatatgaagatgacggtatcagcgaccttattgaacttttgttgcgcagttggagaaaacttgaggaccatactatcataatcaccaagatttgagtcctttgcatacggtgttatcatacgcctgactcttatgtcattttgtactatgatgtgagtatttttaccaacagcaactaaacccatatatatgactaacgccaggctggtgtgattaagggcattacatccattgtatgctagtattaactgtttccagtgagattcgtaaaatcactcttttctagtttcaagttgagaaatttaagtaaaacagccatttgattatttgatgatgttcctccctattgatcaattgacagttgacattcttaccatactacaggtgcaaaaggattagcttcatttctgttctgtcattccaatctatagagttcttttcaaaatgataagtgccaatttctcatgtttttatactagaaatgcaaataaacatcttcatgatgctcttggaataatctgttgtgaggataatgttttgtgacactgcttttgttgaaagtcatttattataaattggggaagacaaagtaattgattttcttgtccaaatatcattcaacaaattcttcttgtactaaaacactatctgattattacacccagtgcttcaacaaatataatacagaaacagtagggaaaaaacgtttctactgagcacatttcgccatgcccatgtatacaaattaagaatgtcacccaattgattattaaaaggcagatttacgtattacgttaccagctatatcaatacatcattccaatcaagaaaaaacattttttatatgtcaaataaaattatcaagatctacattatagaaggtaaattgagaaacagttggaaagtgcaaacctgttctacattttgcagttccatctattctcatgacccgtggaagtgcatactttgtgtgttccgtgttgatctttatccaacttgattagtcatcatctggccaattaaaagcctgcaattcgtacaaagattgggcagattacttttgagttttgacattctcatagttgaagacatgttacttacgcattttaaaattccaaatcattcagctacgaagttataatattcttttacttagaac

SEQ ID NO: 39023 - DNA, 969 bp, Oryza sativa
ataataccatagcacattggtcgagtttatttgtataacaatgtattttacatggacatgttcaatctattatgtcataaaagtaaattgaggcttggtacaatattggtctaaatgcttaattaaacactcacataaatgtattttatatataaagctttattcgttttcatgaccaattatcttatgtgagtcaatgttattccatgagggactcgataaaagttataaatattaatttaattattctagtggaacactcctttatatatagggtcgttgtagtggtgactatttcctaattacttagatgtcatgacacttgtcgatatggttcaagtatttaacatacaatttgtaatttacattatagaaattaataattgacttgtgttttatttggcttgctatcatgtgcataaatatttatgtggttaataataaataatgtattattgtgattattacttagatgtatatatatttagtttaatttttccattgtgacaattttatagtttggcgagcaataacaatcataacatccagcatgatgcaaaagttttaaaaagttcaaaattttagtgatttttattgtcggtaattttcaggacgttatagccaaccattccataatgtccaaatgacatgagagctcccaaagtctaaaattataaaaccacctaatgttgcctaattaatcagcgaagcatatacctaaattcatactagtggaaccattaatagagtacccactagttggggttttattttcctagggtgaataaggtagtaataaacaatagcaatgataaggctataacaaggattaatagcaagtgctaaacaaaacagtgataacgcgggaatttaaataaagcggtaatgcaataatttaaatcaaaataattttataaattgggattcaatatgctcaaggatgatgtgacttgccttgctcagagagaa

SEQ ID NO: 39024 - DNA, 1501 bp, Oryza sativa
attactgcagagagttccgatagaagaattgacatgatacacacatcttatcacccaagagttggattgacaagataggttacccattggataatttggttgaaggcagtaacttgagctaggttcgtgggatccaaaatatagatcttatgaaaatgactcagtatgccatgtgtacaaaattaggggtagtatgtccttgtaggattctatagatgccattaaatttaagtgaagaaacactccaatcaaactgatcagtatctatgcatcagttacaactattgtattcgtgcttttgtctttactctgacaactacttttaactgtctacgcggcttatgtaattttgagagagatatggttcatatattccaatatctgggactttcagtcttctattcacaccacatatctataatcatggccttatgacattaattctgtctcatgaaatatttgaactagtaatttagtgaatgaactgaaattaacaatattattaccaatttgactcaaaatctgaattgaatatattacatttccgcatttgaatcaaacagatatggggccttgagtaacgtttaaccagattaaagaaagttgcttactagttgcgtatctttgtcaataaaacatgactttttgttccatacctgtggctttgtgagataagacctcgagctgggggcaccaagaaacgattaggcccctctccttgcacttgtcacggagttcttctgatagcttgtgttcattacaggacctcacgacccaaaggaatggtttaccagaattgcaaaatccattacccagctcatctaactgagttgggtcaagatcagcaacagttccataggaagcatagacaacagagcaagggggctgattatctagccacgccaagcatggtgaagtgctgtcagaaatgttgaacccatagttcttgtttggttgcaagcgatcgtcatccaagtagaaggatggcacggtcgggccaaccgtcttaaaacgccatgctgatgccaagtaatctgcctcctgattaagtaacaacattgcatctatcaaatcttctacgtttttcattgaattgaacactgccatgatttttcagctgaatttgaaacgaacctattcgttgactctatttctctaattgtctcttgggcaaaacaacaaacaggcgaggggcatgagcaggttgactcaccttcggctccaattcttggaaagagttgacgagcacatcgtcggcgtcctccagcccatcgaactggcccaacaccgcctccaggaacggcggatacgactccggcgccttcacgaacgacggcacgtcctccggcccaagctccacgctcagtgtcgaaacatgatttcggcaataataaaagggggtagcgcacgagacctaaaagtggatggaggcggagacaaaggatttagacaggttcaggccctctcaatgagaggtaataccctactcctgtttggggat

SEQ ID NO: 39025 - DNA, 530 bp, Oryza sativa
cggtgaagacgtaaccgcccaacaatggcggcataaaggccatccgtgcaggcggaaacaccagtcggcggcgacggaggcaggccggcggtgaaagcgtagacgcccaacagcagcagcataataggctagccgtgtaggcggaggcaccaatcggcggcgacggaggcaggccggcggtgaagtcgtagacgcccaacagcggcggcataataggccagccgtgtaggcggaggcaccaatcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaagccggcggtgaagtcgtagacgcccaacagcggcggcataataggccagccgtgtaggcggaggcatggacgcccatgaacggtggtgtga

SEQ ID NO: 39026 - DNA, 589 bp, Oryza sativa
ctctgctgtcgcccatgtgcgtgcgtcccgtcgcccccattcgcgcccaatggataaaacggagcctcctgccacagctagagctagaacgcacagactttaggctttaggtacgatgatggagccaggaaaccttaattgagaaggaaatcaagctttatcccgtcatccacctcattgttcttacccaatcgccattagggctctagctcgtccaggcatgtgttggcaatcttatccccaacgtttccttacacgctaagctaagcccccaacaaaatccccatccctctctgccttttcctccaatacatttcgtcgaacaccttgggcgcgtgctgcagcttcttccctgctccaccaccgcgacatcgaacttcgtcgttcctccttccctcggtaattcctcgctcctgtgactcctcctagtcccctagggattaaatcccccatcaatttcgttgattaggtccatagcagtgccaagccgagctccaaagctccacccatggaggtcaccgtggacatgctatcccgggggctctcccttctattttactggaaaaacggaaccctcatgcgccataga

SEQ ID NO: 39027 - DNA, 1501 bp, Oryza sativa
aaagcaaaaaagaacgataaaagctaaaaggttagcttaaagaacatatcctctttgtttagggttaggcttttaagatgactttttgtctttttttaataagctaatgaattttaagccttaagtttaatggtaaaatcttatctccatttcacataagaaaaaaaaactacttcaacctaactttttcttaacagtgtaaggttgtcttctgcacctagagttgggaacccactctctttatttttcacgcgtacgcttttcaaattgttaaatggtgtgtttattgaaaaaaaaatctatacaaaagttgcttaaaaaatcatattgatcttttttttaaaaaaaagataataattaattaatcacacgctatggaccacttcgttttctgtgcgggagggattacttcccatcccttgctgcacagtctaagagtgacttatagctttataaaagccaaacaaaaaaaaattatctgttggttttgatttctcggcttatggtctaaactaagagggcgccagtaaatcggcttaagaagggggacaaagtgtggtgccgtgatgataaataaatgatatagggattagatcctaatgcacataattacacagaggtatcacatcgggcctaacgactggagtattagtcaaaatcaaccagcctcgaggtcgaggcagcggcaatgtgttgttcgcaggcgagaaagggagagccccttctctgcttcctcttttcccttctctgcagccttctgcccgtcatggagcccatttcctctccgcttcctttggcaacaccaatacacgaacggagcatccccgagtacaaaaacagagtaatgctaatcaatagcagtaatgctacagatattaagagccctttgaatcgcaggattgagaaatcagagaaataggaaaaacataggaattaaataccaaacttattggattcctatgggattttaaaacacaggaaagtctccaagtgtcgtttgattagcacacaggaaaaacgcaggaatcttagacacatgcccctttgaatcgtagggtagaaaaaacggaggaatagaaaaaacacagtattctgacaggaattgaagtataaaacagaggattgtaaaatacaggaaaaacacaggaatgatcgtttgattggagcacaagaaaaacgcaggaatcggatgagagagatagacctaaaggaaattttccaagaggttggagctcttgctaaatttcctccaaaatccacatgcaatgtgtcatttcataggaatttcataggatttggaaagcttcaatcctttgaatcaaagggccaaatagaaaaatttcctatagtatttgaatcctatgaaattcctacataaatcctttgattcaaaggggcctgaagaggaaaacatgaggtgagacctcatgcttattttcctccaaagttgctctagtaaagttcattccataggaatttcaaaggaattgtgatgtgacca

SEQ ID NO: 39028 - DNA, 1501 bp, Oryza sativa
attatttatttaaagttataaaatctgtagttttgtgataaattagtttttaaatgtgtagttttgtgataaaatagttgttgaatcaatagttttgtgatataataccttaaatatgtagttccgtgatatatttgactctaaatctgtagttttgtgaaatacattcttaaatatgtagttttatgatagtttgatcaaagtatatgtagttttgtgaaatttactctaatctttttttagccatgttaagcctaaattaaatctaggttcgagtattacttttaattttgtgaattagggataggacttcaccttacactcgagacttgaaagccacagaatttccttagaagaaagggcacaagcttaattattaattataaaagcaaaaaagaacgataaaagctaaaaggttagcttaaagaacatatcctctttgtttagggttaggcttttaagatgactttttgtctttttttaataagctaatgaattttaagccttaagtttaatggtaaaatcttatctccatttcacataagaaaaaaaaactacttcaacctaactttttcttaacagtgtaaggttgtcttctgcacctagagttgggaacccactctctttatttttcacgcgtacgcttttcaaattgttaaatggtgtgtttattgaaaaaaaaatctatacaaaagttgcttaaaaaatcatattgatcttttttttaaaaaaaagataataattaattaatcacacgctatggaccacttcgttttctgtgcgggagggattacttcccatcccttgctgcacagtctaagagtgacttatagctttataaaagccaaacaaaaaaaaattatctgttggttttgatttctcggcttatggtctaaactaagagggcgccagtaaatcggcttaagaagggggacaaagtgtggtgccgtgatgataaataaatgatatagggattagatcctaatgcacataattacacagaggtatcacatcgggcctaacgactggagtattagtcaaaatcaaccagcctcgaggtcgaggcagcggcaatgtgttgttcgcaggcgagaaagggagagccccttctctgcttcctcttttcccttctctgcagccttctgcccgtcatggagcccatttcctctccgcttcctttggcaacaccaatacacgaacggagcatccccgagtacaaaaacagagtaatgctaatcaatagcagtaatgctacagatattaagagccctttgaatcgcaggattgagaaatcagagaaataggaaaaacataggaattaaataccaaacttattggattcctatgggattttaaaacacaggaaagtctccaagtgtcgtttgattagcacacaggaaaaacgcaggaatcttagacacatgcccctttgaatcgtagggtagaaaaaacggaggaatagaaaaaacacagtattctgacaggaattgaagtataaaac

SEQ ID NO: 39029 - DNA, 319 bp, Oryza sativa
agcgccgtctagccccgtgccacacatggcacctgcatggtcaacgggagaagagaaggaaaggataagcaagattaaggaaagaaaaaaaaaaggggaaagaaaagaaaaaaaagaaaggatctccggtggttttgcaaaatggctcttgtgtttcccagaaatcaagtgcatgtttctctgcattggaaaccttgcacttaaaccccctgaacttgaggaaacacacatttacccttctgcatagggatttccttacctcaaggcctacgaaatttgcaaatatcaccgaaaatcatattatcgcataaaagagaca

SEQ ID NO: 39030 - DNA, 409 bp, Oryza sativa
cttgagatcgaaaattcagattttttttttcttttagggacaaactagtgattgtttggttcggagtcgtatattgcaaaaaaagaaaaaagtccctttttcagtgaatcaaaggaagcatcgaccatggtgaatactagcaggtggtagtggaataaggattacaaccattaagattagtccatccctaattataaagaagcatcttgtgtgaagtgtctatgatggtagagggagagatggggatctggctgtattccataatgcaatgttatatctggatctaattattctatctgcagcacttctgtgacataacatgatatatggttcaagaatctaattagtcgcaacttagatgttgttttcctgatttcattacttttttcaagttgagcttccatccaga

SEQ ID NO: 39031 - DNA, 733 bp, Oryza sativa
tagtatttttctaatttaccacatttatagtggcatggatctaattaatcctttatattttgatacttctattgctagttctattccatatgtttttttctctctctaacacatgtaaggcaggcactggaaagttacagaaaaatccagctttcattgatccaatcctacggctgctcttttttttctccatcggtcggtttagctttcattgctgaggtggatcaattgagtgctatttttggattcactgttcacctatggagatttcttctgaaaaatatacttataggctcggacattctctgtatacaattccgtattttcaatagcccaggatttataggcagattagggcttgttcggatcacaggataggaaaaacataagaataggaaaacacaggaataatatagaattgcatatgtaaaacgaaggattgaaaaacatgaagcgtttggaatacatgaatatataaaccataggaattttctaattaatattgatctcatatattatagtataattatagtataattaagcaataaaatattagttcccatctagtcactccaacgtgattagcatcctccctgtggtagctaatgaaaaaaaaatgaggtgtgagtggatgttcataatcctatgaaattcccgcataaaggcctatttgaatcgcaggaatggaaaagcggagtaataggaaaaagtaggattctgacaggaatgcagg

SEQ ID NO: 39032 - DNA, 1301 bp, Oryza sativa
tagtatttttctaatttaccacatttatagtggcatggatctaattaatcctttatattttgatacttctattgctagttctattccatatgtttttttctctctctaacacatgtaaggcaggcactggaaagttacagaaaaatccagctttcattgatccaatcctacggctgctcttttttttctccatcggtcggtttagctttcattgctgaggtggatcaattgagtgctatttttggattcactgttcacctatggagatttcttctgaaaaatatacttataggctcggacattctctgtatacaattccgtattttcaatagcccaggatttataggcagattagggcttgttcggatcacaggataggaaaaacataagaataggaaaacacaggaataatatagaattgcatatgtaaaacgaaggattgaaaaacatgaagcgtttggaatacatgaatatataaaccataggaattttctaattaatattgatctcatatattatagtataattatagtataattaagcaataaaatattagttcccatctagtcactccaacgtgattagcatcctccctgtggtagctaatgaaaaaaaaatgaggtgtgagtggatgttcataatcctatgaaattcccgcataaaggcctatttgaatcgcaggaatggaaaagcggagtaataggaaaaagtaggattctgacaggaatgcaggtgtaaaacagaggattggaaaatacaggaaaaacacaagaatgaccgtttgattggaccacaggaaaaacgcaggaatcggatgagagagatagactcaaaggaatttttccaagaggttggacctcttgctaactttcctccaaaatctacataggattagccattccataggaattttaaaggatagtataggattcaatcctttgtttcaaaggctttcataggaattttttccataggattgaaatccttcaaatttcctacacttttcctgcaaattaaaggagccctcacagggttgctacagtattcgtaaaaattcctacacgtgcttcctatgaaccgaatgcatgaatatagccaaatccaaaggattcgccaatcctacagaaatcctgtgtaatccctccattccgaacaagcccttaggccctctttgaatcaaaggaaaaaatagaaattctagaggattttatcctatgggaaataatcctatagagttctttgaaataaaggattgtttcctatcaatttgatgaaccctgagttcctctcgacactcaagg

SEQ ID NO: 39033 - DNA, 169 bp, Oryza sativa
atgggcaataccagagcattatgttttaaatttaggagagaacattccgaaaataataaccataatatcctatgaaattctcgaataaaattgcatctaaaattagacatttggcaaaaattaatgtatttggtgttgtatgtattatttattgtgttgcttcattagg

SEQ ID NO: 39034 - DNA, 1501 bp, Oryza sativa
ccttgctttttgtgattgcggccaaacgagatagatttccgagatgaggctggatccgttagaaagaggactccgagagcttttcatcaagtactcacgggccgaaaacggaggtcgtatgcagattcggtagccgtttgaagtcagcagtgtagtaggtggccgaatcggattccagcacttggagtacttgatctcgatatcttcttgttcatccatgatgtgagcaatggttgcatccgtggtagccatggtcacatcacaattcctttgaaattcctatggaatgaactttactagagcaactttggaggaaaataagcatgaggtctcacctcatgttttcctcttcaggcccctttgaatcaaaggatttatgtaggaatttcataggattcaaatactataggaaatttttctatttggccctttgattcaaaggattgaagctttccaaatcctatgaaattcctatgaaatgacacattgcatgtggattttggaggaaatttagcaagagctccaacctcttggaaaatttcctttaggtctatctctctcatccgattcctgcgtttttcttgtgctccaatcaaacgatcattcctgtgtttttcctgtattttacaatcctctgttttatacttcaattcctgtcagaatactgtgttttttctattcctccgttttttctaccctacgattcaaaggggcatgtgtctaagattcctgcgtttttcctgtgtgctaatcaaacgacacttggagactttcctgtgttttaaaatcccataggaatccaataagtttggtatttaattcctatgtttttcctatttctctgatttctcaatcctgcgattcaaagggctcttaatatctgtagcattactgctattgattagcattactctgtttttgtactcggggatgctccgttcgtgtattggtgttgccaaaggaagcggagaggaaatgggctccatgacgggcagaaggctgcagagaagggaaaagaggaagcagagaaggggctctccctttctcgcctgcgaacaacacattgccgctgcctcgacctcgaggctggttgattttgactaatactccagtcgttaggcccgatgtgatacctctgtgtaattatgtgcattaggatctaatccctatatcatttatttatcatcacggcaccacactttgtcccccttcttaagccgatttactggcgccctcttagtttagaccataagccgagaaatcaaaaccaacagataatttttttttgtttggcttttataaagctataagtcactcttagactgtgcagcaagggatgggaagtaatccctcccgcacagaaaacgaagtggtccatagcgtgtgattaattaattattatcttttttttaaaaaaaagatcaatatgattttttaagcaacttttgtatagatttttttttcaataaacacaccatttaacaatttgaaaagcgtacgc

SEQ ID NO: 39035 - DNA, 1501 bp, Oryza sativa
cgagggttcacacacatgtaagcgtttggaattttggatagaaattccgggcatgacaacagttaagtaataattaaacaatattaatccaacgctatacaacataccctgttgtataggcccaaccattctgaacaaccatcccggctgcacagttctatctccaaaccaggaatataccattccaaaccaggagctaatcaaattattaccagttatagcatcttttattgtgatgagaggtgtgagactaatcacgaaagacattgttagacccgcccataaccgcgggcacggctattcgaatagttttactctgatcagaggtgtaccactgtacccacaatacacagccccacatcatgtcaccatgtgcctcaataccaccacggtacctcggaaaggagctgtgacaatacccctcgcacaacacaatccactacagcgcaccattcctggatcataatcacccccttataaacaaggcatggactccccagcgacccctgtgggcttatctccgccacttctcagtctggtgctctgcaatgagccatgctatacaaaaggtaaagccgttgcccacgctggcttgtggttggcactgttaatgtttcacaaccgaaactcgtgaaccggtccttaattgtcatgagcacgactctcaaaaccatgtgctcacaacccaccattatcaagttttagttggcaagtaattaattaaccattcacgattgaccatcgtgaactatcattaagccatcattaaataatagtgagtcataagttatcctaatagtgtgctaatgtttttaagcatggctaagcaatcatatctaatatctagctgaaccaatatatatagcccaactagtcaagttataatgacccaaggtatcaaggaataaagtaatcaagaacaaaaagggctataacaaacaataggttaattccacccaatgacattcgaaaataaatgcaatagttgaatagaaacaatagatttaaacgggatcaacatgctcaaagggttgtttgggatctgtgtgacttgccttgctggccttggaaccctttaaattcttctcctgcgaaaacggactctccggaaacgtcggaatctaaacagaaaagagcaaaatcaccaaaacagcacataaacaagcatgaacagtacatgtggatatttttaacatgtagatctcaattttagaaaaatttagagacttgaaccaactaaatccgagctaagatgaattagttatgaatttttaaagattaaatcggattaaaacacttatatggattttaattgaattatgacgcaataatgaattatttttgaaaaggaaaaagggatttattgcgtcagcggctagggtttgcggtggaccgggcgcacggcagcggttcacgggaacgaacggccgagatcgatcctatccaaaacgaacggccgagatcgatcgggtctacggcggctcacggcagacggccacga

SEQ ID NO: 39036 - DNA, 1392 bp, Oryza sativa
atcagggcatccaacgacatgtgtatatgagtgaatatgtaatatacatgtactttgtgaaccgcggttcgaccgcccgggtcaccggtcggaccggcggaccgctgaaccgagaggtcggccgggtcacttaccggtccggctttttttactatgtttggaggtagacgtcaggttttaatccatcgtttttttttaaaaaaaaaaggtgtcattcgtctcccttatctttttcttatctagtactccgtactattctttttttcgaggggaaaacgtctggggctctaccaattgcatataagaaggagcagaaaagggtcaatttacatacgggccacaaagaggagtcgctagggactcacagcccgaaggaagagcacccaatctttacgaagtgagaacagcaacaagcaggagcaagcataaatgccgtctctggttcaatgccgcaaagggggcaaatctcactgttatcccacccccgtagctgtagtttatcagccgtgaggattttcatgtgaatcatgagccatccgaagaatttgcatttgttttctgtcttggctttccagaagaagtttgatctgctgtcctggatgccccctaggaattggatcctgtaagcagagctagctgagtagcagccattcgtggtccatctctatgaaagtgagtcctctacgccattctgtaagtgaatctaatggatgagttgccagagagcgatgaactctctgacttggaccgtagtgttcattctccgcatctgacgaagccagcggttgtcggcgagttctttagcgaccattctatttttcctggatgcaatctggaataaagatggggctgtatcttttggtgctttgccctcgagccacctgtcatgcaagaatttgaccttgcctccatttcctaagatgatgatagtggaggccctgaagagttgcttgtctgtttcatcacatgggaggtttgatccctgccacggtttgtcagagtacgtcaagtcatgccagagccatcgcagcctcagagcccgactaaatagttcttttggtcggcatactctcttccgaactcgtagtacctaatcgatatttgaaatacataattgttgtacgtacgtaagtactacttatattaggtatacatgctctcaagttgaatgtataagctggttccagttccaaactcctcatccatataactatatagtccatggttactaattacaaagcagcatatatgatatatatttgtatcagttattctaaacaagtggcacgtatgagtccatcatttctatctatctatctatctatctatctatctatctatctaaaaatctattaaactttctacaaacgctcttaaaccgtcacgtggcgt

SEQ ID NO: 39037 - DNA, 1501 bp, Oryza sativa
aaaacgagtcagtctagggttttagtaaaactattgggatttattcgtcagtcagttgggatttgatgggtgaaatgcattaggtcctagctcaggaacatgggttgcaaggtatttatgctttatttgttattattagtatgtatctaatttctcattattttatcgttatgtgagtctgtcttttttattcgctctcatgcaaaatgatctatgcataaaaatttcgctcttattcgattcccttatttgagtcttttattgctttatttaaatttggatttgagcatgcattgatcctacccctttgtcttctctagatggccggtcacccacccaaccaccgcggagaaggcatgatcaactttgtggcagagttggcacgcatgacactggtggtgggctaccccaacgcgccagagtacacgacgattccaccgctcagtggcgagcttcctcaccgtgttcgcttggaggtccacggctacgtgggtacctgcctagctaacatggtggttgaggcatccggaggctcaacagatcacgcctgtcaggaggcagcatacctgatgatggctagactacgggagcgccacaactacatcttccacgacacggcgtaccgatttcaccctcgtcgagccagtggtgatgatatcagtaccttccgtccgacagccggcgagaacgacaccacctttagtcacatgtgtgctgtgatgaggggattggataggatgcactcggacctgcacaaggcgaccaaggccttgaacgatgggaagctcatgaggatcgtcactctgaaggacgagatagcgcgcctgaagagggagaatgctcagttaaagggtcttcccgcgccaggaggagtccggatccgcactacgcccgcaagacgacgacggcacccgtgcgcatccagcttgcgcccaggaacccacctccatcagcagctcccgcagcacctccagttccgcccgcagttcctgcagctccagctccagctcccgcgtccgctctctccttcgctccagcatcagccgccagaggtccagccagtggcaccggaagttggttgtctgctactcccagtggcagccgcgatctcagtagcagcagctccagtggctcacagtcaggcagcggcgagacttacctgccaggctccgggagtcgctcagaggtaccgggtgacgagcaggaggacgccttcgactccaccgaccgaaggagccgttccgagcattaggctcgttttccattagtttatcgactgtctagcttctgcttgttagtttgtgtgtttaggttgcttgtttggggtcagtcgacggtcgatatcatgtgcctatgatatggctgtcttaataaggatttttgcttgctctttaagtgttttaattcagagcagaacaattgcagtttaaattcctatgtaataaagcttagtttctgagcatctgtttttcttcttctccccgtatgcttttcctccaga

SEQ ID NO: 39038 - DNA, 1501 bp, Oryza sativa
ttagtatataatagatgatgctgatcaatacgatatgctttttcaattcttatttcacactcatgatctattaatgacacttaccatgatctattattgaggcttaatagagaggaaaattagggtttatactttttctccctcatctagaggctagagagtgtacctcatgagattagtgataaatagtgtggatgcactttgtaaacaaatttgttatgaaccgtgaatatgttcatataaagtagggtttatacttttcctctctttctagtttgcactcaagagcgaatttcttttatttttttaataaaaagcttacgagatcaagtaaatagttgtgggaagtctccgtagtttttaagcaatctattttcttatttcgggtttgttgtaggccggtctttttcaatttggtgcgattttgttcattttttatacttaaaagttttgatatatattttgtcttttgcaatcatttacccatctcgatctcgttggtttaatttctctcttttgattctattatcatgctccgcacaacacgtcaacgaaccacaagtcggatgagaaatatcagttgtatccttggatgatgtttagtgcaataattctgtatgcggacaacgctggatttatcgctgctgccaaattgccaatggaggcggctagccggtacctaagctttcgttcccaagtctacgctgggtatttatttgaattttccagtgccacacacctctccaagtccatggattcggatcctctgcagtaatgcagagggtcacttttagctacagtaatatgtgagggaacagtgttctaatgcacagcacagtcgcgctttactgtagctacggggatgaatgtactgtagcaccgctgtttagtactgtagcagatttactgtaacgtctcatctgatccatccatcttctatcggacgcttcacagttcttctaatgccgggcactgtagctacctctgaattttctcctccacagcagaggatccgaattgcaagtccattcctggccccaatatcactgcaatcaaatgtactcttccagtttgtttaagcggtcgtagagtgtaattgtgtatttctgtgaaattgccatattacctacccccatgtgacagcatgtgcaatcagtttgtccctgctgcctcattaagttattgcatgtgcttgctgtattgctatgaattaatgaggtgccatctcgtccttctatacgattcattagcttaagggcaattggcaaaatttaaagagtgtaagtctaaaacataaatttgtttgttatacattaggaccccaagcctaaccacaagtcagtcaagtctttttttaaaaaaaaaaaacaaatctaagctagctgttgcttagccaatcttctctttataatcctactccaattgctgggttggatcacaatcctcagcttccaccacaccaacgaacaaaacttgagagacagagagaggcagagagcaa

SEQ ID NO: 39039 - DNA, 362 bp, Oryza sativa
acaatgcaatatttgaaagaaaacattagagcatttgcaatataggatcaacatgttcaaatgacaagcatgacttgccttgctctgctgctggaggaacctcggcgactatctcgaagtacaccggagcgtcggaggggccggagtctagcgacatacaaggcaaacattgcaaacaagctataagactactgaaacagagaacaaaaccatttttaatggattctacacatttttcttgatttactaagacttgaatgggcttaaacggagctcggatgaattagttatgaattttagaagattcactgtgtttattactataaaagaaaaaccttaaatcatttattgcgcaatatatt

SEQ ID NO: 39040 - DNA, 474 bp, Oryza sativa
gttcaagtatttaatatttgatccataaattaaattgctaattaaccttccctttgtctggctttgttttctcgtgcgtaaatatttatggggttcataataaatatcttattattataattattacttagctgtataactttagtttaattttccattgtgacaatttatagtttggcaagtaaaagcaaccataacatccagcatgatgcaaaaagttttaaaaagttcgaaattttagtgatttttattgttgggaatttttaggatgttacaataggtgagcctagcggggctcacctaaccgcatttatagcgggttggacgagcgcgccacgccgcatttaatgcggcgcagcgcacgcttatccggtccgtgaccagtcgcggtatgtgaccggtcacagaccggtcagatcgcgggttaggtggcaacaggcggcctgtcgcacgcctcgccccgtcccgtcggaa

SEQ ID NO: 39041 - DNA, 1501 bp, Oryza sativa
gagctctgaacttttggcatatttctggcttttcgtaggcctccttgatgacggatgtcatcccaccaagaccgcctccggttccccacagtgatatcactcgaagggcatcactgttctcggtgaccagcatggtgagatcaacgaagcctggctgcttcttcgcgttgcaccatgcctcggtgaggacgcccactgccgatgtgccgacggcagaggcggcggacgccaagtgtcgcggcatggcggcgggcttggagccggagtcgttgatgaggctgtagcgtatgttccgattgctgacctcctcgacccgggccttgagcagctcaatctcggcaacggcttggtccagtggcgatgctgcttccgacttgcagctgcacgatgccagcaagcggagacacatggtccagaacgacctatttgtgtccaggaggaggatggatttgatgcagtcctcggcgtcataagacagatcacggacctggctgacccacgtcctcaccacattgttcttgatccgttcccaatcggcggtcttgaggaaggactgcatcatctcgaactcatccttcatgaacacagtatcacgttgcacgatctgccacagctcctcttcctccttgatggtgctcttgaccttgtttacaagtgcctcaaccatcgtcttggagatcccaatggcaaggtctgccattgctctctgcctctctctgtctctcaagttttgttcgttggtgtggtggaagctgaggattgtgatccaacccagcaattggagtaggattataaagagaagattggctaagcaacagctagcttagatttgttttttttttttaaaaaaagacttgactgacttgtggttaggcttggggtcctaatgtataacaaacaaatttatgttttagacttacactctttaaattttgccaattgcccttaagctaatgaatcgtatagaaggacgagatggcacctcattaattcatagcaatacagcaagcacatgcaataacttaatgaggcagcagggacaaactgattgcacatgctgtcacatgggggtaggtaatatggcaatttcacagaaatacacaattacactctacgaccgcttaaacaaactggaagagtacatttgattgcagtgatattggggccaggaatggacttgcaattcggatcctctgctgtggaggagaaaattcagaggtagctacagtgcccggcattagaagaactgtgaagcgtccgatagaagatggatggatcagatgagacgttacagtaaatctgctacagtactaaacagcggtgctacagtacattcatccccgtagctacagtaaagcgcgactgtgctgtgcattagaacactgttccctcacatattactgtagctaaaagtgaccctctgcattactgcagaggatccgaatccatggacttggagaggtgtgtggcactggaaaattcaaataaatacccagcgtag

SEQ ID NO: 39042 - DNA, 298 bp, Oryza sativa
atggcatggtaagataataaaagggaaggagttcatggcaagagataaagtgatgctgttcaattctatgtgaaactcttcgggcacgaaaaacttcgaagcaaatggatgggaccattcaccatcattgacacctctgcacatggagtagttatgcttcaagacggctgacacaatctttaatgcaaatggtcatcgtttaaaagttttcctagaattaattgctcgaaaaccaaaataaaaaattacacgtggtaaatttagtcaattttgacgcatttaccaagaccagttatca

SEQ ID NO: 39043 - DNA, 1501 bp, Oryza sativa
ggaagtggctccatcagcataaaaatcaccatgcaatatcccatcccacacaagttaagaatttagagtctagccaagtgtaatacatgtcccggtgctcattaaccgcgagcacggctattcgaatagatttggttttctcacactgcagtggatgtacactttacccgcactccgcgactgcccaacacatgagcctcgtcccaacacatgagacgcgtcacggcaaagcttttcgataacctcgcattggcagtacccgctccatgaacttttcatcctcatgcactctaggcgtacacggtttctagcagtgagaggagttctggcgcacccgggaagggaagactcacacatgcattaagttataattatgttttagattctcacatggcagtcctaccgatggcgacaccactgtagacacccgcctcgcggtcctaccaatggctgtcccaccgtagagcccctgcctcacacatcaagaaaccactatgcatggatactgcctccgctcagctatctactccgctaggtctatacccatacgagaagtgcggttgtacgggggtcgtttcatgcttaacttcatggctcggtccttaattgaccagggacggtactagccttttccagataccacccaaatcctccgtccgccccagtcgaaaacagttgtttaattttatttccactttcacaaatcatgtcatcaacatcatggcaatgtggcgctcatgtctccacatgccgcatctcaattaccttcccaaaggtaattgcccaagcatatagcatttgataaatatgagtatgcatgattctagaatagcctttctaagcaattgtcatagttgactagggactcatacgtaaacatggttacaaagatttaagggtaaacaataatcaaggcatggcataatcacaagtaggatgttcatcattgcatgcaattttatttataaacaaaacaatttcgcaattgggatcaacatgctcaaggaatagtgatgacttgcctgctcaggataatccctattctcgatataatcttgatcaaccttcacctcctggaagttgcagacgttgcctcacgactaaccgatacacaaagtctataatacgcgagaaaaaccaatattcaagcaacaatcaaatatgcacaaacaaaatatatttgctgaggtcgaacctagggttgctcatattattcgcgcttgctaatggactctaatcaagctaagagctaaggtttcttagtctttctgttgtcatggtggttcagtctagctaatggctaaggaaggattatggttacacatgcatctatctaaatagaacggttatacactagaggttctgttgccggatggattttggatcggtcaaataattactgtgaatcatttgtattattattttattaatggaggctttaatttaattatgtacatatttcacttgtcaaaataaattataaaaggttaacaattaccca

SEQ ID NO: 39044 - DNA, 175 bp, Oryza sativa
aatgtaagtgtttaactcttttagcctaaattcattcgtgatatgttgtgatccaactatgtatgtgtgtaccaactactgatccagggattggtacggataaacacagaagatttccgattttcaaaatcgggggtctacacctatcccacacacgtggcgccaaaaccacagg

SEQ ID NO: 39045 - DNA, 1445 bp, Oryza sativa
aattcctgcagccctattatgagattcagattctacatcaattttcgttagcacgtttttaaaacagctaaatggtgctaaacaactaaacttcctatatagaaaaattacttcgacaagtaaatccatttttcaagtttatactaattaaaacttaattaatcataagctaatttttttcgtgtgcacttacttcatcataaccatcatccatctcaaacgggacctataatatatattgatcaaatatatggtaaaaaaagaatcatctcctattcagaataaggtaaaaataatgggcatattccttgtgccataagaccatatagagctagtcaaatgtaatatagtgacatgcatgtttggccatttttagggagatatccggttgatgctcttatgctcctactaggggacaactttgtgctccccaccatgaggaactataggctctatatattatgcatcaatccaaaaccgcgaaagaaaatttttgccaaaacagaaagcccctggctcttgcaaccgataatttttttctccaaagccatgaaattccttagcatggataaatgtgtccccttttagttatctcgtggtgtaactcgttttaagaccgctatatttgatacatatcgtactataaaggctatgtttggaaggagtttttactatctactgttttttttcaaaatctttagctccttaaacgatgtttaagatttttactcaaattatgagaatatatggttgtatcacactaaaaagccataaccatggaaacccataatttccaaaatctcattggccacaccccagttattccttgttactagaatttatcagtttccagaacaggaccaaatacagttgtacattccccctggataactacaatccaaacccaaaaagaaaaaaaaaacaaacaactgtcaccagaaatattaaaaaaataaaaaagtactagctcatattcatggtcaacgagtcaacggtcgtaatccccctcgccgaagaaaacaatataataataaagaaataaaaaaaaaagaaggatcatactccaaagaaggggtactttgcaaccggcccgaatcggacggccaggataacgcccaccctatcttccgggaatctccagagaaaccacggcgaaaacaagaacagcaaacacacgcggccgacgacacggtcaccgcccgtgggccccacctcccctctcccctctctcttctccactcgactcgactcgacgacccacctctccaccaactcgcaactccaccaagcaaaccaaaaaccccaaatcccccaccccgaattcggaattcccccccaaatccctcgccgcccgccgattcagccccgcggagacgcgattctcgaaggaattctggttcccggaggcggagcaggcggagaatcgtttggtttttcttttggga

SEQ ID NO: 39046 - DNA, 1501 bp, Oryza sativa
aagaaaggaagaggggagaggggcatcgagctcggcggaggccaggagggcattgcagacgcgcaacagggagaaggggatggacctcggcgtggacggctggctgttgccatggacaccaccacgagcacccacaatgtaggctgcctcgacagagagaaaaaagagaggggtgaggtagccttctttatttatttatttttggattggtttatcagacaccacgcggtaggacaaaaccactctggatttggtcaagggggtaattcatccgattttagtggtggagggtgaaatatgtttgattttcgggatatgagggtaattcgtactcacccaatagtttagtggataaattagacttttcccatatccaatcgtcgtgggcgtggcctatatctgcgttacgtgggaaaataatgtcaattcgtaatcaaccgcatgttcggagcagcgcacgatcaactcggattttctatttttggccacatgatcgactcgggtcacatttcctttttaaatttttacccgtttgatgatcggactatttgtattttattttggatttttaccaatcttaatagaaactcaataactaaattttttatgtactctcattgctattgaattttaagtaaatttacactcaaaacgcataaggatgggattttgtgaaactttaaaaccataatacctaagttagatgccacatgtcttaatacacatggttttctaaaatttactctgtaatataaccagcttctagctaacacacgcacaactaaggctgttccatgggccgctaaccacttacagcccaacttgtctgttggtttcccctttggaaaaagtccacttagactcccttaattgttcatcgaatctaattcgtgacccttaactagaaaaccgggtagaatgactcccccaattactaaaactagtacaaattgaatccctcggcggttttgaagagtggtttcgttgatgtggcgtctacctggcaatgttgacttggtctgctgttgacgtgacgcttaggtggcattataactaaaaacatacgcgtgggacccattcgtcattcacatagaagaagactttgtggggcccacatgtcagtctatcccttcctcatcctccccaatctcccccttatctctctctccctcccaattcagcaagcggggggcgccgccggcggcgacggcgggcggggggccacgccggcgacggcgggcgaggggcgacggccgccgagcttcgctctcgagcctcggtcaggtctaggcggtagcgggcgcgacctcaacgaggaagttgggctgcgcgccatgtcggactcccagacgcagtcgtcggggtagcggacggggtcggtggtgggggtgccgaagttgatgcgggtggcgagggagaggaagaaggcaccctcgaagatgaaggggtgaccgttggtggcgttgatgaggtagtcggagaggaaggcccgggactgagc

SEQ ID NO: 39047 - DNA, 1501 bp, Oryza sativa
gcctgcgtagtatacatgggcctgcagattagaggattgcatcggagatatagagtaaacctagcccattagttccatctgtggggagggtaacagcctgctttgctggcttcttttcctcttccttttcgttcaattcttgagaaattgttcttcttaccatcgagtaagagagctgttttctccctaaaagttactacaaatctttatgattttctcattatatagaaaatccgctacaaaccctggcgtacgtgcacaaacatatagggaataagttcactttatgtccctcaatttatcacctgagtctgaaattcatccttaaaccgaaataccagatataacaagtatctcaatttataaaaccggaccacctgagatcctaggcagtattacgtctgattttagttgacgtggcaagttgaatcagcgtgggacacgcgaaccccacatgttagtgactagcattttcttcctcctttctctcatcctatctcttctcctctttctcctgtcctctcctctcttcccaatcccctcctcggcgacggatgacgggaagatggcgtacggtcatcgggtaagtcgtccctcctgaattgcagtgaccttacgccattgacaagcagcatcagccatgccgagaagaagacgagaggcggatgcagaggacgcctctccattgcatctcatccggatgcacagcacgttctatcttcttgtctccaaggtagatcaggggcagtatcaggatgtatcgatttcttattgttcgataggaagatcgaatcagggccggtcctgacattttggaggccctaggcagacttgacgctatgggccttggagttagcccttaaggagttatatctattttttttacttctaatacatacaatatactctataaagcacatataccatagagtgacacaaataaacatttttaacacggtaaataataaatcaagcagtttgcaagttgcgatagagcaatttaatctttaataaataatatcaatagtataattgacaactaaaaataccatagaaacaaattagtatgaacaccttaataggagaccacaaatatcccatgtcccttataaaaaagagctttttcgcgaccttatgagttatgtatagcacccgacaaatgtttctaggtaacattgtaacacctgaagcagtgaaattgcaaagtaaattgatagaggcatagctgcatagagcttctcaattgacttctaggtctgtgacctacctgcagcctgaagaagaggggtgaatgggaaatggccgatgagccgatgacaatcacagatcacgcgggcagggcagggaccagccaccatccaggcagccggcaggaagcatcgacagcgataccagcttgggggcttggccgatgggcgacggcgatcaggcgctataggctagtggcgccgatgcggtctcggcactcacggtggcctctcgcggactagggcatcggcga

SEQ ID NO: 39048 - DNA, 1501 bp, Oryza sativa
tggaaccccaggtcatcattgccatcgtcgatgtcctcggcggtggccttctgcttggcctcacctcgccggttgccggcgggagccgccggggccttgccctcacggcgctcctgcctcttctcctcctcccacttcctcgtccgctcagccaaacttttgaccgcgcggtagtccgcgaggtcgtggagggaggtgttgtgcacggtacaccacttgccggtcgggcgctccctactgggagcgccggcctccttctttttgtcgctcgcaggcctcccctttcggggggcccgcgaagcgccctcgacggcgaggacatgaccctcgtcgtcggaacgggccgacttcttcttcctcctcctgtcccgccgccctggctgtgcggcggacccgggggcggccggagctgccacaccagaaccggaggagttccaggtccaggcctcctccttgcgagccacacggtccgcgagctcaaaaagctgcgcggtggtctggggctccttggaggcgatcttctcgagcatgcggttgtgccgcacgcccccccctgaacgcgtagatcaccgcgtgtgcggggatgcacggtatggtgttgcggacttgacagaaccgctgaatgtacgagcgaagagactcatcgtcccttcgctgtaccgcatgcaagtccgcttcttcgcctgggcgcggatatatgccctggaagttcgtggtgaactgctggcacaaatcctcccaagagtggaccgacgcgggtggcaagttcattaaccaaccccgcgcctggcccttcagggccatggggaagaaattcgccatgaccctgtcgtcacccccggcggcctcgatcccggtcgtgtagatctggagaaactcggcggggttgacgcttccgtcgtatttttcggtgatggtgggccggaaccttgggggccaacggacgttccgaaggctcgccacaaaggctcgacagccggcaccgtcaaccggggacacggggggccggcccccgtgcccggaacgaagtggcgctccggacgaggaagcgccctccgttgcgtgggcggcgcgactatcgtcgcgccggcgctcgatatcgagccgggcatccggccccccatgcacatcttcttgggtcggaggcgttgacgagggaatggcggacgaacggcgggtaacggccgccgttcgccgcgccctccgcctcgacgacgtggagccggcggcggcagcgccagaggccttgttggcggaggactgcccgccggcgcctaggcgctgctgcgccgtcatgaccaagtcggccacgtcatccagccaacgtcgggctggagtctctggatcggggacgacgggcgggtgacgcaggagcgcgcccgcagcctggagcgcgccctggggcgtgccgccatcgccgtagacgaggcggcgacgcgccccgtctcgccgtcctcccccgtcgcccgcgggcggcgaagtcgcggatctttcgaccccc

SEQ ID NO: 39049 - DNA, 1501 bp, Oryza sativa
tatgaaattagggactttcttagccttcatgctgtcggttctgtcattggaaatacaacgatggtggatatggtttatcttcggaaacacggggtcgtaagaatgcaggttgcggtggatgatttagcaactttgccgcccagtgtgtacattgtgttccgtaaccatgggtatgagattttctttgaaccagaaatgcccgaggaggaatcgaaaggaaaggaaaagttagacgaagatgatcagcgtgatgacagtgaacaaaagaggaacgatgatgatgtcattatggaagatcggaatccaaagcgactaaaaaatgaagctgcgtcatcctcaatgtcattaagaggaggctcagttacagactctcagcttaattcacattgtgtttcagcgatcgcagggttgctcactgttgttgatgattctgcagtagagcagcaagctgaggaggttttgccaacaatttgcgtggcttctagcttggaaacggtgatgaacaaggctccagaagagagctcaatgcagatcccaactaccggacagaacgtgaccttggcaaatgaaaaggtggctgctttgtctttggctgtaccggatagtgtggttgccatctcagaggaagaatttacaacgacattgacggatgcgggagagatggcaccggcaggttgtgcatctctctcggaggcttcgacgggagcatcaacactagaaggggctgtaactgtgtcattggctgctcctgttgtcatggacgacgcagcccaggagatcgagtcggacaaggtgggcttggtggctgccgatgctccaactttgtcggtcgatgcaactcaggtcttgccgtcctcgtcaactggcacaatggacgctgctccaatggtgaatcaggaggtgacagaggtaaccacatcacaagactcgatgattttggatgtcgggactgcaggtgttaacacggtaattgagttggctgccgatggggcacaacttgatgcagcacgcaccatcatcgctgaagcaaaggtgcaagcagaagcaggtgggaagcgtccctctcaagaagctaaacgtcgctctcgtcgactgattcatcctacaccaacacgtcaaagtgaatgacagaaggcaatggcaaacggggatgcaccggtggcaaaccgagcagagtttctaaaaaagattcataacctcgaagtggtagcaggtaacaaattcaaccctacaagttcaattctatctttgcctaacaaaactctacttgcaaatatttctaagctaggagtttccctgggtagaaatgacatagaagtagatgagtctatttatggtacaaaaatttctgaagttgatagatttgtagctctacatgctagttcttctgtttacaatggttcttctagtaatgtagataatgacaaggatgagcttttaaaattatcttctatccagcacttatgtagtgattggcaagaagaaagtgagggtagcgctg

SEQ ID NO: 39050 - DNA, 1501 bp, Oryza sativa
cagcaagttgaaggtgtaatgctagaacataggaaaacgaaccaaccaaaagtgaaaaaaaaaagaattcaaggaggtaaaatacactagcattacattgctactagaagagcaaattttgtaccatgttcaggggagcttcttgaaagtacttgtatagaagaggaagactttgtttaaattggcgttcaaatgatgcaggtgcactacaagtaaatgaattaaagtcataacgaagacaattgaaaatatggggaaaatcctcataaaataaataaaaactggagttgaaatcagtaaagccccaagttacctgtatggaacaaaatagggagcagcaatgatgcacttaacttggaacaattctgcaagatgccaaccttcctgaattgtgagaaagatccaaattacgtatataaccacatataggacagactaacaggtatagtcctggagctgttctagtgccaaatatggatagtgcagagcaaggttctagaattatctccgattcttgcaacttaatggagtattatgaccatagaaggcatttaatagatacaccatagattattcctagataagactgactgactgactgagattgtactggaaatgttcgggtgcatcctcaaacaatgaaattccatattttcaacatgaattggtgtggcaggactgtattattacctccaatattttgaagaatgaattaagctacataaggactaactgaaagttgaaccaggagctccacaactcaacttatagcaagctttgttaatgggatcctcaccaacgcaaagaagttgatcacaatgaaatcaccatgagtgctcatgtcatttccaaaaacattttcgacggcagacaagcactctctcctgtgctccacttgaatggtctttttcctctgcgaaaaggagtcatgctcaacatttgattgaacagaatcacctatcaaaaatgcttacatgataaaccatatttgcaaaaagagaaatcacgaacatgaaattggacagacttcacggcacttacatgagatgctctcgagctgttcggcagcaaggacaggtgggcttgacacaggcatatatctaacattacagtctgctagatgtgtcgacaagctctgcatcaaattcactatgtgaaactgtgatcccagtaaagctaagccagctaggcaagtttatattgagttttagtttctacaagaatcaaacctgatgtgctgaatgtgtgatgaacactacaccatactgtcgttggtcctgcgcaaaagctgcagcaagtgcctaagaaaaagggaaaaaatatatccaaaattaggcgtatagactctaaatgggttcatcccgagctgtaaactgttcgctgtctgttcggtgacatccccatccgcaagaaaatcaagtgggattgcatcttgcgctcgaatccccacggacaaagagacgaaaaaaaatacgaagagagggaagagcgcgtacagcta

SEQ ID NO: 39051 - DNA, 1501 bp, Oryza sativa
gagcccagctacttttggccgaggcccgatccagtccagcacgcgcgcctcctcgccctcgcgtttcttctcgttcgagcgctcgccacaagcggctccacttctccgctggtgcggcgacggcgacggcgacggcgacggaggcccttgcgccggagaagcccatgccgcatctacgtccgacagcctgcgaccaggtttgtttcgtgcgttgtttctctgtacgcgtgtttgcaatggcgtcggcgtcggcggtttggttgtggtgggtgttcgccacgcgtgcgcgcggtgtgttcgtggaaatgcccataagaatgccatgagcctgcacttgcacatgcaatcggaaaatcgccggtgttagtttcaacgatttagctaggagaatgattatgacgcaattagctggagcgcatcatcggattgccatacttttttgtggattatggggatctgaactttgggttttgttcatggttccatcatgcaaataggggtgtattattctactactctttgacatggcatctgtatggtcaattgcacagggggagtaggagtggattagttttcatcgaatcatccgttgatcggaaaaccttgctcagcaatgtttcttatatattttatttttttctttcgtttgggtttttagggtctggttaaacaacagatgccatacaatatgtataatatcgtttagaccaataaagtttatcatgcatacaaaattttatggaatctcaatctaattaggaatgatagttaaaaacatcagcaaacaagcttagataggaaatttaatggcaggttatggcaaaaacagaatagttggatttggacaatttaataccaaacgtaattcattacaattataaagcatatccagggctatacaactccgatcacccaaacttaagacttgtttctgattatgaccatagactttttgatgcagccatgtttctaggcgtccattaggcatatattgcaagatgattgctttgtattctaaaccttttggatccaaggtggaacataaggtgatgactttaataagattgcgatgtcggatgtttttcaaggcttcacactctgcaataaagcttgttggtcctccgtgcctattgagattgaagaccttaatagctactagatcaacctcaaactccagggtgcccttgtaaacatctccaaaggatcctgaaccaaccaagttttcagaagagaacccttttgttgctttgacaatatctttgtatgaaattatcgtcatatccatgttattgtctgtcgatatttgatttcttctcttcttttcagcggacagtgagcaaacatatcagtgaaattactacaacaattgcagcaactggaaccactatcattgaataatgaactaatactttgttcttgtgtctaaatgcaggacaatgaggaagccctaactctggggttgggccgtcccttggtagggccccaccctaacggcccaatg

SEQ ID NO: 39052 - DNA, 1501 bp, Oryza sativa
taaatattcgacgccgctgatcttttctaaacatgtttgaccgtttgttttattcaaaaacttttgtgaaatatgtaaaactatatgtatacataaaagtatatttaacaatgaatcaaatgataagaaaagaattaataattacttaaactttttgaataagatgaacggtcaaacatatttaaaaaaaatcaacggcgtcaaatatttagggactgacagattatgagttaatagaactactgcgtgagctagctagctgatatgaataagtggcgtcaaactttttcaagtttaaccgatagcttattaatttgcaaataccagtggtcatattggcatgcattttgaaactgtataattaatatataaacacttcatcgctaattaaatagtgtaccagtgaagttgaggttaggatccctgggacgcagaacttgtagtactgaaataggagtactagctgctgggtaactgaaactcggctgctgctgaccagcatcagcggtttgtttcacacaggacgcaacaacatcaaacagatcctggttcttgaagctgtcgttggttgattcctcctctgacaggcctgtgtatgctagagcagcagcagcagcagaatgcaaaagcagttaatgtgttgtttagatccagttaatgtgtcgggtacttatacagggtatcgtatggggtgtttgaacattaataaaaaaactaattacagaatccatcaataaatagctagatgaattattaagcataattaatcataattagcaaatgtttacttagtaccacattgtcaaatcatggagtaatttggtttaaaagatttgtctcacaaattggtcgcaatatgtgcaattagttaacttttaacttatatttaatactttatacatgtgttcaactgtttgttatgacaggtataaaatttttgtgtgggacctataaaatagaagtaacatcacgatatgccatgccataatgtgccaggtgtactttcctctctgcacgtgcgtggcagccgtcacaacccaagaaacaaattaataatcagccggacaagtttatttaattactccccaacactatagctatttaacccccaaagtactttggtttatatgtactactctctagattacttaagggaaatattgttcctactgatcgtatatagaaaaggcgagagcaatattccacacgcgtgcagtcaacaaaacgaataaatagtaatcacttgaaagtaacacgtacatatgcgctaagctaattaatttggagaggaacgactcactttaatttgcacgagcaaattaaataattaagctgcaaagtagtgtagccacgcatcaagagagatcacgcaaatatcaggtttttcaatttaccctgcacgcgagttcgtgaccctgatcaaattaactagcatgcagttggattatagtattaatgaataatgcaaacaagagcatggcatgtgattgtgatctgagtg

SEQ ID NO: 39053 - DNA, 1007 bp, Oryza sativa
tatatatatatacatatatatatatatacatatatatatatatatatatatatatatatatatatatatatatatatatatatatatatatatatccagccatcactcagatcacaatcacatgccatgctcttgtttgcattattcattaatactataatccaactgcatgctagttaatttgatcagggtcacgaactcgcgtgcagggtaaattgaaaaacctgatatttgcgtgatctctcttgatgcgtggctacactactttgcagcttaattatttaatttgctcgtgcaaattaaagtgagtcgttcctctccaaattaattagcttagcgcatatgtacgtgttactttcaagtgattactatttattcgttttgttgactgcacgcgtgtggaatattgctctcgccttttctatatacgatcagtaggaacaatatttcccttaagtaatctagagagtagtacatataaaccaaagtactttgggggttaaatagctatagtgttggggagtaattaaataaacttgtccggctgattattaatttgtttcttgggttgtgacggctgccacgcacgtgcagagaggaaagtacacctggcacattatggcatggcatatcgtgatgttacttctattttataggtcccacacaaaaattttatacctgtcataacaaacagttgaacacatgtataaagtattaaatataagttaaaagttaactaattgcacatattgcgaccaatttgtgagacaaatcttttaaaccaaattactccatgatttgacaatgtggtactaagtaaacatttgctaattatgattaattatgcttaataattcatctagctatttattgatggattctgtaattagtttttttattaatgttcaaacaccccatacgataccctgtataagtacccgacacattaactggatctaaacaacacattaactgcttttgcattctgctgctgctgctgctctagc

SEQ ID NO: 39054 - DNA, 157 bp, Oryza sativa
atttgaagatgttaaattacttctactaaactgatctctttttttgcatgcgaggtcctatatttatcaccaatctttaaaagtgatcattatttcaataaaatcgcatcttttgctcttcattatattttcttttcttcatgctttaagttgtaat

SEQ ID NO: 39055 - DNA, 321 bp, Oryza sativa
tacggaaacaacctgcggatataggaggagttccggataagaaaagacaaccagagttctacatggaaacgataaggactactcggattgtatccatattggtttccctagttctacttggacaaggggacacctatgggtataaatacaaggccccctaaaaggagaggggatacagacgatcaacacacacccaccatagaagacacaaaacaatatatcaagacacaagatcaacatacaagccaacatacgccaagacaagatgccggatatcgatttcagggataagcacggctagtcccctacggtgtctccaga

SEQ ID NO: 39056 - DNA, 1501 bp, Oryza sativa
atcaagtgtgacaggtgtttcgtgacggcatgatgccgccaaagttcttggtgacggcggcattatgacttttagtgacagtaaggggcagtcaccaaagatctaatctctagtagtgccacttaaccgtgttcgtgtgccattactggagatatctaatctctagaactataagcttaatttgcatcgatcctccgtaatgcgcatgcatgccctctcttttttaagctgcaggggcacacgtctctctctctctctctctctctctctcttcctgttgtttttttttcttctcaacccgatatcgatttacctttttccaaccatattttgtggataggtccatgttttctcaatatacttaacaaggctaaggtggtgtttggatccagggacttaactttagtcaatgtgtatttagacactaatttagagtattaaatatagactatttacaaaactaattacataaatgaaaactaatccgtgagacaaattttttaagcctaattaatctataattagagaatgtttactgtagcatcacataggctaatcatgaattaattaggctcaatagattcgtctcacgaattagtccaagattatggatgggttttattaatagtctatgttcaatatttataattagtgtctaaacatccacgatgtgatagggacttaaaagttttagtcacatctaaacaggtctaagatcgtgccttggtttccaagggtacaagggcgctcgctccaccgcgcctctctgcactcgcgaaaagctatatatactccatatccgatctcgcgagctcgaatacgccatttaattagctaggctgatcgatccatccatccatccatcgaccgatggaaggcagcaacggcactcactatccccaatgctcaactggtacgtccatgcgtcactacaatactagttaaccatcttttcttcactgatgagtaatatcatgcgtgaagatgaacatatatgtcgtctatatataatcaagtcaatagtgtgtgttcggatccttgttttcccaactctctgatctctcgtattctacgcacacgcttttcaaactgataaacggtgtgtttttttttaaaaagtttctatacgaaagttgcttaagaaggttatattgatccatgtttttttaaaaaaaaatttgctgatacttcactcatgcagggatggagaccggatcgtcgtcctcacacaatacttcatcaccttgcagcagcagcagcagctcaacatcgtcgtcactcccggcggcgccacagcagctgagtcgtagtcgccggaggcggggatgaggtgtgtatgcgtgcgtgctagagtagtgttgctactactactgctccgtttcagattagaagactttctagcattaccaacattgatataaatgttaataaatatagacacgcatatatgtctagattcattaacatatatatatatatatatatatatatatatatatga

SEQ ID NO: 39057 - DNA, 1501 bp, Oryza sativa
tgttattcacattgctagcgagaataaagagcttaaattgctatcttctttaaatacttggggttatattcaatttgatgatctttgtccactcaactgtttagagtagaaattattttctagatttgaattgccatgcccttctgatgtgatttttcatattactggcaattatgatagtaaaggagaatataatgtgcatcaagtatatatttgttcgaatttgactataccacattttcatgatgaaatgtgttgtctagaggactgcatgcttataagtaattctctatctagttcctctagttgtttaaataagttataggttggtttgcaagaagggaagtgtggtggtttttcgactaccaagatttcaggatccaaccatatggccatcaagaaattttcctcaacggatgttgaggtaaataaagataagttcaatacactttatgacaaggtgaaaccgaggacgaattccaatctagaaggggaggatgatgaggacacaactagctcggatataaccatgactaccttatgtattaatcaaccaaatgtgcatatgttctacattagatttacttgttatatatttaaacaaccgttgctacacaataagtttcgtgtgtttttgtttgcagagatatttgcttgggcgaaagaaaagagaccgagcgtaagcaatgtatagatgattgaagaagttgactggggaccaaaccaagaccttctccaagtcttctttcatctcaccacatcacttttggtccatagaagacaagagataacgttctacacgttttggattctgattcgggcctcctgacagcatcaacatcaaacagacctagccgctgatctagaaggaatttcggggcccatgagtacttgttggaaagcttatggagtctactttcagatggttttggtcccacatcaaaattcctaccaagctaccggaaaactgcaaaacaagccacgtatctcatccagtccgaatatcatttgggttttgggccttgtaattgtgtcgtgggcttagcccaagggggtgtgcaccctagagcaaccctaggatgtccctaatcatttttactcagtagcagtcatcgtttagagtcagattttgcttagattattctgtcgagaacggtttcgccgctagatcggtttgtaagaccccaactcgtgagcttaatcattcatttgcagttttggttgtattctatctcgttcttgtttgtgttattcgattggcaaacagggattagccttctcggcgaggtcattcgtgtttcgacacgggtgacaaccagaggagacgtggtgctgccattgcggggctcaagagcgtgcgcgttcaagaagccggatcgatttgggtcgcgactctgcccaaatcgttgtttatcagaacctttcagaagatcgggaaccctagtgcacatcacttagtccttgtgcatttcctgtaatttggttcataagaaagatggtt

SEQ ID NO: 39058 - DNA, 1501 bp, Oryza sativa
tcccgtggtactccaggagctgcacgctctgccggtggggatgggtacgtgccgtaacgtgcgccgcacagcaataatgatatacttcctctgtcaaaaaaagtccaacgtttaactgtccgtcttatatgaaattttttttataattagtattttcattgttgttagatgataaaatatgatagtaatactttatacgtgacttttctgtttaatttttttataattttttttaaataagacggacggtcaaacgttggacacagaaacttagggtttgtctttttttttgagacggagggagtatagagcttagtgacacgcaaaacggagcatgcattattgcatgattaattaagtattagtttttttaaaaaaatagattaatttgatttttttagcaactttcgtatagaatttttttagtaaaaaaacacatcgtttagtcgtttaaaaagcgtgtacatataaaatgagggagaggagttaggaacttgaagataagaacacagccgcctaaatagggcggagcatgagccggggcatggggtggcggggattgcgcaggcgatggatggattaatcgccgatggattaagcgctatacatatcaataaataaatcttttatatttgttgtgaacctggtgtgcactcttaattactcccctctctgaacgtgggtttaggttgtcagtctgcctaggcgcttgagctgagcaggcgattgtagaagaatttttcccttccacgtcagatccaccggctaatcaccggcttattagccctgctcttagatgcggtgcgggtgatttggccagtaggaatggaggggtgtaactctttatttttatattagtatagatacaaatatagatcagtggtgtaactaactaggtggtactgtggtccatagaccacctaaaaatttaatcgaggttaaaactatagtatatgtgctagttaatataataaaaattatatagtggatcacccatttaattgatctattatatatagatggaccacatttattttaaattctagttacaccactgatatatatatagttacgttgcattattttggtttactaattatcgctcgcggtatttcaatcatatcgatctttgatttttcagataaaatatatttgggtaataaccggaatctgctaatcaaccggcgggtctcaacgcagatgctgcacccggtgtttaattcctgacaagcatctcaaagtggcagattgcgagtagcaacgaattttgaagctgtggtctggtattctagtgtactccgtagtagaatatttgggtcacatatcccgtaagatgcatggtttgctttgagttaaactggcatggtatgtacggtatggtactccctccctaaaaatgtaaaccaatactgagtttaaacctgtatatatatgtgtgtccaggttcaaacttaggattgcgtctttttttactaagggagtatttgatatgattgttacg

SEQ ID NO: 39059 - DNA, 1501 bp, Oryza sativa
ttatagcattacgaatgtataggaagtattttaatcaaatctaaaagtaactttaaatatatgataatttgttcaatgaaaaaacacattaattaaagtttccttcgttttgttctaagtaacttctataatatatgtaaattacttttaggctttatttaatttacttttatatgtctaagaagtaatttagtgaaatttaaaagtaatttagatatattataaaagtaatttattatttttcatcaaaatataatcatgtgagatcttattataaagatttaattgttacgaacataacgatgtaatcggatcgtagatcggataagtagtttaagagaaaattgtatttgaaatataggtggatagtatctcttatagaggaagtggtaccactgtgtagtcacatccatttcatattcgataccccttctccacaccacagatgcttatatagccgcatctttacaacacaactcaggcccattcctacgttggcccgccttgctcgcactggtatctttttcactggattcgcatagattgccagatcaggaaccgtaccagatactgtagagtctgcaacattcctccctccatcaaaatcggcttgtccccaagccggtgcagtagggaattgctgacgaagcatccccgcatcttcccaagttgcatcctccgacatttgtccagtccaacgaacaaggacctgctcagaagtaccagctcctttcttcaaaacccgacgagccaaaacttgaacaggttcaatggtgtcaggattaaccaccagtggaagacgtaccggaaaatcaagactgggcgcggatgcttgacgaaattaggaaacatgaaccaccggatgaatagcacaatcatccggaagttgcagacgataagccaccgctccaactttctcaagcaccggaaaaggtccaaaatacctgaaagtcaacttgtggttggaacgaacagccagcgaactctgaacgtagggctgagccttgaggaaaacctaatcgccaacctcaaatacacggtcagacctcttcttatcagcctaaaacttcatacgctgctgagctctcaacaaatgctgccgcaacagactagatattattgcccgctccttcaaccattcatccaaatcagaaacgacactttcagaaatattactgacaccaaaatgccgaggctgattcccatacaatacttcaaaaggtgacttatccagcgccaaatggtaagcagtattgtaccaaaactctgtccaagcaagccatcgaaaccatttcttggggcaactcggtccgtctgtccatcggtctgaggatggtatgaagaacacatcttaagttgagtatcagccaaacggaacaactcagtccacaaggcactcgtgaatatacggtctcgatcagaaataatgtgttgtggtatgccaagaagtttgtagatataactcagataagccatagccacatcaaacaccgtgaaagga

SEQ ID NO: 39060 - DNA, 754 bp, Oryza sativa
  unsure (1)..(754): unsure at all n locations
tacagcactacaatttaatatcacaatgcatatgtttgatggtattttgtacatatttataaaatataatcacttgtatattgtgtgttaatggttgattgcagcaggaaacaggttaattagcaagctaattaaatgattcaggcatgcatgtgcgtacagaggtggcctgacatttgggagggtagatgtgtgatgtgaattcggccatgtatgcgtacgcatatatatatgcatgcttcactagctagcaagaccagcagaagtagaccggtgctaaaccaattaacaagagatcaacagatgtacgtgcatatgagccggacggcctgggatcgcgcctgcgtatgcagaccatccgtccgtgatgcctgccatgcatattctcccctttctgcccggcgcccgcgtcggtcgatatctcaacacgaagcaagatggcgccgtcccgatggagagaagccactatcaactgggagatcatctcgtcggcgacgccctaccgctcgcccctgtcggctntgctacttttatcacgctcatcgtcaagccgctagaggagattgccagtcggagcgccgctgcccggtgcccgcacgccgttgttgcgccaccatcatcaaaagtcgtcgtcgatcgtctcatcaggccgaggtcaccatgcggatctgtgatgtcgttcgtccgtgacttatctcctacatatttgtttcacaacacgcataccttttgcgctaaccttttcctgattagg

SEQ ID NO: 39061 - DNA, 190 bp, Oryza sativa
aaggctggacagatggagaacgctaacatggcctgcgcagagatgaaggccatgggattaatgcctgactgctgcaccttcaacattctttcggctggagcatacaagtttgggaaggctgcgttgtttgtacttgatcagcagcagttgcatgaaatgtttggttcacagttgtcaacagatgggatag

SEQ ID NO: 39062 - DNA, 749 bp, Oryza sativa
ttctctatacatgcaaggagaagaatgagagggaagaacgatttgagaattttttttgggattctggtgtcactatatagctataaggagatatacgcgacgtgttgtgatgtggagggggctgtgagcaaaagtgttgcttacttggcatgccactttagcggtcaaacgcagtcaaaggacgattggaccggggtggtacattaaactaagtttatgggcctaaacgtgcaattttcaagttcacggacctaagtgacaccaccacacaagtttagggaccggccatgtattttactctatatgtaaattacttttagactttactaaatttacttttatatgtttaagaagtaacttagtgaaatctaaaagtaatttagacatatcataaaagtaatttatgattttttattaaaatataatcatatgagatcttattgtaaagatttaattgttacgaatacaacggtataattggattgtaaatcggatgagtaatttaagacaaaattttatttaaaatatagatgataggaatattttccctacttacttaatggattagtactatagtaaagtaatattcttcgaattaatacatatcttaataatgctgatggggtgtgctttcgatttagattttgcgatatgaaataccagaacactctctaactcaattccagattgccttccccgaactttgttcttctctgaacccaaattctgagtctcttccaaaccctagc

SEQ ID NO: 39063 - DNA, 1404 bp, Oryza sativa
tagcgcctccctctctctctctctggacacacggctttggtaagagatgggaaggggattggaaattcatgggagtcttatttttacttctagtttcttatttggtactagtagagataagaatcatggggagtatggatgtgaattaaattctaagtgatgatatatggctctggtatatctcgtcgtacttagatgggaatttccttccaattacctgtctctatccacgtattgaaaagatgagggttcgctcttatactccccttccaaattcctcctaaaaccccccatgtcgattcaaccaaacaatagatttaaaagttgccacccttcaaactcacattttccccttaacaattccacccaaccaaacacaccaatagagtaattcagcaactcgatccaactaggtccagtgccgcagccaccaagacgcctccaatttatcaagcgagtatttaacccctttttttctctctctccccctcacctactacagccactcagccattttttccactatcccatcttactataaagttataacccactaaattataaagcttaacatgcaaaaatgcacatcatcatccactaacaattattacatcttaaacatcatgtaagtatactatattatctataattctataatttgttaaattttagtgctttgaaatgcaagcatgttaaatcatcatcccacataattcacataatattttaatatatctctccatcatttttttaatatcttatatatgcttatatagttcgccatcacttagttaatattatttctctcttctctcattaagccataccacttcaattgtttattgcccttggatgattaatctatagtttaaattatcttcctctttttttctctcataaagccacatcacattatactttcacatttaaataatcattatatatactatttaaattattgtaaaccacgtcaacatatgtaagcttatatcatccagctatcttacacattatttctatttattgttaccatactaaatttccataataacgcgcggggtttcgcctagttagaagaagaatgagtacaacccattacatggcccaatgtggctaaacagcacaagaattgggcactcttgttcttggaggcattttctcctccgaaataaatccactttaactccctcaaatatatctccaatctaatttgtatctctcaaccctgtcttgaccctccaactattgaaacagtgtaatttaacctcctcaacggttttgaaagcaattttcgctgacgtggcacgttgaccaagtctaaccagctaagtcagtatgcggtctgatatgttagtcactttttcatgtgcttgatttctattctcttttccttctctctctagc

SEQ ID NO: 39064 - DNA, 404 bp, Oryza sativa
tttatatactagattaaatattatattaagactatttaggcaggggtagagctacattaattaatttgcccaggaacctagtaaaaaaacattttagttggtttaaattaaatttaagcaaccgcatcaatctaaatttagatcaaagtagagtaatgcaaactctcgccatttcgttatagctctagatctagccctatatttaggcacgtagctatctagtcttaatctactatactctctctttaatggacgcatgcttatccggaatgtaatatctgttgatcagctcgtacaccagatatatatggtccaaatttttatgacctttttgagtcatactgcactgaaaattaaaaaagagtaaaagaaaagttgtacgaatgctgaagctagtctctgca

SEQ ID NO: 39065 - DNA, 1501 bp, Oryza sativa
tctaaaacgaaaatcaggatgtgacatccttgacccgctgcgtcacgacatccgcgcggagagctgcaacacaaggaaaaggcgaagaagaatcagacatagagcttaaaaatgttgtcatcagcaataagagggatggcgacgcgagaacgagtaccccgcgatgatatccgcggcgcgtcagaagctccctcataatcaaacgcgggatgggcacgggcttgcagcggctggatgtgtcgggcaatgaagtcttgaacgacttcatacccggttagcccctgttctcacaaatctccaatagtgttcgcgaagacttctagagaaggattgaagggaggtttggaagtccagcagtcttgtcggacaagctagtccttggggacgacaagaaccggatcgagttcttctagctctagataaaaccacctggaccgccacttggaccgggatgtatggcactggagagatatgtatctcgtcttcatgccatcacgcaggcgaaacccgcaacatcccgatactttgccggcttccatccaccggagtttaaagaaaaaacagaaaagatccgagaagggcactaccccaatgtaggcctcgcacggatgggtaaagatgcttaagaaagcgatggagttggggttgaggtgcaagagagaaaggccatagaagttcaagaccagcaaaaggaattccgatggcggcggtagaaaaccatcgcgaacgaaatcttctactactaccatatgacctagggcaagggaaggagcagtacctccttcttcttgggccatgtcttgctctggaagaagggctccatcggtggagagcttcgccagcgttgctagatcggaggtggaaatagcaaggcccgccattggaggaagatcgctggagcaagacgtaaaaatctaaggaatttgggagatgaaaggtccgagactgttggaaggttagagaacttttcggcaaatggacttgaaatggatcccaaaatccctttaaatgagtgcactacctgacggtttgagtttcgaggaaagagagagattgccgccgaaaaatcctgaggcccattaagggcagttgttcagacttcaattcaaattcatgattagacagtcggacttctgttagtgttgtcaataactccacatcttctcggtcccataccgagaatgatcaagtgagtacgacaagccgctgatgagaagtcacgaacgacaacatgaattcatttgagttgaagtcgggggctactgtcagggttacagataaggcatacctcctatcttgtgacttatagaatataccgataagatataccttcatgtatacggattgttcccatgaatgttgcgtggtaaccgattcaggttatggaaaatatctctacgagtcaagtgatttccaaagtcctactcggaagggatagaatttatgttataccgtaccaggtccgatatcctcaaaccttttcttggggatcaagatgatc

SEQ ID NO: 39066 - DNA, 1008 bp, Oryza sativa
gccacggcgtcgaacgaattaacgtgaacgtgaacgggggcgagcgagcgaatgtgaccgagaacgagaacttgaacgagaacgagcgaacgtgaacgagaacgagcgaacgaacgtgaacgtggaatgcaatatatgcaggtgaatgaacgtgaacgaacgaacgtaggtgaatgaaacgtgaccttaacgagaacgcgaacgtgaatgatcgtgaacgaaacgtgaatgtcaaatgcaatatatgttacttcgcgtttatcctaatacatctttttgtatgttgcagaaaagacgttgtcgaagtcgtccctcaagccggagtggtagctagccctcgaaggaattcgcgcaggcaagtgacgtaattatatatatgattgttatatttgtaatgcaattaagactattagatttaatatacgacacttaattagacttagttttaatataagattattatagttttaatataagattattagatttgtaactagacttagcatatatgattgtgtagggttctaatatacgacagttagactacgcatatatgactatttgagttttagtataagattatttgagttttaatataagattattagatttgtaattagacttagtatataattattgactagctagggtcctataatatacgtcacctagacttagcatatatcactatttgagttttagtataagattatttgagtttttgtataagattattattgttttaatatacgattattagatttgtaattagacttagcatatacgacagttagacttagcatatacgacaattagactaagcatatatgacttcgcatatacgacagttagacttagcatatacgacagttagaccaagcatatatgacttcgcatatacgacagttagacgtagtatatatgacttagcatatatgattgttagcatataagattgttaaaacataaatgtctcatgacttagcagctgtttcctgtatgaacaga

SEQ ID NO: 39067 - DNA, 1028 bp, Oryza sativa
cggtacacaattaccagtagtactagtataccatggcaaagagcgaccgaggaggctaggcccatcccacccatacggaccggactggacccgtcacgtccatctcctctctcgtcgtgggcccccaccgcatttgcgcctcgatgtccgcgccctcaacaatcacatcgcatgtgcccccctctcctcgacacccccatcgcttctgtacattcctactccactccggtagcattacgattagcatcaacattagttacttcagctaagtgatttagtcgtactattagcacgattttactgttaattggttaagtaaataattagtatgctgtagtagtgctaattaagtatagtagtagtagattagtagtataaaaataatgtaatagtgcgtgccgtgcccggctgcccgtgtgccgggtcgccctccctcgagcgacgaatctgccggcccttaaacaagaaacaaaaccacacgactaatggcatgtacaatgatttttattaacggtctctctttattatcatacaagcatattggttgatgtggactagagagaaaaaaaaaagagaaaaatgtttgctacgtataaaagatgattgctccgtatgagtatgagaacgatacagagtcgactcttagtatttattagaaatttttttattgcattgagtgtaataaaggaaagatgactactaagaaagtattttgttatattaatggttagataccgtattatcttaactattgtaacatgatggcctctaattaacatagaggccttactgagtctctcccttggtacttgccctaatctcatcgtgaaaagcctcaaaacctgcaattaactaacatcctaattaatcaagtaattaatcaacaatctacagcgtacaaccgatacagtctaccactaccccctacagtacaacaacaaagctcatcaaaaatacccccactcacactagtcaacacatcgtctcatgactaaaatgtttttgttactactacaatggcgccgaca

SEQ ID NO: 39068 - DNA, 1212 bp, Oryza sativa
gtccatttctcgatccaacggtagtttccaagttttcaccacatatgtggtttgcactacatattttcccctttacgtattaaagatatacttcctccgtttcacaatgtaagtcattctagcatttctcacgatgttaatgaatctatataacatcaatgtgaatgtgggaaatgctagaataacttatattgtgaaacggagggagtaattatattaaaatatttattaggacatatctagattaatattattgtcaaattgacattttaaaatggaggtagtatttttagtgcgaatgataattagaatattttagtttaggatattgtagattgctttaaatattaaagttatgatgatgccaaaatatttttcatgaaatatttaagtaacaatatttttttatgaaaattaatattattttaacaaatcaatattttagaacggtggtattatcttttgaggtgctaatcacaactagttagagtattttattctgtgatattatagagctaatctaattattctgtatgattgtgatgtgatatatgatgatatgatctacattatctattttcttcacaactttttttgttgggattgtgatgtgatatatgatgatatgatctacattatctattttcttcacaacttttttttgttgggatggcatgcaaaaatgtcaggacaatttaaaataatagagggaatacatgttttttggattgttatttacaatttaatggtttttatttttttcatatctatcgtatttaatttattagtgtatgttttgtaaagtgatatatagtcatataatatacattgtcatttttgtctatttttatttaacagattcaattgcatgctaagattaggatgtgataaagattaaatatttgttatgagttaaagaatgtagtaacttggaatggttaattaagtaccatgaatacattaataaagaatgataaaaagattgtgtaatttaaaggatacgattatttttctatattatttgtaattggaacatcttaaaagaaagaaagaaacagacgagaagactagatgaggggagggggcaagcaacgtatacgtacgtagggggagcaaccaaattaagtacgtacagtaccgggggggggggaggggggcacaggtggattgtgggtttgtaaaaataaatctaatagataaaagtagccatgt

SEQ ID NO: 39069 - DNA, 1501 bp, Oryza sativa
ttgcgattgctggtaaccacgacgcccttcgggtctccactggcactgcgccgagataggttcacggagcccttccagtgcggagccgaacggtggcgtttaagggtttggtttttgctcaaaaggttcaagcgtactctctaatttgcttctctcttcttataatgtactagggggtcccgggagcttatcttcaaccaaagttagttttaaccagtcacaaaacaaacttatctcttatcttcttagttcagattgtgggctcatcaaaaaaatcaaacaacatgaacatgtgaacacactggacgacgatttctagcatagatattagtgttgtagaaattctcggaaatacacagttgggcacaaaaaaaaaattttctaccaacatttgctcgcagatagtgagctatttttatgttgtagccccatttcaaaatataaggtatattatgtgtaagaaaaatataagttaatattgcccacctatatttaaatatattggaaatagggcactggttttagagtatgcactaaacaggggcaaccaaacaaggaaaagaagtaataaatggaaagcatatgcaacattatttggtatgcagcagtcactcactacatgaatcattcgtagtcgccattcctagacaaagctattgttagtgatattatcaagagacaattatagagatgattgtatcatatattatgtttacatatttatccgactttgttccttgaaatagataactcattattgattaatgaatatgtgattctttcatgagactctttatgttgtgtgttgctatttctaaagaatccctgatcaaatatcatatctggaacaaatatgtttagatgatcagcacatatattaattgatgatcatgtcccatggattatggtatagagataccaaattaataatgtggacacatgttagtgaacatgttgttggaaagacccaacatgagacactgcaagagccatatgtgttgtgtcatcagtgatctcatttagtattggtgttgaatccttagacctgagattatcatggttcccaacatgtgtagtagcttacttagggactgctaaatgctactctataattgggtagttataaaagtagttttcgggtatgctatgaaacttgtagtgagatatgaataatcaagatgggatttgcccctcctatggagagatatctctggcccctcgatgttgtagattatgtaagtgcatggccatgccaaaggtgattgaggagtcaatcacaagttatataatctatcaataggttcgagtgaatgattgagctattagatgatagcatatatctagccttgagattaatcgatatcgtgaggcaaaggggttcatacaagtatacactagaggttcagccgatatgatctttatgtatgcccggtgggtctatacgttctgctcggggccgctgttttcgggttacagccgagtgcacataaacctacagggt

SEQ ID NO: 39070 - DNA, 281 bp, Oryza sativa
tgttgttggggtgatgaagaagtcgttgagggtagtccaaaccgaaaaaatgttaaaattacccgattcaaaatggaaagattagtttaagaaaggtccaaagtaaaattttgccaataaaagatggcctacactgtaattctctctaaaataaaatccaatgttcctgtcaaagaaaaatacctcaatcccttgcaaattcgagttaattttatttgtataagcagatagtacatatttctttgatagcttcaagggaggaggggatgaaggagagagga

SEQ ID NO: 39071 - DNA, 800 bp, Oryza sativa
taaacagttggatggatagatgcacaacactaaataatagtagcttcctgtgttgacaagaatcctctccattccatattggttctttctgacctgtcttactatcttgcaaacgaaactgacttttggcatgcaatgtattatgcacaaagtgtatttcatgttgagtccatgtaatttgtgaatttatccatgtgacctgtaatttcaaattgctatacctgcagtttcttttatgaatcatttttctgaacacctgtactaataagacattttagtcacatgctactcaagtgattttagatggaacacttctatgcacatagaaaactatccttctaatcagtcttccatatccttcctcattggatggaacacatcaatttccagtgacctatgtggtaaatagtacaaggcaccgcttaacaacttatcatttactacctccatgctaaaatataacaatttctagttatgtatctaggaatacccttgtctagatacataatggatatacccttatccagatacataaccagaaagagttatatttcagaacggagagagtagtttacaaacagcttactgatctagttttatatgccacagtttggtttgttgctatcactttaacagtatacatatctgcaaggcacgcttttgcaacgagccttgcttatccaaccagtaggtaaaattataggcaatggtcgaataaaacatcagtacggttcgcatatgaacctatccatacaacacgtacttctatatgtaatctgcctgtcgcttttcttttcagg

SEQ ID NO: 39072 - DNA, 1501 bp, Oryza sativa
aacacgcatggatgataactagagctgtcactatatgcacgatcgatcagtacataacatttcttacaaaaaataatccttattccattttcacttggagcaaaggatcgccgctcctacgaattcaattgaaatggctcaagacaatgagattttggataaaaattagtattgaggttcaacctaatagtattactccctctgttttaaatacataagtcacattaacttttttttattagtcaaactatttcaagtttgattaaatttataaaaaaatacaacaacatttctaacataaaaaacatatttgatgttatatttaatgaaactaatttgatgttgtagatgttacaattttttctataaacttagtcaaacctaaaacctaaagaaatttgattagaaaaaaaaatcaaaaacaacttacaggggcagttcatatgatgtcattttaaaccatacatttttggtaaagtttccaaaatgtacatacatttaactttttgccaaactttcataaatgcgtaagaaataatgccaaaatctttttgccaaactttcataaatgcgtaagaaataatgccaaaattttggtaatattgtcaacttactaaattttttgtattgccaaaatttagtgaggtttattttgactataatctgaacaaccccataatataaaatggtgggattagaaaattccaactagtcttcttttccttcttaaactcttaagctaatgtgttttgcaacttctgttttatacttctacttagtatcaaaatcctatatatttgctacttagtatcaaaatcctatatatttccccccattcaatctaggggggagggggacctcaaaatccactcactctaccctaacccttgtcaatcccataacaaaatatacacagatggggaggataataaaaagtaaaaaaaaaagaagaaagcctatgccccaggaacaatcaacaaccaaggcccattcccaagctcacttttacccaggaaacatgatcatacatgcatatgtacactcctgccccaaaagcaaggtaaaaaaaaaaaaaagaaagccatttgcccccactctccctgtataaccttgtacccatcccaaagattcccctctcctccatccttgtgactctctcctctccatctccaagactcccaagtgctcttgtggtggctgtcccctacctctctctctctctctgcattagtgcactgcagaagtgaagtgaagtggagtaactccactgctctgctctgtgcctgaatctctgacaactgcacgcttcttgcattgcatttgcattgcatcaagaaaatggcgatggggtggttgccgagatctgccaccgccgttcttgtgctcttcttggtcttatggagaggtaggtaaatctgtgatgtttgatcttgttcttgttgttgttgttgtggatggttggtaatggcggcatggtttgttttgtgtgtgtgtgtgtgcg

SEQ ID NO: 39073 - DNA, 320 bp, Oryza sativa
aaaaaagatatagcattacatggcatgaactagtcagggtatcaaattcgactcaatggctgaataagtttaattggtgttagcatcattgacagtgctatatcatctagcaggtctaatgcaccaaaaatcttttagcgctatcacaggaaatcttgcccatcaggtagatcccatggataatgtgttgtatgtaggagagaagtagttgagcttccaattccaaatttcacgggatctaagaaaagagatagcacttgcagtcttgcactaagaaattgagaagggaaaacacatacagtaacaaaactcaaatcaga

SEQ ID NO: 39074 - DNA, 1501 bp, Oryza sativa
tctttactcaaaagaagctatagccaattattacatataccggcaacattaccatcaagctaaacagagcttatttaattataagttgtgtagattacatagattcagttcagggtcgacgctaattaaatacctgaattagctgagacagatccgaagagaaacattggcagcaacaagatggagaggatcagaattgcctgaagatgatgagcacctctcattgctgtaagtaagctggttttctgctgcaatttgcaatcatggagaagactgcacagagagtgcggctcaatcgcgatgttgatttagcatctcctatatatatagagatacacacacacacacacatgtctgtgcgccaatcttgatacgattttgactttgggagatgatgttctacatgagattattcagccaattgaaaggaatggaacgagtcatattattcagtcataaccagaaaagcaatagagaagtgcaagtcagcggagagagccagagaccagctgcacagaaacattgtgaacatttccattctttgtttcccctcatacaagttgtattttaagcttaaagttttattaagacatagttgacagcatcatcaaagttacaaaatatttttgaattttttcatgactatttgcttaaagtttaaaatctcgatgtttaaatcagtcatagtgctttcaacccatgtaaacagtgataaaaaaatctaaaaattatgaagaggtaatttataatgcatctatgatcttatcaaattttagtgtaaaatagaaactaaaagagaaatacagttatggagtaaggtgagtcgttttcaatagttaagagagtaaaatgagccgagaaatcacttaggggataagtgctccgaggaaatatttcaaaggagtaaaatggatttttttccattaatccccaaacaataaatgcattacaatagattgtgataatgtttaaggacggatatgtttcaattaatcctttcccctaacaaatgcattactggctatatgcatatattattactccctgcatgggaacttcaattaatattgccctccctctgatttagatatgcagttattcacagcatcagaacgcctacataaacaagaaggccacaccctccaatttccctttatctgaccgtccaaaaattcccctccaaactgaacacacaataacaaatctccatcatcaatggagccttcaggcaagctctcctcttccgccgtcgtcctcgtcctcctcctcgtcgtcgccaccggtatatttacgatcagaaagataaacaaatccggtctttttttaagtattttttagttgggcatgtagcctactggttatattgacctgagtagcaccctaaagtcttgagttcaaatctccataggagcgaatttcggattgggttgtttgatgagctaagttcctaatttaaaaaggttgcatacatcgggttggatgtataggccgggtaaaaaat

SEQ ID NO: 39075 - DNA, 1501 bp, Oryza sativa; identical to SEQ ID NO: 18085

SEQ ID NO: 39076 - DNA, 240 bp, Oryza sativa
tgtttttctcgtaagtgaaaaaagcaaaaaaaaaaacatggtaggagaaactgttttaaaaaaaaggcgcctcttcaaaaaatggtttgagaaaatcgcgcaaaaaaaaaaccattgtttataaaaaaacaagccgctcattaaaataaaaacattgtcattcacatgattatgcatgaaaaacgtatattattattagattttttttacccgttgcaacgcgcgggcatttttgctagt

SEQ ID NO: 39077 - DNA, 931 bp, Oryza sativa
ctcgggtcgacggggtcgacggcgttccggcggtcggcggactcggcgagggggtggacggggtcgacggcggtgcggctaagccggaggaggcgacgccggggcggacgacggtcccggcgagcggagaaggccggccggaggtcgtcggcgacggaggagagagagggcgacgacgcgagctcgattcaggcggggagacggtgcggcaaggggcggaaacgggcgagggaggcgcggggagggtttaaatagggttggaagggggagagagcggccggaggggaaggaaaccggcgcgggaggtccggccgccatcaatggcgccggcgagatttgcgaatccgcccgtttgaacgcgagagagagagagggaaaaatagggggaaagggagaggggattacgtggagtgattccccccattttattgcacgcggggacggcgggaggcagcgggattcgcggcggcggcggcggcgctagggcgcggggaagccggcgggagctgcgggaggaaggggatgacgggtgggccccacccgtcagcgagggtggcgggcgggcccgcccgtcagcggcgcgcgcgcggggagaggccgagtgggccgcggggagaggagagagagagagggggggaaggagagatgggccgggccggcccaagggagggaagggggacttctagggtttttctttttataaaatcattttaactttgtttatttcttaataattattatttgtgctctgaaaattccactaaaatttatttacgcattttagacttttaggaaatttacaaaaatcctctaagccttatttggcttttaactttgcacattttaattgttggaggctttcacacggattttaattattctaggcatcatttaagggatatattttagagtcgttttgggacatgacagt

SEQ ID NO: 39078 - DNA, 468 bp, Oryza sativa
gcgagctctgtagcatatatagaatgtttgctatccactggtacatctttaacccgagcctacctactgtatagatgtgtttagtacgtgcttactatgcttaattttggggataatatagtgcgacgtgtaagaaaattcagaactatgttgtatgctctagctgaatttgtttacttcctacaaaaaaaatggatgaactactgatccagttcatgttgtgatcctcctccaaggagtttgttttgtttctttgctatctgaaagattccttttttttttttttgctttgttgaagtggaaggagctcattggtgtacctttgttgaaatggctccttttaatcctcattgtttcacatgtctgtttcattttcgtttttaaggggctggccttattaaaggttgtttaaaagcttaaacaagacttctgtttgattgatctttagtccctattttacctaccagg

SEQ ID NO: 39079 - DNA, 339 bp, Oryza sativa
aaataatttataactttttcatgtgttctctaatgaagacaaactttatatcaaacttgtagccctcaacgcgatctacaactttgtagttgaatttgtttttattttaagtcattttttgtcccaaaatgtaattttaaaattaaaatttcaaaatctataaacatgcaacaatattatgggaccctaaacagttttaattcaaaaacttttcaactacaaagttgtaggtcgcgtcgagggctacaattttgatataaaatttgtcttcattagagttcacatgaaaaaattatgaattattttttgatataaagtttttagaccgtcctgtttagg

SEQ ID NO: 39080 - DNA, 332 bp, Oryza sativa
ttgctcctttcagactatttaattaccaaagaaaagttgttgagtcaatatgataaattaatagagctgttgaaattagttggttgattggaaattcaggcatttgactacggatacctggtgtgtatgtacgcaagaaccagagaacataagatccattcggagtagaaatttaacgcgacaaagaaggtggacactacgtactaattgcttaatttggaaggtttcaactttcaacaagcgtcgatatcatattaatttcacgccgtggactcatagaattacatttattttgggattaggggtagtactattgttctccataacgcagg

SEQ ID NO: 39081 - DNA, 1501 bp, Oryza sativa
gaaggctataaaagcaggagctcaagtcactctccaatgcaaaacaactcacttatattttaggcaccactttagtatgcggaattaggtagagagtgaggggaaaatacgaaaggagtgccccaaatatcggagttctctccaaaaagttctggagaagtgtagggtttatcgacattcttccattggagtttcagagaagcactaaagttatcggcatttttctctcgcttgtaccttggcggatgcttcttttaataaattaagtaatcgagctccgccggtctatagaggggagaaaaggaggtagaggcgtgatctctggaggagtgtctcagctttgtaatatcactcacatggttcacggggggtgctattctagtgaccgcctggaaaattagttttcatggtcattgacttaaaacactatgtttgcaggtggggatttaattttacaaagtggaaaacaatcacacttctaaggctctgttcgggagtgagggttgggaaccctcactcctcggcacacaaaacgaagcagtattttagtgcgtgattaattaagttttagctaattttttttcaaaaattgattaatatgatttttttaagcaactttcgtatagaaactttttacaaaaaacgcaccgtttagcagtttgaaaagcgtgtgcgcggaaaacgagaaaaaggagttgggaacttgaactacccaacggagcctaataatggcgaggaactaatgtggatctcaccttgtatatgaaaatcaatttttataggctgccactaggatgatattttgcatcttctacatatataattgcaaattaaagcacatgacaaagaagatttcaatgtacagaccaaaccacacattttaaagtgagagggatttctttttcaataatacctatcagagcagtgcagtttgtcctggatttttgtgtaactacggtgcagttttggcattaagtgatcgatgcgaaccgagaaaagccttcaagttttgtttagagcaggtacaatagggtacagttagcaggcggtagtactatacatctaagataaatcctacatggaagagtgacaaaataggagagagagagagtggctggcgcttaatctatggccgggctgcagccgtagaaaaagcatcatgaccaatcgtcgtccatgcatgctgcagctgcaaacttttctcaccatttgcacgcttcccaatgccctcaatgagagagaatagactatgagaaaatattttttttgctgagttggagtttctgtagcccgttgctgattatactattaaacctgctcttagctggttggaattgggacaacaaccaaagctatagctgaagagacctcaaggagtagtaggaggatgggcgagcctctcgagctctcccgaaacaggcgtttcaggagaaaaaaaaaatccccttttctcccggccccttcccttccatctccggcgaccctccgatcgccggcgtga

SEQ ID NO: 39082 - DNA, 768 bp, Oryza sativa
tgtcttaacatctcgcctgttaaactcaattttccatggcggtcggctaatcgccagtgaaaatgcattattttcactggctttagttcgctcgcggcaccgtcggccgccagcaaaaaactattttagtcactagcaaaaatgattttccacgatatagattgaaagatgtacgcacgtatttggttgagacaagaagggaccagatcaccagatgggacaaagaaactaagaaaactgaaaaaattaagtacaggaaacgcgacgtgcacatacgtaccgcttgtgccacgagcatctttaacgtattaagcaggaacacccatgtgtggacgcggatgacatgttgctttacgcgagaattgagatagatgcgggcatgtgggattcggtatccatgtggtaattcgacaacataccgagctttggcaaaaacaacttatatttttataatggcaaattttgctacagaacatcgtgacttcgtggtattagctgtaagataacacacgaagtaacttttgggggaagacactctataaacgtggtaatttatcagcggacatcgcactcattaaaataataatttctgattgaagagaagagaaaaatcacgtgaaatatcagaaatacccctggacccatatgtcaacccttctctatatatgaccacctcgcattcttcctcgaggtgcctgaccccttctgtcgagcttgacccgtcggccacgtcgcagcgggaggtggaggaggggcacgaggaggagt

SEQ ID NO: 39083 - DNA, 1501 bp, Oryza sativa
cagcaaagcgtatcaagtcggggtcatcaacaagagggttcttcgccttcggctgcacccaaaggctggctgcatcatcgacgccgtcgaggccgccggtgaagttcgcgtccccctgcgtggaggcagctgctgcatgactagtaacctcttgatcatcaccatcctgatcttgagctagtaacccagctaacaccgacatcgtggagtccgcttgttctacgtacacgtgcatgatcgaatgcacatgcatgtttgcagtgcaagaaattaattaatactagtaccatataagtatatatattaatactagtaccatataagtatatatatatatatatactagcaaaaatgcccgtgcgttgcaacgggtaaaaaaattctaataataatatacgtttttcatgcataatcatgtcaatgacaatgtttctattttaatgagcggcttgtttttttataaacaatgttttttttcttgcgcgattttctcaaaccattttttgaaaaggcgcatttctttctaacagttttctcctaccatgttttttttttcgcttttttcacttacgaagaaaaccatatttttctcctttttttgcttttcttttctcgtgtgttttttcttgttttctcacacgtttttttgcttgtttttttcgaaggttcttttttgctttttttctaatacaggagaatatacgacaaatataaaaaatacagggactcaaatataaaagtacaaatctaaaaattaaaatcatataaaaatgaaatgctctcagacatgtagattccgtttttgcaaaccgatcttcaatccggcacatcaatttttttcaccaatctgagtcagacttttttttggcttttctttttctttttatgcacctttctgcctttgttctctttctcttttattttttttaacaaaaacaacctcaagtagcttgttgcaaaattatagggactcaaatgcaaatataaaaattacagggactcaaatataaaattacaaatccaaaaattaaaatcatataaaaatggaatgctctcgacatgtagattccgtttttgcaaacagatcttcaatccggcacatcaatttatttcaccaatctgagtcagatttttttttggttgatataggagtcgaactttttttttttactgttaaggatataggagtcagacttattttttttgtttttttatcagacaaacatggctttttccgtcccttgttttgtcggttttttcggcttttttttggatcggactctgtccggttttttttggtttttttttgcctttttttttcctggatcggactccgtccgttttgctttttggtttttttcgcccccttttttttttctggatcggacttctttttccgttccggtttttttatcggataaacctggttttttctgcccggtttttttacacggtttttttgacggacgatggaagcacctcttattttttaagtagtaga

SEQ ID NO: 39084 - DNA, 567 bp, Oryza sativa
ctaatttttccttaagaagtcaagaacccatttttgtgctttgttcctgcttgttgcagcttcggaagatccgctcttcgtggaggttgaagccgatgtttgggaaagtgagcaaggcaagtcacatcatccttgaacatattgaatcccagtttataaaattattttgatttaaattattgcattatcgctttatttaaatttccgcgttatcactgttttatctagccatgcctatttacctttgttatgaccttattattgttattgttattatttccttgttcaccctagaaaaaaaacaaaaccccaactagtggacactctactcatggtaccactagtatgattttaggtagatgcttcgctggttaagtaggcaacattaggtggttttacaactctagactttgggaatactcttatcacctggacactatggaatggttggattattatggaattggattcacacctccccctctattcaaaaccctcaaaatggttttaggctaggctcggggtgcatggttttgatagtagcacctcggccatataaggaccggt

SEQ ID NO: 39085 - DNA, 924 bp, Oryza sativa
aattttgccaataattttataccaatctttaatttgcttaagaagtatttggaggttgctacggatcagacgtccaattttgtgcaaattatcggacggtgttggtgttgtttaagaatgtttcacatgtttcacttgttgataaaaaaatatttaaatgaaaatatttcagatgtttcactaccagagaaaatgtttcagtgcttaaacaaaattgtttcaaccaaatgaaaatagtcaaacatactcactgtaacaccaagaaattaatttatgtaacaatgaatcaaaacggaatgaaacaacttaatagaacaaattgcaacaaaaatacaaataagctgcaacatcactaaaattccaacttcactaaaatgaaatgaaacaacttaatagaacaaacaagctacaacatctaaaattccctagcagcgcctacctctatcttcttcaagtccgctcaccggaatcaaccgattggcatggtgtagacgtggtcacgtggaccatggcaagtagcgatgcaggagggcgaccttgccagggcaagtcgcgcgacctccttcgcatcgtgggctcgcggctactctgccgacaccaaaggtccaatgtcttatccggtccttcctttcgtgtcggccttcttcgctgccactagcatggtcgccggtgttctcctccctttttgcgtcgtgccgccccaccaccgccatagttaggggtggacaaaaagctcgggctcgtgagctcggctcgggcttggctcgagctcgcaaagctcggcttggctcgaaaagaaaacgagccgagcccgagctgcctccagagctcgtttgtaaattgagccgagcccgagctagctcacaagccgctcggtaggcttgtcaagctggtgaaaaaatgaccttggcccattaacaattc

SEQ ID NO: 39086 - DNA, 505 bp, Oryza sativa
ataggttcctttcctgccacgttcatagtttctacctgaaacaggaagtgacatatcacaattcatacactctccagaggtgtgtcgctctgtacccacagacgccttaaacattttaatactcacgcccgttagcgcttgaagcatacttcatggtgtatgccagcaaggctaaggtcataagcttttcatcaatcccatctatcaattatctctacgggtgattccctcaacaacggcgatccacatcatctaatcggatcccgcaacaacggcaatcctcatcgctagcctacgctcacggggttcacggaagtccttaagcccgcaggataaagccattaagaaagatctactacgctagcctgtcccattccaggtcatgtggtctataatacaccgagtttcaaattagtgtatttcagaaaatattagaacagatgcgcaaaagtgcaatttttaaattgttgttcgaatagacgaccaggaaccatggatgcgtagg

SEQ ID NO: 39087 - DNA, 1501 bp, Oryza sativa
tctttaaattttctgtcaatgtttcgccactgcgaaccatcggcggggtgtctcaacatcccgtcctgttgacgctcttcagcgtgccatcgcatcattctagcatttctcttgttcctgaataaacgccttagccgtggtattatagggaaataccacatcaccttagcaggaattctcttctttgttagctgcccgtcaacttctcctggatcgtctcgtctaatcttgtatcgtagtgctttgcaaatagggcatgcttctaggttctcctactcctcaccgcgatataggatacaatcattcggacatgcgtgaatcttctgaacttccagtcctagagggcagactatcttcttagcctcgtacattgtctccggcaatttgtttcccttcggaagaatgttcttgatgagtttcaataaatcgccaaatgccttgtcactaaccccattttttgccttccattgcaagaactccagagtgatatccaactttttgtgcccctgctcgcaacctgggtacaacgacgttctgtggtcctctaacatcttatccaatttatgggcccccttttcactttcgcactcctctttggcgtcctgcaacatctgaccaagatcatccgcaacgtcgttaccatcagcatccctttcctcctcgcccgtttgatttccttcaaatccaacatactgagcaaagtccggaatattgtcgtcttccacttcatcttcttctatttcaacaccttgctctccgtgggatgtccaacaattatagcttggcatgaactccgactcaaacaagtagaaatgaatagtcctggatgcagaatactccttctgattcttacacttattgcatggacaacaaataaaacccttttgcctgttagcttcggccactctcaaaaaataatgcacgccgtcaataaactctttggaccgccggtcagcgtacatccattgccgatccatctacatgagtcgaaaaaaaatcgtacacaaataattattcttacaataatgacagtcatacaataattataagataattacaaactctttcaacagtcatacaataatgacatatctttattcatacaaaaatcataaaatattacaccaagtaattcttatttactatttctaaagttttaaactaattttaatgtgttttacttcttttaattttcattttagtttgttttttattatttaagattaactttcactatattttccttctcaactattttataaaaccttctttagcaaatcaactaaatttctatatattctttcttccccacacaaattttctctctcatcaacttacaactaaattttggagaaaaaaaactgtgcaaaacatagctccaaatgtaatatgacaaaaaaaacattggaggatgaagttgcaaaccttttaggcacctccgatttgtatgtaatcacaaaaataaattcactagaaattttggcatgacctcccctctttt

SEQ ID NO: 39088 - DNA, 595 bp, Oryza sativa
aattgtagaacatgtaaattgctcaataaacctaattcagggatttaatcctgctaatgtgccactaatttcagaaattcggttattctacatgcaagcatatttataaggacaaaatcatgttagtgtgcttttaatttcagtactgcatttactctaggatatattatgtaagtattcattcatggcaaaatttgctacagggcattcaaaaaatatgtaattagctggtggacaccgtaagaatacgaatttgctgttggacatcacaaaaaactgataattagctgatgaacactcctaagattattttactatttatggagaaattagagagagaaacactcattaaagacaaatttacccttgtcaaacttcttctgtggggcctacctgtaagacttgtcttcttcgctggatcttcctctagttcgacgaggctggcagtaggacgacagcgaccagcagttgggtggcggcggcggagctcgagggacctgggcggcatcaaggatcctcatgcgacgccttcgcggctagctcctccgacccagccgagtgcaagagagcccagccaagatccagagcgacgaca

SEQ ID NO: 39089 - DNA, 1501 bp, Oryza sativa
ccatccgctgcctttttttttttttccggtgccaaaggcgcagaagtactacttatatagtgtgtgtgtgagatatataggagaaatatatagccctcaacgattccaaaccgtataaaaaaagaccccaaggcattatggacaaatttaaccctggtttcattgacatgcactactggagaagtgatctttgatgggtgatgtaaaaaccacattagtcccggtttggatagggaccgggactaaaaagacacgacgtatttaatgcctcgcacttatcctctagcaaactcctccttagcacaaactcctcatcccttatcctccttgtcattttaacttcttcctcccttttcttatcctgtctctcttatcttctccttttgttgcagcgagcaagccggccgagggctgtgcggcggcctatgccgcggcgggcagcgcggatgtctgtggatttgttgacttatacatgatgtatgtggatctgtaaatttgtgatgtaaatctgtgaatttgtggatgattttctaatgtttttgttaatgtggatgattttgtttttgagtacgttcaatttgaaatcaatatgcaaacagtaaaaaaaacaatgataaaaaaaaacctctaataccggttggtatccttagtcccgattattttacccagaactaaatatacccatcttcaaccctggatttggggttccggtttgaaactcgggactaaaggggttgtaaaccggggctacaaagggtttccccagtagtgatggcatacaacgggccccacatgtcagtgtgccgttgaggcgttattacatggagtcatcatcatctctctcgctgggctggcgacgccgcggcggaggtggattcgccgctgctgttcctcaacggcgcacaacatcatgacaccgtggttcccgttcaagcagtccagcatcaggcccgccttcgacgtggccaccggcgagcacaaggtcgatcgtcaggcccttcaagaaaccgagcggcgaggcgagctacgagctgaggtgtacatgcgaggggggagcagatggttggcacgcgccggccaagtgatgctgcgcgtcgccagcttcctcgtcggcttgccggctagcttgccgccggtgtcccggcctcgacagatttctttaggtcttgttcggttacacccgaatgcaatccggactgggaatgacaaatatagtaagaaacttatgataatacaatgagaggccgggatttattcagggctggtaaccaatttacttatgatagggacaataagagaccggaatcgatccatgtaacatcctgaaaattcctgacaataaaaattgctaaaattttgaactttttaaaacttttgcatcatgctggatgttatggttgttattacttgccaaactgtaaatcgtctcaatagaaaaatcaaattaaaagatgcacatctaagtaataactaaagtttacgacaatatattgttaaccct

SEQ ID NO: 39090 - DNA, 1501 bp, Oryza sativa
ctatccataaggtgtagattggtttaaccaaactactccatggttaaacccgactagctctttgcgtcatttaaatgtgacgtcatgtctgaatttaaaatctctccggtcctctcacttttatcgtagttttatttatacctttcgcgcttgtctagctagatatgattttgtctgccttttcccatagcaacgcactggcactttgctagttagggggtgttctagatcccacccccaaaattttgcacccttttagatcgaacgtttaaacacctacataaagtattaaatataggctaaaaaaataactaattacacaaattacgactaatttgcgagatggatattttaagcctaattgctccatgatttgacaatgctgtgctacagtaaatatttgttaatgacggattaattaggcttaataaattcatatcgcaatttacaggtggattttataatttgttttgttattaggctacgttaaatacttcaaacgtatatccgatgtgacacggcaaaaatttttaccgctagctagctggatctaaacacagcgttaaccatataaaattccacaaaactcctaccccccccccccccccccgcgttctactaatcgcagtcgcatccaaaggtttgaaacccctcgcgccaaatgcgaaaaaggcaccccgcatatccccacgtgcgctttctcctcctctccgcttgagccctagctcctccctgagctccctcccccgcgcgaattgaaaaccctagctccgatctctctcatccacttcgacgcggaggccaacgatcgtaagcagcttggtgagcaggggctagctagctacgacgagcagcctctggatgtacgagagcgcgcgcgtggtctcagatcgtcgactgagggcctcgatcgtgatggctagggcgccgcgcggtagcgaaggcgagggcggcggcgaactgggagcgcctggtgcgtgcggtgctgcggggagagcggttggcaggaggcgcgccgccgggaatgcgccgccgtctctcaacagcaacgtccacatcgacgaggcgcttcccgccgccgacgagaaccagctggacgaggaccctaccgtcgccaggattcgtaagtttcgtcaccatttttcgctccgttaggctattgacctgctgtatggccgggtcgccgcggctcaggattgccctacccatgaagttattagtggtgtttttcctagtattttatgcagttagtatcggctacacgaattgactatgctagttcattaggagtacttttgcttttttttttcttacagccttctgtactactaaatttagtcaacagttacatgatcaggctaataatatctttcgtaacacactcataaataatatttatgataatttatttttagatatgagataaaaataaaatttatttattacttattaaaaattatttatttaccatataaatagatttatcttaaaaatattattt

SEQ ID NO: 39091 - DNA, 1501 bp, Oryza sativa
aaacgccggcataaaagatagtataaggtgatcttagtactagtctaggctatagttaaacaaatagttttactcattcatcattcatcatgtcacatatccaattatccaaattaatctgatgagtcgtatcggacggcatcgacgcctccctcccgatcgcgcccctcccacgccccctccccatgcacctcctcctcccacaacccttccagaaaccgcacctccctcccacgcctccctccgccgtctccgccgctgacgccggaaaccgccccaatctcctcccccttttcattcgcacaccctcctcacgcccacatccatcccgtcacccgcccactcgccgtcgcacgagcctccccgtcgtcgatcccctcccttctcaccctcatcctcaggtattgttgccgattgtcctgtctccgctcgtcgccggcccctcatagcgcaaatcgtcatcctgcatcgtcgattccccatgcctcgatctcccgttgggcttcctgccgctcgccattgaccatcgcccatggctcctccaagagtcaccgccgaatccggttctttcatcttatgatggtttgcctgttctctgcagttcagcttggtagatcagtttagcgttgagaagcaagctgttaaaacatccacttaatgcagaagaggtcataagctccactcctgaaaattccacattttttagatatcctcacattattcaccctatatatgttttcagttgttcctgtatatttggtacactattctcgtttaagttgtatgtcagttcaaatagaatctggagcgatgctaacttatggtgccagcttcgaaatttgattgctcatggagacaggggacagattattattttgtctaaacatttctgaaaatataattctgaaactatggtgaaatgaaacactctcatttctgaaaaattcagctgctgtatgggttgctactagcctacggaatacatggttcagttttaacctggcaatgttttcttcgggttctggtcattatggtgtcataagaaatagtcaggccactccattcaaaaaatgggaaagacaataaagctttttcagtcaacaagagacgataaaggactatttttgcatgtgctcttttgcttggagtattgtgtgattatatagctgattgagctatgtttagaaaactgaacttcccagaactaaaattgaatagtctatggcatgacctaatcattaatcagttctctatttgtgagactgatagttgcaattttatagaggatggtctatcataacaaactaaattacttctatgatttttttcttaaatcaaagttgatacatttgtgactgttcattgtttcaggctgaagggggactcgttgtttaaaaaatgaaatgaaaactgctatccatgttgactccatcgattcatttatcagatcagggggtttgaatgaataaggatatctatgctgttcatgaagtgcataatg

SEQ ID NO: 39092 - DNA, 449 bp, Oryza sativa
tggcggtctactttaccgaggcccgtttggccggccaccccaagtcggtctgaccggcctaggcagtggggcccaatgacagccctgcaacggctagaaaactagctgttgtagagtagtatggtctgaccggccacatacctccggtcagaccggcagagcactgagttgggggatttcgcccccaacggctagttttggttggtgggagtataaatactccccctctagcaacaaggggattctcttggcacccaattcaattgcatacaccccttgcacctctctcacacacctttgagcttagtgttcatccattgtagtggttgaggttgttctagccaagagtcaagtgcatttgcttccattgtagagctagtgtggcacttgattgattatctccacgccgggtcattgcttgttactcttggaggttgccgcctcctaga

SEQ ID NO: 39093 - DNA, 1501 bp, Oryza sativa
gaggggactagccggtgttgacaagaaggccgaatgacaaggcaaaaagactagtagcactgtgagctccttcttatactataacagaaaagggacatgctacatagaaagggttgcttgtttctaacttggaaaagacaaagtttgtatttcaccagatccataccaacaaagaaacaggagtatggtattacacctccggtggcctgaacctttataaatctcttgtgttcatctgcttggcagggagcttgggccccgcagattgtcttcttgattgtcgtgtgcaactaacccctggtcagatcttcatttttagggaggggtcttctgcacttccctgttgtcggagaatcgcctctccaacaatgtgcaatgggaatttttttgtcacaggcatatataagttgcgtactgttaattccaatgtcccctttccttccttcattgtaaatacagctgaagcatgttgttttcagtaaattattaaagctaacaaatttagtagtcttaattgacacgcctagcttggctagctcttgtatgttatatatagccgcgctgcctaccagaggacctccgttgcttttccatttcaccatacatacacataagtttgtacagaagttccgttgttattgtttctttgaatgggagagggatctggaacggcgagagtggatcaaacaaacatttgagcctgaaacatagtgatgtcgcacctgtttaatttccatgaactcctaaactaatggcacaaagtaagggggacaaacatgtggaacatgcgtacatcagcacaatatgcttttccattattagtcccttagattccgttccatctgaaaaataagggaaaacctcgtgtttcgtcggaattgagtgattttgtttgctccattgagcaatattattttgtcccatgagcccaaacaatatccaaaattgaatcggagtatttctactctcgtttggtctgccaccagtagatcgagcgaccaccatttatggtgaattaacaagactaataatatgcccgtgctaaacgctacggtacaattctatttgtctttaataatttttaaaatttcatgttagcaaaaaaaattttatatgatttgtacatttgagctttaataacctccggcaaggccaggtctgttttgtgctttgtccgtgaacattatagctattcacttgacattttccccgtatcgttttactgctgattaatcacgttataataaaccatcttttcttgattcacatagagccataactgagcattgcaatgctataatcatttatgtaggtgaaaatgctaagtacattaaagcgatatgatggataagtcatgacattgcgtgtagagtcaaatatagatctgaaagacacaatcgtatgcaactgtaaaaaaaattggttcaaacgcaattatgaatatctcaagatatatggccctgcaatgttatgcggttcgtgtcaatgcccagagaatata

SEQ ID NO: 39094 - DNA, 308 bp, Oryza sativa
tgctcccatacatcttttgcatttgtactaatatattacgtttgagtacatatgttgcgttttagttttagttccatatattttagcagatctgtagcacacagcacatatgtgtagatccagagcatagaatataatagtatgaattgagacatagacagtagtgttaattgtaagatgtagtttagtttgatctggagaatgtaacctacttttagaaatttagagaacaatattgtagagaatgtaacttagggcgtagtacagaaatgcgaggttaacgcggttattgttttcatcaggcacaa

SEQ ID NO: 39095 - DNA, 583 bp, Oryza sativa
gctgtaaaaggggggccaaggctgtttaatgtttatgcaacatctagttctactggttgcttgagcttccctcctgatgccaggtgagatttgtgaacacatttcttgttgccattttttctcagtgggatgtggcattccttgaatttaaagctccaatggtagtttacatccatggtgagacttcagattctctggtccacaatagatacataataattatagtctgtcacataattcagaattttgttaaatggtttccagtgtcctacttaagtgaaattgttcagtgaaagatccatgtaaaaattttatggcatctataaccctttcgacatggatctttaatatccaaaggctacattttcttccgtaaatagtcacaataatgttgccaccgcaggattgaagcacattgtgaagttgaaaggtgctcactgcaatcatgttgtacaggtatgtcccgttaaacagtagaatgaagggagacaatagagttcgatgggtgccaaatagaatgatgttgtgtgtcccaaaactctttatttcataacagggtctgtcaagttctatttgtcccagt

SEQ ID NO: 39096 - DNA, 1501 bp, Oryza sativa
aattccaaaggcggcacaagtcatctcaggagacacgtcaacaaatgtgcgttgcgacgactgcaggcactcctcatggacatctgaacgcgtacgcaacgtctaccatggactgccgttgctgctaaattgatcgatcgatctcatgtttgttttcatgcatgcatgtatagctcagatcgatctgtagtactacttgtaattagcatatgcgtgctaaatttgtgttgtgtgtgcgtgtgctcgtttgtacgtgatacatcggtactgtactccttttttattcccctaattgattgtgctatgaaatactccctccatattttaatgtatggcgctgttgacttttcgaccaacgtttgaccatttattttattcaaaaattttatgcaaatatgaaaatatttatatcatacttaaagaacattggatgacgaatcaaatcacaataaaataaatgataattacatgaattttttgaataagacgaatggtcaaacgttggataaaaagttaacagcgtcatacattgaaatatggaggtagtaattatttattcacgcttgattaaataaagaaagaacatgtgtaatgtactccttttttattcccatattcgattgtgctatgaaataattatttattcatgtaatttccccctttttcttaaagcctgattgatcgagcatcatgttaagcgggatgaggcgtacgcgaaggttgctgatcgatgcaatatggctacacacacgcactttttttttttgactaaagggcttttagttgaaagccaaatggcaaggtccgctggggatcccagctacattgtcagcttacaaacaagcagcaggttaagcatgaaaaactttaaacatagaaagaggcagacacaaaagctaccagcaccaacatctaccacaaactgcccttagggcttgtttgggagagtttaatattctgagaagcagatagttggtagacagcttctgagaatctagaaaaaccgggtttctcagcttctggcttctagttcattttctggattttaaactacaacttcttagaacctagatcaaaagctggactgtttgggggagtttatgattctgggagaagctgtagcagttataacctcccccgaacaggcccttaacatcacagctaccaaaacacaggaaaacaacactatcaaagctagcccacgccagcccttggaggtgtcaaacttgtcaccagcatcctcaacttctctaccaacgcttccagcttgtgttcttcctcaggtcgaaacagtttcctccactgtaaaagattggaaatgatttgaaaaggaatagttagtggagaataaaccagattcgctctaagcaccatattattgtgagtgagccaaagattccaatagattgcagctaaaagactcaaagtgactctaaaagaagtatggtcagaaatccctttgcacaacaagaagaaatctttgaagtttccgggcaaggta

SEQ ID NO: 39097 - DNA, 1501 bp, Oryza sativa
tttatagtagtagtactaatagttatagtagtagtgtagtactagtagtgtactgtagtagtactagtactactagggggcaccgcacggcaggctgggcgtgcgtccagtcgcttgtggcatcatcaatgtttactacctactttatgaataagggtgggccctgcatcagtgggtattagttgttgttgtagccacaatggtgaaagaataaaagtgggtagtaagctggaccccacaatcactagccatgagagaaatcatttgtttattccttatgactaggtagtaagtatatgacctggtattagttacttactactcccacaatgtatacaacctggtagtagtagtattttattctttattatccactttagatgtacattgtagatgctctgagtggatgtaaatccggctcctctaactgctagtaaagagtatacaaaacagagttaaactaggaccactaggagggatatttcttgcaattgtctgtagcaggttcagtcacgttggcgacaaaaaaactaaaaaagtcacaaaagaataaaagcaaaacaagtaattcctccgttttacgatgtaagtcattttaacattttcattaatatgaatgtggaaaatggtagaacgatttatattgtgaaacggaggggtagatatttagatgtgaagcatttacacatcatccatattttgctcctcaattttgtactacttatcgtacttccttgtacgtgcgattccattcattacttcttgtttgggtaaagactatcttatcagcttaagtgattgcgatgtgttacccacaccatttaactcgaatggataaaagtcatgtgacaccaacatcattaaatcttaactaattaaaagattcatatttttccgttcgtcacatgattttcgtccgtatgcacgatttttcacccgtccgtgcgatccgtccctcccagagtccgagtctgtattaaaaaaaaatccccgagctagatccccaaatcaatcaatcaaccagacaaccaaaaacaacacgaaaataccaaatttaaccttaacctcatgaatttgatcaccacaagaaacctaatacccatgtatttcctccctcccaatccgatccgatccggcaatacagaaagtcaaacaaaggcaatcatgtatgaatttgctggcaaacaagaggcagcaggaggcacgtcgggttgcaggcgacgtgcggcggcggaagtgtttggcgcggtcgttgggcttgttgtaggatcgagatgtcgactagaggggggtgaataggcgatttaaaattaaatgacacctaatcaaaactaacctaagttactaggctcggtgagggacaagactaactaagcaactaagttatgttttgcaatcctggggtgaaagtggctcaagtatatcactaggaaagtaaatcacacttcctaagtctagtttagcaatcctagggtgaaatgatctctagtatgtctctaga

SEQ ID NO: 39098 - DNA, 1260 bp, Oryza sativa
tttcacggtgaatatggtgacttctgtaaaggttgttttaataatataatagatgaacaccaggcctgagaattcaatattaccaactaataaaaccagataaccacctcctccatacctaaggtacttgattatcccaaaagggaaaaggtttaactgcatcacacttatctttctaaatgtccagatacaagttcgtaacttgttacaagcttataggattttttttgtagttaagctttttaggccatccatttggttgttattcctattatcccaatggaggtaatactctcacaggaggaaattaattaatttttaccttgctgtttactctgtacaagcatttttttagataatggatactctgtataagcatggttggctaataagtgaaataatcttacctgccatattttaaaattaggattaaaatatacaatgttaccatcatgtcaatctacatcactaggtgaactttaaattctgaggtaaaagtccaaccaataaagttcgaaattgtttatttttcaaatgatggagtttatattaaaacatttttcaaccagactataaatctattagatgtattctattttcagattagatatgatctagagaagttcagggaatgcgaccgcaggcctaagattttagacataatcaagaatcaggtctaagttccctacagaaatatcaggtttgagagctggcctatctcttttggtatttcaccagtaaagctgcagccaacaagaattctgcagagaaatgagaggggacaagtcaaacaagaatccatgaactgactgaaaaatctcaagttagcagactaactgaacttctccaaagttaaactactcacaagttttggagcttgctcaaggttccaatggttgaaggaaggggtccacgcaagttcttgttgtaggataagtccctgcaacaaaaacagaagcgtttcagaagtttgcataaatttccaaatttccaactatgcacatgtttacgcctaattcgcaatccaaagtgctcaaactacagagagaagagaatacatacaggtactgcaattctgataaggactgaatgtccccggaaagcgtcccggacaatccaaaacttgacagtcttctgtaaaaacaccatgaaacaagaagacaacatgagtgatctttgttactcatattactgcataattgcaagaaaaaaaaatcactccatggacatatacaaatctctgatgctgatatactaaca

SEQ ID NO: 39099 - DNA, 660 bp, Oryza sativa
agcgacctctccattctctccaaatctctctcgctttccatctccattttcctcgcaatcattccgttcagttatatctgctcgttgctcgttgattcgctcgctttctgtccctgcgatctgtcgccgccgtcgttttgccggcgagaacggcggctagggaggcggcggcggtgagtctttgggtttcttgcccgctgtgtgtgtgttgttcttgtgttcatcaagtactcaaagtttcgggggttatttttttctttttactgatgagatggtgttgatatgatagcactgtttgatcacgatttgattgaatcaattagtaattgattattagttatcactatgttttatgtatcctggaatcttggaatggatcgcttcgttttattgattactgagcgagatttattatgttttgaggactggatttatcatgccattcactcattaattatctgattaacttgcatgtcctgctgatgaattatgtggctcctattgtcatcaagtaggcaacccaaacctactgtagtgttgcatatgcagcaatacaatataaatagaagattaaagttctgtatttatcatgctatgtatgttctgcgatctccacattttacattgttgtgtgcttgtgtcggatgtaagtatgctagt

SEQ ID NO: 39100 - DNA, 261 bp, Oryza sativa
cgacgacggtggccgatggagctgtcatattggtaggcggccgagcggcagctaggaagatgtcgccaaggaagaagtgtgctgggaagagaaaaagcccaagagaaaaagagtgaagaaagttgtgctttctgtgcaagatcctgtcatacaagtcccaacagctactgtgtatgttgtcaacagcaaaatttcttttttatgccatacatttgctatatttactctacatatttatgttgattttcatttttttgcagg

SEQ ID NO: 39101 - DNA, 1397 bp, Oryza sativa
cagcattaatatatggtcatacctatcatacacacattgcattttggagtccatgttgcagctggctacttatctgtatcctgttactctttttgttatcttttatcttctcgatatgtgtttatagttggattatagtttgctattgtaccaactctaatagatatatgcagagtgaggcgtatagtaagtatatcggtcgttgtcgtgcacggacgcatatggttggctggtcgccgttgctatggctaactagtactccctccaccctaaaatataagagattttggatgaatgtgatagattctagtattataaacctggctttctattcaaattcacagtactaggatatgtcttattcatagaaattctcttatattttagaacacaaggagtagatacttctccggtttaacactataagccattttagattttgaacggatatatatatatatatatatatatatatatatatatatatatatatatatatatatggtgagattaaactacagaggaagtactatcttcgtctaaaaataaatgcagttatgaatatttgtgtacaatgtttgaccacccatcttatttaaaaaattgttgaaaaaaataaaaaattagtattattcatgttttatcatctaataacaataaaaatcctaatcataaaaaaaaattaaataagatgaacagttcaacgttagatatgaacaatttaaaactatatttattttagggaacaattcaaaactatacttagtttgggactgaggcgcagcagtagttactgtcttactggtacgatgcatggatggtgtgcttaatttgacatgtcactaaaaccaagggtccatgcaggtctggaggagtcaagcagaagcggcaacagacttgtctgtccaaggagctctaaattaacactgtactgcgcactctacacgtctacttcctctgtcccataaaaatcaacccaataccgtataaaacactgtactgcgtatactacatgtctactccaaacataaatatttgtacaattgaaaatttatagatacaagttataaacatttttagttacttcattctcgccaactactcatgttttaatttcgttatgatttctgccaaccagggatttaacatgggcactgaaataattttggcaaaatttgctacaggacaccctaaaatcgtgtaattggctgtgggacaccgtaaaatcttggctttgcccacggacactacgaaagttgtgaaattggctgtgagacgccggaggcaatattttataatttccgaggcaaaagaggtcagaaaattttctaaatgaccaatctacccttgcgcgccgctacctctaagcctgactccatcccccctccctccacagc

SEQ ID NO: 39102 - DNA, 266 bp, Oryza sativa
caaaacataataaatctcgctcagtaatcaataaaacgaagcgatccattccaagattccaggatacataaaacatagtgataactaataatcaattactaattgattcaatcaaatcgtgatcaaacagtgctatcatatcaacaccatctcatcagtaaaaagaaaaaaataacccccgaaactttgagtacttgatgaacacaagaacaacacacacacagcgggcaagaaacccaaagactcaccgccgccgcctccctagc

SEQ ID NO: 39103 - DNA, 482 bp, Oryza sativa
gctgccctctccccgccgcctggcgtgctcgcctcctgctcgcgccgggaggagctgcgcctggccgccgcccgctctccgctgccgccagcgccgccaggtaggtctcgggtttgaccgtgtgcagcgagggtaaaaaggtaaatcactaactaaaaaaatctttatttcctttatttctctttattttactgtcacaaactcggtcccactgacttccatccaaaccaggggtaaacgtctctttcgattaaaaaagtgggggcaaaaacgaaaaccctacaaaatcaatattagagctcaaagtgggggaaaaacgaaattgtccctttactaaaagaaactcaattcgggcccatgagcccaacatcagccaggcccagccaatcttgttgtcccaccgtctctttttctctctccgacggcgtcgagaccatggccgcgccgagcctgtcgcgccgccgccgccgccgaagacgcga

SEQ ID NO: 39104 - DNA, 704 bp, Oryza sativa
cgtcagcgaaaccgctcaccaaaaccgtcgagggagtcaaattgcaccggttttaacagtttaggggtcaagatatactgattttgcggttcagggtcatggattaaatttgggtcagttttaagggagtcaaagtggacttattcctcatcataattgtgtttaattattgttgttaagctcagacctgagactgatttctaccatctgtatattatccaggcttcttgacaacaacaaattatccggaagcatcccttctactttaggccttcttaatacattggaagttctgtgagtacaagcgcatattatggatgagacaataaaattcatagattgacactgctgccttatgtcatgaagttcgatcgatgcaggcgtttcgataacaatgcgcaattgacaggaccagttcctaccaacctcaacaacttaaccaggcttacagaactgtgagtttactatgtgtgtctgctttattaattgtcaattattcaatattaatagcttacgcgctatgctttcatttgacactagccatcttgcaaactgcaatcttactggtccactgccagacctaactggaatgaacgaactcatgtatttgtaagtgatcagtcaacccttccaatgttaaaactaaaattgactttccatttatcatactatgcaactttctggatggtttcatcttactaact

SEQ ID NO: 39105 - DNA, 323 bp, Oryza sativa
ccttactccatttagagatttcggttgttttatttatgattattcatcgcgtgcaagttgataactatggtactttggatcactttgggcttcaccttgatcttgttttgtcacaacatgaactagtgcaaggtgttagtccccccttttttagctttcttgaacatcttgaagcttatttctggtcatgcgggtcaggctaaagtttcatcttgaagtttgtctgaaatcttcaagtatatttgtataataatatactgtgtaacattagttcactgttcccgtattaattgcactgttcaagtatattttaagtgtaacat

SEQ ID NO: 39106 - DNA, 216 bp, Oryza sativa
atattgttgcatgtttatagattttgaaattttaattttaaaattacattttgggacaaaaaatgacttaaaataaaaacaaattcaactacaaagttgtagatcgcgttgagggctacaagtttgatataaagtttgtcttcattagagctcacatgaaaaagttataaattatttttaaatataaaatatttaaaccgtcctatttgaccaaga

SEQ ID NO: 39107 - DNA, 1501 bp, Oryza sativa
ggatcggtcttcgggcctctgttgcaaggcatcttcgtgcaaccacaagtcttgtgggtaaggcctgactggaaatttagatcttctcaaaacagagaccattggttggaagggtgtgaggccaggattaaggccgtttttaacccggcgcaagggggggcctgtctcgtcctgggggatccggcaacctttaccttgtcggggaccggcgggcagggaaaccacagcgggttctcctgttttgggtagacctagatggatagtcttgtcacgacctctatccgagtaccgtggtggtacctggcgcgtggcaacgcgtgttgaggttgggtattgtgggtaaagttgtacacctctgatcagagttagaactattcaaatagccgcgtcctcggttatgggcaagctaagcaatgtacccaaagttagttttgttttataaaaccttgggagggtgaaatcatgatggtgtagtcatgtgaagattagcctgggttaaggcaggttcgtaggctcatgcgaccttgatgatattaaaatattggcttagaacaggatcgtgttttaaaatgagctttaacttgattaaaatgtttaaattatggctttatgcaaaataaaccctattaggccattttcttgttttccctacgcattattgttgcatttccggtgtgacttgctgagtacggtggtggtactcactcttgctcacaaaaataatccagaggatggacctgaggaaggtgaaggctttgatctctagttcgctccgccgtcgagtgcctgtggctgctgctgttccgtagtcttccgctgttttatttgtttatctttgagtgtgagggcctaagtcgcccatgtaataaagtactcctttacgtttccgcaagtgtggcatgtaataaacaacaatgtctatgtgtacctcgcctcctgggacgaggattaatgcactgagcgtttggaaatggtgtatatttccaggcgtgacataagagcaatgaccggcttcggccaacaggatgtagggttattacctgacaattcaggggcccgaacctgtataaaaatcctcgtctccgtctcttttacctcaatctcacatatatcctggtaccaacgatcctcatactatgcaaataccggaattgcgacatcaaacatcgaaccaaatggaactcaacatatggtgctacaagatatgccacaggctgccgtcgcctctccgccgcgagctcgaggccagatccggccgccgcgttgacggggaagaccggatccgctgccgcgacgacgggggtggctggatccaccgccgcgatgacaggggaggccggatctgccgccaatgccgacgagcactacaagaaatatgaccttctgtgacgaattccttgtaacgtcggagctattcgtcattatcacattccattttatgacaattaatatgagatgggtggcttagtgacaaaaaaaaagtgttcgtcgttaataccaa

SEQ ID NO: 39108 - DNA, 457 bp, Oryza sativa
gcatatatgacaactcgacgatttacataaataggattagagtatcatgaagatgtcagcactaatcacgagaacgcaagccgccataacaagttttacctcttgccggagatcgaacccgatgcagcccgacttgaaagcaagaattcgtcgaaacaaaaatagaaaaggtggcgatgcgccaaaagtgttattaaactgattgttcttcatttacaaggtcttgggtcatatttatacccaaaatacataatatgtccttgccggatacgactccaaatctgttacaactctaagatacgaacaagtcttttaggcaaacacttgccgacaaatatctctaaagaaactattcaaaatactctagttaatagatacaattgcccctttttcggatttatcccaatcgtggaaatacttgctcagcacatcaatcgatcccgaagatgattctaga

SEQ ID NO: 39109 - DNA, 1351 bp, Oryza sativa
agtggatccccttttttacctcctttgcacgaattttaaagcaaatcgaacggttcaaaattagattgtagttacatgcaagttacaacgtaattacaccacgattgtactatatttacatctattaaatttttagaaaaaaaattgtcgactaatttatagcaaaatcaataggcgtaaaagagatcgactaaaatctcttgacaataaacttcctcaataagaatttgcaatggttccccctccatgaatgaaccatataattaatctttatttggtttcgacaaaccacacatacaaatattgtccataggcgatccaagatattcacttcagatattcggactcgtaacataaagccataatggttcccaacaacaagaatggaagtacactcctatagaagagctatattgatgtttggagactgttagctgactaatcagtgctactacagatatttcacacattataactgggctatatgctgatgggttatcaaggacaatatactggaatggtattttaatttagtgcgtaaatattaaacgaatataaactttttctatcttgtattatactccctcctgttttaaaaaatatatgatgttttgaccatttgtcttactaaaaattttggtacaaattatcatgtctaaagtatctttaataataaaacaagtcataataaaatgaatgatactacatgattttttttaatgagatgaatagttagatgtgttattttcaaaagtcatatatttaggaaatacaagttagtaacattcaacattttgattaatttgtgttgcatagaaaatccacccaccattctaggacatttaacttttctatatctgtgaaaatgatccctcatctttcatcctactcaaagcacagacaccttgacacatacttccaacacgcccatgctggcaagcaatccctctctgtttgctagtagctcagtaccacactgtaagattgaagtagagatgcgcagatggccatcacgcagagtcagcaattactcagcaagaaaaggttcttcctaattaaggttgacttctgaagggccgacaactttctcattttacgttagcatacttctcgatcagctaaaccaaggtttctcaattttttttccaaaaaacgtcatatcaaatctttggacgtacacatacatggatatatagattaaaaaaaaaccaattgcacagtttatatggaaatcgcgagatgaatattttgagcctaattaatccatgattaaccataaagtgctacagtaaaccacatctgctaatgactgattaattagccttaatgaatttgtcttgcggtttccagg

SEQ ID NO: 39110 - DNA, 275 bp, Oryza sativa
tttttatatagaagttgctataaaatatcaaataaattcatttttcaaatttgcaataattaaaactcaattaatcatatgctactagttttttgtttttatgcccttacttaatattcattttcattagtatcaaacaccagtcaagtccctcgcaaaccgtagccctgctcaatcaactcccccgcatatctgcttacatcacccacgtcgagtggcctaggagatccgtgcggtgcacctcgctggtgatggcgctgctagcacgactgcca

SEQ ID NO: 39111 - DNA, 1501 bp, Oryza sativa
ggtggcaccagtgatgcaccagagactccaccgaagccaacaacaagtgaagtgaaagtggattctgctgtcaatgctcctgatatcactattcctgacaacaaagatccttctgtgatgcagaaacaaaagaagaagcttgatctcaatctgcaacctcacagtgacagttcagatcaggaggaacaggccgacaatttcagctctatcaatgatctcagtacaattgatacaaattcagacaagaagaaaaataccatcactggtgttgctgataccaatattcctgaccacaaagatccttctaggatgcagatgcaaatcaagcttgatctcaatctgccacctcacgacgacagttccagctctatggatgatctcaaaactctggctcccactgataccaattcagataaggagacgaacaccggcaatggtggtgttgataccaatattcctgaccacagtgatccttctgcgatgcagacgaaaaacaagcttgatttcaatcttccgcctcgcaatgacagttcagattcattagtctgaaatgaaagacttgattttcgtctactggtagatagttacaggctatgatactcatacgactttctgtttcagaagcaacaagtgtacaaacctcttctgaatggcaaagtccatacttctgtattctttgcactcttgcttcgatagtgaagcagtgttattcagttacatgcaatggatgaacattttactactaacaatatgttctaatgcatacacttctctgtttcagtaaatatggatatactaatgagtaacgacatgattgctgtgtaaaaagattctggttaatgtttgtgtaatttggttgttgcctagattatggcagccttgatgtgatgccatactgatctatgagtgtgttattgctgtttttttttttaatattgaaaggccatggcttggatgtgtgtgctagagcagttttgctcagttcctgcaatgtactgttccattatatatagctgatatatcttgaaatgatttctgggtaaataaatgctagttaaattggtgcagacagtagtgcactggcccttttgctcttgggtgtttcttgcgaaatatggcttgatgtgaaactgagcctggtggccagttgtgcttgcttatacagttatacttaccggttagtagcatgtgcacaacttgaggttattcccattttgtgcagttggtactgtatattctgaccagttagtggtaagtatgatgtgattttggcctcattaaaagttagtcacatttgttctttaagaaaatgtcattcatttttctgagatcagtttctgtgaacttaatttggtgccaatctgcagttgctctcttctcctcatggagtcactgctgccttgtcagatttcattagttttgccaaggttcacttctcaacctgttgatacatactataagcttatttaaagttgaaaattctaccttcaagaaagacaag

SEQ ID NO: 39112 - DNA, 1501 bp, Oryza sativa
taaatgttacttcctccgtcccaaaatatgagaacttaaaattgaatgaaacatttattagtactacgaatctacaagcagtttgtccatatttgtagtactagaaaatatcctatctaattttatgttcttatattttgagatggatatagtaacaattactagcaactacatgaacaaaaactacaagtgcctaagaacaagatttggataacaacatgaaatatccaaaccatgcccttatagggctaaacagagtaataaccagtcgttgatcagcaaaagtcacccatctcaacaggtctgatatgggtctccatgtataatttgaactgttctggtcgatcaatgccatgtagtcaatatacatgacatgagtacatgacatgaagaagtcagtcttctaagctctattggtcagtcagcaacctagtttagaaggatactctttactttacgggtatttttttttcaacgaacagcatcagacagcgtacgttgtttcattgaatagagcgcatgccaaaagtgtgccaagatagcgagggagtcaaaaagcagccatgtggaaatcaaactattctagtcaacattggaagctagtattattttagttacctgcatgtaatctctctgtttatcagccttgtctacttatcccttttcaacacgcaagttctactatttctatataattgaaaccaataactcaacatgaattgagccaaacaaaaaggaaccatttgattgctcgcatgcttaatcatggccatcgatgtattctgtacgctaaccattttgtactatttactaacttaatgtgcattaattgagcattttattattatctcacaataaattcaatgttgtttctaaatgtgtaaaaaatgaccaatacagatgttggaggtcgggtgttactcccatcacccatgacccattggactctagctgtgctcgctaagacccaacacgaggaggaacttttaaaaactttgtgttagaatacatttagaaacctcccaaagaaaatgtgatatttgctttctaaaaacatacttgtaatattctctttgtcaagtatatctttgtattttagacatttacaacaccaaattagttttaataaactaaaatttagtatattttgataatatgttgagaaacacccaaaggtcttccggctagctttacaaggtggtgggttaaacgacctaagttcgaagctttcatcccttctaattatttgatgttatatctttccttaatatccgtgtcttttttttgacaatatgtacgttttgctgttaattttttattataaatttggttaaatctaaaaaatactagaaaatagtcaaagcgaatcgtatgaaacggaggtagcaagccttttttaaatataaagtgtgcgaaatatattgctaacccgagaaaactaagtcaacacataagacaatttgttgcgcgcaataaattggacgcctcttcatgctgcagc

SEQ ID NO: 39113 - DNA, 1501 bp, Oryza sativa
ccaactccagatacacctccatcacgcaccggcagatgcggcggcaaagagctcctcctcggccacctctagggtgtgcctcctccttggcctccgtcggcgcatgcgcgaggagagtcatagttgccatagctcctcctcggcctccgccggcacgtgcacgaggagactcgcagcaaacaaggactgaagagaggtagaggaaggttagagggggaagagagggagagtagagataatatgacagacaagtcccaccaattgtttttttaaaatatgctgataggactgccacataggacgaaaacaactccgataccccaccagcccaccccctctgttccagtcgatggctaatggggcgttccccagatcgatgaacaattctctccctgcatcagcttgacgaggtgcagacgacactcctcctctacagctcaaaacttcccgcctccatctccattttccgaggtgccagcggctcaccgtcgatgagccccagcccattttcctttcccaccatgcctggtgcgtcgtctctcttccatcttcttccacaaacccacgagcaccgttcggagtgtggggacctgatgggtgtggggacgggggacattattctcctggtcgttggttcagggccagggatggggatgttccaacccaatccgcccttgccctgccccatttcacccctactcttgggaaggtttgcatgggcagccatcggagctccgtagctacatctctactttctctgtttcactaaaaaaataattaatgatttgaatctagatatagcctatatgtagattcgttgttagaagttgattttctattggacggagggagtaatgtcaagtgctctttcagttgttgttgatgtatgaaaaaaggttgttggcaaggtaaaaaatggtatcaaggataaacattggtagcactttactcacctaaaacaacctgtttataatctttatcaagataaggtaaaataaaacctggaggaactgagtagtgtcaattgctctgccgattgttgttgatgtacgaaaaaaaagtagtcggcaagccaagaaattgaggatgaacactagtaccactttattcacctaaaacgacttgcttacaatctttatcaagagaaggtaaattacaatctttatcaagagaaaaattagaatgaaaaataaaacccttatctttatcaagataaggtaaaataaaatccggagaaaccaaaagttgtccttccttcaccagcctgcagactgcagcctatgtgctaccatgttcgtggaacgacgaacccaacagacggaattagttaccttgttgccgatgattaggagggtcatgttctgaaacgtaactacaagtcagattaaatttttttttaccgggccggccaagaaaggccaaccaaatttacttcagattgaagaatatatacaaatatacaaagtcagattaaatcatgcatgtgaaagaaaatgatatg

SEQ ID NO: 39114 - DNA, 1501 bp, Oryza sativa
atggttatgcatccttgagaaaatccaaacaggccacttgaactctttgaaaatggggtgcatggagatcctaaattcggcgtgccatacaccacctgatcttgtaaggaacctccaagtctgatacgtagagggctaaaggctacaaaaacaaataaatgggaaaaaaagtccatgaatcatgggaaagtgtagaaaaccataagaaggcaaatacattttgtggaaagtagctctaaacaaattccaagcttaataaataaaggtacagaatgaaccacaaatgtcaatatgtttcttaaaacgggatttaccctctaatatcttatattagtcagtgtaacaagtaaacctccacacggtagaatgaaattgatcacagttgctggcatatgtagttgcaaaggaacagataaatctttgacaagaattctttgagtctttgactttgtaactttaatcctatttgcaatttagtatggaaattccctactgttgtccattttttttagttacagtagaaaattgttcgcagaaaataggtataatattcaccttggatagctttagctagcaaaggattagtcaagtcctgggaaattcacaaaaggatcaaaattagttctttgcaaaaatatcaattacaacatgataaaacacacacattcttgggaaattagcaatttaccaaatttaagatagaagcttgcccccatggacactggtcataattgcacttctctggaggccaccaatcaatggtggcgcaaatgaactcgttgctggtcgaagcgatcgtctcagcaccccgaacgacgatggtcacatccgagtaatcctcggatcgaatcaatgtagggaaacagagaagaagaggtatgagaaaccatagcctcatgctttcttcccctgcaaatggtgttgtccacccaacccaaaagacaaccagaaatgtctcagatttattgtgctaattaaataaggcaactactagttggtaaggactaaggagaaggccttaagttttaattttatcaacatggatgaaagtgacacctgccctatcatcatcttctatatgtcctatatttacatgtttaacaggtcaaatcaattacaaacgaacagtttaaactttgtttccatgcaagtaaacaactatgttactatctcaattattggagcaacttaggcatctccaaatgcagtatccagagaaatataattcttttaacatttgaggaaatcatccatgaactagcactaaacaacaaaatgcaaaaaaaaaaaagaaagaaagaaagaaaggatatttcattgaagaaaggggaaagtttatcagttgagcagggtgaaattctgcagttggcaaaatcatcccaaactgcaaagaggaccctgaaacttgaagaaaggaatccttttcaacatgcaaacgatcgacctgagcacgccatttctgctcaaattcgagaaagctgaagatcaaagtttctctgac

SEQ ID NO: 39115 - DNA, 273 bp, Oryza sativa
aaaccaccatggtgtacctcacggtgaatttaccatcatcaggacctgcattgcaatcctaattagcggtattactctcatgttctagcctactcgagaacaatgtcaggataatcatcctacaggaaaaaataacatctttttgcataatcaaacgccatattcctttgtatctatctaccaacatcaatcagtgcatgctaatcttgcagattaatggatgaaattttgaagttacactcactgtacaacggaggcccttccccttccagg

SEQ ID NO: 39116 - DNA, 1501 bp, Oryza sativa
aaacaaacctttccatccaatgtattgatccaaaaacctatcctaattaaatcaatgtttgcaactgtatcatgattgtgctgagggatactactaactcacaatcatcatcctctattcctttttattgctatcaggatctcagtagtcaatggtcacctaatgcaaatatgcaattagttgatactatttacctatgattctagaatgaatgagggtaaaagcacttgacaatttgacataactgcctgccctgtgaaaatggcactggttaatatcagtaattggctgtacatctttatttccaattatctgctgcaaatctaccgtattatgattcacaaatgctggaggtaaatttgtgagatgccaggaacatgaagtaactggtgagcactggaaaaattgcttgcccaaaataaaaaaaaaactcagtgatattgatacccttgtttttttttttagataatgtggtatccttttaaatggcatgattcgttcttgtcctaaagtccaatattataatattagaaatggttagatgaagagtatgtcatacaaggcatgctcatccaactacttcaaaccaagactttgtttttcattttcatattcaaataatatttatctatatcctacatccttttgggtgcttccgttgttcattgtgtcatcatagtatcatattgtcacaaactggtccaaatcattggactgattacgtgttggaattctctggccgcttcttccctcaaatgttgactctgaattccaattgatatgccaaatgaaatttataaacccaaattggatttgggcgtcacatcttatacttttcaattttgatgctactgcaggagccccctgaatccatacatgaatggtggttttgatgggtttgacctgctcaactaaatcacctcagcttagactccatggtcaacgttccagtcaagccaccaagaatgatcaaatcgtccttggaactcaacatacgtaaattacattgaacctgctgcaagtaggaagcaagcacaggaaatgaagcaaaaaaaaaagaatcaaaattggcagattctaacacagtttaggaattaagccactgaaatgaacttcagcatagtttataagaagtggatttttatctcttaaggggacatcccctcgttttgtgtatggtgtttaaaaagttatcaaaaagtttgaaataaattgtaaaaatagatcaatatatgatatatcttttcgcaaacatgaaaattaaaattcgacatatacaattcgaaacaaaaacaacaaatttgaccgtgaattacacgttcttttcatagtcaaatttgttatttttgtttttatttgtataagttgaatttgaatatgcatgtttgtgaagtgatatatcacatattgatctatcatactaatttttttaaaaaaaaattaataatttttaagtggcatacaaaaacgaggggatatccccttaagggatgaatatagt

SEQ ID NO: 39117 - DNA, 411 bp, Oryza sativa
gcctaatgctgcatcggttaggttcgatctattaagtaatatttagaaccataatttagcttgttctatgattatcggtagagataatattggagtttcagccgatcttacctggtttagttgtcttgttccttatatttaatcgatatgctaaatctgccctttatattaagatcttgctgcgttgaaacatattaagcttgttgtttagtatattttgtctgtattaacatcttagtataaagtagtatcggagtagccgatacatcttagatttacttcatcggctatgctatgaatatatataatctctatcttgaagtacttttaaacataagtgatttatactgtcttggcaaactgttcgatctatcccaatcactttggtttaaacatatttttagaaataga

SEQ ID NO: 39118 - DNA, 417 bp, Oryza sativa
agcagttggttcagcccaaggagagggagggggagaggagagagggaggggtggccgggctgggctgagggaaggagggggagagatgggctagaagtggcccaagaggaggaagaggatttcttttagcttttcctttttataaaattctttaattgttttgttgccttataattatttagaatgctctgaaaattcaagtgaaaattggttaaacatttttaagcatggggaatttattaaaaatactcacaagccaatttgatataaatctttggtgaattttaattgttggaggctcttttaggcttttaaaatttctagaaatacattaaagcacgatttaaatttagggcgattttcagggcgttacatcttattcaccataatcacaccagtacaatatttggggtagcc

SEQ ID NO: 39119 - DNA, 378 bp, Oryza sativa
catgtaggctgctatcgtatgcacatggcacatacacataaattgtttatctgtaaattcataggggcaatatggacttgtttaagtttactgtaaatgactcagatatatagatcattatgtttttttttttgacagttatagatcattatgttggcagtttatttctgtgttttttgagacagtttatttctgtgtgagattttattctgctgttgtagctcatgatgttttttccttggatttagatgcacatgttcaatagctgtttttgtagttgtaaaatgtgctgtaatgatttgcaacttgtccttttggtgcgttctggcgggagattggattcggcgtgacaattaataagacgtatagtactggtta

SEQ ID NO: 39120 - DNA, 404 bp, Oryza sativa
ttttccataccaaattattccttatttcccctctaatcgctagcagggtaccttcttagggcatcgccacgccttaccgccatatcgcaatagcgttgaggcgggtatgcagcgccttagctcgccataccgccttaataaccttgcaacagacagattaaaaacaagagatgcataccaacgaggcaatgcctttagttggaacctggaccactgatgcttttgcattgtgagaacctccgatccagattgtaagatccagacaattcacattagtatgtatgctttgaatattgtggattgctgattgcggattgaggatggcatgattctccacaggatggacaatcagagctgtgtaggagttgtgtgttgcattctcatccattagaatatgaacaaga

SEQ ID NO: 39121 - DNA, 314 bp, Oryza sativa
atttaacagaaaacaaacatattatcaaattatattatatgttagttttagttagactaattttatattctagatgctgctaaattttttctctagactttcaaactcaaacaagtttaacaaggagagaaaaaaaatcaaaatgacttatactaatattttaaaaaaagagtaaaaaaaaatctagcaaggctagggtaggagtagcaataataccacacgtgggcagtgggctgggatgcttgtgttgtgtcttctgcttcctggaggaagcaaccggccagccagcggtttggtttggtttgacccaacca

SEQ ID NO: 39122 - DNA, 281 bp, Oryza sativa
atcccccaatttttaaagatggccttcatgttttttgcttgttcaaaatcatgttcaagaaatattattgtatcatcggcatattggagaatggacaaaccatcatccactaagtgtggaattacccctctaatttggccatcggctttggctctttcaataagaatggctaacatgtcagccactatgttaaaaagaattgaggacattggatccccttgtcttaagcctttgcatgtccggaaattttttcctacattatcatcttgttcatattctaa

SEQ ID NO: 39123 - DNA, 179 bp, Oryza sativa
catattacccgtagttcaaaaaaaaaaaaacgattacccggttcacactccgcatacatgaatgatcgattaatttgtcgatctaggactaggagcagagggtaatcgcagacttggccactagctagtcaacgacgacgagactagtacgcttgtcggcttgtgtccattcttgcagc

SEQ ID NO: 39124 - DNA, 227 bp, Oryza sativa
ttcagcagtatgcagcacggttgatccacagaagtcgagatactccgatacatcggagcagtggtcgataatctccagccgaaacatagaggagcgaccacagccgtgggcgtgtgcggcttctccgtataggcaattcttcgagcacctcggctacatggcatgaccgagcagcagcctaaagattctgcacgaagacgagcggggtccctgactccccctgtcca

SEQ ID NO: 39125 - DNA, 420 bp, Oryza sativa
tgcatgtaaattgtgagacgaatcttttgagcctaaatataccatgatttgacaatgtgatgatacagtaaacatttaataataacagattaattaaacttaataaattcgtcctgcagtttacaagcgaaatctgtattttgttttgttattaaactatatttaatattttaaatgtgtgtacgaatacttaaaaagatttggcccagcaactaaacacagccaatttcatgtgagcagtagtcaaatggtctccttgattaccgtcattagtcaaaatcgcagttcacatcatcacatattcacatggcgcgaaagattacgacacgctaccaattaccaaacccccaaacactttcccccctcaaagccaaacaatgattgaggcagccatggccggcggcgccatgccgctggtcg

SEQ ID NO: 39126 - DNA, 513 bp, Oryza sativa
ggaagaagagatagatgatgataaagcggcctattgcactacccatccaactccagcaaccttatatatacacttgtactctgcctctctgagagagagtatctagaaagaaacaaagagagagcacggatggggatgtgggggttggaatcggaattggagccggccggattcggaggtgtcttcaattctactagcttgttgcttcattcaaagggtgtgttgtgtagctaagctaagctgcgctgtgctgtggccgccaacaaaccaaaccatccatacaagagaagaattgaaagagaaaaaaatactccctccatttcgaaatgtttgacaccattgactttctagcacatgtttgaccgttcgtcttattcaaaaacttttataaaatatgtaaaattatatgcctacataaaaatatatttaataatgaatcaaataatagaaaaagaattaataattacttaaattttttgaataagacgaacggtcaaacatgtttaaaaaagt

SEQ ID NO: 39127 - DNA, 1123 bp, Oryza sativa
caaggcaagtcacacattccccttgagcatgttgatcccaatttacaaatgttttactgtttgcaaacaaatatgcatgttttgctaattacatggggtcagggttttacctatctgctcgcttgtgccatgtttacttgatatctgttctttgtcaaccttgggtaatgaatcgactagctcatgttacttatgtgacctagctagaactatatgcttagccatgcttaattaccactagctcagttgatgggataattgcagtattagacctttttagtatcagagtgagctgcgtgctcgagacacctggccatgcttcatggtcgtaattatccaactaaaatgcgactgaatggtgggctgtgggtgcatggttttgctggtcgcacccatggcagttaaggaccggttcgcgggatgccctggaagaacttatcgtacttaccacaagccagcgtgggcaacggctgggcttgtagtgtagcttttctctagccgacgtacccaggcgagggtgggcgtgatggagttgggtcggccggggtgtccggttgatcggcttccggattcaccgcggcacgaaaggggggctgcccgttgcctgctggggacgggggcgaaccctaaggtgtggtgcgatcggttagagggggttatgcgaagggtcctgtcacggcctctttccggtatgtcgtggtggcatgtcggcgcacgggaacgtgtcgtggggctgtcttgtgggtacagttgtacacctctgatcagagtaaaactattcgaatagctgtgcccgcggttatgggcggtcgaccagattcaccgtgattagtctcacacttaataaatcgacctaatacactgtagtttaggtgggttggttgggcctgttcaacgtggtgtagcgttgatcagtggagatttaatgttactttaattactcaacagttttactgttttgctcaataaaatgttttacaaccgcctttatgcaaatagccacaaaccgtccttgtgttccccttgcacgtctgcatcgttggtgtggcttgctgagtacggtggttgtactcagtcttgctattattcccccttttcagaagtgtagtgcttctgagctgaa

SEQ ID NO: 39128 - DNA, 181 bp, Oryza sativa
aggcccgaacgtttagagttgttgagttgttctgctcgcaacacatgctttcaactcttcttttctcgctttttcaaaaagaacagaacagagaaagaaagaaaacggtaatccagtacattgcgcccttaagctatcatattcttggctattttcaacctagatatttgcaagggaataa

SEQ ID NO: 39129 - DNA, 373 bp, Oryza sativa
acggatgtgcacatgttctgcgtgcgctgtgtccgtgcatctcacgtcaaaaccacactggacacaacttattcatgcctctttcaaaatgcggaaaccgaactgattatacttgattactgattagtgcaaaacgttttataggtttcagagagaacattaacattggagaatatactgatgcaccacccaagaggaaaattagaggataatgagcccaaatgaaccaagttatctgccccctagttatagaagattgaacaagtaatgacatacatagaaattgtatatctggagagagattttcatcacttgaggatacatcttcttatatcttttttcatgtcacctaaataattataaaaaaaataaa

SEQ ID NO: 39130 - DNA, 292 bp, Oryza sativa
ctaagtcaaacctcttttgtgaccaagcttataagaaaatatagcaacatttccacaaaataaatatactacaaaaatatatttaatggtgaatttaatgaaactaatttggtgctttagatgttagtacacttcactataaacttggtcaaacttgaagaggtttgactggacaaaactgaagtgacatataatatgaaaccgagggagtatttaggatttatgcgtttttcatatgggcatttatcttaattgctcctttcagtttctgaattctttgattccctccaga

SEQ ID NO: 39131 - DNA, 1474 bp, Oryza sativa
ttctttattagtattactgtattattattccactcaaaatctgcaattcacttgattcgcatcatgccgatccttttattattatattctatcatatatgcgtgtcgtcactgatcgattcgatcaactagtggcacagcagtacaccgctcattgataacgcaatggcaaattagtaatattggtacggcagtagcgctggtccaagtagctgaacaaactagttattgcatgcaccacccaacaacaacaaatgttaccgagtactacactatactcataaaaaaaatcgtttagaacaaaatttaagtcaaaccttacaaatataaatcatgaataactctcagtttgttgaggttgaaaatataaaaattatatgaatagatttgtcttgaaaaatactttcatcaaagtatacatatatcactttcaataaatatttttatagaaataagaagtcaaagttgtgttttggagaccatgtcgctgtcaaaaacgattttcctttacaagtacggaggttactctactcatcaatatactccctccgtcccataatataagaaattttgagtttttgtttgcactctctgatcactcgtcttattcaaaaaaaatttggaattattatttatttttttgtgacttactttattatccaaagtattttaagcacaacttttcgttttttatatttgcacaattttttttgaataagacaagtggtcaaataatacaagtaaaaacttaaaattccttatatcatgggacagagggagtactacactactccctccgtcccaaaataagtgcagttttacactattcacgtttaacgtttgaccgttcgtcttatttgaaaattttatatgattagtatttttattgctattagatgataaaacatgactagtactttatgtgtgactaaatatttttaaatttttcataaatttttcaaataagacggacggtcaaatgttgggcacggattttagaacggagatagtacatacttgtactataccatatggccggtcaattctactcagctcaaccatatatggcctggctgggtggctggcggccggtacctttcgccatcaccagagccactagtacatgagtgactacaccttaatatttaatcacttcccttttcgccaccaatcctcctagtgcttgtattagtagtacaaaagtgtgcaagcaattcaatttcgctcacacaaagatcaccgatataaatagggtcatcttaaacatcaaggctttccctcttaccaacctccctccctctttgtatcgcaaacactaatagcaaagcctatctagaagcaagcatgcaaagcagcaggttcaacaacaaaccaaaccaaaccaaacccttgagagtaaaagcaacaacaagctgctactactagctagtgtgggtggcttctgaatatgtcaactcttgcttcgcctgataagt

SEQ ID NO: 39132 - DNA, 232 bp, Oryza sativa
cccgatctctgcgatgtggttttttcctgatctatgtgatgtgtgcggtcgatctgtgtgatgtggtttctttttctgatctgtgcggccgatctgtgcgatgtggatttctttttctgatctgtgtgatatgtgatgtgtgaatgaatttgtggagatgattttgtgattttgtgaatgatttgtgatgtatttggggatagaaaatgcagcttgatgtatttagggattt

SEQ ID NO: 39133 - DNA, 864 bp, Oryza sativa
tttgcaagatagcaaagagctatatgtacaagtgaaacaaccaaagatgggttgtgctatcttgtactggctggagcaaagcgttccattatttaaagtagagcatgatccatgaaagcacactgcaaaagcttcagcttgaaattaatcaattttatcatgtcgccatattatccctgttatgtcaaagcatgcatcatatctaggatatgaactgttaacattcagtaatttgctcttcttgaaagtaaatacatccatgttgtaccagtctatcttgtgaaagagttaaagattctttgtcagtgcttctatgaagtgaaatgctaattcattagcacatttggaagaatctctgcacgtgacgtgatagccatatatctgcttgagtagatcttctaaaagcatcacttagacaatggctccaactcccagtcccagagcttatatgtccattgtccttgaactacttgcgtccacaaaggtatcatccatgaacctaattatttgcgcagttaatgacctatatgcatgaaagcgaaattaaaatatactaaaagaacctggcaaggtaattattaccagtaaacagctagcgtaatccttaagctcattaagcatcgtccaaacaaaacaagtaactgagccgcattacatacacattcagaccacacatcttgcgtgccacaacggagttcgaattaaagaaatcaaggctagatttaaccaatataatcggcacctttcttttgaccgagttcaagaaaatgggcgtacgttcttgggtcacctgctcagaacagcgccgcttcgacctcggtcgccggggcggaaccaccccccacacctcccttcctagtccca

SEQ ID NO: 39134 - DNA, 692 bp, Oryza sativa
tccagcctaaaatcaattgcctctctcataactccactctgccagctgggctcaattcatcgttttcacagtttgagatcactcatttactccattcggtttcattttaattgacattttggacaatgacacggattacaaaatatatctttgatcttatttttctactataatatatacaataaataaatgcatgtttacttttattatagtgctttgaaagacaaatctatatatgttgttctagtttgtttaaagtaaatatttttaaagttattaatggtcaaagttataaaagtttaacctaaccttgtctaaaacatcaattattatagaaccggagagagtatctttttcattgattttcccgacaccaaaattctaaaaaagtcaagcaaagccagtggccaccgctgaactcaaaatagacgttattacataatctgataatcatcatgcatccatctatctcttgcagccatgcatgcatcagctctctttggaagttcatccctagcaattactcccatggcgacaaaatccaactcaccatgacaaagctgcttctgtcacttgccacctagtagtaaacagtaacacctctgcatatatgtatctgcatctgcgtgctgtgtgtgccatggccatggatggcatggagaaggtggcgtggtgcgcttgcttcctcttcc

SEQ ID NO: 39135 - DNA, 608 bp, Oryza sativa
ttttgcttggcaatgtgtcttctttgccttcaacatccccctccccacaatgcaaaagatatttttggtgactggctaaggggagtgcctagacccacaaaaaaatgattttatttggagctagtgctttatgttggtcaatttggtgttgccgtaacgatatagtttttaaccataaaaaaatgcctaacatcatgcaggttatcttcatgtgttccaattggctccactcttggtgtatgatgctttcacaggaacaacaggatactatgcgcaatggtgctacacgcttggaattagtagccaaggaacttttattccattttggatggcgtagtacctacagaatttcgtgatagaatctacgtgattttgaaaaaaaatattattttagtagattatatcatcggcagaagttgggggtttgtcccatctcgccttttttaacttttctgttcacgtctgaattttttggctgtgtgcctacgggcagaggccggagatgtaacacatttccattattaaaaaaaaagtcaagaaaggtgcagtcaatgcagctatggaacttataggtacatctgtaagcaaggtgggtactcaacaaagtc

SEQ ID NO: 39136 - DNA, 342 bp, Oryza sativa
ttacagctaaaatcttgataagatatatatgaagatcaatttaaacattcgacatttgatctgcatgtcccatacatgcattgggctttacactatgcatgcattgatcaagaaaggatttaactagataaataaagattagaggtttatatacattaatctacaccatcagagggagcatggagagcagagaaccgcatcattgcgttttgtggcgagcgtgttatggcttttgagcatcgcaatgcattctatatatcctctctctctagcttgctagctacctcgatcaccttgtttatctttctttccgttctcccgagtttgcactgcctccctagc

SEQ ID NO: 39137 - DNA, 885 bp, Oryza sativa
taaaacatgtgctaaaaaatcaacggtgtcaaatatttcgaaacggagggagtatgatgtagtatgtcgcccttgcttgataaacgaaatgaaaaatataaaatcatatgcagactccaattaataaacataaatttgtcagatacgtgtattattgtttcacgtagtacaaaaatcgcaagctcatcgaatggggcttgtcactcacctcatccttccagttgtgttgcatcgcagcaccagcacacaggcagcagtagcacctcgatccatctaccattttatttgctgaaaagttgaattttttttttcttagatttgtacactactttatgtctcacactaggctctatctctctccctggcatgaatgccccaggttgcaggcctcttctttccccaggatttcgttagaaaagccccagtagcacacggattaacaatctccgatttaaagtcagaagagacttggtcactgatatgcgagcccactacttctagacccacatgtcaatgaccacgttagaggtacgtaaaatgacacatgtgcctcttcatacgctctcttctctcctctttctctcgcattgttttgttttgtttttaattttgaagcgaaaagagggagggaggtgcaaagaaaggttaggaaaagggacaggaaaagagggtcactgatttctttatgccccagctgctggagccctgccggcctctaccatctccatatataccacctcactcctccccttagcttaacacaccacacacacccacactggcagcagctcatacacatagctagctcagctgagacacacacacacacagtgagtagttcagctcaaagctagcatcagcagcagagctaattaacaaacatgg

SEQ ID NO: 39138 - DNA, 152 bp, Oryza sativa
tgcttcgtctggcagtgataatactagagaacttgtcagcattaaaagagatggtttccgttttaaaagtctggttcctccatcagcatggatacataagatatcagatttttccaggtcttctagtccactacctcgattttttggatgga

SEQ ID NO: 39139 - DNA, 190 bp, Oryza sativa
agttggacacggaaaccagggtttgtcttttttttttttttgacggagggagtagatgcacgcgtcgcatcatatccgccgcggtagcgtgcgatgcctccaacctgcacacgtcccgtacgtctcgatctgcatctacctgattcttcggatgattctctacagtagttcagaacaattcttgtaacga

SEQ ID NO: 39140 - DNA, 938 bp, Oryza sativa
gaatgcccttactttttacttgcatgaatgtccccatatcgtgcgacaccattcctagatggtcgtaaaagaactactacctgcttaaaacactagtaattcttttactagtgttataaatattgtttagatttcgtggtctgcgagtaaaacaattaccaccttcctctcgatatagcccatgatctcgtagctactatgtagtaatatgtttactgatatgttcagtacactgtataagagtaaaagctgagacttcgtggtctgcgagtaaaacaattactacttttctctcgatatagctcatgatctcgtagcaaccatatagtaatatgtttactgatgtattcaatacacggtataagagtaaaaaatgatactaaaagtattgttaatctatatcacaaaatgaccgtacgaataaaaaaaattacaggctcaatcacatacaaatgataaaaattactcacaagtgaatcaaactagaaaagaaaaaaaatgattcaaccaaaaatccatcgtgaaactaggattctggtggctttcttggatcttgctataaggatggagatgccggtctgtgtcttgtgacaggtagtggagagggcaaccagatggcgagcggtagtcgatgatggaataatagaagggtgtagcggcatggtatagagatgggctcgacattgcgcagtagcagccatccatcatctagcaagcacgaaaaaaatgcaagaacattctcgttcatgttatagagacgacgagcaaaagaaaaatagcaaaaaacctccatcatcggcaaactccaccctatcctctgcggcgaaccacatggagcatgatgtgcaaatgtaggacctatgcagcccatcaattcagatcaagtaatattggagattgcacgttaatctgatttgcaaaaaaaaattggggcttca

SEQ ID NO: 39141 - DNA, 301 bp, Oryza sativa
aaattttggggtgtaaaataactggttttagagtctaagagggtaattcgaacgacccaaatagttcaggggggtaaaacgtacttttccttaaggaagataaataagtagagagaaggacagtgggctatagatttatagccagctgtagcacggactccaagacgcagtgtgtgtatgataggtgggaccaggtattaatagtgtagtatataactattgtataaatgagctattaaattggctatagataaattggagctagcgattggctatactattaaacttgctctaacgtagg

SEQ ID NO: 39142 - DNA, 296 bp, Oryza sativa
cagcagcagctcaacatcgtcgtcactcccggcggcgccacagcagctgagtcgtagtcgccggaggcggggatgaggtgtgtatgcgtgcgtgctagagtagtgttgctactactactgctccgtttcagattagaagactttctagcattaccaacattgatataaatgttaataaatatagacacgcatatatgtctagattcattaacatatatatatatatatatatatatatatatatatatatatatatatatatatatatatatatatatatatatatatatatatga

SEQ ID NO: 39143 - DNA, 1501 bp, Oryza sativa; identical to SEQ ID NO: 26405

SEQ ID NO: 39144 - DNA, 171 bp, Oryza sativa
ttttgtgtggagctgcttttgagaaagaaagaagagagatcacaatttaaaaaaaaatggaaaaggaatgttactgctgagtcatcaggagatgctacacctacaaccaaactcctagctagtacactatctttctcttactctcatgtatgttcctctcttttttttagt

SEQ ID NO: 39145 - DNA, 468 bp, Oryza sativa
cagtatatactacttccaccgtttcatattataaaactttctagcgttgtccatgttcatatatatatatatatagtaaatttgtttggtgctccatggtgcccgggcaccattgttgaaattgagtatataaccaattcaaatgagtatgaaactttttcaattatttaggtattaacattaactactttactaactagttcaaagcaagtttgaactgaatttgaacttgtttttgttagattttgattctaggtatatagcatccatacatataattagttaggtatgtaaacatgaattgtgaaataaagttaaatttgagttgttttgttgatagatatatgtatgaatcgaattcttataactaggtatatactcacaatttaaaaattttgaaaaatttgagtaattttgtgcatttgaaaccatggtgcccgggcaccatggtgccccatatgagtgtca

SEQ ID NO: 39146 - DNA, 1501 bp, Oryza sativa
tagtcaactattgtatgaatggactattagattagctataaatattttggagctagtagttggctataccattaaacttgctctaatgtaggaatttctttcgtcgtcatcattatcgaaatccaactgcccaacacacttagtaaggactaaggaggcgatcccccgattccgcttcggcaattccttcggcggtgtggaggcggcccccgacaaggtaattagtatagatacttagctaatactccctccatctactttttaatagtcatatttctaaatttgaaaattttatttttgataggcatatttcaatccaacaacttataatcttaatggctttcttggatttaatgcgtgactctccattcttacacacaagattggctacatgggcatcgggaaatgtaaatattaatgaatcgcttgtttacgaggaatgactagtagcatgtttaaatggatgacaagtacaatcacttatcattggtctgtgtgccaagatgaaatattactatcaaaagtagatggagggagtatcgttttccgatttgtagtatttactctattttgtattataagtcatttgattttttttcatagttaaagtttgttatatctgatcaagtttataaaaaaattagcaatatccataacacaaaattaatttccatacattttacattaaatatattttgataatatgtttgttttgtatggaaaatattttatatttttttataatgttgattaaatttaaagatatttaacttaaaaaaagtcaaacgacttataatatgaaatgaaaagagggagtatcattgtctcaactggatgaatcctataagagcaggtataatagcaggctataagccagctgcaaccataatttaagaagaggaaaaagtacgttttaccccctgaactatcgcggtcgaccgaattacacccttaaactcaaaaaccagacattctataccctcaactattgaaaccggacaaataaggccccttaacactgttttgagtggttttgacttaaccttgcacacgtggcgccaacgtggcaatctaaccagcaaaaaaaataaaaaaaaacatggcccacctgtcatacctatcctcaaaccaatctggcaatctctcaaccattccatctctctcacgcacgcgctcgggcaaggcagcgggtgaccggcggcggagatggagctcctcgggcggccgggtgtctgaggcagagcgggcgaccggcgacggagacggagctccccgagcagcgggcggcggaggcggagctccctgggcggtgggcggtgggcagctgaggtggaagcagagcgggcggtcgacggtggaggcggaggtccctgtgcggcgggcgtcgtgccactgaggctgaggcggaggcggagcgggcggctggcagcggaagcggagcttcccgggctgcgctgctgcgggtggcgagcggctgaagcggaggcggagtgggcgaccg

SEQ ID NO: 39147 - DNA, 278 bp, Oryza sativa
taaaggatataccagtaatatccctgcatgaattttgtgggatggagttttgggctgcacaggcatgtgatcctggatttgatccacacctacgcccgtgtaagggtgaaagttgaaacacctttttctaaaacaaagaggcaacagtagatgcttacaaaacatggctttatagtttcaatagaacggacaatactctgaagttttcctataagattccctaaagttgatgcttagagatttgtttttatgtaagaaatttcaagtttatcatctta

SEQ ID NO: 39148 - DNA, 239 bp, Oryza sativa
actcaccaaaaagcactaggggggggggggggggggaaggttaccacacaagcacacaaccatcacccatctgtggcccaatcgccaagttatgattccacctctatttacagaaaaatcatgtcaaacaagtgtttcaatactgtcctatgcccacggcatcctgctgctgagttacatttcatttgctttgttacatcaagacaatatatgttgcacagatgagagaggcgggtagt

SEQ ID NO: 39149 - DNA, 435 bp, Oryza sativa
ataagtgatgggtttgccatagcacagagtcactttttatcatgataaaataggatagatgtcacacatctatatgcggagattattgggtgacttggcaaggggtatcaaaaccgttttttgacctttgggggcataaggtttggggtttgggacaatgagaagaatgttccaccccccaaacaagcaacaaaggaagtccaccattatggattgtggaattaaggcaagggtggttgcttacctattttgatagttgtctagttgtgatgccaaagctcactagacactaataaaatgaggatcttgactcactatgttactagaaggaattttgttttacaatacatagtgggagtattttgttaaattgtttaatgaaaagttaactgtagacatggtgctgattttgcatacatatatttctattgtaga

SEQ ID NO: 39150 - DNA, 1501 bp, Oryza sativa
atagacaatacctcacgcggcgtactcgtcgatgatccatagtcttcgagtaggtgcaagactgatggttcatggggatcgatgtcgattaccccaacaaatcgatctgaaattggcgtcgctccttgttccttgtcctcatccctgatggggatgcgtgactgctggaccttaggaggtggcgtcttcatggcgctgagaaagaccttgcagctcgagaggtcgtgattctttgtcttgtgaataggacaatagacatcacgagttggagaggtacgctgaattccacgctctttgcaggcacgaatttcagaatggacgttgagaaagacccagcaggcttgcagggtatgtttcctggttttgtggataggacaccaagactttgtcacctcagaagtaatcctcgtcggctcgtgattcctgtcagaaagacaaggcttggccgcactaggatccttctcgggttcggatgtcgtcgacgttccgatctccgctttggcgggaggaaccttcaacatggagtcaccccgggttgtagccgctgcgttctcgtttccggccattggcggaccagctgagatcggcattgtggtgtaaaccagaaagacgatttcgtcgacttgagtccacaccagtgttgttgaagttggaactccttggttgaggttggtgttgacgctgttgtcgacgaagctggatgtcatagtagtagaaccttgagcgccaagtccccctacctggcgcgccactgtcgacgggggatacccgtagaccggatatagagggtattggggtacgctggtatgaggatctacgtagtacgacatcaagcaaacaggaaacagggattatactggttcaggccccttggtaggtaatagccctaatccagttgatatgggattatatgatggaaaccacagattacaaagggaatagtgaagctcgacgataccgacaagatcgtagtcgagttgatccgactagatctcccggcgacttggcttcgataagctctagcttcgtaggttgtggtggatgtgttggctctgaaattcgatgccttaggtctacccgggtggtcccttttataccgtaggtcaactggtctccaagtaggactcggagacatcggacccgacacgatataatgacgacccagttctatctgagtaggactctttccatctgtagactccatgatggacttccttaacctatgctgagaatgtccgtatacgcgcaaacataccatatcgatacgtgacgtatatcgaagggtagagggtataccttacccgtaaccctgacagtattcttgtctgttggaatagctctgtcgttactgcttctcagattgaaatttagagttttgctgttaaaatttgcttttcctctagtcattctgggttatcctggactttactgtcggtgtatggaccctgtgctggtgttgaaagagaaaattttgtaatctggctccatagcttgcaaattg

SEQ ID NO: 39151 - DNA, 340 bp, Oryza sativa
atctccgcatatagatgtctgacatctatcctattttatcatgataaaaagtgacactttgctatggcaaacccatcacttatgatcacaaccgtaataggtgcaattattggaagagcataaattacacttaatttttctgagggaatctatcctaccatgtcatatcaaatatacaacagcaataaagtaagacacatataaaaccccaagcgaaatctcaggggcaatgcacacggcggtcccgcgggtttcagggcagcgccctgaaaagttcacagggtacatagatctcatctatgattcgccatgtgaaaaccttaacggcgtaatcaaatta

SEQ ID NO: 39152 - DNA, 1501 bp, Oryza sativa
tttttgtgatgaagtattctgatgtttcatattgcgagatatcagtttccactcattttgaaattttgagtagcatgggtggtactgatttcttctcgtgtttcataagtagatcttctgtacggtgaagtcttggtaaatatttcaagaaatatggatgtgcgaaattgatattaggggtgtgtttagtttacgccaaaattggaagtttggttgaaattgaaacaatgtgatggaaaagttggagtagcatttgcccgttgcaatgggacaggcccatacaatcggggataggccgagagggtggattgaggaggtgatgagtccgctttttatgaactgtgatcgatcctgtcgttgttgctttgtactagtagtaaatggtaatgcttgacgtaatgacatgtgtcctagtggacaatgtttcaatctaagctttcaaacttagcgtgcctaacttcaaacaaacttggggtgtgtttagttcacgccaaaattggaagtttgattgaaattggaatgatatgatggaaaagttggaagtttgtgtgtataggaaagttttaatgtgatggaaaaattagaagtttgaagaaaaagttatgaactgaacctccattgcgttgtcgaactgtcagtcattgtctcatcaccatgcaatgtcttgttttgcatcacatcacgctattggtttttttgcgtgaatcagcgtaagtcggatacttcaacatgtcaatggctgtggttatatctaaagtttgatccaaacttcagtccttttttatcacatcaacctgtcacacacacaacttttcagtcacatcatctctaatttcaagcaaaatccaaactttggatccaactaaacacagccattaatatgtcattgtcctgtagcagtatacccttcaatgtttcctgattgatcattgcgtaatgcataacaacactgtcaacacatcatgtttagcccataacaacactgtcaacacatcatgtttagcccctttgaatcacaggaatgaaaaaacggagaaataggaaaaacataagattatgataggaatgtaagtgtaaaacaaaggattgcaaaacacaggaaaaacataggaatgaccgtttgattggaccactggaaaaacacaagaatttgaggagagataaagactcaaaggatttctatttgatgaggagagataaagactcaaaggatgaatttgaggagagataaagactcaaaggatttctatttgatgaggagagataaagactcaaaggatttctatttgaggagagataaagactcaaaggatttcttccatgaggttctacctcttgttaaaattcctccaaaacttgtatgggaagaggcattccataggaatttcatagtattccataggtttcattcctttgattcaaagggctttgtaggaaaaatttctataggaataaaatcctctaagggcccctttgaatcgcaggattaagaaaacgtagg

SEQ ID NO: 39153 - DNA, 1501 bp, Oryza sativa
gtgagtgaagtgaggatgagagctccttttatagcttcccgatgacggttgtgacggctggaaaggtcggtaatactgttaataaccaaatttggtaatatcggcatcggaaaagaagattagatcgaagtggattcgaaggcggagaacgattcaagaacagagcaagagtccgctggagtccagatcgcctacgattaggatcggctgagtctgagtcggactagggaagccgatgcagccgattccgacaatacgacttggtgtttgacatcgggttgaattgaggtacttcaagatgattactgtacatggatagagtcctgagaaggcaactgtatctattaattaggatattttatgtaatttccttagtgatatgtttgggcaaaagtttgccgcaaagacttatggtatcttagagtttgttagagataagagtcgtatccggtatggacatagtttgtaattttcgggtataaatagaccccgaaccccatgtaatcaattaacgcacacgttcaatacaatttcggcgcatcgccacccttttgctttagttttatttcgacgagttcttgctttcgggttgagctgcatcggtttcgatcttcgacagaggtaaaacttgttatgacggcttgtgttctcgggattagtgcttccatctttatgatactctaatcttgtttatgtaatccatcgagttatcatataacttacataatctttggcaatatcgctatctaacctacaatcggctaacatctgttggaagagggtagccggttaggttagacaatgacgttgatttagattatataggatatctaccactctatgaaacttccagtggcttgattgtctagatattgttcttcttttcatacttaatgctgcatcagttgagttttatctattaagtcgtgcttagaatatcaatctctatcctgcttcctggttgccaattagggtagtgtcggagtttcagccaatcttatctgatttaactatatttgctctatatacttcgttgacatgttaaatctgccctttatgtaaagatattatcgcatctaagcatattaagctttcgttgggtatattctgcttgttttaatatcttaacatagagttgtatcggtgtattagccgatacatgctagatctatctgatcggctattttataaacacatattgtctcgttattaatatatacttcgacctaagtgatttacactgtctcggcatggcgaccgatctatcccaatcacttgatttaagtatatatcgatataagaactatatattgttgatatctacagccgatcgagtagatttagttctttgttatttatttataactaccgatcgatttacatatgacatcggctcaaagataaatgatatgtcatcggcacctagccgatcggctatcgtttataggtttaaccgcggtttcttcatctttatttcttgttgattgcaggatcaaatcaa

SEQ ID NO: 39154 - DNA, 1473 bp, Oryza sativa
ccaactaccaagtgatgtgaggtctctgatgcaatgcaatcatgcatataaatatgctgctcataaacaattcaacatgtcccagcaagtcatttagtacatctgcaaggctaaccaattctgaaagacagtctgataaggagatccaatctgctgctggttcttcagagaaagatgagctatctgttatcattgtccggtctctggccatgatctaattacagctcacataacggggataaattgcagagaaaatttgccaagaaatgcatgcatggctgaagtcagccagcttgttcagagttcagttcagtccaactttctgaatgttaattagccaggcgcatcaaatgatcaatcaatcaactgaactaggctaattttcacatagctctcatcaaactgtacacaacatcatggtgttccatgccttctcattattcgtttagtagcaacatgaacttcattcagctcatctgtcatcagtgtcattatgttacctgataccgatttctctgcttgatgctgcttcagcgacccttaatccatacacttctccttgttctgatccgtaaactactctcggttttcattactgcaattgtgagatggagattttaaacggggacaacatgatgatccaagaagtaagcaacaggagcagaggtatgattggtgttgcgatattctaagacaagtagacgataactaaccagaaagatggtatgtagctatctagctcgttcacagcaacaaaggatcattcatggaaggcaagtagacagcagcaatgatacaagaaggattaggacttggataagctggatcttgaagagattatggtccattgtacttgtgatatgtgaagttgaggtagataccagatatccatctccgataataacatgattagctcatgagcatggcatataaaaacatttcaacacaaaaattctaaaatagggaaatcataatttgataattttttgtattttctaaaaaaaaccccaacataatcattggtagttatttaaacattaaaatatatctcaagattggcttatttctttttagggttaattagacacatgccattacaaattcacttatttagaaaaataatatttctattcgtcaaatcagtcggatgccactctactcttataaaattggaactgtaccactccgtcatgtgttgacagaaactgtgacagaatgacacagttccaattttaaaatagtagagcaacaaatagtaatggtatttttttagatgggcaaatttgtaatggtatggatccaattaacactctttttatattagaaaaaaaattaaaaatctgtaaaacaatctaaaaaaattatcagctttgtttctcttgaggcccattacttgatgagccttcctgtgaagtgggcctccatcttccaagttcatcatgcaaccctgcaggctgcagcgagatctttctc

SEQ ID NO: 39155 - DNA, 1243 bp, Oryza sativa
ctcgggatgtcgctttcaaaataaaggatatcgagcagtgcaaacagatactttcacaggttaatcacaaaccaaatttcagtacagccgaaaaaaaagagatactccaatcatgcacaaacatgaaaaaaaaaacatatttcaacaattagatcccatttcaaagaagcggtttcagttctctcaaatatgacaggaaatttgttaatattaatactggtggctgaccatatcaaggctaacatgggaatgaagcacatcagttgaacttcagattcagtagtggtagaaaattggcatatttagccattttattataggagtagttttttgagcaagaagaaactttcacttcatagagcaatatattagtaactccacttcatgtagccagaaagtaacaaaggagcttgatgaaatacatgtgcaacactgattagaaatagcagtatgatgcttgatgataactcatccagataatgcaatgttgtatgcagtggttttttaatattccactccaagattcacatgacttttttttatcaataaaagaaggcagataacagtaataaggtaatactgggaagggcatggcatcttactttacatttcatagaacggactcagagagtttttaatggcccatctgttacatctcattatctatgaacttccaaattagttgcagttgaacaataaagggacatatcttaaaataaataatctccttttttgtgggttaaaataaataaatctcaaaaggagtctacatgcaactaaagatcaagcaaatagatatactgtagccaagtccacatgtcccttgaaacaatgtccaggtttgctgattgattatgaaatatgaattgatctgcaaacttttgaatgcagtagaaacatgagacaaataaatctcagtcaagaaacaaagctattgtgttgggaatataaggtaaaattggacaggttaacatatctatatcactattaacatactgacatgactccaatagtcattaaaaagtcaaggatctcatagtaaaatctatacactaaaataatatggtgttctaccctgcagaaatgaaatatttgcctgcaacatatgaagtattggagaccaaggaacaattcagttttagtttacataggcagagctttcaatcacaacatacagtgcaaaatagagtaaatatgagataataataaggattcaaacagtaacaggagtgcacctcgacca

SEQ ID NO: 39156 - DNA, 1214 bp, Oryza sativa
cttagctgcatctttcggttcctgtggctttacttacaaggcatgactctggtttgttccaaacctgtggcttactcttttcacaagtcaaaatgtttttccccctgtaagatgtatgttttgccttcttacattgatcacttctgggttagatggatatgttatattcagagaaaacatgtgctccctctggtttttaattttgacaatgtttacttttaaacatatgtttgacaattcgtcttattcaaaaatattgtgcaagtatataaatcatgcttaaaatactttcaataataacataaatgataattacatatttttttaataagatgaatgtaactatgtatgtccaaaaatcaacgacgtcaaacatttaaaaccagagggagtacaaggtttccacaaaagtatctaagggattttcctttcttattgacaaatatgtttgtgctatacgttgttcaacatagtacttttagtcttttagataagggtaattttattatcttgaagaaggtaccaagatgtaccacattttctagtgtaaaaatttgataacttcaggtactaaagttttagcgtaaaatttaggtaattcaaggtactttctcaagaactataaaatttctctttagataatggaagagttgttctttctagtgtttttgagcttggtaaaatggatcattttttaacgacttctattctatctctataatttataagaaattgccaataaagatcacaatgttaaatatatttgatgtttccaatctaaaaatgaattgttctaatctccagggagataatactaagataatggttgaagaatactctcaactctcaacgccacaaaacctgaaacggacagttaacattagcttacgtcatgggatataatatgctcttgttccggcttttggaaaaaagtctaacgaacgcaaccgcgtgaaatgaccaaataaacttgttcaacagaaacaacaaaacagcaggcgaggcatttgctgcagtttttctcttgtttttattttaggtgtagtagtatcagtttggtaggcatcgttgacgcctttagatcttccagctatttctgaatcatcacaccctgcacgttaaaagttcagatattttctttctccctttcatatattctttggagctcctgcaactgaactcaacgaatttcaaaaaccataaattcagtttgg

SEQ ID NO: 39157 - DNA, 1501 bp, Oryza sativa
caagtaggactcggagacattggacccgacacgatataatgacgacccagttttatccgagtaggactctttccatctatagattccatgatggacttccttaacctatgctgagaacgtccgtatacgcgcaaacataccatatcgatacgtgacgtatatcgaagggtagagggtataccttacccgtaaccctgacagtagcccccgacttttgcttaaatgaacacgtgaaatcgattgcgacttctgatgtcgaaattgtcgttgttctcggtgtggggaccaagagacaaggagtgatcgacaacgtcgagtgaagttcaacggtcatgagtgaatgtaaattgaagtccgaaaaactgccgtgtgtaacggacctagaaatttccggcggccatctctctcctttccttggaattcgcaccggcggaggtgcgtctatttaagggagttttggggatcccatttgaggtccgcctgttgaaaaaactctccagcttccaagcgtccctcgtcttcttcgctcccgcaaaaaaccctagccaactcgtctcggtcttttctccggcgatctccggtggccatggatctcgacaagactacctccaccagtgcgtcactgaagaaactgcaggaggatggcgcccttcccggtcgcgggaccgcggagagggaagtaggaggtactgaaccccaacctgtcctgggtcgcatggttgcggttgaggactttattctctgtggttttcttcctccgccttctgaatttctccttttggtcttgaatttctatggtcttttcttgctccatttgaaccccaactccatcgccttcctgagtatttttacgcatctttgtgaggcctacattggggtggagccgtttcttgacctcttccgcttttactatgagttacgctggatggaatccaaaaaggtgtccaggtgtgttggtttccgacttcgggatggcctgaagtcgcgatacatcccctttcagtgcccctcatgtcacagcaaatggcgggggaggtggttctatattcagatagaggatttggatcctgtcttcgttgtaccttaggaacagccagacaagattccatcttggaccaccaaacccgctttgaccccgtccctccaattttcatcgatatcgttgatgacctccgagaacaggggttgtcagggtatgaagttgctgccgacttcattggtaggcggatccagcctcttcaggctcgagcccattctgcctttgattattctaggctagaggacgcgacccaggtttctcctcggggtatttcctttttagttaaattgactcccttatgcgcgtgttcttcccggcttatcggattctgttctcgatctacaggcttgaatagcgcaactgtggagcgccgcatcggccaactgatgatcagcggcccgacaacggcgagcaacacccccgtccccggggcagccgagcgcgacgctgccatcaatgtaa

SEQ ID NO: 39158 - DNA, 1501 bp, Oryza sativa
cttaataaagccatactggttctggtgtattatagaaaggatcactttttgaattctatttgccataagtttgtcaaaattttcaaggatattcccattaaagaaataggcctgtaatcatttataatctctggatttagtttctttggcactaagataataaacgaatgatttaaaggatcaagagacaaagaaccagaatggaaatcatcacatagcttataatagtcatgacagattatgggccaacatttcttaataaaaagaccactaaacccatcaggaccaggagccctgtcagtaggtaaatccttgatgagctgatcaatctcttttttgaggaatggggtatgcagaatatccaaaccttcatgggcatcaataagtgaatttaaatcaaaaggcatatcctcaaacatggaaacccccattcttgatttataagccctccaagcaaccacagctttgtcatcatggctagttagaaatgtaccatccacatccagtaaagaagatatagtattctttctaaaagattcagtggccatagcatgaaaaaacttggtgttctctcctccgaatttggcccaacggatagttcatctcttttgccaatataattgcttatatttcaagtataagagaagcttagaacgaataaacactctgaaattccactcaagaagggacagatccctaagctcctctatactatccagaaagagaatgatagcattacagtttgctataagcttctgcaagttagacagattcttactccacttcttaagaccattcctcaaagcattgagctttgcagagatattcctagccgaatccgccagaacaccatgattagaccatatagaatggacaagatcaaaaaaatcctcatgctcaatccaaaagttttcaaatctgaaaatattggctcttgggatattggaacctatctaaaccacacagggggggtatggtccgaaattgatctaacaagaggcttaaccaaagtgtttaggaaagtgatagtccaactagttgaagtaaagaaccaatcaagttgctctaacaaaggctgttgctgcatgttgctctaagtataggccctgcccttaatagataattcaactagacccaggtcgctaatgacatcattaaaaagaaaaatatcattcatatcttaccctggcctatttctattcaacactgacctataaaaattgaaatctccaaggagaagccaaatgtcatcatctgcaatttgcaagctatggagccagattacaaaattttctctttcaacaccagcacagggtccatacaccgacagtaaagtccaggataacccagaatgactagaggaaaagcaaattttaacagcaaaactctaaatttcaatctgagaagcagtaacgacagagctattccaacagacaagaatactgtcagggttacgggtaaggtataccctctacccttcgatatacgtcacgtatcgata

SEQ ID NO: 39159 - DNA, 1501 bp, Oryza sativa
caaagtcttctcctgcaaaatcggactctccgggaacgtcggaatctaagcagaaaagaccaaaatcaccaaaacagtacataaacaatcataaacagcacatgtggatatttttaacatgtagatctcaattttagaaaaatttagagacttgaaccaactaaatctgagctaagatgaattagtaatgaatttttaaagattaaactggattaaattatttatttagattttaattggattatgacgcaataaagaattatatttgaaaggaaaaaggatttattgtgtcagcgggctcgggttcacggtggaccgagtgcacggaaacggtctacggatcgaacggctaggatctaatctaatccaaacgaacggccgagatcgatctaatccaccacgggtctacggctgacgtggcgctgatgtcgacgatgacgtcatcaccggcggcggctcggcacctcgtgctagccagcgaatgatggcgcggcgacgcaaacggagggcacctacgcgtagagggcgacgcggcgaactcaccgagggctcggacgacggcggacgacaacggacggcgacggcggcgaggtcgaagcggcagagacgttcgggtcgacgatgacggcgatgctccggcggtcttcgacagaaacaaaggacgggacgaggacggtgacgacttggcgatcccgacggcggccttcccgagggacgacgacgaccggagcggtggcggcgcacggctggactcgcggcggcgacggcggcgcacgggctaacacggaggcggcgctacaagcggcggcaagctaaggcaaaggtggccttttataggggctagggggcggcgatggaggcccacggcggccggcggcgagaaggaaggtttagggttaggagggaaaaacgaatccgaatcgagatcaaatccaccggtttccaaacaaaattagccgaagattccaaaagagaaaaggaagaggagatctcgaggatcatttcccctccattgatttgatcggatcgttaaagggtcgacggaattttggaagggggcggcgacggcttgcgcgctcttgggcgcggctacggcgggaggtagacgacggccctgacaggtgggccatcattgggagaactgcactcgcgaagttcatggccgcatctcactatgcgtatcaagtgttcaagatgccaggactgaagggaacaatcactattcaagggaacgctaagctggcagtacaatgcgacaagcggagcctcgacatggtcgagcacatgcccagcctgcctgccacagcagagccacccaagaaagtgagcaagacaaacaagacgccgaaaccagacggcgcaatcaagatcattccactctccaatgccaaccccgacaagaccatcaagatcggggcatcactaggcgagaaataggaagtcgcgctcatcaccttcctccgcgacaatgctgacgtgttcgcttggcagccgtccgaca

SEQ ID NO: 39160 - DNA, 444 bp, Oryza sativa
tttctcctttctgctatcaaataggatcaatgaattgttccgtgaatgctaattatattatgagaatttttccccgccaaaaaataaacgaatgaaatctgtagaaatatgctatatattaatcttgaatttgtgagaatgtcaacattcaacctttcgactatgaccctatgtcacactgattcattgtcatatctgttgatttccaaatttgcttaatcgatacatgttaaaatgcaattccaatatatatgaaaaataacaaaattgataaaatgtttgattatgctctggaaattatacaaaatgaaaagctcaatctatatgtaaatcattgattctgggtacttattcaactacaaaaggcattgccccagatcccaactttcataactttattagtttgtcatttttgtttttgatccttgcacatgatgacagtac

SEQ ID NO: 39161 - DNA, 1501 bp, Oryza sativa
tcggtcggacattagttggaaaagctttccgacaaaggtttttctggccaaccgccctcaaagacgcttgcaacatggttcagcagtgtgaagcctgtcaattcaacagtaaacacacaaagctgccagcacaagcactccagactatccctctcacttggccgttctcgtgctgcgggctagatatactcgggccattcccacgaggacaaggcggctacaggttcctattcgtagcgatcgacaaattcaccaagtggattgaagcgacacccacgggggaaaacaaggccgacaacgccatcaaattcatcaaagggatattctgcagattcggattgccccaccgtatcataacagacaacggctcctagttcatcagtgccgatttctaggattactgcattaggttgggagtcaagatctgctttgcctcggtttctcaccctcagagcaatggacaagtcgagagggcaaacggcatagtactacaaggaatcaagacccgcgtctacgacaggctcatgtcacacgacaagaagtgggtcgaggaacttccatcagtactatgggccatgcgtaccacaccgacaacgtccaacaaggacacacccttcttcctcgtgtacggctaagaggccatgctccccaccgagctacgacatcaaagtacacgagtacagaagtactccgatgaggatcaggaggagcagcgatacgacgatgtgaatctactcgaggaacatcgcgaacgagttgccgttcgagcagtcaactaccaacaagcccttcgccgttaccatgagaagcgcatccgagcacgcacgctttcgatcggcgacaacgtcctccgacgggttcaaaaccaagcagggcacaacaagctctcacccaagttctgcggccaggcgcattcaaaatcgcagacggcgatggccgcgagttggcaaattcctggaacattgatcaattacgtaaattctatgtataagtcaatagtatccatacttgtaagacatcttacagcctcaataaagcctattattcaggtacagacgacaatcaaagtgttccttcccgatgatcccttacccagatgacacctagcattgaaacctatcctcatgtccctttacgccgtcttgacaatgcctccgaggaacccaagggaacttcggctagggacgcccagagccgataaggccttgtcagatcctgtagagacgaaagaccatgtaagatctggtcgcgtaagagttctcgccgtgcgtattaaccaagccatgtaatcggaaataaactttccaacttcatggctgggggctaggatcagtgcttgttcaaccgaggcaggtcaaaggtccaagagccttatcttccgagaagaattctccgatgacaaggctgggggctagggagagtgtataactcaaacgactgatcgaagtcgcgaagtgagaagacactcatacacactacgtctagagtaagaaagcttagt

SEQ ID NO: 39162 - DNA, 1347 bp, Oryza sativa
catgttgagctggtttcagcatctcccctcctatttcgcccccttggggctgattctttcccgcactaaccatctccttctcaatggaaaacaatgctttcttagcctgttcaggtttgtgcatctgaaccgatttctttacaggactcgtcacttcctcctcctccccatttctggcctctcttccagtaactactgccccagaatccttcctcctccaagatggtgcatcactccccctactactgctatccccagatcttctctgcgctccccccccttccacccaattgtctcatgttacttccctcctcccacctcctcttttctgggatgaaccgcagttttttgctataacgttgctcttctccctcctttagctgcacactacacactttatcagtatgctatatgatcccacatgtatagcagaagtacggtaggaactcatacaccaggggacaccatatctccttcttccccttcgccaaactcagagttacaccacgcatcaggggtttacgaatatccagacgaacctttatacgaaggaactgccccacagcagtgccatccttttccgactccattcgcatgaattcacccacctctcccccgatcgctctccctatggccttgttcatcatgcataaaggcatctttgaagccctgatccaaataggaacaaaggcaaacaccatctcctccaaaacctttgattcatcataatccacgacgatcaccagatctttaccaaacatccagggtccatcctccagagcatgccgcttcccggatgctgatgaaaggtaaacaggaaatggttctcgcctagatctctgcacgttattcccctaatcagacaccagatcttccccagtgcttgcgccaaaccctccgcgttcaccactttctccgccaggaccttcccgatcgccttcggatcccctgatcccatacttccagactccgcctcgcagatccggatccccttcttctctgcctccgacaattgcatgcgcttcatcagtgcctgcatcgcctccatggtgccctccgaaccctaaaactacccctccccggctagcaaggtttggctcggctccaaaacagagaatctaaccgtggacacagaggaaggatgggatgtggactcaggatctagaccgaagagatcgatccgactcaggatctagaccgaagagatcgatccgatcaggcatgagaccgatggggttgagagaagattgaaaccctacccacgcagaacccaccttgagtcgcctaggaaccctaggcgccgaggacatggttggctaaaataaatttaatatcaaagtgaacaca

SEQ ID NO: 39163 - DNA, 591 bp, Oryza sativa
agcaaacagaaaactttcaaaagaatgacatgggagactagaggtaagattttgccagcaggctcggggacggtgatcccgggaaagagaagatagatggagggaggggaggaagtttcggaaagcgaaggaaggagggagagctaaagaatagtgaggaacaaaacccaatggaagcgggacttgcgatccagtcctgcgggaagaaatgaagctagtggcttggaactgtcgggggttgggaaaccgcccggcagttcggggacttctggatcttcagaagtcggaaaagatcgatattcttttcttgtcagaaaaaaaattagacaagagaagaatgcagtgtctgaggtggatgttgggtttggttaatatggtggtgaaagattgtgaaggacaaggaagggggggaattgcagtgttatggaggaggaggattgatgtgtctcttagaagcatgtcaaagtaccacattgatgtggatattgaagaggggggtggtggaagttggagatttataggggtgtatggagaggcacaaagtgatcttagattcagacatgggacactttgcgaagcttggcgatgaat

SEQ ID NO: 39164 - DNA, 1501 bp, Oryza sativa
ccttggcgaccttctccttcagcgacgccgccacctgatggtccacgactggcccgatgatatcagtcagagggagagcctacgtttcatgaagtcataatgcgatcccggaagaaaaatgcaaaaggacagctaagtacacttacattgatggcagcgtcgcgctcggctgccccggggacgggggtgttgctcgccgttgtcgggccgctgatcatcagttggccgatgcggcgctccacagttgcgctattcaagcctgtagatcgagaacagaatccgataagccgggaagaacacgcgcataagggagtcaatttaactaaaaaggaaataccccgaggagaaacctgggtcgcgtcctctagcctagaataatcaaaggcagaatgggctcgagcctgaagaggctggatccgcctaccaatgaagtcggcagcaacttcataccctgacaacccctgttctcggaggtcatcaacgatatcgatgaaaattggagggacggggtcaaagcgggtttggtggtccaagatggaatcttgtctggctgttcctaaggtacaacgaagacaggatccaaatcctctatctgaatatagaaccacctcccccgccatttgctgtgacatgaggggcactgaaaggggatgtatcgcgacttcaggccatcccgaagtcggaaaccaacacacctggacacctttttggattccatccagcgtaactcatagtaaaagcggaagaggtcaagaaacggctccaccccaatgtaggcctcacaaagatgcgtaaaaatactcaggaaggcgatggagttggggttcaaatggagcaagaaaagaccatagaaattcaagaccaaaaggagaaattcagaaggcggaggaagaaaaccacagagaataaagtcctcaaccgcaaccatgcgacccaggacaggttggggttcagtacctcctacttccctctccgcggtcccgcgaccgggaagggcgccatcctcctgcagtttcttcagtgacgcactggtggaggtagtcttgtcgagatccatggccaccggagatcgccggagaaaagaccgagacgagttggctagggttttttgcgggagcgaagaagacgagggacgcttggaagctggagagttttttcaacaggcggacctcaaatgggatccccaaaactcccttaaatagacgcacctccgccggtgcgaattccaaggaaaggagagagatggccgccggaaatttctaggtccgttacacacggcagtttttcggacttcaatttacattcactcatgaccgttgaacttcactcgacgttgtcgatcactccttgtctcttggtccccacaccgagaacaacgacaatttcgacatcagaagtcgcaatcgatttcacgtgttcatttaagcaaaagtcgggggctactgtcagggttacgggtaaggtataccctctacccttcgatatacgtcacgtatcgata

SEQ ID NO: 39165 - DNA, 433 bp, Oryza sativa
cgaaccagacgtgagactggggaagagaaggtggctgcgactccgagggtggtggcaccgggttcctgcccagctcggctcgatgaggaatggcagctgtagttcgctggcgaggtatagatgtgaggagacgaaaagagagcaacagacctccggaatgccaaaggagggggagaggaggttgcctaccctttgtaagccaaggggaggagaggaaaggccgggggagctctccagcctgccatcaatggcaacagttcgtcggagagtaaattcgggtaataaaggctaaattaagagggagaaacactgggaaatgataggaggaggaggaggaggagaaccaatttttgcaatcaattggaagagcaaacaaactgggaggaggcagatcggcgtgggcggcacaagggttttggccggtagagtgaaa

SEQ ID NO: 39166 - DNA, 1142 bp, Oryza sativa
tatagctatttacgatgggatttgactcatcttagaatatagaatttgaagagacctctgctcagattcgttattataggatgagtcaaatttcattctaaatagcaatattttaatattttagaacgagaacgcggtagcatcccagtatgatgcagcatgtaaccgaaaatgctgccattgatgacaaagacaacctggaagattactgttgcactttgtaactgaactaccgaagctgatggcagcggtagtagaattcttgaattgtctgttcatgatgccctgcaagctaatgcattcagttggagtgattaaagtaggcaataataccatgagtaatgtcattatttgtatcggacaaaaaaaatgtactacctctgttctaaaatctatacataatataactaaaatataaagatagaatcgaatagaaacaaatctgagcacgtctgttcaaatttatcgtattaggacgtgtctaatataataattataataatgtatcttatgttttgggacggataaagtaaattacttgatcagcacactctggtgacatgacagctgtaaagttgactactgaattcagtggaaagaccgtgagcattattgttcacggctgaacacaaatctgtgggccacatcgtgaccttctccggggcccacagaacgcaaccgggcccttctttgggcccaaggaaaaatgggctgctcttttgggcccacgtgggccattttgcctccgttttgggccggccgtgaaatggctagagctgaaattgcaggtgttgatgacgatcgaaagctggatgctaattcaaaaaaaaagaaaagaaaaagaaaagcttggatgctgcacttgtaactgaagctggtgacagcaatagtacaaccttgaattgtctcttctgatctgctgatgcatttctagataatgcatatccagcagatttgggtgattaatccaagtaatgatctcactccactgatagtggaaattgctggcttcagcatcaaaaactgcattgtatgtttgttttttcgttcttttttttggcattgtttcagcttctttatatgaagtacaaattctacactccagcttggccttaaagtgatcgaacacctagcttgcacgg

SEQ ID NO: 39167 - DNA, 1501 bp, Oryza sativa
caatgcagcatggtgatcttctcctcaattaagctccatcgcatgctttcaatttggggcagctgggaggggggggggggattgaatgcacaaagcgacccatcaaaaaggtcccagagagaggcatccccacaataataattagtaatcccagtctcacatatatgacaagggcccctgattaattgttcagttaatgactgggaaatggtccatgacctgacctgactccatcctctctctatctctttctgtgtgtgtacaacgctgaaaaagattttgtctgcttgtaaactggacaagaatctcttgttgtgttgcaggaggagtatgaaactatgaactgtttggctgctgcccctgcttctggttagaaagagaaacagaagaaaggacttggttatgctaatcattgctggttttgactgacaggtttgcttcctggatttttgtcaatgttggaaccccgacaagtgcccaggattaatttgatctgaaaggtcgtcaaattttaccaaattaaccccttttacaatgccgcagtaattcctttacggacttacaatggcatgaccaaaatggttgccccaaaatataagttggagattaatcattttaaaaatagaataatagtatcaaatgataaacatgttgctcgaacatattaggcaggcacaactgttgtaattgcctctgtatgaaaatatattcgactcccagcaaaaaagaacagagaagaacggagattcatcccatctcagttaatttaaaacaagacgatatcctgccattaggaaatacaaaggaatgacttaactgcatcaaagagaaactatttacacttttcagagctcagcccatccaaacaaactgtcttgttatcatgggcctaatggaccattattaattcttaaacaatgctacgtatgatatatcaattgggccgcataatttttacttactgggccgtacgttcacttggatttcttagaaacaagtctattttgcctccctcatgttcttgcccttggtcgaatcacatccctcaaccgcaaaaccgggtataacgcctcacccatctccgaaacccggtgcaaatcgactcctcaggtagttttgtaagcggttttgtcctatgtggtgcttaggtggcattctacatagaaaaaaaatataaaaacatgatagtggccccacatgtcagtctcactttctccacctctaccctctctctagtctccctttcttctccggggtccaggactgacggctggcgaagaggagaggaagaggtcaggggcggtggatccgccttcttacactcccacaccttggcctctgcctcttatccatggtggtggagctctacctccgcctcctatctggttttgctatggattaggctctagcatgcttctcctcgaggcagtcctgcgccagccatgtctcctctgtgagttagcaaaatatcacaaaatatcaattgactaatgtgtgaagg

SEQ ID NO: 39168 - DNA, 1295 bp, Oryza sativa
catccatagtacttgtactcctaggcaaattaagcagttatgctttgctttcctgcaggaaaatgtgatgctgaaggagcaactggcaatatatctgagagagaacgctgttctgaagagggcggttgctatccaactgaacgtcaaaaagagtttgacgagaggactcaggaggttcatagcctgaaacaactggttttgcagtatcaggaacagataaaaactcttgaggtactactccttactcctggtgattcttttgtcccgaacactactcccggtgattttgattgttcttacataagtatatttaacattgcagataaataattatgcacttagagtgcatctgaagcaagctcagcagaacaattctatgcctgggcgtttccctcctgatgtcttttaacagatcttgagggcaatattccctctcatagtcttatactcaatcataccaagatatcatatgatgcaaggggttgacctattgctcatggtgtggttagacacttagactattcacccttacgtccaaatcataaacaagcaacgatcctcaaaatggagaaaggcaagcaacggtgaagcatcaattgaggtgtagattaatgtgtgcaccaggaagcttgagtgcttgacccttctctcagaccattgattgtatgtaaagtatggtgagatgtattgtagcatgtaattcaaagtatgaaaggacctgttcactgtattgtagtagcatgtaatacaatttatacaaagcatgagaggatctgttcattgtatcgtacgtatccactgatatatttattccgataaaagaatgcttatcagatgaaagtttccattgttccgtacttttaaaaatttatatcaatatttttatccaaatttcttcttggagaattatgtggagcatgaatatgcctgtctttagttttcacggttttgatttctgaatgcctggtgattacagaaccagagtatgactctatgggatacctgcaccaatatcctgcacgatgactgagcagtttaggactaatgccaattgctatcgacattgcaaggtgcataacattgatcctgcttctggacctcgccttctctgatagtctgattctctctcttatgcatgtgacatgtgacgaacacaaacaaacatgaacacataaaccattttatttagcacttaatccattcgatccaaccaggttacattttcacataattaaggctaggtagtagatgcggtgcacggctaggtgccaccattgccgctcgaggcagctccc

SEQ ID NO: 39169 - DNA, 1501 bp, Oryza sativa
tgaactgattattttggaaattccttttgtgaagctgaacttagtgttttcaggccagatcgatgcatggtaaactgtttttagtacagtaggtcgtaatatttttttgtaataactcataaatgtattaattaatcaggtttgcttttacggttttgtaacaaattaaagattgtgaacggtgctccaggtttctttagaacaacacacttccaatagtattatccaaaaacaacttcttgacacggtgaacactactccaggcctctgcacatattgagaatgtgatatcaccatgatgttcaccttgccactaattcatactcatgaacaagcccatctactcggatcgatgttggactaccttcaattagcctcatgtctccagaatatgaagaaccagggaagggatcaacaagatactaagttccttacatacatatatataaggttcaatagaaacacaaaaggagaggtgcaagtcgatctattatgaccagaagaaagagtacagttgtttgtatttcattttcttcttccaagccgatgtgctctgcatggagcttacagttgggaagagaactcaactagctcattgcattcttcttcatcaaggataaaattaattggattggatgcacaaaagtagtttgcagctagcttcctctaccaatggaaggtcatccatgcatgtcctcttggatcaacaggaacagggatcaaggatgaactcgtggttcacaaacatattgaagcagagatacctttgcataccttcgtatatagtaatactaattactatctccatttcatattataagtcattttgatttttttctaagaaaaatatagcaatatttttaacataaaacaaaggaactatcaaaaatatattcaatattagatttaataaaactaagttagtgctataattattactatatttttctataatattggtcaaattttcaagaagtttgaccttacaaaagtgaaagagaattataacatgaaacggaggaagtactaataaaatatccgttagaaaaagagtttaggggtacaaatgaatgtatcatgctcaccagatcttgtgaacgtgagggtaggtgctaacatcaaaatttggtaagccccgaagtcatcatcggtctagagtcagtatcggctttagagtcctggaatcggccgatgggaattatcaagtcttcaatagttggattctaagtagaatcgattaaagaaattaatatattaaatgaagtttatccaaaagtgaccgagtttaaaggaggatgcggcatggcagtttatctattaattaggaagagtctattagtttccttttatctttaggaaaatgtgtttagtgtctgataaagactttatgttttccttttatctttaggaaagtttctttcttgtccaagaaggactaatatctacctatgggtataaatatgtacaccaagggtcattgtaaactatctcacgatcaata

SEQ ID NO: 39170 - DNA, 333 bp, Oryza sativa
tggacgtcagaacgtgttgatcaagcttaaactatggtgcgttctcgtttaaatagtttaccaataggttgccaaaagtcatcgggaatgttgcttgaacccatcgctgctaaagtggatcattccctgatagcacacaccaaaaaagggccagtgatacaaggagataaagggggataaaaagaaagctgccttgcgaaccagagcaagggatatctctaatctcttcacaaaaacaagagcaaaggctaactagagatgacttcaagtttagcctgaagctgtccggccaacgaatgaaaaaagaagattcttaactcaatggaaacagga

SEQ ID NO: 39171 - DNA, 446 bp, Oryza sativa
ttgttttgcgtgagattaagacggaaattcgaggcgctgtaatgattttgtgcactgttcgtgtagaatttgagttagaaggccgctggactcttacatcacgcaggagaatttcattgctgaagctttgcattgtgcgttgcctttgcagttgtttagtttgtggtttgcattcttgtgtacttgtgttgtttggaaattggaaagttctagagtctagacatcttaagatgtcagatctctccactatgttaaatgcattttggttttgtggaagacaggtgcttgtaacaaaggtgaacactttaattacctagttgatgcgccgacactgtgaactctgtgtagaatcattgatgactaaattctaatgctgacaatgtgagcactagcacaactgttttgtatcttgtactcaccattctcgctaccttttgtggtgtagt

SEQ ID NO: 39172 - DNA, 1319 bp, Oryza sativa
aatctaaaaatggagtctttgtgggacggaggaaatattaattaaactgtcagataagtcaaaattttatgtggcaccaaaattaaatttctgttcgtactagtcacaaggctaagcatgagagtttgagaggagaggaaaagagaaaattgagaagatatgcaaaacgagttcgcatgatttgttgagtattaactattttaaattgtaaaaatggattaatatggttttttaaaagcaactttcccatagatttttttaaaaaaaacacatattttagtagtttggaagcgtacatgtggaaaacgaggtcttttctctctcgatttcccagcaacgaacaagttagagatgttgattcatgtaatgtgcaaatgggatgttcaggacaatggtaataatacttttagaacaatcttccccttcccaggtggagttccatcatatgatggaatgggggggcagtaaatacaaaggttgtaaaagcaaagatggtgatagtagagaggggatttgggaatgagatcaaattgtgatgcaatcttagggattaactaaagagttgagagaactttttgttcatatgggttgttggttctattcttggtgttagatggtggatattgtcatgtcctgataaatctcaagcactaaaatatgcctaagaaatattttaaagtcgctttgattatttttcttaaattctccatgctctaaattggttccgcaaattttatttgaatttttagaacacctaaataattataatgcaacatcaacaaatttcaaagtttattaaaatgaaaaaactaaaactaatcatctccttcactttgggccgaatccagcccaaagctctcccttccttcttcagcccgctgccaaagtctccttttgtatcatacccttcctcctctccctctctttctccaccaacctcttgggccatcctttcccgctgacccaacctcctcttccctgctccttcccacgccctgcctctcgcgccttgtcgatcgccctcgtgctctagcaggtggggcccacgtgccaagcgcgtaccctagctgcgccatttcactctaccggccaaaacccttgtgccgcccacgccgatctgcctcctcccagtttgtttgctcttccaattgattgcaaaaattggttctcctcctcctcctcctcctatcatttcccagtgtttctccctcttaatttagcctttattacccgaatttactctccgacgaactgttgccattgatggcaggctggagagctcccccggcctttcctctcctccccttggcttacaaagg

SEQ ID NO: 39173 - DNA, 1501 bp, Oryza sativa
tgctacagcgccaatttttccgtgtgggtgggcggattttcgcgtgcgggtggacggcccgcacgcacccagtcgtctgggaaaatcgcgattttcacgtgcgggtggtgcgccagcacgcgaaaaccgatttttgcgtgcgggcgcttaagtcgcccgcacggagcaacaaaaaaagaaacaaaaaaaaagaaaaaagaaaccctagccctaaccctaatccgccgccgcctagccgaggcccgccgccgccgtcgccgtcgcccgccgccgaatcttacatcacaagaacacacatcacatgaacaaatcacacaaaaaaacacaagtaaaaaagagaggagggggagagatagatctggtcgccgacgcatgccgccgctccgccggatctgcaagggaggggagagagccgcgcgtcgccggcctgcaaggggaaggaggggagggggcggcagcctccggttccaccactcccaagcccccccctccgctggatctgcacggggagggaggggagggggcgcacaccgccgccgctgtcgcccgtggccgccgccgccagatccgctgccctctccgccggatctgcaaggggaaggaggggagggggcaagcgccgccggatccgccgcccccaagcccaccctccgccggatctggtaggggaaggaggcgagggggcgcgcgccaccgtcgctgtcgcccacggcggccgccgccgccgccgcatgctctcctcccgtcgctgcacccgtgctgtcgtggaggggagggagagggagggagagagaggagaggagaggagagtgggaggagaggagaggagtggagtgggagtgggcggtggctggtgggaggggttaaatggtgggcccgtgcggtgcgtacggttggcttaggacgcccgcatgggaaaatcgattttcccgtgcgggcgacaccccagcgccggttctcaatttttctgtacggttccacttacgaaccgcacggaaacaaaaaggggaggcgtccaggaaaatcaatcatatagtagtgtaggtacacatatatgtttagattcattagcatctatatgaatgtggacaatgctagaaagtcttacgttatgaaacggaggaagtactacaaagtatctctatcttgtatagccagttagccacccacgctctgcttctgtctcggccaccttccttgcatgcaatgcaacacaacggcacgccacagctttactagttcagctgctgccgctgcggtccggctcctagacatgaccatctgatccactgctgcatatgatcagcctgaagctccttgactgcagcaaataatccaagcacatgtcctcccatgcatgtcaaacagccagtgtatgtacatcttgtatgccatctgcacatatatactatcagtccaagcacagtgatctcagcgacatcggtacaactttagtaacctaaatgctatagctagcacacatgaccgatgcatcacactg

SEQ ID NO: 39174 - DNA, 1501 bp, Oryza sativa
atgtgctcagatcatcagcaggggtactgtacaattgcatatcgccttgcagaaggaaataaattagtaaacgtcaagatgcattaatatataccttgatatcagcatatatatttattatgtcatgttagtgtcaatcagcgagtaattaacgcgttaagcgtacaatactggtgtacatggcgtgtgcgatagcacacatacgtagccatcaaactcactcaccattaagagtaatcgagcagtagtaattacaagtatacgtactgctaattaatcgctcagagcaggcaaacgatgttgatacgtgtggccgccggccgacgcgtttgcagaagatccggggcggatcagacgcttgcgtgggggaaacaagaaggtgttttgcttgcttggggttcggatcatctgcgccgcgtcgaacgccggacgcgccgtgcggccacacgcggcggcggctgtcgtcgccgtcgccggggtgtgcgtgtctggtgttccgtgggtgtgattgcatgggagctgacctgtcagggacgacgttgtccacgtcgaatggggccccgtacgtgggccggtgtggcccagttgtcacgtaacgtcgccgtccccccgtgttcacgggggtggccgtgtggggcccgcatgtcagaggctggggccagaggcgtttgtccgcttgatgggtgtgtgtcgagttgtctgtctgtcgaccattctgcatgtacgtagctttaggttgtgctttcagttcttcagtgtcgtcggatgggatcgtctccggccggccggtgtatgtcttcgttgttaggttgctcattattgtcgatggtatgcatggtcaactggctaggtcgtcagttcgtcacggcggctccggttacgtgcatactgttggtgtcatttgcacatgttcattcattcattcagttaggatgtatgagtggctgttaattttcttgggacaaatatttaaggctctaagatgggtatatcatgtatgcatgcatctctgttgtggacttttggtgtttttgttgttgtgtatggcggattggctaatggatagctccgtttgacagttccttagcagcatgtggcacagtggcagtagtcactagtcgtatacaggtgaactgtacagtaggcgtatagctgcaagcaagcatgtgggtagtgtcgaaagtgtcggcgacacgctccagtgcctacccgacggacgtgctcccaggaggcaagtaggcaacgtcagagaatccaagcagagagagacacgccgccccgtccggtctttgcaacggggccgctccgtcgtgggctctagtactacctgttggcggctactgtccgcgaagatgaaagtacaagtactccactcgcagtcccaggcctcggcccaaccagagatgctgcggccaaggccgtgcaaaaaggccggtggtttcggtgggccgcctacccatcgtcgccgtcgcgtttgccatccgcagcggccgcgcggtga

SEQ ID NO: 39175 - DNA, 1501 bp, Oryza sativa
tccataaatccccacaagtcactcatgctgcattatttcactatttcctgtggttcattgcatgaaatccaataaggcactactcaactttgacatacagctattaatcgcaggttcatacatatagattatattctaaacaagatttatgatgtgtcatgtcaaactggatcagtatgtgatagcttaacccaatataatggatttactgcaagaaatggtaggatgcggttagtttaatgttttatttttcatagtacaagtacaaaaagtatggtcagttaagttacattctaagcatgggaaaaaaagtgagaaacttaacagtgtatccagggtctatggcttcatctgaattatctttgtacacaagttaattaaagtcttaaagattatacaaggtggataaggcatcttactaaacttgcacagagtataaggaatgatgggcactcgcaaatcatgggtcaaatactaacctttttccactttgcaatcagattacggtctgcataaccctggtccaggcaaaactcatacaactcttttgatatctccttccttctgtaataaagatcatatatgtagcgacttctttgatgggaaatacggaaaattggccagagggcttcgcactttctcttcccatcatgcgtgtcattttcagctgcatgagtagatgatattagtatccatataagagcagaagtatcaataaacatctgaaaggggagcatatgtcataccttccctcattttggcatccaactcacggatagttggttcaataagctcccatcctccaggatatttgacacggcttgtctttattttaggcatgttctctcaatgaacgtcgaggggctaaagcttgcaaagaaaccctgaggacatagagtaggtgtaagattcacaatgcaaaacatttacacggtcaggctcttccatcgaactcaagagattataagaacataatggacactacacactattacatagaatttatccccgcattgaagccttacatcagatatgctatatattccttactataaaagaactgtgttgaacacaaataacacaatttaaacaggtattttgcatcttcaggctaacagtcttgtcgaatcatgatttaaccctattttgcaagtacaaaatatgtgcacctcgaatcggtgaatggacggtctaatacataaagaactaatcgacacgatgataaaaatcgcggaaaaggttccccaaaccctaggctactcggaagaatttttttttgagggaatactcggaagaatttcgtcccaataaccacatacgagagaatttcgtcccaaggaggagacgaattgaacgaatccaataaacagcgaggtagaaactactaaaatatccagcgaagcgaatcatcttcaggcaaagaaaaaaaaaacaaaatcagaatcatggaacggaagacgaataataacctcttggcttgggcggccttgcagtcgccgga

SEQ ID NO: 39176 - DNA, 547 bp, Oryza sativa
ctagcccccggccgccgccacccacccctcctctcaccgcctcgccgccgccggaaaccacgcggacgctgggatggcggcggcggggccaaaacccccgacggcggctcgtctccggcgcaaggaggcggcacagcgcgccgcgaaggcctcgcggcgcgtggctgcggatccgccgccgccggatctggcccttccgtggctggatccggcccgtcatcaccggaactgaccggtgagctgacggagcgggcgacggcggcaggtggcgtgaggacggcggcgtttggcgggggagacggccgacgggagacgcgggcgacgccacggctggaacttgctgacaggaggtggtacggctccggccgctgcgggtacctccccctccgccacccaccacacgtcgccccccggcagattcaccgcctgcctgctcgccgtcgccgccatcaccaccatcttcgccctcgccctcaccctccaccgccctgacctctccgccgcctcgccacggtgagcgcccgcccccccttgctccctccaccaa

SEQ ID NO: 39177 - DNA, 1059 bp, Oryza sativa
aacatattttatgtaattgatacttatgaattttgagcctaaaaattgagattgcatggttttatgagagaagaaagaagagactatgtgtaccatagatctatcatccaaaggctagaaataattgtgatgtggcttcatgagagaagagagaaatagcattaactacacttagtggggatgaactataagtatataggattaggatgatccaaactatgatgtgataatatcttggtttttgggttaagggtggttgagccttatattttggaatgtagggaataatttataatattgaccaaccatcccaaattgtcttattggtttacatgatggtttttatggaatacagaaagctccagtaaaatataagaaaatgtggatgatttacatgatactacttttggtttcaaaaaagaaacaacttgtgtttcttagttttcattaagtcaaatcttacatagatattgcagcctacagagtaatagtcatgaaggactttttgtctattggatccaaccataaaacctatctaattttattatgtcactgtgggatgcatcctgccattagcttctgttcctatagttcaaggtaaggtctaaaggagccaggtgtctatacccttagttagcactatgaattcccgtagtctctcgagaaaacaatgtgctgaagattaaggttaggtcttacagacacttcacacaaatgaaaattgtgtgttactaaagcagcaagtgcaacagcaccatttaatcaaagctttcactctttcagcatatatcagctataacatttcacattatcatagtgcaatgcagaaactagaaaggcggtagaagtacattggaaagaaaaaaactacatgcctcaaagtttgaagaaaccgttggagtagaagccaaactacttttcagagcatctgaatcagcagagctaattaatgatttagtaaaatccctgtaaaataagaaggtgtttcagatagcagtgcttgcatgtaggtgtgcgcacacatgtctgtacagcaacctgcacaaacacataatctgt

SEQ ID NO: 39178 - DNA, 1501 bp, Oryza sativa
ttgatgactaggtcatccacatgcactaccgcaatgtaccctagctgcggatgcaaggtatactgacaccacgtgctacgtacatggagccggcattttttttcatagcagtaccttcctggaggggttacaaatgaagggtttagtggctgacatgtggtggcttcctgccgtggagggcagcaagcatgatgatgtttctacaataatttacttgtacttactttaaaggtttaaaaatataccacagcaaaatttgctttacgctgaaaattgtgaccacaaatggccctcctaatctcagcttgcatgtatttaggtcttgcatttccatttttttttactaactcttgctttgtattaatggtagttgcatttagaatttgatgtaggtgatgaatactttaatgtgcagagtgacaccaattttcatgatgattataactagtcagttgcatgtacgagggttggacaggctattgacgcgaaaaacacgaaggcatgggagatctgcttaactttagtgcaggtcctaaatcttgataagatgtgggcatgtcaatcaatttgatcttgcactgacaagatagataaatatgttgacgatcaaaaagccgatgggctaacaagccgatgtcgatagggttttcaacaatcggtttgaacaaacaatccaatcggtcggtgataatatgatgaaatataagtccaatgaagcaaccggtcaatattgatacaaaataataaatgtaggctcagtggttaaaacatacattggctggaagtccgatgcaaagataacatatcggctagcgctctgataaaacactggcatgaaacctatcggcttaacaagacttagattatcaatgacaatttagcagctcgaacctaactgatgcagcatgggatttgtatataataatctaatattcaatgagccaatgaaatctatttaatgtgatggatataacaaatttatctaaaacaatattgtgattgtagagatatctcaactaaggccatgtttgtttcagcttaagattattgtaatctacattattaaatcggattactctaagctggattatagtaagctaatataaaataagctacgagttgattgtttctctggattattagaggcatctaagggtagtgggtctttagccactcaataatctggaaaaagctcctctagaggagattattggattatagtaatctggcttatagattataataatctagcataataatctacttgtttgtttcagcttactcctaataatccagattataataattctaagctgaatcaaacagggcctaaatcagaataacagatctaactgagacagtcctaagtaaaccgattcatctctaaacatagtgcaattagagatacaattgaaatatcatgtaggcaaaatataccgatacaattgccagggccagcaaaacttaggacttaccccttcgctggagatcgaagccgatg

SEQ ID NO: 39179 - DNA, 1501 bp, Oryza sativa
aggggttatcaaaccatcacaaaatacaaaatgcatggggaattttggtggataggccagtgtagtccatggacggaaccgacctagacaccaaaattctccatgcattttgttttctgtcattatttgatgattaaggaactttgcagattatctaaacttgttgatttatataccctttttgtctatgaataggtcaattgcatgaattgttgtttatatacatgatttatatacccttgctgctgctgccacataaatgattgtgggctgttttattatttacacttgcttgaattgaatggatgaattgctgtttacatgaagttagtagtactgtctccttttttatctacacccctgctactgctgttattgtgggctacttgttaatacacctgttccttgttttatgttgttgctgcccctgtggagtatctttgcccctgcttctgctacccaatgtgttccttgttaaatggccagtgatgaattgctcaataagaacagattatctacacttgttcatttttttatctattcttctttttgcccctgttgtggctcaataagtaatgaattgctcaataagaacagtttatctgtacccttattgtgggctgttttttaaatttgcatgattgactcagtggttatatacctctactcttgttctttatggataagaatagagtatctacacttgttctttttttatgcataagaacagattttctgcacttgctcttttgatgttatgatttcctctttttatcccttcatgcaaatgaatataattgatgcatatttctgagcaaaactgaggccatatctttcatagtatacctcgtattacatgattttggtgcagtgaatcttgaatgtggatttaagtgcaactgctgctgtctatgtttgcccttgctgtctatgtttgcccatgctgctgcctatggttgcaactgttagttaagtgcaacttgaatgtggatttaagtgccatttggacatataaccattcatggagtgtgtactgctatatatgttgctagacctattgaattttgtggatcatgtttacatttagccgaaaaaggataggtcagtgtagtccatggacggaaccgacctagacaccaaagttctccatgcattttgttttctgtcattctttgatgatttatatacccttgctgctgctgcccaatgtgttccttattaaatagccagtgatgaattgctcaataagaacagattatctacacttgttcatttttttgcccctacacttgttcacttgttccttattaaatggccagtgtagagtggttatatacctctacacttgttctttttttatgcataagaacagattttgtgcacttgctctgtttttatgcataagaacagattttctgcacttgctcttttcttctggattgataagaggagtatatctagacatgttgttttagttaatttgcccctgctattgctaccc

SEQ ID NO: 39180 - DNA, 309 bp, Oryza sativa
cgccgcgccctccgcctcgacgacatggagccggcggcggcagcgccagaggcctcggtggcggaggaccgcccgccggcgcctaggcgctgctgcgccgccatgaccaagtcggccacgtcatccagccaacgtcgggctggagtctctggatcggggacgacgggcgggtgacgcaggagcgcgcccgcagcctggagcgcgccctggggcgtgccgccatcgccgtagacgaggcggcgacacgccccgtctcgccgtcctcccccgtcgcccgcgggcggtgaagtcgcggttccttcgacctcc

SEQ ID NO: 39181 - DNA, 229 bp, Oryza sativa
ttcactatttctcacctctccaaaatcagcaacaattttacaggctttggatatcttcattaactccggtctgaaggagttttggagaatatgaattacaggcagctgcctaggttgtcagcaaatccgccactggctgactagagaaggggttttggatcacaaatttatcattttttttctaggatttcagcagatgcaatatatcatgtaaacagtaagaggcata

SEQ ID NO: 39182 - DNA, 1501 bp, Oryza sativa
aatatgtgcattgcacgtgcacgattactagtaatgtcttaaatccatagttttgtgatcgtttagtcaaagtatatttagttttgtgaaatttactctttttaattttgggttaattagcggtgcctgcaacgtaatatagtatctgagttagatggggaaattagccttattatcaattaatttagtaattgatccgctttgcatcaaattgattgtgaccaacctagtaacttcaatgtgaattttgaaacgaagatttttttttaagaaccaccaccatgtgcctgccattagttgacagaggttcacacgccttaatttagggctgtcaacgagccgagctcaagcaagccagagcgtaaggctgccttatgctagaggttgagccaagcttattccacctttatgctttcaggcgggcttggcttaagtacgtgataacatatatttgatgataatttcgtagtaaaaaaacaatttagaatgtaccagcccatataaccagactcattagatgctttcagctcagctcaacaaattttgcgagcttggggttgggctcgagctcggttcgttaagagctcgagcaactcgcaagccttgagctttattattattgttgttattttacagccttaggccaatcctccgtatgcaccaaatgagcgtgcaaagatgcaaaagcatagcgagatttttctcatgaaatgtattgggcaatatctgtcccttgcaacttataagttataaccacaagtccacaactccgtaagtatacattggaacatgaacatcagtgtcctgttaaaggacttattttgggccctccctctgtttattggcatgaagaccaaagcaggcataaggcccacctggcctagtccagtctgataacatcatacacaaggctcaggccagatcatatgccagtgtctcgcaccaattacattgtcaaacagcagggcaccacaagcaataaagttctactaagatctcaccctctttagaaggaaaataatttgttctgcaatctacatatggttcttgtatttcatttggtttcatgtataaacgacaacaatgcatcaagtacagcactaatctgacaggcacaatgcaagaccagccaaactgcacctgctaagtaggtccatgacgcaagatctgctccgggtgatcaccaccaaaaccaactttccagcccatgcttcgtcaaggtactccaatacatctagagtgtattcatcatctaaattattgttcataaacctataggccccaaaaagcacacaaaagcatggaatatactttgaaaaactccaaagcaaatcaaaagcatagaacagaaaaagaagtttccacatgctaaggaatatgctaaggaagatacctcatttcggtctgcgaaaaggcactccaccacctaagcttccactttgtgaaagaaacctcgtgtactctctataaatgaaaccaagcacagcatcttccatggagg

SEQ ID NO: 39183 - DNA, 1055 bp, Oryza sativa
attcctgcagcccctgctcaaaaaactactactataataaaatggctaaatatgccaattttctaccactaccgaatctgaagttcaactgatgtgctttatttccatgttagccttgatatggtcagcccaccagtattaagattaacaaattgcatgtcatatttgtgagaactgaaaccgcttcttttgaaatgggctctaattgttgaaatatgttttttttcatgtctgtgcatgattggagtatctattttttttcggctgtactgaaatttggtttgcgatttaacctgtgaaaaatatttctttgcactgctctatatcttttattttgaaagcaacatcccgaggatgaaggctcttgtactaaagaaaatctttagttcctctccttgcaattttttcggttcttctttttgtttcgattaatgaaaccaaaaattcttgaattgaaggaaaacaggtagctctactatgtttatggtctttcctattgaagtaggaattcataggtgtgtagcagtgctcagcgattgcacgaggttggttctccacttctctgcatcagattggatatatttcaattgcttggattttgatctatactgacttccttttagctaaaacttgattactgataacaagttctacacagtgaaggggatgcaaaagatggtgtctccacctctgactccattcatgtaatcatgttcatggtctgctccattgagtttatttttactggatgcacatccttccattagtagttcttgcatgaaactgcaataagtagcattcatatagcattctgttgccagtatcttcagtaaagcatgtattgtcatttgcttacctcttttgtgttttcttcttttgatgtgtaggagaccaaaaaacaagcgtgtacaaacgatggaaagagaataaactatgtcaaacgatcaagattgcatcgctcatcttttgccacaaacactgcaagagagattgatttacatatagtgaatgaatcaattctatagtctcaaagatttatctcttggttttcttta

SEQ ID NO: 39184 - DNA, 290 bp, Oryza sativa
cagaaaaaataatgtttgtcggcaaatctctatcattggggtctgatggtcggtcggtaaaaatatgttggtcgggaaatctctttgctgactagatttcttgtgactgttgaagttggtcaggaaaactttggatgatcgacaaattgtatatgaatgtggtctttgccaaccgatttttccgttggggattttgtgtcatgctgtagtgagggcgcggtggctgttaggatacgcataggctatgatagcataaataaaaaattttctactatgtaaatcaggaacta

SEQ ID NO: 39185 - DNA, 200 bp, Oryza sativa
ctgccgccgccgggccttgtcgtcctcgtcgtcgtcggcggcggcggcggcgtcggcctcctgatccggcgcgacgaacagcacgacggggccgagggggacgtcgtcggtggcgacgagcagcggctcgagcgcgtcgacgacggcggacatgtcggggcggttcttggggctcccgctgaggcaccggtaggcgacgg

SEQ ID NO: 39186 - DNA, 183 bp, Oryza sativa
ggtgagagttcatatgagatcaacgggctgggaacttttctgaattctgataagcatatgctcgtgctttactatcaaacctacccttattttgttaagctacgtggatacattactctgttcaatcttcaatagcctaacgttgtttactaatttcactgaactgttctgcattttactagt

SEQ ID NO: 39187 - DNA, 261 bp, Oryza sativa
gtctccaacctttcaatcactgcgtacttatctatcctatcagtgccatctcgatcgttcgttttccttgcacactaatagtactagctctttttctttactttattaactgctaattaaccagtcaacacaatcaacacacagatgtacgtcagagcccagctagctttacatgctccattggaatattacactttgaagagaaatatggtaagaataattaaacctagcttaagaccagtgatctctagcagataaaca

SEQ ID NO: 39188 - DNA, 300 bp, Oryza sativa
gggaggaactaattaatctgatcatgctctctcgtggtcaaatggttagaaaagtacacacacatccacatctagaagcaagccgggccgttgttcgtcgtgctagctcgatccatttcctacgtgtgcaccaaaccacaagttcagctttgctgccatttggtctttctaactctctctatatatatagtcatacgcgcagcatatgtgcagtattgttgcacagtgcagcggatatacagatttcgatcggcgacgttagtgatcagctgggttaattaattacgtggctaattaagc

SEQ ID NO: 39189 - DNA, 316 bp, Oryza sativa
ccatccatcaatccatccagtggaagcaatagaatgcttcagagcttggacaccgtcaaattcagcaagttgatggcttgaggctgatgccttctccaaccaaaccaaagcaagtgtatcataaattttttgcactggtatgataactggttaagatgcagagactgaatcttccatagcgaaaaaaaactccagcatccatggtagcaaaaaagaaaagaaaagaaaagaaaagaataactctgaagaaaattctgcagaaaaacgtgtgaattcccggagtttcaggtcgctgtcatctgattgctgcaactaa

SEQ ID NO: 39190 - DNA, 1501 bp, Oryza sativa
  unsure (1)..(1501): unsure at all n locations
aatttacatacaaactgtgcaattagtttttctttttatctatatttaatgctccatatatgtgtccgaaaatttgatgtgatgttttcacgaaaagtttttgggaactaaacaagccctaacagattagcataagggatggcaaattgtacgtaagcccagcagcaaaagctcgtcgagctatttgagctcggctcgaaannnnnnagcttcgtgataggcttgagctcagtttaataataaaacgagccgagcttgaatcaagcctaaagcgagccgaactcgagtagcttgcgagtctcgagcttttttgacagctctacacacaatttttatctaccgctatctcaaacccagcttgccaattgttttgactggttactnnnnnntcatatattcatgaaaagcttaagccagcatggaacctccacatagaaagcatggtaaacagctaataggcatgatatatttagctttccttcaaaattaaataacctttacctaaaaagatgctagcatggaacaatcataaatatttttttctgagagggaacaatactatttctgaagtcaacaaaagcaacaataggagtatcagaatttcagcatcatgggttttatttagttaacaaaacaagagtttcttgtgaggacaaaatgggaaagataacaacactacatagcccaacagtgacaaaatgggatggacaacagtggcacagttggaagttcaaaccgtttcccaccaactgcggttaggaaaaagggtgtgtttagttgattggctaatttttttttaagtatatgaacacatattaaacgtagattaataataaaataaattatagattccgcctgtaaactgcgggacgaatttattaaatctaattaatttgtcattagcaaatgtttattgtagcatcacattgttaaatcatggtgtaattaggttcaaaaggttcgtctcgcaatttacatataaactgtgcaattaatttttcgttcacatttaatgttccatacatgtgtccaaatattcgatgtgatgtttttggaaaaaaaaaatctaaacacggcaagggtccgacggaaatttgcacgagtatttttcaaaacaacccaacacagccgaaatattcacacataattcgaagacgtgtttaactagcaaagggaactggactgtaaacaattactcattaattcgagggacttgtacgcaaaaaagctaaaaaattgaactaaccatagttagctaacctcgccttccacagaacaaaccagggttgcgcggacgcgaacaccaccagaccagaccacctcctcctcgagcttcccctcctccccctctttccaaatttccccaatctcgcgtcgcttcttccccgaattccccaacctcgcatcccgattcctcccgcggatcgtgcggcgacctcgcccaaaatcccccgccggattggcctcgccgatggcttaattggcgatttcgactctgcaa

SEQ ID NO: 39191 - DNA, 1102 bp, Oryza sativa
taatttgcagggctcatgtgtgctttttttgtttacactgtatctatttgaccatttgattgtttaaagttagttgtttcttctttgctttgtagatccaaccatatgttgtcggatgattcaattttctgttacatttgttccatggaaatattttcagatgtgcatgtcatatgttcagcacactgcctgaatgaggatcatattagtgaacccctatgatcttagcttcattagtatcttttcacaacaagtttatgatttttattattgtggtttcttaacctaattgcgtagtatagttaatttttacctacatgtgcacactatcatctcactatatcgatcaatttgtatcatctgacatgattctattgtaaaatcaatgtgtgttttgattatattttgatgatgaacaattggcatggtaggttattggttttgatatttggagattattggcgaagtggtttggtgctaattatgtgctctggtcaggccggatagactaggccggtcagaccggcgtgtgttgtgcggtcaaaccgaccagcctgacgatctaactggctggtttctgactggaatcggttttgggttgtttaattggatatctgtgattattgttgatggtcattaagtgcgaactttcactatcaactcctacataaaagaataccaaatataatatcaaacttattggtaggggtttattactaactatttcctctagtcttggtaaatagtggtatgtagttgatttctgaaggaaaacacactcgtcatgcgattaaatgtacctctgaccaatcatacgtaagcacaaggatcggagagcccacatgtcagtcaaaatcgactaaatttgagctaatccattgccaaccgccataatcactcacctggcatacactagagaatgtgggtggctagatgcggtgtgcctggttcgatcgaacgaggggttcgaccaaaccaaggttggcaccaccctcctcccctctccccgccacctccttgcacttggcgacccactattggttgttgatggtggttgtgggtgcaccaacctccacaactgtcattccaaccgttatatgga

SEQ ID NO: 39192 - DNA, 1286 bp, Oryza sativa
tagttggctgctgctgtagttgacttatggaatattaaaatgctgttaatttacttatcccaagctgtacatgatgctgttacatgatgctgttacatgtagcttcatgggttgcatgtagacagccatttcggttccccatgtctgacctttagttagttgtgtacaccgaatggcagtagagatagatgcgtaagatggtggcaaatctgatcacatgctgttcaattataccataatgacaaagcaaccattttttaattagctgttcttttttcttaattggttagcttaaagaggtttggtggtgtgtcatggactcatgggaaccttttttgattagtggaggtttggtggcctcttggcaaagcataagaccaactcacacctgctcatttattccagatttctgaccagccttgacacggtaaatttttcggagggggggtagatctgatctgctgggtttgtgggaaggggcatataaggagctgaggcctccctctgagtgcatatcgtaggcagcttccctctgcatacaagaggctgcctcccatttctcttctctgtcggtgttctcctcaagatctgtcttaagttcttgagatctggtaagattcttcatgatctcgtgcatacttctgcggttgatctgtagttcgagtatggaccatgcaagctgtgtggtttcctgttttagttgttcatctcaagatacttaatgctgtgaatctctgaatttgcttgagattcatgccttgcacatatatgatcccttgctagattcagtaacttgatttactctgtgtttgtgccattaaatttgtttcctttcacccctgtttggaactatttccttttattttactgcttgctacagtgctgtcgtcgttgatgaattagaggcattattattctgctcgtaacttgaattcgttagctaaactttttgttagtgttgttgtggtgacggatctccatctgtcattctcctgatgcagtttgacaccaataggcacatattattatcatgaactgctcattggtttatcagtttaattgtgttcctcagaacctgactaaatgtatttcacagcctagcagtctttgcatgtttcttttgacatattggtcattgtgcttgtaaactgtgtatctagatagcttctattaactcaaaaatgctgcttacaagttctgatctatataattacttttagtgcttattcttcaatctcctgaaaatcagttttcattatcacagtttcagaactaagctgagaaga

SEQ ID NO: 39193 - DNA, 690 bp, Oryza sativa
aggtagtatttctctagcttttactcatacgattaagatttcttttaaatgtcaatatatcttctttttatgtatttaagcgtccctttgtgcttttatttttggtttgcaagttgtttatgtatttcatttaagaaaggtgtatggattacatgtatataatcctcgcaaaaaatgcatgtatatattgtggatttagccatctattttccctgctctttcatgctttcaaaagggccagcggtcacttggtattgtgtgggtgctctgcacatgactatttttataaatatgtaaatcatgtttgcgtatccctgcatcttatgctagacgttgattagttttcagcaaaaaattgggaagttatacttggttgaaatcagtattttgtcgatggttgtcataaatatatcaaaagttctaaactagaaaaaaaatggtatccccaaatctaaaatatttccttatgagttcacgttaaatgaaatggcctcatgcatatacagatgagtatctaatggaatgattcactcatttaccaaaaagatagtacaatattattcatcatagaatgctaccatcaccgccactatgtttttttatattagtaaaagatggatgagcctttggagacttattagttattaagttacttatgcttttctcactttcagcttgaaggatactaat

SEQ ID NO: 39194 - DNA, 1501 bp, Oryza sativa
acaagaatatatgcagtggtgaatccatattatgatgtcgggccggttgatcccatagcgttttcacaatcacctttgagaatcttttgttttattttccatataaatccattcaaatttgcataaatgatcccactgaaatattcagtaatgataattgatccaagatataaattttctagctccgccactgaagatatgaacttcctcttgcaaccgttttttattattaaataatttggattgaaacttttatctggttaccggttttccaaatggatcacatttttttttcttcaaaactctagatgcgagagtgtggcatctcaccactattagttcagtctgcattggcaaggaagtttctctaatccaaacagttttacattctaatgaaacaaccaaatggagactaatagagttcgataagaaaaggagggcgaatagacaaatatacacaaaaagtagtatatttaaccaatcgtctctacttattagcctcgaagccaagcatgcattctacccacaaagatgacgatcgtttcaaataaccacatgccatttttgaagaactttcaccatgatgtcattttggaaccacatgtcaatttgatccagttaaaactgctcatttgtgctaaaaatccctcggaggtgttttgttttgtacttcctccatattttaatgtataacgccggtgactttttgtccaatgtttgattattcgtcttattcaaaaaatttatgtaattatcatttattttattgtaatttgattcataatcaaatgttctttaagcatgacataaatattttcatatttacacaaaaattttaaataaaacgaatggtcaaacgttggtcgaaaagtcaacgacgtcatacattaaaatatggagggtactggctgacatgtggccatgtcacgaatggttgacgatgatgaacacataaaagaagaagggacatgtacgtcggtcaatagtgtaaaatcaaaggagttttttattactattctgtgatgaacaattgggcattggagattattggttttgttatttggaatttattcacgaagtggttttggagatgattggatttcacaggtgatcgcaggtttattatttcatgtgaccggtcagactgggctctggtagccggtcggaccggcggtgattgagtggtcggaccggccagcccacggtctgaccgaccgacactgtgtcggtttcggtttcgggttgtttatttggatatccgagtttatttcatgattatgacttttagatggatactatacgtatgtaatactattatttgctgctaatgagtcaagttggagatagcttggtctcggaatatggtttctttgtttgttccatgtgtaggtgactcgatgtctcgggagagtatttgcggtgatggaccgggagtcgacttggggataagacgacgtccgtggtggtcagagatcatgtgggatactaaggctagagttga

SEQ ID NO: 39195 - DNA, 1501 bp, Oryza sativa
aactcggatatccaaataaacaacccgaaaccgaaaccgacacagtgtcggtcggtcagaccgtgggctggccggtccgaccactcaatcaccgccggtccgaccggctaccagagcccagtctgaccggtcacatgaaataataaacctgcgatcacctgtgaaatccaatcatctccaaaaccacttcgtgaataaattccaaataacaaaaccaataatctccaatgcccaattgttcatcacagaatagtaataaaaaactcctttgattttacactattgaccgacgtacatgtcccttcttcttttatgtgttcatcatcgtcaaccattcgtgacatggccacatgtcagccagtaccctccatattttaatgtatgacgtcgttgacttttcgaccaacgtttgaccattcgttttatttaaaatttttgtgtaaatatgaaaatatttatgtcatgcttaaagaacatttgattatgaatcaaattacaataaaataaatgataattacataaattttttgaataagacgaataatcaaacattggacaaaaagtcaccggcgttatacattaaaatatggaggaagtacaaaacaaaacacctccgagggatttttagcacaaatgagcagttttaactggatcaaattgacatgtggttccaaaatgacatcatggtgaaagttcttcaaaaatggcatgtggttatttgaaacgatcgtcatctttgtgggtagaatgcatgcttggcttcgaggctaataagtagagacgattggttaaatatactactttttgtgtatatttgtctattcgccctccttttcttatcgaactctattagtctccatttggttgtttcattagaatgtaaaactgtttggattagagaaacttccttgccaatgcagactgaactaatagtggtgagatgccacactctcgcatctagagttttgaagaaaaaaaaatgtgatccatttggaaaaccggtaaccagataaaagtttcaatccaaattatttaataataaaaaacggttgcaagaggaagttcatatcttcagtggcggagctagaaaatttatatcttggatcaattatcattactgaatatttcagtgggatcatttatgcaaatttgaatggatttatatggaaaataaaacaaaagattctcaaaggtgattgtgaaaacgctatgggatcaaccggcccgacatcataatatggattcaccactgcatatattcttgtggaatatatacattattatatctaatcttactgtttcaccaaacatcgattgggctagcctcgaactaaaggtgacaagcgcacaactccattttttttcaatcatttttcctttttcgccactgactgtgtgtgccacctttttcttttgttttcttaattactccttttctccattataaatgtactactacctatgtagtgcgattttatatttaaatttgacttattgcaga

SEQ ID NO: 39196 - DNA, 927 bp, Oryza sativa
agaaaagatcagcaaggtatgtattgacatttcatcaggatatattgtaacatcctcttcgcctcttcgctcctagagctgctacctgcacttatattgtgatattattcttactatcttacacacggtgaactcatgacctttaccaggccgatcttgaggaagtcagtggtctgtacttggatgctaaatcgtcggcgcgtctccttcaggagcagcaggaaagatacatcacctaagatctcttgctgtacgacgatgtatttgtccttagtcattccgctggatctctgataacttggtactaaagtgcgaagacttctttagggcactggattgatttatgcggaaatgtagaatccgaactctgtactcccgccaacctctagaggaaaacttgatttcggcatattgcttgttcacattactccttgctgagtagattgcatatgaattatcgtgtattttggtttcccatgctaattagttccagattccgtttgtcatctgtcgatttttttcattaaccagctgcttatcatcttattctttgaaatgtggttggtattatactccctatttgattgggtttatccaaaatttttccgcggcgatgcgaaggcatctttgcgcctcatctgcgttgaggttttgaggacgtgttttatgcagaggggcacatcggtgcgtccgttccagcgtcgctgtttgctggcccctgctttttcttccgtataataatgacatttccatgtcgattcttgatcattcctacattcattgaatcgtagagcgaaatgccctgaaatttgtcaatagacgatatagatatattttgctaatttctgaccatcactataccgctagagattactaggcagcactcggctactggaggcttagcctcacgtattgccgtggttcagt

SEQ ID NO: 39197 - DNA, 1501 bp, Oryza sativa
gaaaagcttggataaatagtaaaattttggtaacgaaaaattgataacaaaaatgacctaaactaattgttgttttttttaataataattaaaaaagtgctgagttgccgagcagtagtaagctcccagtccaaacatttctcctcctcggtctggagccgctcccccctccccgccgccgctgctctcgacgccgacgccgacgaggcagctaggccggcgacgaacctcgatctcgatccgctcgccgccgtccgtcgccgatccgcgcgccgacaccgacaccgaccttgatcctgatccgcgctccccgcgacgtacgccacggtgggctcccgatctgaccccatcctccatccaccctcctcactctccgccgtcgtagtatatctcaggagggctaccagctgagccgagggaggagaactggatgcctcgtgcgcactcaaaggccgcagctttagcctttaagcttcttttttttttctcttactatggggggctagttgtttatagttagttagttagctcgaagcctctcctgcgtctgcggttgcaaccgattcgatttccaggttggttggttggttggttgtttgcactgatgggaataaacctttatgcataaatagctttgcgtgacttgcactttgtgcagctaaatgtgacaacctgctgttgctgttgctgttgatgttgatgttgctgttgctgttgatgtgcgttgtgatctctgaccaacctgaaattaccgggaggccagggtagatccagttgttttgtggtgagttgtgtggttgtggagaggagggcgcatgatataaagagcttggggtttgctcccctctgaatacaaaagtgacaacttggggaactaggcagtgcctctgcatagcatagatcttcctgtcctttctttcttgtctagtggtgagatctggtgaggattttctcctcaagatatcccttttttcggtttgtagtttgttctgaacatctgtagtttggcatgtccttccatgatctagctgttcgttctgaagatccataaagatattgatacttactgtcttgggaactgggggatatcatttccctttcacccatatgtgaatcaaagtttattttatttagtttacctcttagattcgtcatttcgcttgctgtcgattttgccttctttagctgtgtagtcatgatagaatcgttgcagcaatggatttggtattgtgtccttaggacttaggagtagtttgaccgtcttcccagaactactgctgtttctttctccattcagttgggtggtagctttctcagaaccagagttcacagtcctgcactcttcacatgtttatttcgggatcctggctggtgtgcttgtgatctgcgaaacacggctgcttatgttcactcagaaatgcgcacattcctttcagtttactactctgcaatctccctcaaaatctaatttatatggcaggtttgcagtaagcaggaaaga

SEQ ID NO: 39198 - DNA, 1501 bp, Oryza sativa
ccccgaacttgacctcaagagcatcccacatgtccttccctaaaggtatgtgcatatacacatccacaatattatcggcgagcacactgatcaatgctccacggaacaagcaatccgtagcctcgaacttagcctcctcctcaggagagagaggcggttcactcggtttgccccatgagacaaagaaacaatgcatcaccgtcaaccacaaaagtgcacgcgctttccatcttttataatttgaaccatcgaaagcacgtggttttagtgatgcagcaaagccaactaccaaaaaagacccatcaagtttttggattgttggaaatttggtcataattcggcatattttaatccaaaatattaagacaataaacatgacatttgcaatattagtagatctagtgacagtgctaaatgtatacaacttgagtatgcttaatatgaaataagcatcaacatttacatagtaacgcaatgctaccattgcgaagagtattaacaaagaaacttctaatagaatcgggagaatgaaagtataccccgagaacgtcccatcgctggatttgaggcagtattgcctccgttgatgtcgttcatcttattgtctccaatctccgttgacatcttggtgaaggcgccgatgcagcagcagtagccgcgaagaacaagagcagtcgcgcttgaagcgctaccaaaaaacttgatcgcccgcctacccgtgcaagttctcaagcggacggagttccggaggcacctgctcgtcccgtacacctgtgcgcgcaggtgaacagaaccggggaaggattctgcagctcaggaacagaggaggaggaactcgaagtgcaatagtcgtgaagaacttcgtccgtccttctggttgctgcggagtatatatatgcaggcgcgagagtaacgttcggagtcatcaactgcggtgtttaatttcgtaaccgacgcgctcgttaatacggaatcaattcacggcgtttaattccataaccgacggaatcaattcacgacgtttaattccgtaactgacggaatcattgatacgaaatcaattctccgtgtttattaccgtccgttacaaaacgagagagcgcagcagcagctgctgtctgcctcgcctcgcctcgccccgcctggttgtccgcgcaccatctcaaccggtcaacagagactctccactagctccgtatttaagttgagacctctgcactcagatttgcaaggtggtgttattacccatagcacttaatgtgggccaatggaatttattaggatttaattgggtatagcacattaatctaacaaccaatttatatgattttctttttgaagtttatttgaaattttcatctctgttcgaacccggaaagtcctagctaccattggaatgcataaagttataagacttcattaggaaccaaattaatttatactgtaaaacttgtatgtggaagtttacgagaaattttcacctctcggtgaaggccgaaag

SEQ ID NO: 39199 - DNA, 157 bp, Oryza sativa
gttgtgtccagtgtggttttgacgtgagatgcacggacacagcgcacgctgaacatgtgcacatccgtgcagggcttcgtacttgtagaacgcaaacctgttcgtccatgtcgcgttctcccagacatccgagccgtgtcgatcgcgtgagctgcca

SEQ ID NO: 39200 - DNA, 1501 bp, Oryza sativa
aactatgcctcccctcgacataatgcgtcagttgaagggaggtgtaactgcaatgtaattatatgtaactcgttatgaaacaaacatgaaaaggtaggtgactagtaggcttccatctccatgagatccctaggtctattcccacttcacgcatgtggtgtgaaattcttttatccatgccctagcacaaatcttaacactcatctgatgacccaccccgaaagtttctgtaaaaaaaattctggcgatagttttataacaaatccgtttatctttacggcgctcttcaaccatgcacggtttaaagatctgtggcggaaccatgcacagatgcattcgaccctgaaagtgaacaatccgattaatgatagattgcccccccccccccccccctcttttcaattaaaaaaagtagtaggactatacaggctttttaatgcaacacttaggtaggagtactgggctaagggcctaaggccaggccatctgatgtaagaaactggccatctattcattccggcccagcgtacgtgcttacgtttttcctactgttcttgcggaaatgcgtgtcttcaacgatatttgctgcaagataagtgcgttaatgatcaagaataagtccactacggattagagagatttattacagtaaacgcgatattattgatttattggtacaaggagaaagagacaatcgatgatatatatgaacatatataagggcgatatcggagtagatcaaggagtagatgtcaaggcggcggctgctgctgctgcctccctgttcgccgacttgggcttaggcggcggcacaaccgggaggcggtggccgtgaggcggcgaaggtgggaatggttccgtcgggacgggcatgaacggcagcttactcttgtccgtcgccgtggccgtggccgtcgttgccggagcagcagaagacgaagctacggcctgcagctgcagggaggagatgcttggcagcggcagcagcagcagcactgttgccgccacggccactgcaaggcctcgtccgaatccgtggccacggcaccctgccatctcgatcgaatccaacaaaatcaacaatatgagatcaagtaattcccctctcgttccatttataagcagaacagagtagcatcattaatgctggtgttatgatctgcttgcatagttcgggagtggagtaatgaactgctcattcttctagagtactagcaagtatgatacgtgtgataaatgtatttatgcatatgcatgttactcccgcctaacttgcatccatgcatggaaactgaaataatcaaccgattgctaagcagtagaacaaacaaacaaacaaacaccacactcgcacaagcacacatgcgtgcagattaatggattctacagtagagtagcatatatatagaccgagtaaacagatctcatgattcgtagccgaaggagcagaagaccgtatattaatgtaaagtggctgtgagcctgtaattaccaggcatat

SEQ ID NO: 39201 - DNA, 1501 bp, Oryza sativa
aatgtgagaaaacataggtccttaatagtgattggcgatttgttgctggtagtaatatttaatattccaataaagataagttggggagcttctgtactccaaagcaaaactacacattcttaatcattagtctgtttctgctttactaatgggttgctgcttcgttagatcaattactcattgcagtggactgtctaagtatcaatcactccttttgtttttcccacttctgattcttagctggcaaccttgatgcaccgtagaacattttgttctgtcttttcgtttcattgagtaaatatcttggaattttcttttaatgtagtagtatgttgcatcctaccatcaccaatcgaaatgcaaaatgtttcttctgtatatttggtttcatgtaaacttttgggtggatttaacacatgaattgggattgtgcaagtcaagcctcttaaattcatgatgctctacttgcagccttgaaggcgctagtatgctttcccatgcaaagcatgcgaaacatatgcttgcgagagtcgacagaggacaatgaagcataccttgtgcagccatataccttcagactacttgtgatcactgatgcaggtgttccttgtctctcagctgaaagacttccaaaggcgctgcaaatctgatggtttggatgcgtgttatttttgctcaatgtcaagtatgctggcagttggtgatgctgtatgagttggtcttgtggtgcttcaaaagaagctacttcgaggagtcgcaggaattttcattctttgcaaagcaagctaccaatgttcagtaaagcggtgtttatctgtatgcattcagctattttgttactatggtgctgaatgcataatgcatatcctaaattcctaattatgatgttatgttttttttttttgctttcttgtggtttgtttaattctgtcacagattcgatgaaactgccctatgctaattttgccaaagtcaaagcggttactccctccgttggaaaataccaagtgattagtttttgacatggtctttagtattgaactttggccattagaattcacagtttccatactcagatttaactgaaataatgcccttggggttgggtcaaagtgcgaggctattatatcctacatttcatctcttgccgcatcaccttcacacaacgtttcttttaccagttgcgtatcacattcaccagtacttaggttaactcagataaatttgtaggtaccatttggtcacggtgtggtatgcctcgatattgtatccagggtactccctgatatggatcttattcaccatacatgatactgttgatgtagctgtatttggagttttttttcgcgggtcggctgaaagattggccaatcaaatttcattgagattgtaagggggtgttatatgttatagcgattgatcatgacattagctaaaacggactattcataacaatattgaaatatgccagcagttctccaaatggctatttcctctttaa

SEQ ID NO: 39202 - DNA, 364 bp, Oryza sativa
acgtagttctccacttcccttgatagcttcatccgtttgttatagcagcacatatctttagcaatgcattttgtgttgaccgcgggacaaaaagtggataaagcatttgtctctcaatagaagaaaaaataattaatgagtttcatcgaaaggctttcattggaagtaataagtagagtatttggacctgtagtagttgatccagagtgggacttgaacctcagttggatgtgttcgtttttgtgtgataaagatatgtggactctacctgaaaggcagtccatagtatgaacgttagataaagctgcagatccagtgagaaatagtgaagtttatccctccaccgttggtaatagatgaatgc

SEQ ID NO: 39203 - DNA, 296 bp, Oryza sativa
ctttttgcttttcagtgcatctttcttttatgacagcatctcctttcacttttactttttagagtagcaagccagctataaatatatatcccaacccccctcccctgcgtgatggtatggcacttgtgagaaataaacagaaaattgccccaactctccttcttgagctcccctctgtcctcagtcggcagcaggaacaccggctgttcctacttatccctcttcccctgcgctgacgagcagcagctcctcaaaggcagtctcttccccacgcagcagcccctagtggcgtgcca

SEQ ID NO: 39204 - DNA, 1501 bp, Oryza sativa
tcacaaaggctaatcatggattaattaggctcaatagattcatttcgcgaattagtccaagattatatattttattaatagtatacgtttaatatttataattcgtgtcccgatgtgacacggcttagtcccattattctcgagtagaatatgtcccttccttagcggcgtaaagaaagaaattcgtctcctccgctcctagcgccgccgagtcgcggctgaacagaacaagggagggaggggcggcgatctccatctggcgagcagagcaggggaggggatcctcgtgagcatccacatcctctttctgattcatctctctcccatcgggacacttgatatttcttgcgttcttcgttaaccctagcttctcttctagatctggaagaggctcttctttttaatttcagagccttaaccttaatacaagtaacagtttgtttgttccccgatccgcccctgctgctggtacttgggctatttgattcctgcatagtttcagagctagagctagtgttgctctttacagctttgggcggattcgcgatggcggatgaagagtcgtctgacttcaccttttgcaaggttttatttataacttgcctccctattgcttctatgttcagctacttgttatttctacaatcaatcagtcatatttttttttgacttatgtattactttcaattgtgtaataaatctgccgatcttctttgactgatttaatcacctgcttttaagcgcaatcttggttctggagatattttcttgtacaaagttctaccaccacaaattcttggaagaagcaatatgttagggatatattccactaacattatcttcatttttggcgctaatataaacaaataggtagtatctgactaacatgggatggtacaaacaagtgaaaaaaatagatatgaggaaaaggaaaaagggtaagatgtaacataagaaatcagggagactgaatggaagaggaaagaaagattcatctccgctgtatagaaatctcatatagtttgtccttgttgctgctgtaccaagaaatccaccttttgttgttgatatacatgagctttagaatttcctatttcataaaaaaaaagctatgctgatgtagtgagcttaagctaactaggtaagcacagggtacccacttgtgtatatagctccattttcatgaattatttgctactcccattttatctgcttttcttcatggtacttacattttaaatctggaatcatgagtacaagggacatatatctagattgtttgccatcttgaatctaccggatttattaaattttcatggatacttactgtccaaatggtctaaatttaaacttcctatgttgattatataatgaccatattcttttacaaacaattgaaacaaatcttcagtgacttgatatggtaacttgctgatgttattctacttatgtttttgttgtgtagatgtaacaaattctatattcaattttgttttctaga

SEQ ID NO: 39205 - DNA, 391 bp, Oryza sativa
agacgtcaggcaggccgtgaagcaaacgagtaaggcgattgccgggacttctagaaagtaaaaaaaaaacaaaccccattgataatcatattcgatttttaaaatctcaatgataataaaaaggagaagcagcaggcggggtgtataagagtacagttgcagagctgccgacggttaacaggacttctagaaaataaaaaaagaattctagaatcacaatgataataaagagttggcggcggacgggctatagaggggcatagtggcatcgtttgatgggacttctaaaaattataaaaaaataaaactacaagtccaatttttaaaggttttgaacttctaaaaagtaaaaaaaacccaatgataatcatgttcaattttaaaatctcaa

SEQ ID NO: 39206 - DNA, 249 bp, Oryza sativa
caagtcactgagtcatgcctccatctcctccagaccgagtcgcccaactccacacatcactctggagctgaagaagtcgagggagaggtcctcagcctctccgtcatcctcaacctcgccgccggtcatagtgacgacgaccttcgccatctccgtttgagtcaaggtcacctccatctctttcgcgttcccatctctccacacaatgccgagcatttcctcttttgacctaaacccctctcgtgcagt

SEQ ID NO: 39207 - DNA, 1279 bp, Oryza sativa
ttgccgagtttccgcgatttcttcggtgaccgcggactgatctaaaaagggaaaggctgattgtgaattgagcacctcttcccacagccgatccatcagtaagatagtagaacggcaataaatgagtggacgtccacctaaatgattgaaaccctgaccctcttacggtaattagttgagtttacaactttgcacccgaagtagtgatcagttgtgttatgagtgcaggaaaaaaacgagcaagcatcaaaaataatttatgagtaaatatttgttagtctactttatctagggtataaaaaaattaaaaactaaggtaaaaaagaatatgataaaaaatccacattaactctaaaactaagctttaaaattcaaatttgatactagttgataaaccagcaaatgaggagggcacaactgatgtgtggagggaggctctggttgaactggcttgcttgggcccatagatggccaaatgggccgtctggcacagcacggcctaggcccggcagtgtctgggccgaggttttcgagccttttcgggcccgcacggcctgacctacacgccgggccgtgtcgtgccagcccacgggctacacacacggtccaatacgactcgggtccatcgtgcttctccacagaattagtctatttctcatccctcgactctgtggctatgtccataatggctgaaaaataagtctgttttatactcctcttgtctttgggccttgccttatatggttatttaagtctattttggattcctctactatttttcttcgatcatgccgtgccggccggcccaccgtttcgagggtgcagcccaggctcggtccggctgtcgggccaggctgacacggtacgaccctagtcgggctgtgccgtgcttgggccaagccatgggcctcagatcatatggccatctatacttggaccagggctcagttttggctggagaaaggagatagaggactaggagggtgtacatataagttctatggagtcatgtctatcgatactaatcgaacataaaaacttccgaacctcatgggccgctgacccccaacctggcctatccatcatcgtcttcaccttatctactccgcctccattgccgccgcagccattggctgcggtagtagcagggatggtttctcccattcgcttggtggtggcgaatcaaggaggctagcacagtagcacttcgtccttgctggtgactgcacattgttactgcttgatatttgttgtttgcaattggatattggttgctaca

SEQ ID NO: 39208 - DNA, 1501 bp, Oryza sativa
cttctttcagtatatacttctttcagtaaatagatggtggctattacatagatgaagcacacggtcgttagttaatgacaaatatcattgcttttttttcctggttctgattcattattggatcatgtttcgccattcagagtgtgtcccgtggtgttttcttttcgtgcagaaccatgtggttcatttgtatttttgagtctttccttaagtgcatctctgtacgtttacatgttttttttcccttcatatcgatttttttttggcgcaggtgcttattgtcgcggtcaggtccgtgcgatacgttcgttactgttgtgctgctgttccctttaccatcagctcctgttcaggtgagctttgtttctttgctatttctttggggctgacatcctttttgttttgtagtttatttgtgccttgtggtttggtgtatgttctttcttttatctgatatccagcttaaattacattcttattccctgcaggttgcggaccacatcttctgtgcccgtacatgtcggctaaggtataacaattggcctctgttgcttcagctatctatacattattcgagctgcgcttttccttgtgggttatatgttctatatgtgtgcacgacatttctgtttttctgtgcgtttagttcctatatggaagggggttgtgtggttaggcctgctcgtcgacgggatcgccgattgctagagcgtagcagcgcttctcttagatgtatggtttgttgcggtttgtttttttagacgctttagattttatatcttttcctgggtggaaagattaaatcgtctgttgcttgtttagcatcttcctctaattcagctgccagcgaatatgtttgggagactgttgctccaccccgtcagggtatgtgatttactgatctgtgtgcgactgttgttgtggcttgtttatatttatgtagtcgttgctcatatatttttctcgctttggtagacgatggatttttccctatctaccctgcatggtattcttcaaaaagacggcaaatgcgttcaaaaaaattggccatgaaacgattggtggctgcaggtttttccattggatctttggttttctgcatatgttcttgctgacatggcttacatggacgttatgtctccttccctataggcaaaaaaccttgccgtattgctcctgtctcttgcaacaagtttgacagtgattatgccaagtttttgagaggttgctttcatctctgattcgtttccattcccttgtttgcaatgccagcatgctgggtttaaacataaatttctttttttgaatgcttgcacagagacttcaaaggataggtgtgattatggccctcctgagtatcgctgccgtttgtgcgctgctcagttctggtaccaggaacggtgcaagaaagattctgctattaccaagcgccgtgtctgttacaacctttgttgcaaaggtgggaaaatttttgtccctccatttgcgcagccaccagaac

SEQ ID NO: 39209 - DNA, 216 bp, Oryza sativa
atctgtgtgataatgttagtattatattagaatataaaattcatgctaaatggtagtaagaaataaatttacatgtacaagaatataaaatggatggtaactagtaagagttaaatgacattaacatatattgcaagtctttaattgcacctctactacttgttttatgcaacatgacttcatgaaagtttcaaaattttcccctgcattctatag

SEQ ID NO: 39210 - DNA, 613 bp, Oryza sativa
accttgactcaagtttagaaattgttgtctaaataaatagggccaagaacattttttcttcttatgttgcacattgcgtactgaaatatttttgcctttttgtttgtgctcattgtttaagtgaggaagaaatcaccaggttaccactgcggcaatggttgacatcagcctgtgttttggttcaattttaaggtcctcagatcattccatgtatgtgctaagcatgtttgaattgactaacatattcatataccactacaagttagattcagatataagtgttgcaggacatacacatgtcttcattattaatgtgctgcgatctggtaaataacgattgtggcgttgcagaaatcactgtcagggctaagcaagtaagcatgaaagttaaggagtgtcatttgtgaaaattccgcaacatcgaaccaagttctgcaaggatgaatccaacttctgatatttgtagtcaaaataattttatagtagagatggtagcagtagcagatattatcagggtcaggactactggactagtaaatttttggaaatgtgatttctttttggtggtggtacggataccatatgcattggagcattaagttgccatcactga

SEQ ID NO: 39211 - DNA, 911 bp, Oryza sativa
cttttatatgggatgtaatgcgctccaaaatgatctgcatatggcctaccatgttttgctaccactgaccattgcacgcagcctaccagttatatcttttgctttgcataggcatatcatgtaatattactaaccatgatggctatctgctatattgctcagttcttctcgcactgatgaccaagctgctgataagcaacatgttgtgcctcatgaggttgatgtttcttagattgcagctgcctctgctaaaccaaatactcaggttaagcataaatacaccactttccagctaatttagtggtcgaatttttttagtgacactggcaacctaattattcccgttctataggtcaaagatatcctaccaactgaagccaaaaagaaaaggtataaaactacatattcaagctgagaacgaataagaaaatccctatttttgtactagcggtggaagcatgtcacattcattgttaaatagactgcaccatttcgctttcgctgctctcccgtttttggttcttctagattaaccaggtgttcctctttgctttagtgttgatccaggctctacaggcacacgcaagactaagcctcctgtaccgaaagggaactaaattgctcaccttagcttttgtgctgatgtgagtatcctgttctgttatatatctatgggcatggcattagtttcacctagattgctgatcactttaaattatttttcaggggaacaataccctacatcagcgatcccaccctatgtctacatatttccttaatcttactgttggcgatgcagcttgacatggcacatcgtatcagacaatcttttgtttacatgattgctggcaccactgtgtccatgcatgtgcatgtttggtcctctacctgctgctctttcgccctttagt

SEQ ID NO: 39212 - DNA, 243 bp, Oryza sativa
aggacctgtccagcaaagaggaaatcgatcaacttctttttttttttgcggggaacttcaaatatctataactacctgacaaattttcactcaagtttcatttgcaatttccttaggaatgcattacattacagagagtgcacttcgaaagaattgttgaataggcatttcacagctactattaagtatttcacaacatttcttcagctaaactgttaattttgttgatcaaatcatatcagg

SEQ ID NO: 39213 - DNA, 445 bp, Oryza sativa
gaagagattagagatatcccttgctctggttcgcaaggcagctttctttttatccccctttatctccttgtatcactggcccttttttggtgtgtgctatcagggaatgatccactttagcagcgatgggttcaagcaacattcccgatgacttttggcaacctattggtaaactatttaaacgagaacgcaccatagtttaagcttgatcaacacgttctgacgtccactgtctcaatttcctggatctctaccgtgtgctatcgttttttaatagattaaaagtttacttcagccgacgcgaccttccgtagtttcctctagaaatatccgaatgatcattatgcacaatgtggagtaacaaaaattatatgatacttcctctgataatccgacaagatccgtttccgtttcactggattcctagacctccaccgcccctagg

SEQ ID NO: 39214 - DNA, 610 bp, Oryza sativa
aaagtgaaaggagatgctgtcataaaagaaagatgcactgaaaagcaaaaagaacacaaagaccaattagcacaagaagaccaacagcgtaagacttattccatcagacagttgcacatttattatgaagatgatgaaactgttctacattggtacttgttagtttgttgcatggtgatataacccccaaactgctacatcccggtgagttgtgtttcattttgggttgaaaaaaaaatacgggcctattcagattgtagccaaaattttagcaagatggcaatgttgccaaaatttaagatgacaatattgctaaaattttggcaggatttcttatgtatttaccaaatttgacaacaaactaaacatagacatttttttggcagctttaccaaaaaatggtatggttgaaaatagcatcaatctgaacagcccctacaatatcaaattcaaactatcgttttgacaagtatgtttttgaacatcatttcataaatcataagtattatgttggaactatttaccttctatctgtttaatccaaaatcaggaaaaagtagttcactttaaccagaacctaacgcttcttctgttaactacatgggacaga

SEQ ID NO: 39215 - DNA, 199 bp, Oryza sativa
ccatctcttttacctcaatctcgcatataccctgctaccaacaatccccatactatgcaaaataccgtagtcgtcatatgaaacgtcgacagtggcgcgccaggtagggggattttggtgcttaaaggtttcgacgagatgggtataagagatggattctccaacaacaagctactcgacgacttcggctgtgggtaga

SEQ ID NO: 39216 - DNA, 600 bp, Oryza sativa
tttttgtgctttggtcctgcttgttaaatgaagttatttagagtaaaagccttttcttttccgttggttgtgtagacgctgcagcttcggaagatccgctcttcgtggaagttgaagccgacgtttggaaaagcgagcaaggcaagtcacatcatccttgaacatattgaatcccagcttataaaattatgttgctttaaattattgcattatcgctttatttaaattcccgcgttatcactgttttatctagccatgcctatttacctttgttatgaccttattattattgttattgttattattaccttgttcaccctagattaaacaaaaccccaactagtggacactctactcatggtaccactagtatgactttaggtagatgcttcgctggttaaaaggacaacattaggtggtttttataactttagactttgggaatattcatatctcttggatactatggaatggttggcttatggtggaattggacatacccctatcttcctctttcaaagcccctaaaacctgtttttcggttgggtttgggtgcatgccagttgtgggaagtagcaccccggccactataaggactaa

SEQ ID NO: 39217 - DNA, 1501 bp, Oryza sativa
aatgaaaatgacagtagtgtttatgcatcagctgaagttagaattgatcgtcttggcctactacatgcatgatgatacatcattcgtgatcatcatatatctaaattgaaggtcgttcgtttgtagaaattgcttcaataatccaaaaggattttacgatgagaaagtataaaaaaaaagctatgggtgaagcgccagggacatttaactatttgtcatctatgtgttaatgacatatagatccgagtggtaaattaattgaagagtgtcaaatagttaattttttccatttgccccatacacagtagtggatgagttggctcctctgttccgatggaatagctaaaattatcaagaacctactggtgcctctctctctctctagatagttcttttttctccttgggcagtggcctatctagcatttagcatttagatggtctaacttacataattttttatttttgttaaagtgagataatatacagttagttcatcatgacataaggatatgatttgctaattgttacccttgcaaacaaatgtattttttctcttcctaagaatagtttttctttctttttaacacatgtatctttggctacgtatttctaggtgatcctggaaccacccacaagcttggaataatatggttgcaaattttatgtatatattaaatgtggtctgtcgttggggcatgtgtaaattttatatagccattgtttcttaagagtaaaataagacaccagttattaaaattctgtgtggaatatcattgtggttattaagctttgaaaatacatagtatattaagaccaaattaatttgctaaatatatcgttgcaggtctaaaatctaatacatcagatctttaatgctaacagccggatataaagaaagtagataaaactaattgaggaaacggatgttgtgattaattgaaaagtagatgtaggtggaaaaaattgaatggtgaaagtttgtgattgaccgagaagagaataatggtggagttattatgttttatgacaaattttaaatattagaagttgctatattttaagaagtaccactcaacgatacatttaggagcgtcaagatagacattgtattataagctcctcaaccaaccaatgtaaaagttcgaattaaaggcttcttcacattgctaccacttttaagttttaaccctaataatttttgttctgtaagtatgaattaagagctcttcaccttgcttccacttttaagttttaatgctaataatttttggtgttatcgataacaaactaaacataatattgtatcatcactctaccaaaatttgacatttcaaaagtttcttctcacataaatactagtaattttttttggcacgaatactgtaatttttgataatgctgcaaactaaacatataatgctacaaactaaacatatctaacattgccaaaatttagtaatactaaaatatgccaaaatttatgaatactaacttttggt

SEQ ID NO: 39218 - DNA, 1447 bp, Oryza sativa
gcacaagccacaatatgcatgcatgcttggctacttttgctatgagacgtttgagaaacacaaaaaaccaaaattttgggacagacaaaacctcttttaatcacattgtctcatgttaaaatactactgctgtcattgaacagagaacaactgtaatatattagtagtttggctcaaataaatttgtaaaaaaaaaatctactttacacaatggaaagcaaagtctttgaaaactaaggttccaacaatttgctaggcctttacttttgaggcaaaactgaaacagagaaaacactctaagcggggacatacattaagcctgatgcatgagaaaatgtttctttacagggcattgaacctccctctggtctgatgattaaattgctatacagctgattctactctttatacactataagatgaaactaaacaaaaccctatgtatatacagcaaatgaatgtctccagaattcataatggattcaaaagataatcgtatgtatatacagacaagcagtagtatcatgaatgaatagccatatatgatgaaattgtgggagcatgttgtagtaatagcctcacattatacagcaaccataaataaaatatcaaaagccaaactccaatatcaatacgcaatgttttagaagcactgaatactaattgcacaatacaaaaattaatcatgcacgaggcatgtttaatgtgaagtaatcagtatggcactaaagcaaaaaactgcagtgacggatactcctaaatatagatataagaggtgccttaaaattattttgtgcaatagtaagcatggatctgacctaacatcttgcacaatttcataaaaaaattgaactaagcttgcagaaaaggcaaaaaaaaaaacataatagtctaaaggcacactacccatgatgcagaactatcaagtcgctttaatagtttgacaactgcagcgctgaaagctcaatgagaaatgtcactccgaagcagcagcagaaaaagaatgctaaagagtttatatataaaagcaaaggcctaatcaaagtgcaaagctagtccatttttatctgctcgctgaccaaatatcctgcactatataatatatatatttttttgtttcaaaagggaaaagatgtcttgcaagcaactgtgccactctcctactctcctagccatcatatgaactccatacatgtgtatgttttccatcctgcaaatcactgggtgtttatttagatttcagtttaatctgtataaaagcgaggacaggtgagaagcaaaacttttgctttgaggtcgctgtgcacagattgattagttgtattttttttaccagagagaaccaatacttaataatagaggttatacctttaaaacttcatatggctagcttaccttaaaaataattactaacttttctgaaaaaaaaaatcagagataatgtgca

SEQ ID NO: 39219 - DNA, 1501 bp, Oryza sativa
cttgcgcgtcggaccgtggcgagaaggtgtggggattccggtaagaagagactagttacatttggttgactactgagctgctgcgttgagatggcacagtatgggctgaccaacaaatcgattgaattgcgggcccgttaacggtgaacggtaatggggactgcagtgcagtccctcggttaacgaaaaccgtcagtcctaggcgcaacgtgaagttaaggaattcagggttgagtttgtcacgaaaataaaccaaaccaaaagttagtattcataaattttggcatattttagtattactaaattttggcaatgttagatatgtttagtttgtagcattatatgtttagtttgcagcattatcaaaaattacagtattcgtgccaaaaaaaattactagtatttatgtgagaagaaacttttgaaatgtcaaattttggtagagtgatgatacaatattatgtttagtttgttatcgataacaccaaaaattattagcattaaaacttaaaagtggaagcaaggtgaagagctcttaattcatacttacagaacaaaaattattagggttaaaacttaaaagtggtagcaatgtgaagaagcctttaattcgaacttttacattggttggttgaggagcttataatacaatgtctatcttgacgctcctaaatgtatcgttgagtggtacttcttaaaatatagcaacttctaatatttaaaatttgtcataaaacataataactccaccattattctcttctcggtcaatcacaaactttcaccattcaattttttccacctacatctacttttcaattaatcacaacatccgtttcctcaattagttttatctactttctttatatccggctgttagcattaaagatctgatgtattagattttagacctgcaacgatatatttagcaaattaatttggtcttaatatactatgtattttcaaagcttaataaccacaatgatattccacacagaattttaataactggtgtcttattttactcttaagaaacaatggctatataaaatttacacatgccccaacgacagaccacatttaatatatacataaaatttgcaaccatattattccaagcttgtgggtggttccaggatcacctagaaatacgtagccaaagatacatgtgttaaaaagaaagaaaaactattcttaggaagagaaaaaatacatttgtttgcaagggtaacaattagcaaatcatatccttatgtcatgatgaactaactgtatattatctcactttaacaaaaataaaaaattatgtaagttagaccatctaaatgctaaatgctagataggccactgcccaaggagaaaaaagaactatctagagagagagagaggcaccagtaggttcttgataattttagctattccatcggaacagaggagccaactcatccactactgtgtatggggcaaatggaaaaaattaactatttgacactcttcaatt

SEQ ID NO: 39220 - DNA, 1501 bp, Oryza sativa
aaccaactcatattttgttttctcctggataaagtctttcacctctatttttttttacatgtgacatgcaacacttgcactaagatggtttacatttatcagctgtaacaatgtttcttactttggccggtttcagcaaattgaacagcagcaagatgttgttcttagcatatatataatttatggcttccagatcaacagacagaagcccagaaggttgaaaacacaaaatgaatggctatttactgcacatagtcaaaccaactttgatgattgatcctttcaatcaatcgccaactcatgatagtagttggctcacacttctgctaactgattctttgtgtttaaatccatgtgtatcctataatattagggattagggatacaactggagactagaacatctcaaggacaacactggcattagataacaaaggaagccgttggtataatgacctaatcaaaaaaatgcactggcacaaaaaacagcaaatacttggacaaaaataataacaagagatgaagagaactgaaagaaaatgatgcttagaccatcaactgtaaacaggtggcaaaatacctcattcattggccagtaattgtagaacaaggtcaattggcattgcacaagctcgtaggatgaagatccatccttgttagtttcatggtccaacacaacctgaaaagttggcttaactaaaactagtaaacagattccactgaaagagaaaatctacaaaagtaagatatacatcatttcttcatgtatcctcttggtatctattttgtaataacttcataaaccttgaagataattttgcaaaaaagaataaaaaataagctaccatttctgggtccaaataaggtaatattgtgtcaaaaccagtgaaatacgtaaattaaaattttaaacaggctgaaagtgtgattttcctcatctggtctcgaaaagaatagttagaaagaaaatactgtctagtctggtgagttcttgtgagtatcatcaaggtagaatgctgaaccaatttggccagcgcacacccaaacctcatttgatcacagttgaatccacagaatcattcaaatagaaacttttcctaacctatgtgatttttatttctacaactgcaactatgaaaggctatttggtgacaagaattcatcaccttgacagcctccgggaggtcatcaaccctcttgttggcatagttctcgtccaggagcagcaaccgggtgggacctcctctccacgtgatcctcccgaacccctcctccccgaccaaccccatccactcgtcgccgtgctcctcttttctctctccgatcacctccaccacatatactttgtctttagtatcccttgccgtagccgcagcctcgccgcctccttcatccttcttccccttccgtttcctcgcggggggccgcgacatcttggcaaggttggggaattgcacgaagcctcgggcgttgaactcgcgggccagcttctctcggcgag

SEQ ID NO: 39221 - DNA, 1501 bp, Oryza sativa
cgttttcaactataaatgttttgcaactgcctttatgcaaatagccacgaaccatccttggatccctttgcacgtctgcatcattggtgtggcttgctgagtacggtggttgtactcagccttgctattttcccctttgtgtagtgcttctgagctgaagatgaaattagaggaccaaggctttgaccccagttgagttttgcctgtggagtggagctgaagccccgctaggatcgccttttttccgccgctgcggctttttttcggtgtgaggaataagtgcctcttctgtaagtatttacgctttatttacatttggatatgtgtattaatttgtcattttgtgtaccctagcttgtcctggatagggatttaatacacaaaatagtccggaaatttaggctaaatttctgggcgtgacgccgcctcccctacatcatacaaacatatagtccctccatcccaaaaactcaacctagatggaaatgtgacccattctaatacaataaatctggacatgtgtactaggatgggtcaaatctccacctaagttgagtttttcgagacagaggcaatatatgcatgccgctagttttgtctacatcatcgtcatggaacacgactccacagtcaagtgacaaagccgaagatcaacaacaacaacaacaatatgccttggttgtggtggcagcaaaaagcagggcagcggcaggctcaagtatcgagggtgaggcgacaagctttagacaatgccaaccctaatagctctctacttttctccctcccttcctttatcttgctttatcttggtggccttttctcccttttttgcatgtgctttgctcttctcaactcgatcggatcgaatgaggagggaagagacttataagtgagccgaaaggcattttggtcttttcatcttatccttcacattggactggatgaaattgaaaatctacgccagtgagaaaaggaaaaataatgacacgcgcgagttgtagtgagaccggatgacaaatagaaataaaaataaagtagagtggattttgggaaaaaaattcttttcgtgtgagtggcaaatagttgaatatttcgggggccactgcccaccatgtattccttggcagtgctccgcgagtgatcagccggtgtcctcgcttctctcctcgccacttcccctattcggtcaggcacatctccccaccccccaacaatcatcgaggaagaagagggagggacgacgatgtcgatgccggaggcggggcgctcggagagggacgggcgggagcaggacgacgactacgagcagcagcaggccagggtgctcatggcactgatgcagggcttctgcgccgcacgctaccggaaggccgacaacatcccgtgccccatcgtccaggttccttcctctttccccgcccatgttcttcttcctccttgatgtgatcaatccgtttgttctcgtgctgccgattcggtgatggatgcgtccgcgggatgt

SEQ ID NO: 39222 - DNA, 1501 bp, Oryza sativa
gggggctcaaatggaagaacaaccgtcacttcctccgcaaattcatcttcaggaagggcatcggtcaaggcatatcttgaccatgagaatgaaacagaaaactcatcccctcctaatgagaattcgaggcttcctaattacatggtgtcgatgagaagtttcttaattggatgcccgattaggacgtcaatgtcttggatttcaaaagcgtggaaatccatgacaacctctttgttattgtgatgaacaagaacatcttttataatcgcaaatccttcaatcaactgcccaacatgatgtttgaagaatttgtaggtcagtattatcactccattgcccaaataggagaaagcgagagatttagagatcagattagcaccggccgtttgatgaaccctgagctccactcgagacactcgaggctgttgttggcccgatctgtcggtgagttgatgataactacgatttgggagaaatgttgatgacccgactacaaccgtgcgagacgttgttgtgttgcgtcttagcgatcgatacacctctccgtgggttgttgatcttgccggtgcagatcaaccttattcctgcaagcaaatcgaagaaacaagcaagaacaagataaaagcaatctgaattgcagataggaattgaacacaaatgataagttggggtttcgtaacgagtaaaccggcgatctagcagatcacgggattacacggcaaagtagcaaagctaaactttaatataaacaaaacccaagaaactctaaagggctacctagctaattataatggtgggaggacgaccaaagggaccctagggtcatgatccacctggttggggcgcacctcacatgggcctgttaacaaccaaatttggtaatctgagtatcggagatgaagataggagtggagtagaatccaagatggaaatcgtttcggaaacagagaaaggatcggttaaagtccgaatcagctgtgaccaggatcggcagagtccgagttagacaaggttagccgattgagccgaatccgacaatatgacacggcatacgttgtcgggttgagttaatgtgcttcatgaggattgccatgcatggatagagttctgagaaggcaattgtatctattaattaggatatttcatgtaatttccttatagatatgtttgagcaaaagtctgccgcaaagacttatggtatcttagagtttgttagagataagagtcgtgccgacatggacatatcttgtaatctcgcgtataaatagaccctgagcctcatgtaattaaactaacacacacgttcaatacaatctcggcgcatcgccacccttttactttcgttttgtttcgacgagttcttgctttcgggttgagctgcatcggtttcgatcttcaactagaggtaaaacttgttatggcggtttgcgtcctcgggattagtgcttccatctttatgatactctaatcttgtttatgtaatttgtcgagttatcatata

SEQ ID NO: 39223 - DNA, 1501 bp, Oryza sativa
accctcaataaatgtgcattaaactgcatgaaagtgtatagggaaataatttattcaaatattaggttaattatcatgaataaatataatttttgcagaatttatcttctcttctaagcctcttaaaaattcaaactggtttccaatgagtctatcttctcctaattttttgaacaatctatccataattttttagtacaaccaaataaaatggaaactaggtacattcatctgcctccaataaaatccatgtgaactcatatgcaataaaaattaatctataaattaacaaagaagggagaagaaataaaatcaagaaaaattcctggaatttgcctgagacctgtgtcggctgtgcccacctgcttctggacccaaacttctcatcctcacctaatttgctccgacctgggcccacttgacggtgtcacaagctagctccaactctgtgcataacttttccaccaatctaaagacccacaatgaacgagagagagtgatcggctctgggcgtgcgcgacgcgtggccgagacgtggcaacgccgagccgagcctccttctcttcccagccacatcgcccatcctcactcctcactccagtgccgaccaaaccgagagaacaagctctagctgctttcctcgccttcgatctcaccgccggctgtgatgaagacgacgctcgtcctcgcctacgagtcttcgccaaccctatctcttccacgttccatactcacctcaccatacggaaaatttctccttttgatttcatcctctctcgtgcagcggatcgacgggaacgccgacgtgccctcaagagctccagagcgcgctccaaacgtcgctgtggtggcatcgtcgccgtcgccaccgatctggaccaagccgggccatgccatcgcgccatcgtcttcgcctcgtactcctctccatttcccctcaagaaccacgaagaatggtgctacgagtgtggagatcggccaccgtcttcttcacctccggttgccgtcgccattgtcgtttccgcctcctccggtgagccattgctcgattactcgcgcacacaccatctctctggcctcactaacctcatggacacatttgcacgatagttcttggtgccgattgagccgtcgccgttcacccgggaggttcttgccgtcgccaagccgttctgcaagccaccgctgccgccaagaccacggcaaccttcgctagactcatggcgagcattcttgaggctttagtgtcgcattcatgcactttattcatctagatccagcccctaaagtcacatgcaccaccacccgaaaccatctttcgctcggacccgccgccggcgctactccgatgtccactaatcgagaaaagtagaggaatggaatcgtgagagagttctcttcattttatatttttacctcaaccccaaacgagccaccaatcgcctccggtgaacctgagatcgagctcagccatggctgctctgcctctgtagaagacgag

SEQ ID NO: 39224 - DNA, 1501 bp, Oryza sativa
ccggatcccttgaatagacgagacagtcgcctcctcattctgtacaatgaagcaagaacggactaactcgacgggggttaggaatgacaagagtttcacccgccagttagtttcaccaaagcaacttgtataaatgcaactaagtgatttgaatttgagggaaactatcaaagcttgaatgagcttgagagcaaactttggagagggaatgaaaatgtgttgaaatggggtacagtcccctctcccggccggttaacatacccgaattctaggattaagaaatttccatcaaaactagttgaaaggaaagttcttcaattttgtgaaccaaaaatttccattttaaatctaggtgaagttgatctaactcttgcgtgaataaaattttagaataaattaaaactttttcatcttcaacctaggactagatgcaactcaagtgaaagcatggatacttgcataaaacatgttttgacttgagtctttcttgtgcatttagatttttggttggcattgcatactaggactcatgagcataaataaaagataaagtttcactaatcaaacctacaaccacacttgagcaataattataaagacatgaaaatgaggttaaatagtatcactatagattaagagtagtctaaataaatttcttacaactatttagatgcatctaagatttggaaatgtccatataaagaaaagaccttgctaattatctaaaataattcgtgcaagataaaattatggaaaaattcatgtaggctctacttaatacatgcaactcactgtaattttggtataatttaataactaaatttgatacctaaaataaatcggtcaaaccagtcaaacagtaggttaattataatccttaatcggctaaaaacctaccctcaataaatgtgcattaaactgcatgaaagtgtatagggaaataatttattcaaatattaggttaattatcatgaataaatataatttttgcagaatttatcttctcttctaagcctcttaaaaattcaaactggtttccaatgagtctatcttctcctaattttttgaacaatctatccataattttttagtacaaccaaataaaatggaaactaggtacattcatctgcctccaataaaatccatgtgaactcatatgcaataaaaattaatctataaattaacaaagaagggagaagaaataaaatcaagaaaaattcctggaatttgcctgagacctgtgtcggctgtgcccacctgcttctggacccaaacttctcatcctcacctaatttgctccgacctgggcccacttgacggtgtcacaagctagctccaactctgtgcataacttttccaccaatctaaagacccacaatgaacgagagagagtgatcggctctgggcgtgcgcgacgcgtggccgagacgtggcaacgccgagccgagcctccttctcttcccagccacatcgcccatcctcactcctcactccagtgccg

SEQ ID NO: 39225 - DNA, 1501 bp, Oryza sativa
acccggctgtacagatctaatctccaaaccaggagctaagcaaattattatcaggtataacatccataattattgtgagaggtgtgagactaatcacgaaaaacattgctcaactcgcccataaccgcgggcacggctattcgaatagttttactctggccagaggtgtaccactgtacccacaagacacagcctcaacatcatgtctaccatgcgtcgcgatactggaaagtacccgaatagaggctgtgacaataccctctgcataacacaactcaccacagtgcaccattcctggatcataatcacccccttataaaacaaggcatggactccccagcgacccccgtgggcttatctccgccacttctcagtctggtgctccgtaatgaatcatgctatacaaaaggtaaagccgttgcccacgctggcttgtggttggcacggttaatgtttcacaatagtagctcgcgaaccggtccttaattgtcatgagcacgactctcaaaaccatgtgctcacaacccaccattatcaggttttagttggcaagtaattaattaaccaatcacgattgaccatcgtgaactatcattaaaccatcattaaataataatgaatcataagttatcccaatagtgtgctaatgtttctgagcatggctaagcaatcacatctaatatctagttgaactgatatataaagctcaactagtcaaattataataaccctaggtatcaaggaataaagtaatcaagaacaaaagggccataacaaagaataggttaattccacccaatgacattcgaaaataaatgcacagttgaaataaatagagaatttaaatataggatcaacatgttcaaaggattgtgtttaggatctgtgtgacttgccttgcaataatcggtcttcaattaatcttcttgaacacttccgacgcactcgcgaacctttggaacgacggaaacgacaagctaacacgcaaaacgaagaaaaagactaataaaaaccaaataaacaatacataaaaagtaaacaaacatgtaaatcataattttagatgaattatgagacttgaacggcctcattctgatttcatatgaatttattatgaattttataagattaaatctatttaaagcccatttaaaaagaattaaataaatttaattcaatttatggacaaatttaatatgtagatctttattttataatttttgcaacttgaaccacattaaactgagttcaaatgaattagttatgaatttttaaagattaaatcggattaaaacctttatatggattttaattgaattatgacgcaataatgaattatttttgaaaaggaaaaggggatttattgcgtcagcggctagggtttgcggtggaccgggtgcacggcagcggttcacggaaacgaacggccgagatcaaccctatccaaaacggacggccgagatcgaatgggtccacggcggctcacgggagagggcgacga

SEQ ID NO: 39226 - DNA, 1501 bp, Oryza sativa
ccgtagcattttagaaaggggtttagggatttggtagcaattcgagctcaacaactaaccaatattttcattaaatccctacaaatgctcttaccttttgtccctcagcattgtcagatccattttgtgcacagagggtttgagttaatcagtccatttcagtggtcactctatacagggagaccacaattttcttggatttttttgtgcttgtatacaaaaaaagctatcttttgtttttgtgtgctatgtattattttttttaacggtagtcctgctcaactgtgacatactaagacacttttgcttccatttcatcagtgatcaatctgagataagcctccctgaaaatgaactccaggctctgctcctaccaattatgtttaatctttttgagattaccagcagagcattgagagaggagagtaatcgcaaattcgcaaagcatcggtgtgttacattagcaactcagcaaatgacagtgggaaacacaaaatgagagtgagattaacggaattagtaggtgttgatagaaaacacgaggcctgggagatctgcttaacaccagtgcaggtccaaagctcgccttcgaatgtatgagcgtgccagttgatttgatgctgtaatcaacaagaaatagagacaaagaattcgtggttaaatctataaatgatagccgatcggctaggtgccgatgacatatcatttatctttgggccgatgtcatatatgaatcgacggtggttataaatagatagtaaggagctaaatctattcgattggctgtagatattaacaatatatagttcttatattaatatatacttaaattaagtgattgggatagatcggtcacaatgccgagacagtataaatcacttagatcgaaatacatattaataacaggattatatatgtttatagcatagccgatcagatagatctagcatgtatcggctaatactccgatactactttatataaagatatcaaaacaaatataatataccaaacaaaagcttaatatacttaaatgcaataagatcttgacataaagggcggatttaacatgtcattgaagcacaaagatcgaatatggttaaatcaaataagatcggctgaaactccgatgctaccctaatcagcaaccagaggacaggctagagattgatattctaagcacgacttaatagatcaaactcaactgatgcagcattaagtatgaaaagaagaacaatatctagacaatcaagccgctgggtgtttcataaagtggtagatatcctatataatctaggacaacgtcgctatttaacctaatcggctgccttctattaacagatgttagccgattgtaggttagatgacgatattgccaaagattatgtaagatatatgataacttgacgaattatatggacaagattagagtgtcataaagatggaagcactaatctcgagaacacaagtcgtcataacaagttttacctcttgttgaaga

SEQ ID NO: 39227 - DNA, 1501 bp, Oryza sativa
atgtggtagatatagtgtgtcacacctggtagtcgggtatcatgttcggtaccaataaatatcatacatgataccacataagtatagagtgacgtcagttttgacatgaatatgacgccattacttaaagtatccgtctgaacggggtaccgttttcgagccgttctattttttaaaggatagagttattacgcagtaatgatgcaatattgaaatattttacgtcaaatataaaatgataaaaaatataatttaatttaaaattaagctctaaattccctaattattttttttgccaagtgccaatgtgattttctaagttccgtaacaacttttttactagtctagacaaagagtaaattgcgttgatggtacaataacttggcaggtgggtgcgattaggtgcaaaaacttgaaaaccgagcgtagcggtacaataacttggataggtgggtgcgctcatggtgcaaaagttgccacgccattgttccacctcagcgaaagtgccacattagcattgacacgaaagacctatctcattttatagaaaaccccataatatgatttcttgacgtacaaatatctcccttcatctttcttaagtgatcctgattgagaggtggttgtgctggtggcgacgcaacggcggcggcggcgacaacgacgagggaaaccgtgcaactacgtcgcggcggcgacgagggctctgtgtgccacactaattcaagccctaaaccataaccaaaccaattcaagtccacaaactactgctgtcgacgtgattgccgcaatctttgggatggctctgactcggcgagttctttgagcttctgctccttgttatggtaaatcacttgctgatggttgtagatttctattttttgttcaattgatggatgattgcaaagttaaggtctcattgatttgtacgatggctgcattattttggtctttcacttgaatatcctgttatttgttatttgttagtgatataccctaaaggcaatcatagagatgattgtatcacatactatgtttacatatttgtccgacattgttccttgaaatagataactccttattggttaatgaatatgtgattctttcatgagactctttatgttgtttgttgctatttctaaaggatccctgatcaaatatcatatgtggaacaaatatgtttagatgatcagcacatgtattaattgatgatcatgtctcatggatcatgatatagagataccaaattaataatgtggacacatcttagtgaacatgttgttggatagacccaacatgagacactgcaagagccatatgtgttgtgtcatcagtgatctcatttagtgttggtgttaaatccttagacctgagattatcatggttcctaacatgtgtagtaacttatttagggactgctaaacgctactctgtaattgggtagttataaaagtagttttcggttatgctatgaaatatgtagtgggatatgaataatcaa

SEQ ID NO: 39228 - DNA, 1501 bp, Oryza sativa
ggtcgacggcgtcgccgccgtcgtagagatgtcctgttgtacgcgttcttccggtcatcgatcgccaggtacaggtgcttcttcgccgcgatctcgccggcggcgccgtttgtggcatccgaggagttgcctgatcgtgggcctatgatcaggtggcggggacgaagaaatgctgggacgtcggtggcgtcgtggcggcggacggggcgccggagatgggagaggagagggctgcgcaggccggcgaaggatcggccgcgacattgtccgcgaccgcgccggcgcttagggttacgtacaccatgcgtgacaccattcgatctcatggctatgtttttgtggcctcctctatgattgatgggctttggtctacctctcggcctttccctctggcccaagatggcccagcccaattgttgttattagttactaaatggcaaattcacgtacggagtaatatttttatgtcgcaaaatctaaatcgagagcactctcgatttagtcataacgagtgacccctatttagatatgtgctaacttgaagaatcttactttactatagcactaatccatgaagtaagttgagaaaatattcctatcatctaagcttcaaataaaattttctcttaaattactcatccgattacaccattatgttcgtaataattaaaatctttacaacaagatctcacatgattatattttgatgaaaaatcacaaattaattttatgatttgtctaaattacatttagatttcactaagttacttcttagaaatataaaagtaaattcagtaaagcctaaacgtaatttacatatattatagaactaacttataacaaaaagaaagtaactttaattaattccttttttcattgaacaaattatcatatatataattatcatatatataggttacttttgattaaaatacttcctatatattcataatgctctgaggtgattacttttattattgtttttagttaattccataatttgtgctgattaattcaatttctagatagagtcatgtttttatctctccaacagatttactttaaatgacatggcaaagttaccttcgttttgttctaagttacttatataatatatgtaaattacttttaggctttactgaatttacttttatatatctaagaagtaacttagtaaaatctaaaagtaatttagacatattataaaagtaatttatgatttttcatcaaaatataatcatgtaagatcttgttgtaaagatttaattgttacaaacacaacggtgtagtcggatcgtagatcggatgagtagtttaagagaaaattgtatttgaagtacatgtggatggtgtctctatagatagagtggtagctggtttagacaaacttagtggtagctgtgtagttacgtcctttatatgtacgtatcaaaatttaaattattattggtagagtcatataacaacgacttcgccaagaattgaactcttaccggtagag

SEQ ID NO: 39229 - DNA, 1501 bp, Oryza sativa; identical to SEQ ID NO: 38941

SEQ ID NO: 39230 - DNA, 154 bp, Oryza sativa
gcttcccctcctcgtggttgcacggcctcatgccgctctccccactaagtactgtaattaattatcaccaccatcaaatcatcagaatctaaaccaaaatatcttaagagttaagatgaaagcaaaccttaaccaaaagattaatttatcatca

SEQ ID NO: 39231 - DNA, 1501 bp, Oryza sativa
tttttattagcatcatttattcatatctctatcgaaaagttgtgctgaccacgtctcatgtctctcattaattatgaactaccaacaatttcgttttcaagtgagatgactgctcggttacatgcgctgaatgcactgaacaagtagacttgttaggtagctttcagttcagcgtctcggattagctaagctagaattttaacatgtgagggggccgacttgttgagtaataataatacttaattgttgtagtaactaggaaggtagcccgcgcagttgcgcgggcatattatttaaactatcataatttttgttgttattagaaagaatttagggtttcctttgtaacacaggatttttagaaaagaatagaaaatggtatataaatgattttgagaaaagaaaagaaaatggtatataaatatgatagaaatgaatgtttaaaatatagtatggaatagaatggatgtttggatagagtgtaaaaaatttaaaatgtattaacccagttagatcaaattatcatctggacaaataataatcaaacaacctttgcattagtagcttgacgattgtctcgatggtaattttttaaaattctgttatatgcaagatatatatcttgcatgtacgtacagatatcgtggagagacgagtgattatgtacgggagggaggtggaatggatttgtatttttaaggattggtctatcggatgtaaataattgttttaccgattaaagttacaatggtcatattttttttcttatattttatatatgttttttattttgaaaagatataatgtaatggtccaaaataacaggtctaagattttaaatcatgtgatagcgtaggattttttagaagcatgtgtaaaatagaggatagagaaaagtggttatctgaattattaacacatagattattaacaaaacaaattacataatccgcatataagctgtgagacaaatttattaagcgtaaataatcggtcattagcaaatgtttactgtagcacggcattgtcagatcatggcgcaattagttttaaaagtttcgtctcgcaagtacaggaaaaacagatgattgttaaattttgttatctatgtagatgaaataattatgcatttgtgaaaaaaaaactgcacttaaccaaacaaattttgcatcactttgctttgactaaaatactaattagtagtaggcaactaatactctgtaactctgtctaagctaattttttttgctcttcttttctattccgctatacgagtatacgtatggatagcaaggagagagtgacagaagaggggaaaatggaaaggatgaggtctgaggggaagggcggacgaggagggcggatggcggatggcggatggcggatggcgcgggccggaggtgcgagcggagagctttgggcaggggggacggcggcgcaggcggcagggatggcgtgggttggcggcgtaggcggcggggacggcgtcagacggcgggga

SEQ ID NO: 39232 - DNA, 1454 bp, Oryza sativa
gatctatcccctgaatcgggatgattgcgccggtctgaccagtccagggctcggtctgaccgacatccagaggcgcggtcagaccggcttgagtcccggtctaaccgccggggtaatacccggtctgaccggccatttggccggtcggaccgatggcgaagtcgcggtctgaccggccatcaggcccggtcggacaggccatctgcgccgctccatcagttctactacttgtttgatctgtaggagcttggctagcactagtagaggctttatcttttaacataaaatcggccatgagagggccgaatttagttcttaaaaactcatcaaatcgaccttcaatagttgcgtctaacttatttttaaaaataaccatggatgaatctattgcagatgcatcttgttgttggatagattgtgttacctcttcattgcttaccaaatcaggagtgagcttaggacgtggcccaggcttgatgatcacgccttgacgagtcctagtgcacgcccttatcaacgcctcatgtgtgatctccttaatgtactcctccatggacttgcgatcttccccttcgaagtcatccaatgtgattggtatcacattggtcggctccacctccgccttggatgacgactgcttcgtcatggcaaagtcgaagttgagttgacattgaacggatctccccagtggagtcgccaaaaatcgtgttggcaacttttttgtgacaagttgacaagcacgatcgtagcaccttatgccttgcggtgatcctagagtcgccaaccaccttgatatagcaaagagctaaacctagatgggtttttacaaataaactggctagcggagccgattttagataactacccgtctcgtgggcaaaacggaaggttttcaggacaaacctacaaagagatgtcgcactctcgcagtggtggcgaacggtttacgacgcaaaccgacaaagatggacaaacctacaaagagatgtcgcactctcacagcggtggcggacggtttacggcgcaaaccgacaaagatggacaaactaagagaaaactaaaagcaatatgaaaaacgattcgattgattgattgtagattggttgttacaatagaaccggccatgtcccttatataggggttggtcttaccctttacaggccctcctccacatccaactcggggtagaaaccaaaggaaacctaaagcatgccttcccgagcaaggaaacctcgagacccgaggaaacacagtccgactcggacctgccggtcagaccggccacacactgccggtttgaccggccctcaaccggtggtcagaccggcccactcggaggaaaccggtagacttccaaatcttggcaatctttcctatattaatcctaggtgccaaatttgggtgtaaacgttatgtattgtgtcttacactttttttttgttatcgattgcaaa

SEQ ID NO: 39233 - DNA, 1501 bp, Oryza sativa; identical to SEQ ID NO: 38943

SEQ ID NO: 39234 - DNA, 326 bp, Oryza sativa
tatgtcatatactcaccttgcaatcattcatcagaggaagagttctgcagtgaagctgatggtgtggaggattaggtgtagccctggtcaagctgcctgtggagtggagccgtctgcgccgtttattttattttccgctgcttagatccttattgattgagaggaactatctacctctgtaataacattttttacgcttatagagtagtaattgtactctattatcaatttgttattgtgtgcctcggctgattcctggacgagggttcacacacatgtaagcgtttggaattttggatagaaattccgggcgtgacagccagcca

SEQ ID NO: 39235 - DNA, 1501 bp, Oryza sativa; identical to SEQ ID NO: 38944

SEQ ID NO: 39236 - DNA, 1501 bp, Oryza sativa
agagaaattcacacctgaacagaagaaggattttgaagcaatgttgtagcatgcccgggatcagttcttgaactcattcatgcagacccgcaagggaacattggttcagaagtataaagtaaaggtagttgctgatgatcttgggaccagttcttccaaaggtgaagacgggaaacaagctccagatggctcggctcaactgagtgacaaaggtgctaccgacggttctctaggaagtcaaggtgacaactctcaagggatccatggagttcaaggcgatggagtgcatagagttcaaggtgatgctgctcaggggttgcaaaggggaaatcttaatcagaatagtgatgttgcacaagattttttcaataatttccaagaccgggtcgactatgctgtgcaccatgctttgatcaatcagtctggggtgttagtcaataccttatcaaacatgatgaagtcaatagccgatggatcaatagctgagcatcaggctgtaggcccagtttatttgcaaggaggtgtctttccaaattatcggctttgatcactgatgcccagccatctattcagccagtttcccccgtcgcaccatcatgtcagccgacagcgccggcatcgacccccttacctactccgtcagcattggcaccaggccagctggtgaaccctcagttgttaatgagagagcagccacagcatagtgggcaggttgtgaatcggccgacgcaagatcaggttgctgccatgtttctgccgcctcaacctgctgttgatccaatacagcagcagccgattcaatagacactcccgattcagcaggttgtacaacagattcaggtggccattgagggaggcaggattaagtttgatgattccaaaaagccgatgagggtcgatgataaccaatttcccgttaacatggtacacaaagctggccgaacagctgatccggggcgcatgaggggttatcaagtaagttcggctagaattataaacaaatgtcaaaggaaatatgacaagcaacaggaaaggcatcatgaagaagataatggtggctttgatcctcattggggctgtgagttcttcaggttctattggaatgaaggtatgaggttaccatctatcgaggattgtcctggatgcagtgatgttgcagggggttcaagccgattgtacgatggaggcagttggccaaaacagacaagagtgcctgttcatcagagattgggcccagtaaaccaacgtggtgattcggaatatgacgaaaataagaagactcaatggtgtcctcctgttatttttacgaagaatcagaaaagaagggttcaaagattgaggagtagggaacgcttccaagaggtcgagcaagaaattaatcatcggctgaagaaaccaaaaccgaggcaggagtggagtgttaagaatcaggctcctgtagccgatgatgttgcagctgatgaggcaaagaggttggcaaaaggaaagagtgttgtgacgg

SEQ ID NO: 39237 - DNA, 441 bp, Oryza sativa
aaattaatataaattaatcatcttaaaagtaaattttataaagcctcacgttttatgatcaaagttacagaaaatcgtaggtattatgacttgtaaaacataagagattttatggtctaatgttttaaaaattcccaccttgattcgaatttcaattgatttcaatacatctgaaataatacttttcaaagtagtgaagagttaaaccgacaaacttaatgaagaaataaaaaactaaaagtttcatatgcattacatgttttgaaacggtaagtaaatatttaccaaatatgtataggcgtgggattttgtcaaaataaatagatgaggctatgtgccactggccataatgctcaggattttatgcaacttcgatattataaaaatatggggtttgatgaaatttgctctaaattttaacttctctgtgtgaattgcagg

SEQ ID NO: 39238 - DNA, 1501 bp, Oryza sativa; identical to SEQ ID NO: 38945

SEQ ID NO: 39239 - DNA, 437 bp, Oryza sativa
tgctgattaatactgtactaatctcccttaattgcacacgaatacttctgagcttagagtagtatttatcttaccaataattaatttttcaatcgtatctacaatcgtaccctaacgtacgttctcttccctaatttagtgaaggttcaatcacactttctggatctataatccattatattcgtgaaaggatgaaatataagacatattttaccaaacctcttttacctgagtgcacttaaaatttgactactgttaatgtcaaaatctacaaagttttaccgtttaagaataaaattaaataactttaactgatgaatggagcgagtatatatgaaaataaaaaaaaagtatgcacactgaacaaaggaaggaagtaattgataacatatttttttacatatatgggaaatcatgttttttttcatgcatatagg

SEQ ID NO: 39240 - DNA, 321 bp, Oryza sativa
atatagcttgtccttctgtcgtagtcacaatcgtccattgatggtagctgacgcagttggcatatagacaagacgaccaatatagagataatatcgcccaccagaggtggcaacaatactggtggtagtgaagatagtgataccaatcaaaagtaatgaagtcgcatagccatggaggcgaagaaaccagtcggcggcagacagatcaactaacaatgaagatgaaggagcccagcgataaaattgtgtagccatggcagcaaaataatcagtcggtgacagacgaggtagatcaaaggtgatgacaaaatccaccaatca

SEQ ID NO: 39241 - DNA, 1501 bp, Oryza sativa
ggttgtcggcgccacctatcccctcggtgacatcataaatgatttaaattgcactataaatcattattaattctagaaaatcatttaagtagctcaaaacttctattaattcatatctaattcatacgaactccaaattgagccgttcaactggcaaaatgcatctaaaattgagttctacatgttcgtttacttttcatgcactatttgcttttttttattagtgtttttccttatattgcgtgccagtgtgtagtttctgccattttggaagatcgtggtcgcgaggaaaagatataaggttgttttgaagaagcaaggcaagtcacacattccccttgagcattttgatcctagtttacaaatgttttatcgttatcaaataaatatgcatgttttgccaattacatgagaatagggtttacctatctgctcgcttgtgccatgtttacttgttacccgtccttgtcaaccttgggtgataatttatctagctcgtgatactcatgttgacctagttagaactatatgcttagcaatgcttaattaccactagctcacttgatgggataattgcagtattagtccttttagtatcatggcgagctgcgtgctcgagacatccggccatgtttcattggtcgtagttatccaactaaaatgcgactgaatggtgagctgtgggtgcatggttttctagtctgtcacgaccggaaataacccaacaggcgttccttacgtgcgtgcattattccttgtcccaggaggcaaggtacaccaaaagttgatacagttcagagtttaacaagcggaagcgtaaatagataatttattacatgggcagcgaaggcccagcacacacaaagacaaacgagaaacagcggaagactagggcgacgaccacaggcgcttgacggcaggcacgagctagacaccaaagccttcatcttccagggactcctcttctgggtttgggaaaaattgagcaagactgagtacaaccaccgtagtcaacaagacacacccacaagtgcagaataaatgcaagggagtacaagggagttataatataaagggttagggtttaccgtaaacagcattaaaagacacttagttgctcaaagctattttgtaaatacggtcctagagctatacaatattattaaacaaggccgtgaacccacacgagcctgccttaacccaaggcctacgatgattcagaccgaactggcaacccgaccctgggtcccagctcatcccaagccaacccaggccaaccattccacattttagttgttaaacaggttttaagaattaaaacactaacttgggtacattgctcggcttgcccataaccgagggcgcggctattcgaatagattatactctgatcagaggtgtacatctttacccacaagacacatcttcctcacgtgtagccacgtgccacataccacctcggtatacagacggaagacgtgacatagtttccaacccatcc

SEQ ID NO: 39242 - DNA, 1501 bp, Oryza sativa
tcgcctcccctgacgtcgtccacgccgcaggcgaggccgcccctgacgagcttgtcgcagaccttctccagccgctccctcgacctcctctccctctccagctccctccgggacgccgccagctccctctccgcgtcggccagcgccttcccgagcttggcgttcaccctctcggcgcgtcgcctcgacctctgctcaccgtcgagctccgccgccgccacgcgcaccatcgccgcgaccttctccctctgctggctcctccactcccgcgcctcctcgacgagctgcgtcctcatccgtgccgtctcgtcgccgtgccgccggtcctccgtggcgaggtgccgtacgtgagcgcgtgccaggtcgagctcggcgcacagcgcggagagcagcgacgccgtcgacgggtttaggccatcgtcagggccccagatgccgacaagagccttgacgagctccttggacgtggcaaggctgctgcatatctccttcagttgcggcacatctccttggacatgtaatctaaacggcggcggcgacaggcgctgcactcgctggcgtgcggcgcggtgaggaagcacaggctggaagaggacaagaaaagaaaataggggagaggctgacatccttgaccacatagggcaatctagtctttttcgattgtttctctctccattttctccgaaaataataaaataaggccgcgagtgtccgatagctaattaccagttttttttcgtgcctgacagcaaattcgtgtttttccggtgtccactagctaattacaagttttttttggatgccccgtagcaaattttgccattttttatgtggcgtaattctaaataggattatcttaaaaaaactgctgcaagtttttttaaggaaaaaccttttcaatctaactatagtattatagtataattgtaatataattccactataattgtaatatgacttatatataagtgttataataatatatacaactttatatctaacttatataaagataacaatatagttatagtgtagttacgtggtagttataatataactatactatataattgcattgtagttacactataactattactatatttatatttgaaaggttttttttatcaaaaaacttgtgacagttttttaataattccgattctaaatttctccaaaaaatactaaccagctcgcaggagacagagacatgacccatgcgcagaagatctccaattgccaggtcagcctcccacggccccatccaccacgcagcccccaccccgactacgttcctagaccctgtcttccacgtgattcagtgccccacgtcactgatagctgggccccacccaactgtcggtccactgcacccgtggacgggtaacccgcagccttaaatctcggcttgtgtcagagccgctccgaaccccctctctcccatcgccgccgccgccgccgccgacacagccgctgacctcgccgccgccgacgccgatgg

SEQ ID NO: 39243 - DNA, 1417 bp, Oryza sativa
aaaggccatatcgtaccatctcaagaagaattgaaacgtcgagcttagtgtaaatggcatgattctcactctcattctactaatgattgcaatgtgtttcgacgacaggttcaatcggccatagatgaaggacgattgaagttcatcgatggttccaagatgaagcttgatcatgatccttttccgatgaatacaattaatttcaatgataagaaggtgttgattcggccagagcaagccgaatctactaagggaaaaggagaggtcattggtgaaccgaggccaaagatgatagtgccaaagaaaccggaggttggtgtttggaaggaaaataatagtgaagcttcaacttctaaaacccctaggaagaccaaagtgacctttgatatgcttttggggaagtacgagaaacaaggtggtgagaaagctcgcaacaaagggaaaagaccaagatcacctcctagggagcaatttggtcattcaccaagacggtcggaatcacctcaatataattgttctcaaaacatgtcatggggtccatatccaatgccgccgtcgggttatacttatccttactacatgccatggggggcaacaccgccaatgttcaatcatatgcctccaatacaattcaatcaagggtggggaggaccaaggaggacaatccatgagcatttgtcttcaccaaacaatggctggttttatggtaagaaccgggccaatgaagaaaagagagaaggaaagcgtattaaggtggaggcaagaacttcggaagtgattaccatcaatgtgggatctcatgatgtgccaataccttcttgagatgaagttggagagtcctcaagcaacaaacccgaagcaggtaccagctcatcgcagtcggccggtctgaccaggccttctagccggtctgaccgcaatcatacggccggtctgactgggccatctggccggtctgactgccgacccgacgatggtccgaccgacgcctcaggccggtctgaccgcccaccaaatgtcgatatgaccggcgtatctggccggtctgaccggtggtctacatccggtctgaccgggctccagcgccagtttgacaggaggtttgctaagggcaatgcgggggctttatcgtcatcaagtaaactcaatagagggcactatttacctcctggaacggagctgaaacctaggtggatacctaagtatttaacggctactcaaaggagaaggttgcaacgtcttcgggcccaagaaataagagagcaaaaggccgaagagcaaagggataggaggtttaatgagttgcgaccaccaccggtatggaggcgtaaatccatagagaaggaagaaccggttgttgtagaggagaaggaagaacaatcggttgctaaagatgagccatctacaaaagaagaca

SEQ ID NO: 39244 - DNA, 611 bp, Oryza sativa
gatgaatgcgggaaggaaatcggacgaatcggagggagagagagaggggaaaacgggggaaacgggagaggaaatcacgggggtgatttccccctctttattgcgcgcggggacggcgggaaacggcgagattcgcggcggcggcggcgctagggcacgggcgggcggcgggcgcggcgggaggtaggcgatgacaggtgggccccacccgtcagcgagggcggcgggcgggcccgcctgtcagcggcgcgcgcgcgggggaggccgatgggccgcgggggaggagagagagagagggagggagaagtgggccgagccggcccaagagggaaggggggggaaaaagaacttttaggatttttcttttttttataaaccttttccactttgtttatttcttttcaattattatttgtgctctgaaaattccactaaaatttgagggctccttttagaccaaggagaatttaacaaaaattctccgggccacatttgaatttttcttgtacgtattttagggtttgccaatttcttttcgaattttaattaattctattattccttttagaagatgatttttatttcgggatgaatttatcaggacgtgacac

SEQ ID NO: 39245 - DNA, 363 bp, Oryza sativa
gacaacatgggagcatgtaggtcaatttttagcgcaatgtggtgagaggctaatagtgatacatttaaattgcacttgttttctttatctttgtccggtaccgcttttacatggtttacttctttaccagcatattctattcatactttggctcaattagaacaaagatttcatgattatttctgtactagagaaactgagcttaggttatgtgatttgacatcggttaagcaaaaatataatgagcctgccgttgattatattaagagaattagagatgttagaaaccaatgttatagcttgaatataactgatagagatttggctggtcttgcttttaatggtttaattgctcctcttaga

SEQ ID NO: 39246 - DNA, 237 bp, Oryza sativa
aaagtagaacgatattgtagatgtgccgataggtttctagtcagcagtatagtctggtgcaagatctttggtttcggaaatttgtcggcttacaacattgaaatgcatttttcttttcatctgatacaggaacgaatttcctgttattagatgtgactgaaattgtatgttggttgtccatatcttttgtaattgatcttttataattgttgacgtgcatatgtctgtctttgcagg

SEQ ID NO: 39247 - DNA, 1501 bp, Oryza sativa
aaatccactctactttatttttatttctatttgtcatccggtctcactacaactcgcgcgtgtcattatttttccttttctcactggcgtagattttcaatttcatccagtccaatgtgaaggataagatgaaaagaccaaaatgcctttcggctcacttataagtctcttccctcctcattcgatccgatcgagttgagaagagcaaagcacatgcaaaaaagggagaaaaggccaccaagataaagcaagataaaggaagggagggagaaaagtagagagctattagggttggcattgtctaaagcttgtcgcctcaccctcgatacttgagcctgccgctgccctgctttttgctgccaccacaaccaaggcatattgttgttgttgttgttgatcttcggctttgtcacttgactgtggagtcgtgttccatgacgatgatgtagacaaaactagcggcatgcatatattgcctctgtctcgaaaaactcaacttaggtggagatttgacccatcctagtacacatgtccagatttattgtattagaatgggtcacatttccatctaggttgagtttttgggatggagggactatatgtttgtatgatgtaggggaggcggcgtcacgcccagaaatttagcctaaatttccggactattttgtgtattaaatccctatccaggacaagctagggtacacaaaatgacaaattaatacacatatccaaatgtaaataaagcgtaaatacttacagaagaggcacttattcctcacaccgaaaaaaagccgcagcggcggaaaaaaggcgatcctagcggggcttcagctccactccacaggcaaaactcaactggggtcaaagccttggtcctctaatttcatcttcagctcagaagcactacacaaaggggaaaatagcaaggctgagtacaaccaccgtactcagcaagccacaccaatgatgcagacgtgcaaagggatccaaggatggttcgtggctatttgcataaaggcagttgcaaaacatttatagttgaaaacggtaaaacagttgattaattaaggtaatattaaatctccactgatcaacgctataccacgttgaacaggcctaaccatcccacctgaactaaccagttcattaagccaatttattaagggtgagactaatcacggtgaatctagttgaccgcccataaccgtaggcataactattcgaatagttttactctaatcagatgtgtacaactgtacccacaagacacagccccacgacatgtttctgtgcgctgtcatgccaccatggcataccagaaagaggccatgacagggccattcgcataacctcctctaaccaagcgcaccacacctcaggtttcgcccccactcctcaacaggcagcgggcagccccctctcgtgcctaggtgaattcggaagcagcaaaggccgtcacaggtcccactctatcacgccactcttgcctggatgcgtcagc

SEQ ID NO: 39248 - DNA, 1501 bp, Oryza sativa
ctgtccaggtatggagtagagcgtgatttggtaaaagcgagcaagccagtgcctaaattattacgataggattaaacttaagctttcttaagaccttgttcctcactagcaaatcctctctacccctttgcctatttatgccttgtgtccttggatgaacctggagaagagttaagcacacgcgttccctgtggaaattcaataccttggaatacttcagggtgaagtgctacagcggtatatccgtgtgcttgcagattttatctgtgactgtaagaaataccaacaagcatttctggcgccgttgccgaggaacggttgttgtttatctccgaaccttgttcattatcgtatctttttaattttctttcttctacctctacccggatacctttagagaagccttcctgtaaacacttctctaccatggagcacaaacctatctatcaattatcagctcctaggggtgaattttatgagccacctccttcaccgaagccaattcttacatctggctatgaaattcgtcctaaaattataaacatgattagggtgaaatccttctctggcttagatcaagagaatccctaccatcatctgcgagagtttgaggaattgtgttcatgcctcatgattcaagacatgacacaagaaatcatacggtagaaattgattcggttctctctttaagagggagcgaagcaatggtacacatacatcgttgggaatgtaaacggtaactagattatgttgtgagataggttatgcctcgccttcttccatgtaacccatattacatctcttcaggtacatatcctcagttttcggcagattgaaaaagaatcaatcaatagcttgggccagatttactttattagtacaatctacgcctaacttgtctatacccgattatgtgttgttacaacattttcatacaggcttagataaggagtctgcattccatcttaacatcactgctggagagtcgttttttcataacaccccatctgaaggcacggaaatcctagatcgaatcttggaaaatacttcctttgttgagaaatattctgaacccctccaaaaggcatctgtgtcaagtcgtgaggacccatctttagtcgaacctgagtctgacctttccatatctgtagattcaattaaagaatcctctcccaagccatcaacaccggagagcaaagaaattcgaactccaggatgtgctcctgacttcagggacgattttcatgaagattatggaaacaccctgaattatttcaacaaaaagaagccacatattcttactccacctcccgatccaatcgaagatgaatatcttggagtaaccgttggggagttaaccacaatcatgagcaacgaatggttgaaagagaaggagttctcttctaaagtaattcgggttaatacttctcctcataccattccttgccaaataggagggaatactgtaggcattttgtatagtccaacggtgatgtgacca

SEQ ID NO: 39249 - DNA, 1501 bp, Oryza sativa
gcactatcgctactacaacggcctcccgaatgcaaggttagacaagcacttaacttaataggccaaggtcaccccataataacacatgtggatgtacagtaaacataatgaacaaacattgagtgaagtccttaggtcggtttgggcgcactctccccctatcggtacacaactaatcaccatatgtgtaccacttgaggcccaaacctaaactccatgttttccatcattttatttatcaaaatcacaagtattaaagttctgttcagattatttcaaaatcaattttcatatttgtaatgaatccataatgataaggaagatcattctaagcatggctaagcattatagtaacctaatgactccaaaactcatatataaagtggtatagtcatattgttcctaaggttaggaatctgggatatggatatatgtggggttagggtgataatgcaagtaataggagtttgtctaacaagtttaacaaaattttaatttattagtgtacaatcaacatgcaagatttgcaaacattttcaataacctccaaaacataggtttaaagtgatcaaagagagggaggtgggacttgccttgcaactgaaaaatgtcagcacctaaatcacttcttcaccgtttaagcattcatctatataaagtacacgttatgcaattaaacaccgaaatatgcgaaaaaaaatccaaaatgctctaaaatgcatgatttgtgcacagaggataggcactggtttaagatgaattttaggtgaaagaatttctattttatctctttttatttgggagttatgaattttagaagtttgctcagtataagatagtatcacctagggagtgttataaaatatttttataaagtgatgtttattaagtttgacttcacagaggtgtagaggagtgttttctaagactaacacatttggtttcataatttttggagttaatatgaattctttatgtattttacaagttataacgtgttctaggcatatagtctctatgaatatatggctttagaagttttatgtccaaaacatgttctatttactagagatgcataaaaatgaataatttagctaaccaatttaatcttagttcaaaattttagagtttatattactctactacatattttataagctagggagtgttctatgttagtgacttaacatattaacctagagcatagtgtgccaagttctagtggttagggacggaacttatgttttctctggtccaacaagttggtttattcatagctagagtgcattttaaatacctctacacatatattttgcttaaccattactatgttgaattccactatgttcactccatttggactaaagatgaattttctacaaattttagaaattaaggtatgctctatgttgcttattccttacacaaatgtttaggggtttttattatactgtaagtatgtctttttattttactagtgaacgtgcttgcacgttccctc

SEQ ID NO: 39250 - DNA, 1501 bp, Oryza sativa; identical to SEQ ID NO: 29979

SEQ ID NO: 39251 - DNA, 1501 bp, Oryza sativa
ctaattaacataatgactaggtcagtccccattctagaaactgcggtcgcacccgttcgtttgacataagtacctggtgacaacttatatcgatcgagacagtactagccatccggaaatcatccaattcgtatgtcctgtcccaatctaagtataaaacattttaaccagattgtaagcaaaataagcaatactaaattatctgggtttctatggttgaattatgcatgtgaaagtagagtattgagtagaaaggttataaataaataacttgtaaaatataggcttaaacgatcaaaatgtgtatagtaacttgccttgctcgatgtcctgagattgactgatattatctaatgtgtcataagattcctcaagaccaagggttaaacatgtaaaattcaaattcaaaagggattcaaataaaatccaaaaataggtaaaaataaaataaaatataaaaatagcaaaagtggtctcaaaagatagagaatgattttagaagaattttggttcaagtttcactggaaatgaatctatattttaaaatatatgggcttctaaagtttgaaaatcaaattaaatgttaaatggtattgtgtgtgggtcccaccgatcagtctctccctctcttctcttcttcaacctccaactgttccccatttacggccggcggcgctagggttagggattatggcagtaataaagggggaaaggtgttgcggccgaggaggggaggtagatagggttccccggcgacggcgagcggcgccggaggggttaatttggtgtgtgagtaacctagcggctagggtggcggtgacatggatgagctgagaaggtgatcggggtggtgagagttaggcatggctcagggaaggttcctagagcatctatgaggtgtctagaaggatttaagtagcttgccgacgttcggcaaggtatggaagatacttgctgacttgcgcctccattggcggtggtcgagctcacgtcggcagtcaagagggtgatgttagtgctaaccaattacgaaaatggaatctaaggagtatgtcgatggttaaaatggaagaactcaccgagataggttgaaacgacggattgcgaccggaaaaacctctcggcagcgaagaacagagcagagcaggggcggcagtgctcggctcggtgtgacgaggtgtcgacgcagagcttcggttaggctttagtatgctagaacatggttgaatataggtgttctatgggttggttagggtagagggtggatggagtggtgtgaagtcgctcgcgcacaaggtgttcgaccggcgggcgaggatggttgatgagatggattggtaaagcagagctttggggttgtggggttatggttggtgatgatcgatgatggacaaggaagggattggggtcctacttatagggtcacaagatgtcgatgagctcgggcgccatcaacgccattgatgagctcggaaattgggtatggcaggggtggtagagg

SEQ ID NO: 39252 - DNA, 1501 bp, Oryza sativa
ttgcaattcatctgtaggacaggcatataataaaatctgtcagccatcggcaatggcagtgtgagcatttctattttctttacttaccaaacactgtgaggctctcaacagaactggatagggctctctcaatcatttcatggccaaggtacaacaatcctcatctaacttagatgcttcactttcctgattacaagtttacaacatctccttaaaagttttgaaccataagcaaaatttatgtatatgctatatggaaccaaaaccttcaagatcaaactaaaaggtagtctaaggaacaaaatctatgccaaaacggtaacgataactactatatttgaaaaaatacttgataattccaaaaaaaaatatccacgagattcatttgagtaaataatgagatggaaataaaatgtagccttgaaagctattgtaccaatcaacagcattctgtttactcatgttcaaatgaaaaggagcacataccatgcccagagatttggaagtataaaacaactgaagcatcactcaccatggcttccacaatgtccttgactgtttcaaggctgaaatatttttctatagcctccagcctatagtaacacagaacaaatgagatatacatgaacaaataatacatttttcctaatcagtgacatgaacaatgtggatgctatacatacattcacatgaaaattcatcattatttaagaatataaaaaagcatgcaaggtgaccccattctcagcacattcaaagtgcaaccaatgtatattactaccagtcaattatattaccaagcgaacctagctcccaaagaaatatataaaccacagctttacaggtaatgcaaagattcatgaaccacacaaaatagcactcggcttgattaaatgaattaagaactatatgccttataaatatagaactatctattccatatttccatgacagttttgtgtgtctttctgcagaataatgtaattacactgaaatagatgatggtctgagttctgaaatgcagtccaaaacatttttaccaagcaaaggaaagcatcttgattctactataattcccatgctatgtttaaaagaggacaagattatctagcattccagcaacttctgcatatgacatgttaaagcacttaataatacattctcagtttataaattagaaatatatttacttcttatatgtcttacctacaaataatgctattcttatccggatacacaatatcctcatgtatagaaataatgctgtcatcatgctgagagagagagagaggtcatttgtgaagaagagcaatactgattcagaactaatcatcagctgagaaaaataaatcatattatagtttcaggtttgtcactctatttagtaaataatgttgttccacttttttttgttaatgcgtaagttccaatcttagcatacctttgtcgagttaaaatgataactacacaagtttcttctgtctttgacaccttggtctcc

SEQ ID NO: 39253 - DNA, 1501 bp, Oryza sativa; identical to SEQ ID NO: 38953

SEQ ID NO: 39254 - DNA, 1501 bp, Oryza sativa
acgcatgatcggctagtgttgctgatgcatgacagccgatgtgttttacatcgtcttgagatggccgatattgttatatcacccttagtcatttttctaattgtaatcggttatggtttgccgatatatataatggccgatattgttatatcgcccttagttgtttttctaattttatcaatgttgttgacattataaaattggggggcacatatatacaaaaaatgaaaaataatgaaaaattagaagttatgttaatcggcacaaaggattgttcaaacagcagggttttaaggtatcttagccgattacaagaatttctaagtcctattacacaaaagttattgagacaagtactgctggatagccgaaatagctctttgcctaatttgttcgacttcttcaatggcttgggcatcctgagcatcagtcctaggaatgatcttcagggacttggttaggtcagcaacattattgatagctgatttgagccttgctttttgctcttcgacagattttgggagatcggctagctttttgtgctccatatccaattcagcattgcattcttcaagctgtgccaagagatcgatcttgcgggcttcaagccggtcgatattggatttgatcggaccttcggatagctgatcgagtttgatttttcttcatgcacaagctgccgattgacttggattgtggcttcaatctctttacgctcacggcgttcggctaatcttagcttggctttttctagtttaaattgatgttgctcaagataagcggctggagttaggacatcggccagttcttcaggaattagagcttgaacttcgtgcaatcgtatcctaatcgatccatagtcgaccactaagctatccagagaagaggcctctagccgacgcgagatatcttcaagtgttctctttgcatcgtcagataagggagctacagctttgcttgaagtatcttattctgcctcatcaagataatctttgatatcaaaagaaaagagatcggctagaacctgcaggtataagttcagaaagtttgagagctaagtcaatatagtcgatctaaattcttgcatcaaaggaaaacttactgggatagcaggagcagccggttgttcttcttccacaatatgatgactccccacggccgatggagttcggtcactcgatgatttttgtacaggagaagaaggagtaggaggaggctataaaaagacaagtgttagacaaaatcggctgaaatcaactagtaaaattgggagtgtcttactggtggagctggtttgagaattggtgctgccgatttcttctttatagcagttttcttcttctgcaactacaaaacctatgagtagtcggctgaaaaataatgattacaaaagggtttgcaaggaaatatgttttactctgaagaagtgagtgggggcagaaggagttgaaggtatctgcttaggcgaagccgatggtgttttttcagtatcacttacttc

SEQ ID NO: 39255 - DNA, 1501 bp, Oryza sativa
  unsure (1)..(1501): unsure at all n locations
tatatgtatatatatatatatgtatatatatatgtatatatatatatatatatatgtatgtatatgtatgtagtaaatttgttaggggctccatggtgcccatactccaatgccatccaccgttcgcttgctttaagatccgtgcatactcaaaacacggtattataatctattagcgggtttaacccaataagactcatgattcacatgcatatactcatgattttgtttgcaatattaattcatgcccgctaattgctattattatccttccattttctatgcagatacatatgcccagtgatagtattccatttttcatgttcacggttttcttggccacactggtacaccattgtccgcgagctctttcgtcgttgctgctggtccttccgcgcgagctctcnngccgacgacattctcgtcaccacgccgtaacgaagccggacggccacaagcttcttcgtcgctgccgctggttgtccatgagtttcgttacacggacggcgttcgtccatgaggttcttgttggcagacagacctccgcaaccttcgttacagcgcaggacgtccgcgtgcggcgtgcctcctcgccatcgctgcccgtcatccgtgaggtttggcactaaccgtaggtatgtgaaaagtctagatcccagaatttatcgttcgtatagtttaagttgacatgcagtactcccgtgcgtatgtatatgattttcccttttttttccacagtattttactaaccaaacccatgttgaatcgccagctggtacccaagagcaaaattgtttaattttgacaagtgaacaattgcaaaaatgttcctccgatgtatattctaaataaattcaattcaagtgtgtattaatttatacccgggtataaattaatacacacttgaattgaatttacttagaatatacctttacgtttttttggtgcctaacggatatatacacaactctgatgtatacgaagaactcgaatgaattctggtgtgtgggaggacttaatccggtaattatttttaattacatattacatgttgggctctttcaatttggtttcaagtacaattttaccttctcgcgccaacttgttattctactaacaaaattacttattttatgaatcttaggtatccattgacaatatcagagcaggcatgtgatggatataatggcaatgaagactaatgcggctacactcccagatgtcgtccaacaacttatgaagcaatacaacagtgctgtttcggaatgaagcaagatacttttttaaacctctattgtatgaaataacttctgttgcatgatgcaagaattattcgaattaattgttgcttttcagtcagactacatgagtaataatgctttgacatagatacaaattcgattttgctatatctcactcgaaagattttttcttatctctcactcgattttctcactcaaatttacagtgcattttcttgtaagttacagtgtaatttata

SEQ ID NO: 39256 - DNA, 568 bp, Oryza sativa
cgagggttcacacacatgtaagcgtttggaattttggatagaaattccgggcgtgacaagttggtatcagagccactttgaccctaggttatgccaaatggttacccatagaagccctctgaaaaatattggaaaagtagaactgttctcctctctttctcttttaattaaaccaaactaatggcacatgtacttcataatctcttttaatggttctcattcaaaatttattccagtgttattagtactgtacatctattactgtactaatggctcatttaccagcaaaagttttacaatactgttttatttaatcttgctgcaataaaataaatttagcatgttgattttataattttcctttcatttcttttgaaaccagttattcaaaattacaaaatttgtgacctcgtttccaaatgttttaatttatttcgcaaagcttggtttaccttatttatttccttttttttactttgattttctaactttattcaaaattaatccaaaaaacttgtgctattaattggataaaggtcttaactccctcctttcacttgtctttaga

SEQ ID NO: 39257 - DNA, 1501 bp, Oryza sativa
atgcccatttaaaagataaaagtaagataatatttatgggactcctaatcagatgcgaaatatgtaactaggggagatccaaagagtccctatggcatgtagatttggacgtaagtgattatgtaatgcagaggcacattattaaagcaattttccttaggggttgttaggtacttaggttaatccccatgaggaaagcattggagcggattaattccacatctcaatagttggaattaatcccccccaattccccttcaatccctttggaagagggattaaccgaacaaggccttgaagtgtttacattgttttgtccaagccataaagttggaggcttctggaagtttttcctctgtagcattatatttttctctgatacatttctcaatgtcatcacttccttaatccttgtgtaaagtcaaaatgcacatattaagtaattatattttgtgaatttctgttaattttcagatcatggatatgtcctgtgagctcctggtgcaagcagtgaaaaagctccctgccgttgaaatcctatctctgcggttattaacaataggacatacctttggaccttgtgtttaccatttgcttaagatgtctactggtataagggagctgaagctgaagttagaagatcacattgcggtaatgtatacctcttcaatgtaatcaaataccatggtctctgtgaaagtggtagaagtatttgcaatttaatgcacctcagcttgatctttttactatgagtggtactgtggtagcacttgatgtgtcagtcccagtaccgatctgtccctccatggtttatctattaaaactacaagtctttcccctcttcatactacgatctaaaagtttgatccaagtgttgccatgctgctttggttttcaatgataaaatagaaatgattggaatgtcgctgcaaatgttcagttgctggtgattgatatgggtatgttgtggtcgtagtagattcatgtcaatgagacttccaacgaaccatgccaaatgatcaattgaaattccgacaaaaaatattgtaattgtagtcaaagtgtctgctacattttccaattttcttttctttccccctttctccacacatcacatctggaggtgattagatctaaaagatattgctcttatatgaataaaagcttttaatgagaatgatcattttcatttccctatattttcctgacttccttttatctgtgtcctttcgtaatattcttaaaatcaatttcttacatgcttttcatttcaggatggagaagttccttgctcatctggctgcgtttgttacgagccccaggcctggaaaaagaataatatcagcttgaattttctccagaaagttgaaatcaacaatttgagtggagcagagcgtcaaatatattttgtcaaacgactgttgagatggacgatgccagagctcaagacgattactctaagttttgatcctttggttactgtcagcgagaaggtgtctag

SEQ ID NO: 39258 - DNA, 1501 bp, Oryza sativa
ctagccagctaggcgtcacctgcgagtacccgattgttatgatagccctagaaggttttgtgaaggtttatcatcacctctggaacgaaagaagtatttgagtggatactaatcatggtgctcttggtaaatcaagcatcattggatgcagtagctcgtcgtccaagcttgaatcttggtggtcgcttggaaacgaagttttgtctcggtggtagcttagaaactaaaacttcttcatggttgatagcttggtgaggattgggtcaattgagatacaggttccttgaagtccctcgaaggggagtatggtcgctctgtcaattgttgttctgttgtggtatcttatcttgtgttttctatattcatctcgctatctttccttcccgctgtaaatcaaaatgttcatttttatattagtttattgtgttttatatattcacctggagtatatggtgtgaaataccggagttcaaatatagagtacacttcgagaaagagtgtaagcatatagattcatttggattggattattttatacaatgtatacataaatcaattcagttgttgcaaaaacactatagattcaattgttccaaacgggacatacagattttgactcttgtaaatgtcaaagaaacaactctaaaatctactagtagaaaagaaaggcactatcaaaacgttcatttttcagctttgccaacatttatatttcgttttttttgaacttttgataaatgcactatcggtgctatttagctcaaatttagtattcatttgagcttagaaaaaagaacataaaaagcagtacaatcattgaaggaatgttcatgtcatttcatctgaaaattttactggcatactccctccgtctaaaaaaaaagacaaaccctggtttccgtgtccaacgtttgaccgtccgtattatttgaaaaaactatgaaaaaaattaaaaagataagtcacgcataaagtattaatcatgttttatcatctaacaataatgaaaatattaattataaaaaaattttatataagacggacagtcaaatgttggcacggaaacccatgatttttttttttacggagggagtacatatggagtacacaaaacacagtcccgctaaaaccatcgcaataattcaaagcccccaccagtcagagagccaccacggcagacggcaccgtcccgctaatcttttcccaaacccattcgatttgggcgccgaaaatacgaaatttcagatcccgcccgccatctcatcgatccgcgcttttgtccacgtcaccaatccgtggcaactccctcgcaccccgatcccacccgtccattttctccctcatccaacggcccaaacccactccacatcgccccgccctgccctttaaatatcctttggccctttcgcctaccgcactcactgctcacaaccaccgaatccttccccaaaatccccaatcccccatctctttctcctccagcgagcgagcgcggcggcca

SEQ ID NO: 39259 - DNA, 1501 bp, Oryza sativa
tggtagtgcgcatttttgaatctgcctaattcagctctttagttttttttagataactaagtgaactaatttcttggagaaactgaaaagttggaagaaagaaggttgatccatggctcgtcgtccctggctgccgaagccgtgtagctgctcgtcttccccggccgccgcgtgcgccgaagccgtgcagctacccggctcctgccggagccactggtcctccctagcagccgaagccgtgcaatcgctcgtcgtcccctgccgctgcgtgcaccgaagctgtacgtgcagctgcgcgcctcccaccggtgctgctcatcgtccctggccgaaagatgaagagagaaaagggaacaaagaagggaataaaggaagaagatgagggcaatttggtcagaaaaatttagaaatatcagtgaaagggtaagcagtggtacatctcgaagacatgttaaattgtaaggaaaacgcttcgtatcgagtgtccgggagcgaataaaatattggacgaaaaacgtttggtgggacccgccattgactcaacccattcttcgtcacccacgtcaatcttatcctctcacagacattccctcatctctcccctctatctctatatgctctctctctcccctctctttcactacagcggagatggcgcgatgagctccatctcgtcgtcaacagcgacgagctccatctcgacggcgcgacgagttccagctcgtccttgacggcggcgacgagctccatctcatcctcgacggcgcgaagtgctccatcccgaatacgcgacgagctctatcttggttcctcgaggacatggccctcgacatagtcacatagatgctgaagaagaggttcctgccctggcgagccttgaccacctcgccgaggtggtcgccgttccaagcatgcggaggcgacgcgatagcgatggcaatggcgacggcgctagacatggccaccgtcgaggacctgatgcgaatgcaactggtcttagccaagtttgtccatctcgtgccgttgctcgtctaggggtggttggagttgaagaagaagacagatgtgggtttagcttatgttgcactttgttgtattaaggtgtttcattttattttgattcgaattcaatgttacatatgttgattcttcatgttgcaatcgatatgtttcgattgcatttggttgaaacactttcgtcaaagcgatgaaacatttttcttctcatttgatgaaacatctaaaaatgcgtgaaatttttttagtaatgtttgagctttttttttattttttgttgcactttattatattaaggtgtttcattccattttaatttgatgttgcttaaattgatttcatggtgtggcaatccgtattgttgaatatttcatttggttgaaacaattttgctcaagtgctgaaacatttttctctagcagcgaaacatctggaacattttcattgaaacaatttttactgagggatgaaacatgtgaaacat

SEQ ID NO: 39260 - DNA, 1501 bp, Oryza sativa
aggcctctgccgccgcatccttttggagttgtgattatttcctgcacttgcgcggtgtgattcgcctctgctttgggttaggatgcagtgggtggtatccataatctagttgattacttcagtgttttctgcttgggcgtgttgccttgagaaacttaggtttagtgcaacggttggatatctagttgtagccggtggaagatgtttagggatgttttttttttgctaatttacttgttcacgaatttaggaaaaccaaggactgaaatagtcgaagtaggttgatgccatatattacaatgttgttgtttactactacctccttccccaaatgtttgacgttggttagttccaacgtcaaacagaaaagaatggagggagtactactgttgctttgcttatagcataatggctgcgcactcttcctatctacgtacctagttgacaagccgtcatggttgttggtcaatttgctgtggtttagccgtttagtcccccggaggttaatacatgaggcgcttataatgttgtccgttgccagcgttttggatgtaactgaatagcttgtttcattctgaaattgataacgttgtttgtctgcactctacataaattgtatgcttcattctgtactctttaatgttcagtggatatggctgatatggagctgccacgaataaagttttaaatgttattaattagagcgtgcccacctatttacaaggcgttttctttccctttttgaaaccggcatgcctaatgtttcggatatagcagtaaacaggtttcggaaagctaggatcaaagatctactggtgaaaccatttagcacgtgaggacctgctttttaggagtctgttttgtgaagtaatgccctaagtgtgaggacctgtgatgccatctgcttattctgtaagacataaatttataaagatgggcataaatgtaactgtacttatgtaggtttgtgttaaatttgttgtgcatctttgcttgaacggcaggttaaagccagttgatgctgtagtttgtgtatattctaatattgcatttattagacagtttctgctgtcatttgtttgccacgtcatccttttagattttctctgccacatctgacatgtcattatgtactatattgtgagataaagcatgaaaggggaattctgccttgtatagataaaggtggttttgtacaaaacaagtaaggggaattgtacataaaggttttttttgtataaagactgtcttataaaacaagtcattactgtgtgaatattaccttggcattctttttgcatctcatgctgtttttttttctgtgggtcacgtggcacaatagtgtactcctaatgtttttctgcctgtttctacactttgctacatggggatcgatatttctttccatgattttccctgttttgccagagaagcgtcatattgtgttgtaagttttttttttcacatcatacattgttccaacctgaaattttgtttgttc

SEQ ID NO: 39261 - DNA, 1501 bp, Oryza sativa
gctgtttcatctggaaactatgttctatttttcaaattatacaagaccgcacctgacttgaattcttgtcttatgggtaaatatgatctccctctctctgtaatttgaagtgttcatctaatttcattgagatggtgtttttgctttgcaacttgcatgattggtgctgtagatctctatgttgaacggatgcgctttgaggctataaaatgcatatctaaatcatatcgcccaactttacctgtaaaatatgctgcacaagttttgggattcatggcaattgacgaagtttgtgaagctaaaagagctgatggattggaagaatgtgaagaatggttaaaagcgcatggtgctgttctttcagtagataacaataacggagaattgcagatagacacaaaggtaaaacacgcagcaggtttttgcaatgtgtttgtgttgtattggcttttgaaacactgcactacctctattgttcgacaggtttcttctacttccctatacatgccggaacctgataatgctgtttcacatggtgatgcatcacttgctgtggatgattttttggcacgaacatcataggtgatgccatgctgagcatttttatcactcatgtggcactgaacttcgaaggtatttctcgattgcatgtagcaatgcctgtagaggaatgttctgttaaatgcagggtaggaccttgaaatggatcagctgaagggggaagcacggtcccttgtcgaagagaacagaatgcacatgagcaggtcgctttctattatactcaaaacgtgctctgggcctctgaatctcagatgctgtgggatcgttggcatgttgctagctctacagccctgcagcagttccattttgacaaacaaaattctggaggcagcattaaccgaaaaaaaaaaaccctcctcgaagtatacattggcgggcattacttttgtaccgtcccagccagacgacaagtgtacatgttgagatgtagtcgtaccttcaggcttcagtgtattgtacaatttttgtttacatcggtgaccctgatgttactcatttcattgatcaactgcaaatagttaatacaaatttggaagtactcatgttggtcgactactgttttattctctttttgttaggtaaaatgaaaaaacaaacctgagtaatgtcgcaactagacgattagccgtgttagaaactgtgcattatggcagattcgtcctgagtaataaactggcctttttgggacggagggagtagaacgtatacattatttccggtacttgttttcagtagtcaagttttatgtattttgatcaataatcaaagtaacaaatacatttaacgtctaaaagttatatcactatattcatatttcaatgctttagcaaaacattaattttatagtttgttgggaatatattcaagtttaccaagtgtcttactccctccttcccataatataagggattttgatttttttcttatactgtttgaccat

SEQ ID NO: 39262 - DNA, 1501 bp, Oryza sativa
gatttcctctagggtttttgcacaaatgaggcaaggggttaatcgagacccagctctttggagctcctcaacagagagtaggatcgcaagatccgaatttcgggaaaaaatcgcccttgtctatttctgtgatgtttctgtggatgattctgtgatctatcctctacttagaatacctgtgctctttcttgtgaagattggcttagtctcctgtttcgaaatttgaatttcatctctgttctgttacccggaagttcctgtcctagaacattggaagttccgggcctggaaggccggaagttccggagttccttaccaggaagttccgggtctgtttaaattttaccgctgcgatttgtttttaagttttcagggacagcctattcaccccccctctaggctcatcagcgcgttcaacgtgcagtaacaacactaaaatatagttcaaatatagtcacgacggatctacttttgacaagtactttttttctagcatcatagtgcaaatgatttcaaaaaataatgcatattttgcgagatattgctcttcaaaggttagcattttgaagtttaatcctccatatgtagtaacactatagcattactattactaccatttgttccgtgttactacgagagtgcagtaactactacaacttttacagtaacagtgtgttactgcaattgcttggtaatgttaccacaataacgtaataacaaccaataaattttacatagagaaaaaaatagttttctttatgatgaggaggacatgtgagagacgaggggtggtcagtgtttgctcgaatcgggaatattaggagtgtaattggaggccaagaaccgccaccaattttgctcaaactagtcaaagtgaatccatgatgactaatctcgttcaaactcctaagcggatgcaacattcatattgtgaaaattgtgcagtaacgttagtgcccgtgtacattaacaatatatgtgttttgcagtaaccgatcgttttactgcaattccatgatgatgttactaagaaattgtaacggaattgatttgcttctttcatggaggtagaaataatctaccttgttttttgtttgaatagcttactaaacaatatatgatagcatattagaatgaaaatgatactatacaaattgtccaatcttggtcaaaccctcaagcggatgctacatttatctagttagaattgtgtagtaatatagtgctaaatagcagtaataacttgtgttttgtgtattaaccgagcatgttactttaattccgtgatgatggttactacgaaattgtaccatgtatcttacacgtgctaaaattaatttactatatgtttttgtttgaacaatgtattgaatggtacggatgagggaggagagtgcagataaggcgggtgaggagagatgcgtgacatggcagagaaaggatgtgttttcacatgataggataaagcctcacgtgctaactgtatacttgttactgcaca

SEQ ID NO: 39263 - DNA, 1501 bp, Oryza sativa
aataaaaagttgtgtttaaagtactttggataataaagtaagtcacaaataaaataaataataatttcaaattttttaaataagacgaatggtcaaatagtgtaagcaaaaagtcaaaatcccttatattatgtgacggagggagtatgattcatagtcgttgattttttataggatgaagggagtacccagcatcaaaccataggcttcccagatgattccatacccttcccttcggtctgggggagagcagacaaaaacaaaaataggaactgctacatcattgcacacaaacagagttaggatgtgattgtcttttttgtattttagtcctaaagtaaattgtaatttagtagtacaaactaatcctgcaagtactgaaattttgtattggtacaaaatgtatgtctatatgattaatttatattttaccaaataacgaggcatatgctctgtgcaagttaggatgtgattgtctttttttattttagtcctaaagtaaattgtatcttacaaactaatcctgcaacaaagaggaatgtatgtctatatgattaatttatattttaacaaataatgaggcatatgctctgcgagttaggatgttattgtctttttttattctagtcctaaagtaaattgtaacttacaaactaaggttgtgtttagttcctgataaaagttgaaagtttagggaaagttgaaagtttggaaaaaaattgaaagtttatgtgtgtaggaaagttttggatgtgatgtgatgtgatggaaagttggaagttgggggtagttggaggtgaactaaacacggcctaagggcatgtacaatggttgtcaatagtggtctcttagcgttgctaattaggaatatttgttgacatggaggaaagagaaagaggagagacaaaacatcgttgttatgcatgacaacggcttaacaacgattcttagtcattataatatggaaatatggttgcatgaggataaaaatatggaaagaatattaacaaaaggaatattttttgagttaatgattagagcctttgtcgtctcaactattgtaaagacatggtctctaaataattttgcattgtttaagagatcatacccgtctctaccattgaacatgtcctaatcccacaacaaagaggatagttatggttgcgcaaatagggaaagcaaaaccatggtcaagatgaatagaaaatgacatttcacattacaagcgtattcaaaatactataaatgacacatttacgaatgtttggtagattatttatttttacaataataattaatcacaaattaagataaatatattatgatatagctatagttactgcaaaaatgcatgtttcacggatacttatttaagctaattaaacaacacataaacacatctaaatctaatagagaggaaggttataatcacgcgaatgggtgacttaataagctagtacgaacaatggtaaactctgcctttttcagaaggtaaccaaac

SEQ ID NO: 39264 - DNA, 728 bp, Oryza sativa
gtatgtatttaatcacaattaatttccgaataggtacaatacatcagaatcagtcaaaaaaaagttgttatatccctgttttgacatccaattttcacagctcaaacttcactgctgaagtaaactcaacggaactcgcacgcttatcaagactgaacaggaaaaggaaacttgaccttagaagaagcggatctacattgaataacagttcgacctgttcaaatccagcaaatcacattgaaaggtaaacatacagaaaatcaacaccattgttagaaaggaaatttttccttattcaacaataaacactgactgtgatatgaataaaatcaggtctagaaaagaaaaatatcagatcccatcaaccaacatggaaacgaataggtatgttaaccacattataaaaatgatatcgtcattcagtttatttttaaatcacttttttcttttatgaaaaaaatatttgtcttccagtctcaagatgaatgatcgagtaagtaaggaaggaaacattacaaggaataaggttgctgtaccaccaaggaagaagaaaaaatcaagcgtgaaagaatggaattttggcaagcctacatgcacatgtcaacactgtggtgcacttttctggtatgaagaaagaactcgtggcaaaggaaaagggccaccttcttttagcttatgctgcaaacagggcaaggttgacttacctacactaaagaaaccacctactt

SEQ ID NO: 39265 - DNA, 369 bp, Oryza sativa
gaatctagacatatatatctatctagattcattaacattaatatgaatgtgtgaaatgctcgaatgacttacattgtgaaacggaggaagtaattagcagcccgtcaggaaaaaaaaacaacattctattaaaaatttcaagagaaaaagaacagagttttgcaatgagagaaaagagacactgcaggggcaacatggacattgcaccgaacggtccaaggccaaggagaggagacgaccccctatatctgcgccgtgccatgccgtgtagtcccttgcctgctcagcacgctgcactgcactccaaaccacacagcctcctcgtctcgtcttctgtctcgcgcgcgcacgccactcgctgggagctca

SEQ ID NO: 39266 - DNA, 566 bp, Oryza sativa
ggagaaggaactagccgcgttgaagggagaagcaccgccgcagaaggccaggattcgtctcaccgcaaggaagagagctttgtttgtccctcgttatcaattggcgccaaagattcgtgtggtggagaaagaagttgccccagctcaagcagatcctccagtcatcatcataagtagtgatgaagaagaagaacccaagcgcaacaattccaagtttgagtgggtagctatcaaagatgaggaagatgagccgaacgagccttcgatcgacctcctatgctcggaagaactagagtgacttgttgggtcgttgtcttagatcgttgtgttagtttgcttgtttaagtttgcttgtgtgtgtgtgggtcctgcatgtgatttacatcagtggtgggatgtaagtgcatgcgtttgtttgcttctgagtgttaggaagttggtgagtttagtggtgtgagagtcttcagtttgtaataatgaaactcagttaagatcaataaaagttaaagtaattctctgtcctaagtagtttccccggtttcttttcttatcctgtccatgccaga

SEQ ID NO: 39267 - DNA, 1501 bp, Oryza sativa; identical to SEQ ID NO: 39224

SEQ ID NO: 39268 - DNA, 1501 bp, Oryza sativa
tataatccttaatcggctaaaaacctaccctcaataaatgtgcattaaactgcatgaaagtgtatagggaaataatttattcaaatattaggttaattatcatgaataaatataatttttgcagaatttatcttctcttctaagcctcttaaaaattcaaactggtttccaatgagtctatcttctcctaattttttgaacaatctatccataattttttagtacaaccaaataaaatggaaactaggtacattcatctgcctccaataaaatccatgtgaactcatatgcaataaaaattaatctataaattaacaaagaagggagaagaaataaaatcaagaaaaattcctggaatttgcctgagacctgtgtcggctgtgcccacctgcttctggacccaaacttctcatcctcacctaatttgctccgacctgggcccacttgacggtgtcacaagctagctccaactctgtgcataacttttccaccaatctaaagacccacaatgaacgagagagagtgatcggctctgggcgtgcgcgacgcgtggccgagacgtggcaacgccgagccgagcctccttctcttcccagccacatcgcccatcctcactcctcactccagtgccgaccaaaccgagagaacaagctctagctgctttcctcgccttcgatctcaccgccggctgtgatgaagacgacgctcgtcctcgcctacgagtcttcgccaaccctatctcttccacgttccatactcacctcaccatacggaaaatttctccttttgatttcatcctctctcgtgcagcggatcgacgggaacgccgacgtgccctcaagagctccagagcgcgctccaaacgtcgctgtggtggcatcgtcgccgtcgccaccgatctggaccaagccgggccatgccatcgcgccatcgtcttcgcctcgtactcctctccatttcccctcaagaaccacgaagaatggtgctacgagtgtggagatcggccaccgtcttcttcacctccggttgccgtcgccattgtcgtttccgcctcctccggtgagccattgctcgattactcgcgcacacaccatctctctggcctcactaacctcatggacacatttgcacgatagttcttggtgccgattgagccgtcgccgttcacccgggaggttcttgccgtcgccaagccgttctgcaagccaccgctgccgccaagaccacggcaaccttcgctagactcatggcgagcattcttgaggctttagtgtcgcattcatgcactttattcatctagatccagcccctaaagtcacatgcaccaccacccgaaaccatctttcgctcggacccgccgccggcgctactccgatgtccactaatcgagaaaagtagaggaatggaatcgtgagagagttctcttcattttatatttttacctcaaccccaaacgagccaccaatcgcctccggtgaacctgagatcgagctcagccatg

SEQ ID NO: 39269 - DNA, 434 bp, Oryza sativa
ccatctaccagtcaatacccagtaccaaaggtaccaggtaccagctggtactcaaagtactaggtgctagtggaacgcacctggaagctcacggaaagaaagtaaaatatcccgttctaacgggatcccgttctgtagtctccctctttttaaactatgtgctttacctaaaattaaagttatcttttttttaaggcgaagtgagtattccacaaacaaatattttttttccattctctcactgtaggttattatgggcttatggcagtttgtacccctactatagacagccaacaatccagccagccacgtcgccacgtccgtgttcgtgcctgtgcgtggtagcgcagcggatggattggtggatgatggggccgtggggtgatggaccagcggtcaataagtgcggtcggtggggtacgcttcggatgcga

SEQ ID NO: 39270 - DNA, 374 bp, Oryza sativa
cggcctaataagagcccaacttaattcttagtcgctaatccacctcttcggagcgagatactctgaagaattcttcgtcaaagattcaaacaactactacctttctgagtaatgatcaaagtttaaaaaattgatcatttcttgttcgagacgttaaatatttatgatcggagaaagtagctgatagttgtgcgcccgtccatatacattgtactacatgattttgaattaaaatcgtgtcctttccacatctatgtcaagatatgactgtagctagatgtacaggtccaaagtttacggccaatggtgtcggcatgcacgactcttttaaagcattataattaagtgactaatgacgaggctgctttttcaga

SEQ ID NO: 39271 - DNA, 1501 bp, Oryza sativa; identical to SEQ ID NO: 39259

SEQ ID NO: 39272 - DNA, 1501 bp, Oryza sativa
tccaacaagaaatccatgtgctgggagtgtgagccctccatcagtagcccgatcacaatcttattgttgttggcatccacgttggtattgcggttgctgccactgctgcttcctgtctccaccatcttcttgcaatcaacaattgtcacctccaccacgccggagtcgaactcgacgtaggcacctagaggccagtgatccatcatcaccatgaggctgccacacacgaagtcgttccacatgcactctggcaggggcatgtccactttttgcgcaccgtggatgcggagttttagggcagccacgctctcctcgcgacgggcgaacactgtgaccttccgtccccaactagccggagggaggtaggcggtgacatggaccgtgtcatgcatcctatcaccgccgctccacttggccagcccgtggatccagcagaacctcgccgccacctgccaatgggggagaagcaggacatgcgagccatcaaagatgggataatactcaatgtcgtggtcatcagcgagctccctattctagaataaaaggcgttgcatggtcaccgggatgccatagcaactctccaccttctgcttgatctcaacaaccttgtcaaagggctcgaccacgacggtcaggcggcaactacggctgactaccgtcggcaataccacgacgttcacatccatggtagtatgatgtgaattgtggaagaatacaacgagggagaggccgtatatgtagcaagttgttaatgtctaaacaggttcggtttggagcaagggcaataactatagatgcattaatagtttctaatgaaatatacatgcattaatagttccaaatgaaatatgcattaatagttttaaatgaaatatatacacacattaatcacacatattgcaaatccagttttgcattacaccccttgtgtttcataaacaacaaacgtccaggacattttggcattgcacctgaagtcttccgctacaccatttggtctcaagagaatatcttatttaatcaaaacttttcatgaaaatattattgaaaatctagtacattgatatatatgttaagggagtactcatatgaaaactcaatgatcgaatctacaaagattgaatccaaataattttttaatacattaaatattcgctaaagttttagaagttggtttggtcaatcatctttaaaatcacgccgtttgctaacttttgaattataacgatgtggctactttgggattaatcaaaattttagcaaatcctattttgcattacacccttttgttacaaataatatccaacgtttgggactttttcttgcaaggtacctaaagttatccgcgataccatttggtgtttatagggaaatatgctgcttagcaaaaccttttaagaaaatattacttgtaacctagtacaatattatgttaaggaagtactcgtcatgaaaaatttaatgatcaaatctacacaaattcaattgaacaggtttttta

SEQ ID NO: 39273 - DNA, 1501 bp, Oryza sativa
acaagaatatatgcagtggtgaatccatattatgatgtcgggccggttgatcccatagcgttttcacaatcacctttgagaatcttttgttttattttccatataaatccattcaaatttgcataaatgatcccactgaaatattcagtaatgataattgatccaagatataaattttctagctccgccactgaagatatgaacttcctcttgcaaccgttttttattattaaataatttggattgaaacttttatctggttaccggttttccaaatggatcacatttttttttcttcaaaactctagatgcgagagtgtggcatctcaccactattagttcagtctgcattggcaaggaagtttctctaatccaaacagttttacattctaatgaaacaaccaaatggagactaatagagttcgataagaaaaggagggcgaatagacaaatatacacaaaaagtagtatatttaaccaatcgtctctacttattagcctcgaagccaagcatgcattctacccacaaagatgacgatcgtttcaaataaccacatgccatttttgaagaactttcaccatgatgtcattttggaaccacatgtcaatttgatccagttaaaactgctcatttgtgctaaaaatccctcggaggtgttttgttttgtacttcctccatattttaatgtataacgccggtgactttttgtccaatgtttgattattcgtcttattcaaaaaatttatgtaattatcatttattttattgtaatttgattcataatcaaatgttctttaagcatgacataaatattttcatatttacacaaaaattttaaataaaacgaatggtcaaacgttggtcgaaaagtcaacgacgtcatacattaaaatatggagggtactggctgacatgtggccatgtcacgaatggttgacgatgatgaacacataaaagaagaagggacatgtacgtcggtcaatagtgtaaaatcaaaggagtttttgattactattctgtgatgaacaattgggcattggagattattggttttgttatttggaatttattcacgaagtggttttggagatgattggatttcacaggtgatcgcaggtttattatttcatgtgaccggtcagactgggctctggtagccggtcggaccggcggtgattgagcggtcggaccggccagcccacggtctgaccgaccgacactgtgtcggtttcggtttcgggttgtttatttggatatccgagtttatttcatgattatgacttttagatggatactatacgtatgtaatactattatttgctgctaatgagtcaagttggagatagcttggtctcggaatatggtttctttgtttgttccatgtgtaggtgactcgatgtctcgggagagtatttgcggtgatggaccgggagtcgacttggggataagacgacgtccgtggtggtcagagatcatgtgggatactaaggctagagttga

SEQ ID NO: 39274 - DNA, 359 bp, Oryza sativa
tgaaacagagggagtagttgctaaccagtcaattttgtggccgtcagatgttgtggagcacgaattaggagcgcatcttctccttattggcagcagtgacgtcatcgaagccaagaggtatgacattttagttttttagaaagcgattttgttagacatcactttgacatttttgtgggcaatatcactgaattcataacatcgcaatttttctctgagatttgtgtgttgtcttcatctctaatgaactttagctagtctccgattggttaggtttcagggtcaggatggcagaagagggtgggaggtgttcctaggatgaccgaggcagtagtgacccaacggtgggttagcggaca

SEQ ID NO: 39275 - DNA, 1501 bp, Oryza sativa
accactgactttttaagataagtacgttttatcattcattttattaaaaattatgtaattattatttattttgttataacttgatgtatcattaaagattttttaagcattacttatattgttttatgttaaaaattggataaggcgaatgattaaatgtttgtctaaacaatggtatatattaaaaatagaaatgagtatatatttaagcacaccacaaaaaaaaagaaaggatctcatgactgaaatatatcttgtttaattaattaacttccttcatatttggttggaataaattgaaatataaatcatcttctaaaaatacctccaaagatctccctttttccagaaatgagagcaaagatccttgaagtagataaataatccctttgtttgctagtgttactctgagatcacatcaatatctctgaattaaaatactcagcgcgattaatttgataattgcctccatgattgtgtcatctaacctagctacagaaaaggctgcaaagtactctgcaacatgaaaagaaaaattaaatacaaggactacattcacaaacgtatatctaatcataatcctatatgcttaacaaactgcctaccggtgcgtgcgtatttaattacacatgtttgtttccccacgaagaaaagaatttatgtaccctgcaacacgatagatggatgagaaaaaaggcagacaccgaattgaactcgtaaccacttatcatttcatagatcagcatcttgcacacattcattggttcatgcagatgaaataccagtacaaaaatctaaggttgctttactttatgtttctttgttcttctttaagaccttttgcaaaagcaggtctctgctgcaacagtttgattatagggcatctgaattcagaagaataatgtttggttgcttcgcatatatgctggtcacatgatcatatctaggccttttaactcaccaattaaaactgttgaaagggtagcaattcagtgattctgagagaaattgcatggtgtatgattgacagtaagttattgcagtggttacagggtcatttccctgaactttcgagcaatcgaactgtgttgaaaagttcaaagaaatgtgttgttagaaaggcatgtgcagtgcatgcatagtgctgtcaataaaatttcttttcgaaacatatctatcagtaataaatttaccaatattgaaaattgattaaaatttatcaatcaaactgatacttataaaagtatgtcgacaatgacgataactgaaactactcttggcatcacatgaaacattctattgagctaatataatgcaagaactgttttttattttttgagaacgcgaaaaactttgcacttcaacatattagaatagtgcaagaactgttgttaaaggtttcaaattgaccaggtttcattagcttcatttaagaacaaaaaagagttcagctagtccaagtttatgactctgctttttcggatcagtccagcacaaaaat

SEQ ID NO: 39276 - DNA, 606 bp, Oryza sativa
cggcagaactctgcccaagtgacttcagtacctggtgggcgggtggccatgtgattgtcccaccaagctgacgcaggaccttgaagctggtgtgtggtgaaagcaaccttctcctgatcattgcactgcaggagattcagcttcttctctatggcatgaagccagtcattcgcctccatagggttggtggtgctggagaaagtgggtggcctgacacgtagaaactctggcaatttggactgagggggaggaggaccaaactgctggtgctgctgttcggcgtgctgcagcatcctctggtgcatctgatggtgctgctgctgcatctgctgcatcatggctgccatcatctgagtctgatgtgccatcacctgggctagcgtcggattctcgggaagtggtggtggaccattgccggaatcgccgttgggatgcaccccatcagtgcgctcttcgccgttgctgccctcgcctgttgcgcggctaccattcctggtgtagaccatctggagggaaaagcagacgggggaaaagaagaaaaacagatgctcaggaactaagctttattacataggaatttaaactgccattgttctgatctgaatt

SEQ ID NO: 39277 - DNA, 188 bp, Oryza sativa
caagatttaatgtggaaatagcatctgtttcagtagtcataaacctacgctcctctttaacactaatctgaactctagaacaaatagcatctatctcaaagacaaggattctatgaaagattagagtctaaatttcacacttggacacttggtggtcgctctatgtaaactgtcatttattctacagc

SEQ ID NO: 39278 - DNA, 1501 bp, Oryza sativa
gactttgatctgcttgtgggctctaaattatgttacatgactctccgtagttaaatgatcttattttctttctttctttcttatttcagttttgtctactgtaatttctcttacgcaattttcgcttacgattgtaaaattatagtcacgagaaagtagttttgacataaatttgacaatatcaattttatggcaaaacataaatattacttcctccgtttcacaatgactttcacaatgtaagtcattctagcattttctatattaatattgatgttaatgaatctagatattctatattctatattcatattgatgttaatgtgggaaatgctaggatgatttacattgtgaaacggagggagtactatgtgcgttgtaaaatataataatttctggttatatatttggacaagggtttatctaaattatggtactatattttaaaacgaatatagtattaaataaatcattaactaaaatgtaaaattaaacggtcagaatacgcataatattttgagcggggagagtatagaatatagagtcactcaatttaactacaagtgtactctttatccaatttgacagtaacatagatataactcataaataacaaataaatgagtgaaatgctaaatggcattcgatagattaattattgggccaaaatcttacagattcatgctctggtattagctttttctccgggtccgccggctccaatgacaccgacaaaggtggtggagttagggatgtaggatcccgggttgggttagagattgggggaggtgggggcgaggaaagagcgggagagagccaatccagttccaacaatgcacttctcgaaccgagaaagtcaagcttagatggatagccatgggtggcggtgggcagtggatatgggcgagcgatgagccacaagcggctgcgttgaagccgtaaggatggaggagggaggtgatccagcgttggtagcagggacaaagcaagcttgtggttagaaggctagacagcgagaggaaggggatcgagcgaatgagcaatcccatagtggctgggagtgaggagggaggggtgatatggtttagattgtgttacacgaatcttacaataatcatacggtccaaaactcgcatgttttctgagggggttttatgtcaaatgcttgatggacagtccaaataaaaataaggaatattaaataaccatcctaaatgtcacccaaaatttgagattttccttgtaaagaagttttgttgccaatatcccccctcccacccctcctaattcatggtttgatattccttcccaaattaccgatgttcgcgtgttgagtgtcatgagtagggatgaaaacgatacgaaaatggacgaaaaccacctttattgtttttgttttcatattttttttggaatcaaaaacctcgaatacgaaaacgaaatcaaatattgtcgaaaccgaaaacggaccggcaatgatacagtaacgaaaatttatcga

SEQ ID NO: 39279 - DNA, 492 bp, Oryza sativa
gggatttgaaaactgtcaacttagatttgaaaactttggactagagtttgaaaagtcaagatttgaaaattttcaacatgatatttgaaaaactttccactcgagagtcgagatttggaacttccttcaaattgaaaaactttcaagttaagatttgaaaactttttcgagtaaactatttttaaaacatgtgtgctatcgattaaaaaaatcggaaaaaaaagaaataaagaaaaaacacgcgatgggaggggaagcgaataaaacgaaaaaaaacgaaaaagatggaaaaaatagcgataaaaaaaaagaaaacgtgggaagagatagcgccagttccataacccaactttccctttccccttcagccgtaaaagactgttcatcagcttctcggcccacagtccataacggcccgcccacgcccacgctgacgccgtctctcccacactccccacctccgtggctccgttcctcggtctcgctaccagc

SEQ ID NO: 39280 - DNA, 1501 bp, Oryza sativa
tcccgcgcgggagcgatcccggccgtccgatgagatggacggctcggatcggctcgctcccgacgcgggctgacgaggccgtgcgggaggcggcaaacgccggcccaggcccaggttgatgggcctggagcccaggcggaaggcggcgcggcaatgacgggccaggccgagtgcggcctggctcgagaaagtggcccagttcaattttgtgtggctgcatagtaacgggctgcatggtaatgggcctaattaaagattgggctaagataatattacaattaattttttccttttaaagaattatgattatgatcattgtgtttaaacattaaagatattttattatgttttaattaatgataataagaataataagtgactttgttatgtgataaaattatctttcatttatttattttatgatagttacattatatttattacttaaagttattattgttttatgcattatgagtttatttccgctacaaataaatattataattaagtgtgacaaataattgtcattctggccaaagctgattgacttttatttgatcacaaaattttattaattcaattcaaatctggccaaagctgttttgattgaattaataaaaggagttttaaacaaattgataaagtgtggtttgtatttattattctggccaaagctgattaataaatacttattcacaaaattttattgttcatttgcttctctggccaaagccgttttggatttgatcaataaaagaaggtacttatttagctgctgataatgggcaatattcagggatttgatcaatattcacaaattgccggaataatgggcaatattgaacaacttaatggaagtaattatgcttcatggaaggagaagctggaaattactctagccctgttggatattgattatgccctccataatgatcctccggttgagcctagaccagaaaatgataattatgagacccataatgaaagatatgacttgcctgctcagaatagtccttattcttgatataattcttgatcaaccttcacctcctggaagttgcaaacgttgcctcacgactaaccgatacacaaggtctataatacgcgagaaaaaccaatattcaacaacaatcaaatatgcacaacaaaatgtactattcgtgtttgctaatggattccaatcatgctaagggctaaagtttcttaatctttctattgtcatcgtggtctatttaggagttaaccaacatagcatttatggtatacatatatatttggctaatcggtggtttagtctatcaaatggctatggaaggattatggctatatatgcatctatctaaatagcacggttacataccagaggttctgttgttagatggatttaggatcaatcaaataacgaatcatttgtattattatttaattgatggaggctttactttaattatgaacatattttacttgtcacaataaattataaaaggttaataattatcca

SEQ ID NO: 39281 - DNA, 444 bp, Oryza sativa
cggaagaggaaaggaagagtgattaaaacaagaagtaccgcatgatttatttcttttaaagatttttccatacacccgggaagtggaatagaactataggttcgagtttagccaagatacgtacacggctaagtgtattaaaatccaagaaagaatcagggctatctaaaagctaggaaggagaagaccgcaggatctgtagtgacatcttctcctgatgtgcaattggaggcacttgtgctagttgctgcatcttcaccgcgtccattctactatgatcacttcgacgtcatatttcgaatccttctttgcttgggactccgaccctcccctgccgccgaagcacgaactacttgaaatcgcggatcgacagcttcctgcgacattccttcaatgcaaacgtggtatttttctgacatacgttgcgggtgtccagttggcata

SEQ ID NO: 39282 - DNA, 1501 bp, Oryza sativa
ttcatgcccaaatccctctgttaaagttgaattgagccaaaatcatgcaatcccaaagcataagaaatggaattaggccttctagggtttcggcttgaagaaattagaagaaggggaaggaaaatttcatgcaaatctcagacaaatccctaagaaccgaaaccctagctgaagtaagaccccaaaaattccccaaatcatggaaccctaaccctaaaatcatggggaaaaggagcgcggcgggcttacctaagggcatggtggccggcggcgacctccgtgtcgccaccgacgcaataagaggcgagcgcgcgcccgaggacttggtccccgagcggcctcgcgacccgccgtgctggcccggctcctcctctttgcgtgctcgtctcgctgacgccgcttcgctgaggtagccgtcgccgcctcgtctcgccgtcgccgccgcggatcttcctcgcgcgagcgaccggcgggtgcttagggcaccgtcgagcaacgctcgacggggatgcgcgccagctatggcggcacgcagccccggcgagcaaggctcggcggcgccatctccaccccgtcgtgcgccgcttcgccgtcgtctcgctcaccgtcgccgcgggcgtgagagaaagaggggaggagagaatggggctagggttttcgcggggggcggccgcgcgccggttttgtcccgcgcgggagcgatcccggccgtccgatgagatggacggctcggatcggctcgctcccgacgcgggctgacgaggccgtgcgggaggcggcaaacgccggcccaggcccaggttgatgggcctggagcccaggcggaaggcggcgcggcaatgacgggccaggccgagtgcggcctggctcgagaaagtggcccagttcaattttgtgtggctgcatagtaacgggctgcatggtaatgggcctaattaaagattgggctaagataatattacaattaattttttccttttaaagaattatgattatgatcattgtgtttaaacattaaagatattttattatgttttaattaatgataataagaataataagtgactttgttatgtgataaaattatctttcatttatttattttatgatagttacattatatttattacttaaagttattattgttttatgcattatgagtttatttccgctacaaataaatattataattaagtgtgacaaataattgtcattctggccaaagctgattgacttttatttgatcacaaaattttattaattcaattcaaatctggccaaagctgttttgattgaattaataaaaggagttttaaacaaattgataaagtgtggtttgtatttattattctggccaaagctgattaataaatacttattcacaaaattttattgttcatttgcttctctggccaaagccgttttggatttgatcaataaaagaaggtacttatttagctgctgataatgggcaatattcagggatttgatcaatattcac

SEQ ID NO: 39283 - DNA, 557 bp, Oryza sativa
atatgggctatgatattgatttatatgggctttgcatcttctttttgggctgggtttatatgggcccatttttgttgttctgtgggtcccactttcactgttcaccactttgaaatcaacgcctacttcatccgttgtatgggtcccaccttgaccatttactcccttcatcccataatataaggcatggtaaaagttgcacggtcttcaaaactaatttttaacttataatttctcatatgctataaggtttgtagcaataaaattataatcatatgaaagtaaatttaaatgtcaatctaatgatataatttttaacaaataaaattcatttcatattacattaaacgttggtcaaatattttaaaggttaaatcttgaaagcgggcacatttgaaatgcagcagtagtgagctcctatagaaaatccaaaattcaataaaaggtcataatggtcggaagctgttcactacttcagaaccatccagaaggcaagagaaaaaagcaccccattataacgacacgagaacgcagtcaggcgtggggtgcgagttaga

SEQ ID NO: 39284 - DNA, 1501 bp, Oryza sativa
tcagcgtgcttcgtcccttggtcgtttccaggcgacggtgccagctgctatcggtgccacgccatgctgatggcgatgaagtcgacgatgcactattttctgggatagatactactttttcctcctccttttttcaaacaactatactcctttttccatcaatgataaaagtagtatcataacatactgcttttgttttgaatatatatactatctttttttttgcgggggaatatgtatactatcaatttcatctagtatacttcattttatggctcattatataaaccattcggtgaaaccaagtgatataaatactattttcttaattatttaataagtaccactcggtgaagtattatgtacttcattaattattttgctaataatctaataaaaaggtgcatccatacataccttctatcgacgatcgatgtactacaatactgcatactaggtgccattaaaaaatagtatatactgcttcaatgaggatttcagtatatgctggatacttttaaaaaacagtacatactcattaactaaaaaagacagtacatacttctcattaaccgattgatttagtatatactggaaactaaaaaagacacaacatatttctcattaaccgattgatttagtatatactggaaactaaaaaagacagtacatacttcttaaccgactgagttagtatatactggatacatgataaaaacagtacgtacacctaattaaccgatcgagtactggatacttagaaaagagcagtacatactcatttcaatagatcagtatactaacgttaaagtaaagaaggttatatactgatactaaataataaaaagtatgcattcctacataaaaaatagtatacatatactgtactacctccaaacaaagttgtatatatgtactgctacaactatttaaaaggtactccagtatatacggcaactactactacgtaaactagtatatatactgctacgcattgcttaattttttgacggtgaaaaagtgctgatacagttcattctgaattctcagtatatactcagtgacgacactgttaatttatgaatctcatcagtgacatatactactttttaaacagtacacgaggaaaaacaagtatatacttgcccgctacctcaactatatcaaaatttgaacctaacgtatgtccgtatgtaccggcctaactgcatgcatccagaattcgaaaaatacaaaagtgaacggtaatttattttcccatttaatttaattatttattatcaactaatggatatccactaagaagagggagtacatacacctgggagtacaaaagagtcgtcctatatatatatatatgtatatatatgtatatatatatgtatatatgtatatatatgtatatatatatgtatatatatgtatatatatatgtatatatatgtatatatatatatatatgtatatatatatgtatatatatgtatatatatatatagga

SEQ ID NO: 39285 - DNA, 1501 bp, Oryza sativa
gagctccgcgttgaacagaaagaagcaagcagggggtgttgccgtagcgcgccggggagcaaagactccttttgtactgagaacacaattcaccttctcacaagaaggcaaaccttgtacgttgatcgaatcttctttcgcatccagaaataagtgcacgccttatattatgggatggagggagtatctcgtttattcctacagaatccaagggagagagagaagcagctgagagagagagccaagaccagcgatttcaccgagatgaggagcaggcgagctcactgcaccgtcgagctagagatttcgtcgcggcgtcggcggcattggagctactggttcgtgattcatcatcgttgctgttggtggttagtacttgctcccttgcttttgtttttctttcccatcgttttctgcagcagtagccatcaccaccgccattttttggctgcattttttgcttgtgttgtttgactagttgatcgatttttggtgccaccttcgattttgttggtggagttatgattcgttgaagagtttttgtgttgttctcaaggtgatttgttgtgaatcattttgttgtttagcagcgattagatctgacttctagaacgatgaaaacacacacccttgagtagagcacatacatgttttatgtttgtttaaacttcattgatgcttgcatgatttattctaactctaatttgttttgcaggttttttgcttgtattttggctctgttttggtgtttcaatcacaaatctatcattttcatctaaggtgagttagtttttttttgtttattttcaacttgaatgtgtgtggttctggaattttttgtgggttttccttttaaacaatgagctagtggcttttgagcaatttaatggttgatgtgaaatactgcttgtggatgtatttttattgtgtatgtgaaaatgtaattctgcatgtgcatgtgcatgtttgtattgatttttttccacaaatgtgttctatgaggtctccatgaatcattatttttattttttgttcattatattattttgctattcctactgcttgtatgtctgttgaaaagtgtttgtttaactttgtgtttggtatattagatattgagtttactgtgtttgagatgtatattaactgatagtaagaaaagctttatcttaaattataaataaatattgtaacttgcttgtatgagtatatgtctagttgcatgtctgagtgtctttcctttgtgaatgtttagtgatttagtcggctgttttagttcagttttatgaagttagtggacgaactgcttctggattttgtgttggttttagttgattcattcggctcagtttcatgaagttagtggacgactctgtgtatgtttgtggctgggagcattatattgttttatggtctttctggttaatcaaagcaaaaccgtatttgttcagttcatcagcacacatgcacagcggcgagctcatgtgtagtgaattagcgc

SEQ ID NO: 39286 - DNA, 367 bp, Oryza sativa
atatatatatattaaagttgtttggtgctccatggtgcccgggcaccattggtgaaatcgagtatatacccaattcaaatgagtatgaaactttttcaattctttaggtattaatattaactactttactaactagttgaaagcaagtttgaactgaatttcaacttgttttcgttagattttgattctaggaatatagcaatcatacatataattatttaggtatgtaatcatggattgtgaaataaagttaaatttgagttgttttgttgataggtataggtatgaatcgaattcttataactaggtatatactcacaatttgaaaattttgaaaaatttgagtgattttgtgcatttgaaacca

SEQ ID NO: 39287 - DNA, 346 bp, Oryza sativa
caaccttagcatcggctaaccacttcaaatatctaaccgtcgtgctactccattctagcaccggctagaaaaccaaatccaccaaataaatcccacctatccaaaattatcctttcttcgtttttattcaatttccaacctatagaaaccatcacctctcttttattttcaaattaaaacttattttgaacccattcctttttcctctcgcctcgctccaattttatttattccttggctttatcgtttcttgtagcaatttgcttatagactttatttgctatcttttcgtatccgtaagttagaccatacagcaagttcgactatcgaatccaaggaactgaca

SEQ ID NO: 39288 - DNA, 1272 bp, Oryza sativa
attttttagaaccctgtgatgtaatttttttaagagtttgtgatgtatttggagatgatttgtttgaggatttggagatgttatgtaatatgtgatgatttggatatggaaggggacggtgtgaaatcaatattcaatattaaaagcagaaaaaaaaagaaaaaatatctttagtcccggttggtgttatcaaccgggactaaagatgctcccatcccatctttagtcccggttggttacaccaaccgggactaaagattgatttttagtcccggttatttgaaccgggactaaagatagcgatctttagtcccggattcgtagtcccggttagaaaaccaggactacaggcggttacgaaccgggactaaaaagcatttctccaccagtggtaatggtgtagcttctttgggcataatgtacaagaacttttaactcaactgatttaagcgaaggatatatttcttttactccattcaatgtatgttggcacgtacacgctaactagtctagagaagatagagcagcgcatgcagcaaactgttgcacgcggcacatgcatgttccgccatgcacgcgcgcactaatctctgtagaaacaaaaacaccgtaccggatattgattctatgcataatcccattcggccattcccatgcccatatatctccaatccagccaaatactcgatgtcgatcggtttctgtatcgtcgtagttagaattaattgtttatcctttgcgacttgctatatttagagcaaggataataatatagctaactttctactattagctcatcttaaaagccaacatatataataaattagttataaggttggctacaattttcttctcctctctctatctctcacttatacatttaatgtatttgtcttgaaccttgtgataagttagctcttgcatgagagccaacatccttaatttttcactacctctctcctccacctaagcttatagtatgcttatagctcactattatacttgctcttatgctactagtacgtactactgtagtttgcaatttgcagtgttttctttcttctttttctttgaacgaacaatgtgcagtgttttcctttctttcatcgtatgcaccagcaatcgatattagcattgtatcggttgttctgggatgatgaattgtggcaaccgtccagatctggccggaagatccgcgctattccgaccatatctggcggggcttagtgattgcggcggcgacagcggcgtggatcgccggatatgacagga

SEQ ID NO: 39289 - DNA, 1501 bp, Oryza sativa
aaggacttcgtataattattttctataagatacaaattctatggatttcctatgttattcctttcccaaatattcttatggcaagcacaaagcaaccgtagcagctatttagaaatcagaagtggtttcagagttttatgtagtactttgcagcatgctaagcatctctagcaaccttttcatcccactgtttaaatcaaaatttagtaattatggataaaaatcgcacaccaacagtccatccatcccactctccaagtcatccgctaacaaactccttctctcacttgccaaacttaactagcctactcaacttgctattcgtgtcccactacattctattctctttcttccttcatttgggagcggttggcgttgacgggagcgcctctccctcgactccgcctcaacgcgcctcctcgctaccgtggcctcccgctcgccgtcgcctctgacctcgcacgacctccaccgcctcctcccccgtatggattcgactcaggattcgtcgccgtctcctccatctactttactggagacggtgtggggatgcctacagcgacaatggggttgggagtggatggcgagctcgagctccgttgtagcatgggcaccgccacaatgtgcagtctctagagccacctcgccctgttcaccgtgcccgccaacaacctccctttctcccgcgttggttacctcgctccacgcactcatggatcttccatcgttgtccgctgtcaccgtcgctgttcgcctttgcacggacgtcaccaccacagagatggagagggccaaggaggagcttagggatgcccccagtaggagaagagggaaaggggaataaagagaaggaagaagaagaggtagtagatgataacatatggataccagtagtatagacttagagtagaaatgatagatggagagattattgaagttagcaacgagtttagcttgccaaaccaattaaagatatgcttatataggtatttggagagtctgatttggagtctgttggagatgctctaacaatctaactaatttggccatgcttttttagccttttagcagccattcagaagtattgagttcagtatttctactttattatttagaacatttgttgcaagctatgtgttaaagtctttcttcaaatattttattgaaacacttccacatttttttttggcatagtttgtgttcactgcaaaaatcactatgatggtcatgacttcatgctctctactttattgatgcacaatactagtacaattaattaaaagaactagtaataaataagacagatatagtagtattagcattcaggaaaacatttttctacattttctgcagcagcagaccaccgttcgacagtcgccatcgtccaccctccaatctccatcgcttcttccctctaaccacactccgcactctccccctcccctcccgcctccccactccgtccaccccgccgcaccgacactctcctccgccatggatc

SEQ ID NO: 39290 - DNA, 1258 bp, Oryza sativa
tttgacatatacattctgatcacaaatccaagaagcaaagcaaaaaaatgatgcttttctgaaaacttttccattcttgtgctctacatgttcagtgtgaggcttagtagaaatatattactgaatcaagaaaatctggtgctgtgttctgtgccaactcccaagttaattgtcttagcaaaggtaattgtaataatcaactaattgtaaaatcaaggagttgatttagattttgtgatgaaaatattggtggtttgataatgttattttcgacgtctacttcattttgagggtaatctttaattccgcaaaagatttttggatttttggttttccctatcattcacctcccctatgataggtttgtttgatcttttatgatcctacactaatttcacaagtgcaactctgaacatgctgtgagctgcattttgacgatccttgatgactagaggattggtaaagattgaaggcataagttaaaattatccaaaccaataatatagattactgatgggaaattcagttgctggtaaaattattaaatttaccctgtatttgttaatctccatattttttctctactactataatttacagagaatggataacaagaacttatccaagtactgactttcgtagtcaattttgtttcccttttgttgatggcccgctgagctccaccactttgtgatattggtccatgaactccttaatttagtaaattttcatattggtggtttctttaactggatgtgcactgggggaaaaaaggcaaaagcaaagttgcatcatacacctactactacaaggataatgttaatttttttatcctgaactacaatagttccagtcagtacaacagtcaacgttcttcatatctaccatgtttgattcagctaatacagtatttgtgacaattttgtcagtaactgtcacactaaagtatgtccacattaacaataaatgctgctgcagtttacatgactttcttgagtgtgtcatagtacaaattttaaacctaacagatgataggtgcaagaaaacaaacatgattacaagaaacacttgcttcagtgctatcccacataagataccactcaatttctagaagcagtgttggctagcattgaggagctcatttgcacaagcaaagaatatcccatatatattgccacattatgagaccagaggtggggccagaataaaaactttgacttggcattccactgattcccttccatttccatggggtcca

SEQ ID NO: 39291 - DNA, 1501 bp, Oryza sativa
caacagactccaaatcagactctccaaatacctatataagcatatctttaattggtttggcaagctaaactcgttgctaacttcaataatctctccatctatcatttctactctaagtctatactactggtatccatatgttatcatctactacctcttcttcttccttctctttattcccctttccctcttctcctactgggggcatccctaagctcctccttggccctctccatctctgtggtggtgacgtccgtgcaaaggcgaacagcgacggtgacagcggacaacgatggaagatccatgagtgcgtggagcgaggtaaccaacgcgggagaaagggaggttgttggcgggcacggtgaacagggcgaggtggctctagagactgcacattgtggcggtgcccatgctacaacggagctcgagctcgccatccactcccaaccccattgtcgctgtaggcatccccacaccgtctccagtaaagtagatggaggagacggcgacgaatcctgagtcgaatccatacgggggaggaggcggtggaggtcgtgcgaggtcagaggcgacggcgagcgggaggccacggtagcgaggaggcgcgttgaggcggagtcgagggagaggcgctcccgtcaacgccaaccgctcccaaatgaaggaagaaagagaatagaatgtagtgggacacgaatagcaagttgagtaggctagttaagtttggcaagtgagagaaggagtttgttagcggatgacttggagagtgggatggatggactgttggtgtgcgatttttatccataattactaaattttgatttaaacagtgggatgaaaaggttgctagagatgcttagcatgctgcaaagtactacataaaactctgaaaccacttctgatttctaaatagctgctacggttgctttgtgcttgccataagaatatttgggaaaggaataacataggaaatccatagaatttgtatcttatagaaaataattatacgaagtcctttaaaacaaagtatttcctccgtttcagaatgtaagtctttctagcattgttcacattcatataaatattaatgaatctaaatatatatgtgtgtctagattcattaatatctatataaatgtgagcaatgctagaaagtcttatattatgaaacggtgggagtatttgcttttaccaattcctttgaaattcttatgggatgagctattgtagtgcaattttgagggtaaataagcatgaggtcttacctcatattttcttcttctgatgtctttgcgttcctacgttttttatgtattcccgctagttttatgaaactttcatgtgttttgaaattttataggaatccattgagcattacgttttattcatgcttttttctacctctgtgtttttatagtcccgtgtccgtagctaatcaatggctaatccacacggtcggtgaacgttcaagctgtccataatctatcctgcaggggcgagc

SEQ ID NO: 39292 - DNA, 933 bp, Oryza sativa
cattgtagtttcaacttgtggttccagctgaagcaattggagatttattaaatctaaggctacatgctaggctgctatgaggtaatctgaggaattcaaatttatatattgctgtgttctggaaaaatatctgacagtttagcacctcaagagaggacattaatttgtaatatatgactcctgcatttccttttacctcaagttcaggagtactcacatgagttctctccccatgctaatgctattatgaatttgataatacatttcaaaaatcaaaatgcatccaagttcaggaggattcacatgagttctgaatttctgttgtagtaactgaatttgtgttcaacccttaagaattgtcaaacatgttaggatcaagtatatatgtcagcaattaggaaatgtaacacctcatttgtgttcaacccttaagaaatgtatgtgtcgatttgtcaatcactgtttttgctcatcatgttgctgttataaatagttcagcatcacagggattttgtctttgaagaaggtttttcatattctggtttactgcacatgctatgagaaagcccaataagtatagctatccatatatttcttgacgaattcagccaatggtaataactcagtcttaactggataaaactatgttgagcatgacaactatagggctaactgaaaacctgaaattttcagggcataatagtatgttgcatgccggtaaccccaaagtagcaatgaagaaactcatacgttacatactacaaatcccaaattcatgaatacaacaactttgggtaactttaagaatttaatcaagaataggtaccgttaatgctatcctgtgtttgtcaacaacaattatatttctgaatattttttaacctttgaatatacatacaggttacgtaaccctctgctactctgctttttagg

SEQ ID NO: 39293 - DNA, 810 bp, Oryza sativa
atgttcaaacaaacgtgatcaagagagatcatatcgactgctgcgtgtcacgtacgcacgaaacttgttgatccggccaaccaccctcctcgatcgattccacgcaatcacgcgccgtgccatcactacgatgcatatcagagcagggtacaataggatgagtaagtaggctccaaaatttctcacaccatcctaatcttagatttagggcagagaatggaagagagagagaaacaagcgagcgagcgcttgttctagcgccgggcgttagcagctctttctatgcgttaccgcctgcgtgcagccgttcttgacgatagaaaacacgttttgtggggcccacgctttcccagccgatcccgtgagtctgtttcatacgccacacagctgcggcaacgaagtcttggtcaatcagtgcagcacaccaaaatggccacagagatgatggtttgtattgatcatactagttactgtgatcatgcaaatattaaatacttcaatgatttaattaaggatagcttgcagcttaacttgtagccattcgttgtatgagttagctctaagtgaactcctaattacatgaaacttttttggagctagcagttagctcttctattgaccttgctctcaagcgccacatgcttctgctcacgtagtgtagtggcggtggaacagcaatcgaaacgcccagtgcgccgccgcgacgatacaaatccaccatgcactaggtgatcgatgattctatatataatcccagcctcagcgccccatccatccatttccgacgaggaagagatcactgatcgggca

SEQ ID NO: 39294 - DNA, 736 bp, Oryza sativa
caaaatatctccgcccaggcgcctcgccagtttgtttcttgtgtactgtagtaattaacaacccgttccaccaccaccaccaaagacccggtgcacacacggaagcacgaagcgaagcgggggtccatggtgtgtgtcagtcacactgtgcagggcacgtgggggcagccgctcaagtgagctgtccctctcatctcatgtggcctctcgcgttcccatgccactgccagcctgcaaaaccacagcacaagtagtagtagtagctgcctccctcccccgcgatcttacggtgaattgctggtaaaacccgtgagccgtgacggttgtgtcgggtgctaggacgagaccgtgctgtatcgcgattttgtactgtagcccggttccactccgacacaggagccgctgatgcgagttgcgaggatacataaccgcgaggttatttcctttttagagcttttaaatcatgacgtatcccacgataatcacacgattttcacagtaatcgtactgttaccatgataaccaccaaacgtgaggcgataattttatctaaacgatttggtgaatactgtgatgccgagagaagccggggacttttttttttacgaccggtacggatggcgaggcaacaccaaccacggcggcggcggggtccctgcccccgcggagcttacctgttaccggacaccacaccaccatcaatcatcgtcatcgtcacgccaatgaaaattaatca

SEQ ID NO: 39295 - DNA, 1501 bp, Oryza sativa
ggcaactatccatcgacaaaccaaacggaaagcataggaagatagaactccataactcgataggcacttttgtactcagattatatcacaagcaatcaagataaatattatgaaattcgttgaaaaaatgcgatataacatatgtagcccccgactcgctactcaatagagaaccaattgatgtagtgaggcagaggaaaaggaaaatatcatataaagaaaaaaacaataatgacttagctttgtaatattccccttggtgatggcagaggtgaccaatgtgggaacaaagtcatccatcaataacaatgaagacaccagtcggcagcgacgaaggcggtcgatggtgaaagcgaagatgcccaccaacggcggcataataggccagccgtgaagaagatagcatcagttggcgtcataacaggccagctgtgcaggcggaaacaccagtcggtggtgtacgaggcagccggtcggtgatgatgtagacgcccaacaacggcggcataataggccagccgtgcaggaggaaacaccagtcgtcggcggacgaggcggccggtcggtgaagacgtagacgcccaacaacggcggcataataggccagccgtgcaggcggagacaccagtcggcggcggcgaaggcaagctggtcggtgaagacgtgaacacccatgaacggcagcataataggccagccgtgcaggcgaaaacaacagttggcggctgcggaggcaggccggcggtgaagtcgtagacgcccaccagcagcggcataataggccagccatgtacgcggagacaccagtcggcggcggcgaaggcaagccggtcggtgaagacgtgaacacccatgaacggcggcataataggccagccgtgcaggcgaaaaaacagttggcggctgcggaggcaggccggcggtgaagtcgtagatgcccaccaacggcggcataataggccagccatgtacgtggagacaccagtcggcggcggcgaaggcaagccggtcggtgaagacgtgaatgcccaagaacggcggcataataggccagccgtgcaggcgaaaacaccagtcggcggctgcggaggcaggccggcggcgaagtcgtaggcgcccaacagcggcgacataatgggctagccgtgtaggcggaaacaccagtcggcagtggtgaaggcaagccggtctgtgaagacgtgaacgcctatgaacggcggcataataggccagccgtataggcggagacaccagtcggcgacagacgaggcggcctgttggtgagacccccgagcatgtggcgggatgccccggatgcacgcgccacgggtgtagtcgggccgcgtcagccacgcaatggatgaagcccccgggcatgcggcgccgttccccgagtgtacgtgcaaacaaaaaggggaaacaatttcagcagcatcaatgaattaaatacatatgtatatacgtagatgcaaagtcaaataatgcatggagtgtttgcttg

SEQ ID NO: 39296 - DNA, 1501 bp, Oryza sativa
cgagcccggccatctcccccgcgtggatcgccgcgtcggagctcgtctcgaacacggaggtccacctcgtcgggagcatgtcgctggtgttcccgaacttggcgcccacgaagaccgctgcggcgacgaggcggtgcgccgtggacgggtcgacgcggatcccggcctccaccgcggcggcgctccccaagaaccgggtgaggtagatcccggcgaggacgtagcacgtggcctggagccggatgtcgtggcggacgctctccagccggacgaaggcgtggatccgctccaggaactccccgatcgcgacggtgggcgtcgcgccgccgcggaaggcgcggacgaggtcggactcggcgggccgtgtggcggcggcggcgtggcgggcggcgtcggcctccacgatcgcggcgaggagggagagggatcgagggatcccccgctcgtcgtcgcggaggacggggtggtcgccgtcgtccgagacctccacggtggtggtggcggcggcggccatggcggagggagagggaatcgcgaatcgcgagagggggattagggtttcgcgaaaatcgcaagagggggattagggtttcgagggagagagggggattaggagaggcgtacgtatacgggtatcttgatacgtattatacacagcggatggggcaccccgcgtgtagcgtacgccgtacgcgtaccttttttttttcttttttgcccttcctttctttttttttttcggaagctttgggcctagctagcgatttgggcttgcctgtaaaaaatcaggcctttcttcttttttttttctggataatacagaagtccctcttaaaagacaggattccacaatataagaacttaacgagtcttaataaatataagtaccaaaatatatactagtttcgtgaattttaatatttttcaacttcagggatatctcttttcatgaaaaattccaaaacatgcattcttaatttttcaaaacttgttcgggtcacgatttcttttgttctcatctctctcatcccatcacacagatgttatttcttagcaaccaagcagttctgagaaacacaaagtgttgtcacggcatattagcctgatgataatagagaccaaaaatgtgcactctgcatgctgcttatttttcttccaaacataaaaagttaagaacatatgaaaattgattggatagcatgatccattgcgtcactgcgtgacactggtaatatacatataacttacaccaacaaaagatcattatcacataatcctagatcttggcatcacatatattacaccctgaacaacaaaggcagtaaatacatctcatctcaatgccttcgttcccacttcccagattggacatattctgcagttgaatcctgcattgtggttctttgccatttggatcatcagtcaatgtgagaagagagccctaatgagcccgtagcccgcaaaaccaaggccgaagagaaggaaaccgtagtccccccag

SEQ ID NO: 39297 - DNA, 249 bp, Oryza sativa
aagaagaagagaaaagttcaaaataatactttttatgtaagtaactaatattactagtaatatgcccgtgctaaacgctacggtgcaattctatctgtctttaataatttttaaaatttcatgttagcaaaaaaaaatttatatgatctatgcatttgaactttaattcaatttatatcgtacataaaatatatttcatgtaaagtgcaatactatgatattgcgtgggcacaataaaactttacaaga

SEQ ID NO: 39298 - DNA, 1501 bp, Oryza sativa
tatcggtatgatgttcaaccaaccaaacctttatttttaacatgttgtctatatattgctagatgaatacatgctatgattagtgacttcatagatcatatgtgtaattcagacgctatgatcatctttcttaaaaatatttatttatctcctaaaaagatcattttaaaagtatcaaggtcaatttgtataggtatgtagccctcatatgcatgttaagaaattaattaagttggtagaaagtcgttagatgcttaacgggatataagtaatagatggaggtccatttgtgtttttttcccatatagataatttcaattttaattgttaaggagataaaaaacagagataaaagaatagggcacgctatacacgagcagggagggagggaggtttggaatgtttttctaaatgattaatctaaaaacctaaaataatgcgtccgatgtttatgtcgaaactgataatcggatgtttttttgttttattgtatcaggattttctctaatttaagagaacgatgtaacatcttaagagtatttataagatgtgtaatagactttttaataccatatgccgcaaagacggagggaggaaaggaggtttagggtgttctttaaaaaaggatctaatgacctaaaataatgtgtccatcgatttatgtcaaatccgatggttggattttttttttccaaaatttctaagatttttctctaatttaagaacatcatatagcagcttataagatgtttaatggattttaacatcacacggcggtggggaaggaggttgagaggtttgggttttttcttattgaaaaactaacaaatcaataacctaatcctttgttttttttaagattttctctttaatttaatagcaccacgttacagcttagaaacattcatagaatgtttagagtgacagagcgagagttgctagacctaataggtggaggtattttttaatgatggttttttaatgtaaaaataattttgattttaattcctcatgaatatagctcgttgatacgtacgtgatggggaggtttcggatgtgtgcttttttttaaaaaaaaatctaaccttctaaaataaaataatggatccaccgatttaaataaaattcgatggtcggattagagtgccacttagaaacctaggagcgtttgtatggtgccacttagcggcttagtagtatgtgtaggatgtttaatgaacttttaatatataatagtcttttttaaaaaaaatcaaggagggagagaggtttgggatttttctattaaaaaatctaatccattaatttaagtacaaaccaatgatcaatttctttatattttttaagatttttagtactttcactaatttaatagcatcatgtagtgatttagaagccttcgtagaatctttaaagcgacggagggagaactgctagacctaggagggagaactgctagatctaatagtatgtcttttgtgattttttttcctgtaaaagt

SEQ ID NO: 39299 - DNA, 1501 bp, Oryza sativa
catgtccacctctttgttgtcctcgtctcgcatgaattgtgcactaacaagacaaccatcatgcagtaacagggttactttctcgcattaacaatattataacattatcaaaatatagtgataacggatctagttttgtaaagctctttttttaaaagcattatggtggaaactgttcaacaatataatatgtgatgcgagagatacgattgtttaaagattagaatttcaaataatccacttgtgtttagtttgctactttgtatcttttgtgttgctcacttccctccacgcccacctctttggtgtcctcgtctcgcatgaattgcacaataataagatgactatattgtagtaatatgattacttactcgtagtaacaacattcggtagtttgtagaagtaccgttactactacatgcatgttctgcgttactacaatttccataggatgttactgtcaaaactgcagtaacaacctatatatttttgcagtagcaacctacatatttttgcagtaacgtggcgtgttactgcactttttcaataatgttactactggaacataataacagattataagtttcacaacaatataagtgatttgctctcacaaagtttgaatagagatatattaaattgaagcagtaaactctaatcacaagatgtcatagggtgaattggttaatagagaatttctttgaaccatgaggtcatggataagtcttggttttgtcactttaattttaaaatttctctccaatgtgagataaaaaaaattagagggagagaggccgtcgggcgagagaaaaaaaatcagagaagagagagggcgtgccagtgagagaaaaaagagagagggagagggcgccgggagagaaaaaaaagagagggagagagatcgatcagagggagagggtgccgagaggtccgaggggagactcgatcgagagaaaaaaaagggggcgcagggagagagagaggggagggcgcgcggaagaaaggacgagggaggggcgggacgagagagggaggatgagggcgggatcgggtgggccgggtggagttgttgggtaggataggaggggttgtagaatagctattttaagggggaggtgtagaatagagttgtcctataaatcttaactaatataaatattcgtatttttccatttgttacaagacggacgaaggcgctttcgtccgtcggcgggacgccttcgcagcccccgaatcccaatagctctcagaatcggatataggaaacatatcccaaaatcggcacaaccaaaactcaaccactctttgccccaaaagatcattcacaatcatcaccaaatcacaaaatacatcacaaaacttcacaaaaatatacatcaaaaagaagaagccgcaggatccgccctcggccatcgccaccacggccctcggccgttgccaccgccaccctcaaccttcgccaccgccgccggattcatccgcggccgttgccgacgctaca

SEQ ID NO: 39300 - DNA, 315 bp, Oryza sativa
ggaactaagagtgttttcccgagtttaggaacccttgtaactctcagtataagtcccatacaggagtagggtattgtggagattatgggtaccccatacccacacggcatggttatccgactagttataggggataacttatatctatgtaatatgtaacagatcatgacttgggtgttacgtttccttgtatattacggaatggcctaaagtcctgatttaggaaacagataccgtattggttaaggtttctatcttgtaatcctgccccccatcctatataaggtgggcaggaggccctctagggggcatata

SEQ ID NO: 39301 - DNA, 409 bp, Oryza sativa
ggtgctactttaaaaaccatgcaccgtgtgcccagcctaaaaccatttttggggattatgaataaaacgagcggtgtgaaagcgattccacaatatccaaaccattccatagtgtccaggcgatatgaatattaccaaagtctagaggtggaaaaccgactaatgttccctaattaaaagcgaagcatgtacctaaaatcatactagtgattgcatgagtagagtgtccactagttggggttttgtttattttagggtgaccagggaaataataccaataccaataataataaggtcataccaaaggtaaataggcatggctaaataaaacagtgataacgcgggaatttaaataaagcgataatgcaataagttaaatcaacataattttacaaactgggattcaata

SEQ ID NO: 39302 - DNA, 1501 bp, Oryza sativa
tgggaaggaatatcaaaccatgaattaggaggggtgggaggggggatattggcaacaaaacttctttacaaggaaaatctcaaattttgggtgacatttaggatggttatttaatattccttatttttatttggactgtccatcaagcatttgacataaaaccccctcagaaaacatgcgagttttggaccgtatgattattgtaagattcgtgtaacacaatctaaaccatatcacccctccctcctcactcccagccactatgggattgctcattcgctcgatccccttcctctcgctgtctagccttctaaccacaagcttgctttgtccctgctaccaacgctggatcacctccctcctccatccttacggcttcaacgcagccgcttgtggctcatcgctcgcccatatccactgcccaccgccacccatggctatccatctaagcttgactttctcggttcgagaagtgcattgttggaactggattggctctctcccgctctttcctcgcccccacctcccccaatctctaacccaacccgggatcctacatccctaactccaccacctttgtcggtgtcattggagccggcggacccggagaaaaagctaataccagagcatgaatctgtaagattttggcccaataattaatctatcgaatgccatttagcatttcactcatttatttgttatttatgagttatatctatgttactgtcaaattggataaagagtacacttgtagttaaattgagtgactctatattctatactctccccgctcaaaatattatgcgtattctgaccgtttaattttacattttagttaatgatttatttaatactatattcgttttaaaatatagtaccataatttagataaacccttgtccaaatatataaccagaaattattatattttacaacgcacatagtactccctccgtttcacaatgtaaatcatcctagcatttcccacattaacatcaatatgaatatagaatatagaatatctagattcattaacatcaatattaatatagaaaatgctagaatgacttacattgtgaaagtcattgtgaaacggaggaagtaatatttatgttttgccataaaattgatattgtcaaatttatgtcaaaactactttctcgtgactataattttacaatcgtaagcgaaaattgcgtaagagaaattacagtagacaaaactgaaataagaaagaaagaaagaaaataagatcatttaactacggagagtcatgtaacataatttagagcccacaagcagatcaaagtcacaaaggcaaaaactcctttgatccagacatccagtcacttcttctgtgtcccacattaattctcactgatggtggttagaagcagatccatctctctcagcctacagtagtaaacttttttcttcactgcgacaataattcgcagaataatctgttccaaacgtttgccaaaatcttcataagttccta

SEQ ID NO: 39303 - DNA, 1501 bp, Oryza sativa
ttaaccgaattaaccgagaaaaccgaattttggcccaataagcctaggaggcccaataagcccaataaactactaaaccctagaggcaaccacacatccaatccctcctcccaccagcctcacgcagcgccgcctctccccatcacgtcgcactcggctcggtcacaccgtctccgccttctgcctccaccgcgtcgcctccgcttccacggtgcctccgccgcctctgccttccgcctccacaataccgactctgcctttccgcctccactgcggcggcgccgcctccacctccgcagcttcgccttccgcctccacggcgccgcctccactctccgccctccacgctccgcccgtctgcctccatcgcgccacctccgccgggcgccagcccgtcctcgacctccatcacgccggcgccgcctctgtcggtccgtcctcgacctccatcgtgcagacgccgcctccgccggtccgtcctccacgaacccgcctctgcctcaacgccaccaccacgtcgcctccgtctccagccagactgcggtgggggattcgatgcgttcgcgtttgagccggtccccctctgtcaaaattcggttagaccgagaccgagaccgaatttgtcggtcctgagtttttttggaagaaattcggtcctcacttttcaaagaccgaaatgaccgaaaggccgaagaccgagaccgaatttttcggtcagaccgaacgcccacccctatttgccggtgccaaagccgcagcgctcggtgcttgaacatgatgagccatccacttatggggagcaggaggagcccaaggagagtgccggtcggcaacaggacggtaagaggaaatgagacgaggaaaagcaggagccagtggcgcagaattcactgaagctggttaggaagggccctgaggtcgtgtacttagataggaagcgatgcctgtgattgcactcttcccattgtcattggacatgctcatgctacagaggtgaagtccatggcaatgggaagagtgcgaagctgagggtgaatggcattcaatagccattaccttgaccttgtccaggttactttttatatcttaatgtccaacatattggcgatggctccatggcaggcatcgtcctcgacgctaaaggtcagtgcaccctccccattttgtcttctccctcctcccatcctctatccctctcatcttgccaccagcagttgtcctgcggggcagtgggtgatcgtacttcttcacggtgaccagcggtagcgagtggtcttgaatttccaaatccatgtgatgaattcaatattggttctgtgatgttttattttatgattttttttttgttgcgtatctatttcatttattttttgaggaattccaatcatggcttaatttctatgatgaacttgtgacttgcttttcgatttatttttagtggatttggatcattggctcgaatcgtgttgagccacttttttttttttacaaatcgagccga

SEQ ID NO: 39304 - DNA, 1501 bp, Oryza sativa
gaaataagaaagaaagaaagaaaataagatcatttaactacggagagtcatgtaacataatttagagcccacaagcagatcaaagtcacaaaggcaaaaactcctttgatccagacatccagtcacttcttctgtgtcccacattaattctcactgatggtggttagaagcagatccatctctctcagcctacagtagtaaacttttttcttcactgcgacaataattcgcagaataatctgttccaaacgtttgccaaaatcttcataagttcctatgtgtggagattatgggtaccccatacccacacggtatggttatccgactagttataggggataacttatatatatatgaaatatgtaacagatcatgacttgggtattacgtttccctgaatattatggaacggcctaaagtcctggtttgataagattgtaaagtagatttaggaaaccgataccgtattggttaaggtttctatcttgtaaccctgccccccaacctatataaggagggcagggagcccctctaggggcaggagacaacctgatcgtcagatcaatacacacccggcagattcaaatccccaaacaggagtagggtattacctctcattgagagggcctgaacctgtctaaatcctttgtctccacatccatccacttttaggtctcgtgcgctaccccgttttattattgccgaattcatgtttcgacagttggcgcgccaggtagggggtgcgtcgaattacctgtcgaaaagtgcgatggaatcaacttcagaagaaaccccgagatcaatctcatcaatttcgatggctcaaatctaaatcttcaatcgggtctaccgttccaatttaatctctattagattaatttttaatcattgtttgatttcctgatattttgacgaatttcatatactggatgagatcgaaacacggccatcatcgtcgcctacttgggtgcccttgccgtgtccgagtgctcctctcttcctttccttgcagatggacgtgttgcaggagtggcacaggccgccaggattcgattcctgtttgcatgtatgatggttgatgggctccgccggctacctccgatgatggcatcatgccgaaagaacatcgagttagctgttagttgccggggcttatacatgttgcatggcacgtcgccggctatcactcatgatccagcctcactgctcgacttgagtttttcgtttcaatttgttatcaatatatattagattgatttctaatctcagattaatttcttgctatttttttgttgttgttcgcatataactacgcggcactattgaggcgattgatgctggtcatggactcgaggcgtctcagctttccggtcgatcggccgcgagtccactccgccggcttgtcctcgccaccgccattgctgatagcaacaacgacttcaccaccggcctgcctccgtcgccgccgactggtgtccccgcctatacggttggttggtca

SEQ ID NO: 39305 - DNA, 1501 bp, Oryza sativa
gcgtaaacggtagcaagagagaacattttccttgtcattttaagctatcaaaaagcttctcggcaacctgcatggtaaaacataaccaacatgagcaagatagtttttaccatgatccacaaggaatcagaagaaaaacagaatatctaggtcgccaattttggtggatcttattaaggtgccagtcaagattgaagtagatattgacatttcatggctagtacatctctttgatgtgagtactaagtacccatacctgttcacttagttggctgggattttcggaaggttaaaatagaaaatagagacaagtggtttctttggatcaacaattcactcaaatataagtgtatatatggcaacaagcactcacatttttgtcgacacatttccagtaatcgaagtattgaccagtacaatgcttctgaccagtctcatcatcttcaattctcttgacacatttctgtgtgcacaacatagagtagcataagataagatccaggcccagcagtaccaaaggtgcagaagaatagctattcagaaagcaataatgtacagcaatatagatagcatggagcttctccaaataatgctcggattgactacatttagataacagtactgatacattaatattgtgaagttgaaaactaagcacaaaacgccaaatgtatcggttggatattaatagcaaattaatactgctatctagttgagatagctgggcacatagaccataaaaacaaaatgagagttcaccaacagaaaaaaaaaaacagcatatacctgatattcataccactggtacacacacttagccttcgatcgatcctctaggagtgccttcgggtcagatacctcctcatccgacctgaattagagtgcaaggctacaagctcaggaatataataacaaaaagtcgcactatttgttatataactaccacaaatatctttgatggaaaaccataaaatgcaggacaagtttccaaatgcaataccgggtacttgccatgcatttcaataaatcaaacaataagatctaaatttggaaagagtaatcacaatattatgcagtactctctttttcccaatagcgccttaaccaccagtgcataaaacatggatgcaaacgcaaaatatgatacaccggtttaatctaatgagattgtacacagtaaagctatagtttaaagcaagtcaacctttttttcagaaacaagcaagttgcattttggtcaatctagagttacttgatgtgtccacgcatggtgcacaaagatgagaaaacgataaaaccgcaacaataaaaagaagctgtataggtgtaatgcagatggcaaggcgctggagtgtgtgctcacacccattcgatccccatcggcagtcagcgtgtgtgttaaactctctcttaattacatcgatatgaaaggaggagctttcatatccagctgttagaaaacaatagaactgaaacaatcaaaactgacttctgcatgggc

SEQ ID NO: 39306 - DNA, 1501 bp, Oryza sativa
caaatttgatcttccaagggtttttagcataacaatatgtaatacgcgaacgttggcaggaccctagcaagttctgatcaggcgttcaggccaatgtgtatttttctacgcgttccaacttctgagtgcgattttgagtatgacgtgtttacggattcactgcttccatgtgattagtctaaggtaattaacgagtcctacgtaactagcatgtgattagtatcacaaagcatagtaggctatgcactcctaaagtcttggttatatttgaattaacttgcttttctaaataaaatatattattttcttacataagtatcaatttaaattttaaacttgccacacataatttttattcaagaaaataaaaaactttatacacgtaagctttgtacaagaaaatagtaaacttatatgcataaaatttttgtctcaataactttctatttagggtaaaaaaatacttcatacctaaattatattttttagacaataattttggttaaagttgaattgttaaatatatcaaaaaaattaagaagatataaaaggaaaacacatatccctatggaacaaacaaaatacaaaagtacatgctagaaatacctatgcaaagttgtgttgtactagtttcagttccatacaaattcaaacaacacacagaaaaaaattgtacaactccaattcgtcgcctctctttgtggcccataaagaaataaggcaaaatttgctacaggtcgaaaaaatgtgtaattagctcgtggacaccgcaagaacgagaatttgctgtcggatatcacaaaaaatgtgtaattagcttctggacactcggggccttattttattatttcctgtgaacttggagagagaaacactggtgaaagtacgattttgcccctgccctcacaccggccagagcaccgctgccacctcctccgcgcggcggccgacgcgacgagcgcattgggcagagggggagaaaggcgagcccgctctgcgctgcccgctgccgcgcccacgcaggccgccaacgcatgccatcgcatgcacatccgcgccaccgccgccagccaacgttgcgcatgccgccgccgccgccggcggcaacccgacgcacgcgcgcgccgctgccttcccccaactgcgccgccatgccggaagatgaggaagacgacagtgacaaggacgacaggaagtaggaggccgtggagctcgagatgctgcgcatcgaccgcgcgtggaagtccgtgaagccgacaagctccgccggtggccgccgtgggctgatgcaggtggagctgctccggcctgtggccgcggccgaggaggaggcatgctcttgtcgacgggaaccgagaagcactcttgtcgaaacaaattttcggcaatatgaaaagggggtagcgcacgagacctaaaagtggatggatgcggagacaaaggatttagacaggttcaggccctctcaatgagagataataccctactcctgtttggggat

SEQ ID NO: 39307 - DNA, 1501 bp, Oryza sativa
agtagcaaaacttgcgaagtagcaacaatagagtttgccggtgccgaagataataaagatgaagtcgctctaccatgatgacaaagttgcattgccgtgatgaagtgaacacgagtcagcggcaacagaagcaaaccggtagtgaagacgcgcagttgtgaagataaaagcaccagtcggcggcagacgtagacagtttgcgttgaagatgatgacggctattagcggtgacggcgacgtagccagccgtgaagaagatagcatcagttggcgtcataacaggccagctgtgcaggcggaaacaccagtcggtggtgtacgaggcagccggtcggtgatgacgtagacgcccaacaacggcggcataataggccagccgtgcaggaggaaacaccagttgtcggcggacgaggcggccggtcggtgaagacgtagacgcccaacaacggcggcataataggccagccgtgcaggcggagacaccagtcggtggcggcgaaggcaagccggtcggtgaagacgtagatgcccaacaacggtggtgtgaccaaacaaccgtataggcgaagacaccagtcggtggcaaagggaaaccggtcggtgaagacgtggacgcccatgaacggtggtgtgaccaaccaaccgtataggcgaggacaccagtcggctgcgacggaggcatgccggtgatgaagtcgtagacgcccaacaacggcggcatagtaggccagccgtgcaggcggaaacaccagtcggcggcggacgaggcggccggtcggtgaagacgtagatgcccaacaacggcggcataataggccagccgtgcaggcggaaacacgagtcggcggtgacgaaggcaagccggtcgatgaaggcgtagacgcccaacaacggcggcataataagccagccatgcaggcagagacaccagtcggtggcggcgaaggcaagccgatggtgatgttctgactgatccattcctagagcgtaagagataagcttaaagccatgaatcccttttatgcatatctggatttggatcctgcagaacaaacatataggatgagtagtatctgatgtaaatataatactcgagaaaaatgcaagtattttaaaatatttataaatatgtatttctcctcctgtcaattttgatttccccgagcagatgactcattacgtttaaacgctctgtccgactagtcatagcccccaagcaccgggagtcggcctaggcacttcccaaacatgcatatgagtgacatgagtttactactcgggtacttttgcaattgttaagagcagaaaataaattatattatctctatgcttttgatttcttccgagtaatacttagcaccttgcgttactcagtccatccaacgagcccccgggtgctaggaatcggcccaaaggcaactatccatcggcaaaccaaacggaaagcataggaagatagaactccataactcgataggcacttttgtacttagattatgtc

SEQ ID NO: 39308 - DNA, 1501 bp, Oryza sativa
agcgcgctgtttatttttctctctctctttcctttccccgctttctctgatcgccgccgttttctgcagttggaatccggatcttccttcgtcgagggggtcgcgtcgcctcgccggcggccgtcgcgagcatgtgagtctctcacctgatcccgtccccttcaattttttctgtcttgcttggtagtcgatcggtcggtcggtcggtctcctgtttggttggaacggatcgggcgtgctgcattggccatgcgtttgggggattgattggttttgatttggaacgattcgggcgccatgatcgtagggggattcagtgaacttgcatcgcggttgctccgaccgaattttcacggccgtatttttctgtcggtggatggcttttgtgtcgtggggagttgcagcgaatggatgcgatgtagccacgcgtgattcttgcgaggtcgcagggcagagtgatatggatctagtaaaaaaagtgagagttttcctatctgattatctcgtcctccatatgtttttgtttatgctgtgctaattctggttgcccagcacccatatccaattcccatgtcattcatgaagcctagcattggctataattgattaggttccttctacatctgcattatgatgctgacgcttgaagttcttttgattcatactttagcaaagcacacctgcaatgcaaacacttatagtcttatgtgatgataccttcagtgcaaaacttattctgaagaccgaaagcatcaaactatggtgcttaccgtttcatagtttagcaaagcacattagcaaactctcctgtgtgctgttaacttagtaggaactgattctgaagattgaaagcgtcaaatatttatactagtgcccatgcagaagtcagttttgattgtttcagttctattgttttctaacagctggatatgaaagctcctcctttcatatcgatgtaattaagagagagtttaacacacacgctgactgccgatggggatcgaatgggtgtgagcacacactccagcgccttgccatctgcattacacctatacagcttctttttattgttgcggttttatcgttttctcatctttgtgcaccatgcgtggacacatcaagtaactctagattgaccaaaatgcaacttgcttgtttctgaaaaaaaggttgacttgctttaaactatagctttactgtgtacaatctcattagattaaaccggtgtatcatattttgcgtttgcatccatgttttatgcactggtggttaaggcgctattgggaaaaagagagtactgcataatattgtgattactctttccaaatttagatcttattgtttgatttattgaaatgcatggcaagtacccggtattgcatttggaaacttgtcctgcattttatggttttccatcaaagatatttgtggtagttatataacaaatagtgcgactttttgttattatattcctgagcttgtagccttgcactctaattca

SEQ ID NO: 39309 - DNA, 230 bp, Oryza sativa
ccatatctctagtcaataattttctgaggattacagaactcaatcacttgctgctagctgcaactcatgttttcggaataaaaacaatactgtgtaatgtgaacaattcatcaattagaaaagggtagcatagacataaacatggaatccagtgggataaattgacccattcaaatatcacataatccttcttcctttggaagctaatctcacatgtccatttgttctga

SEQ ID NO: 39310 - DNA, 1501 bp, Oryza sativa
tcgctcggctggggcggcctgagccgtgccgtgccccagccgcgccgatccgggccgtcggttcccgtggaccggtggtggaccgcctcggtggtcccggtccacggtggaccggcgcccttgtgtcgctgaccggtggggcccgcttgccggcgccgcctctcccccatgatgacgtcagcatccccttttcctttggaagaataattattaatcgcgtcataaatcgtatttaattctagaaattcatataaatggctcaaaacttctaaaattcatatctaattcattcgaactccgaattgggccattcaaattgcaaaattcatctaaaattgagtctacatgtttgtttagtttttatgtactgtttccttggtttttattagagtttttcctcgttttgcgtgccagcgtgtagttcccgtcgtttcggaagatcgcggtcgcaaggataagagttcggaagattgtttgaagaagcaaggcaagtcacacattccccttgagcatgttgatcccaatttacaaatgttttactgtttgcaaataaatatgcatgttttgctaattacatgggatccgggtattacctatttgctcgcttgtgtcatgtttacttgatatctgttctttgtcaaccatgggtaataaatcacctagcgtatgttacttatgtgacctagctagaactatatgcttagccatgcttaattaccactagctcagtcgatgggataattgcagtattagacattctagtatcttgttgagctgcgtgctcgagacatctggcgatcctagcggggcttcagctccactccataggcaaaactcaactggggtctgagccttggtcttccaacatcatcttcagctcagaagcactacacttctgaaaagggggaataatagcaaggctgagtaccaccaccgtactcagcaggccacaccaacgatgcagacgtgcaaggggactcaagaatgacttgtggctatttgcataaaggcggttgtaaaacaatttgttgagcaaaacagtaaaactgttgaataattaagggaaattagatctccactgatcaacgctacaccacgttgaacaggcccaaccaacccacctatactacagtgtattgggttgatttattaagatgggactaatcacagtgaatctggttgaccgcccataaccgcgggcacggctattcgaatagttttactctaatcagaggtgtacaactgtacccacaagacacagccccacgacacgtttccgtgcgccgacatgccaccacgacataccggaaagaggccgtgacaggacccttcgcataaccccctctaaccaagcacaccacacctcaggtttcacccctactcctcgcaaggcagcgggcagtcccctctcgtgcctaggtgaatccggaagccgcagaagccgtcgcagggcccatccaaactccatcacgcccacccttgcctggatgcgtcggctaga

SEQ ID NO: 39311 - DNA, 1501 bp, Oryza sativa
gccataaattgcacatcctgcttaaaaaactatatcataatttttgctggctacttttttccaagtgtttttgaccaattatataaaaacatgtacacacaaaataatacgaatgcatgaaaaatatccttttaacatcagcttaatggctcctttggaacgcatcagcttaatggctcctttaaattcaagtgtcttgttatcttaaatcctacagatagaaaaaaacacaaagaaacagtagaaatgatcatttggattgagtagaaaaaaaaacataggaatcaaacgagactgacagacacagaaattttttttcccaagaggtggcacctcatgttgataatccttcataattcctatgacttgacacaatctaaaagaatttaaaggaatttgagcaattattcctttgttccaaatggttacataggatccaatctatcaaattttttctcaaattcctttgttctaaaggggacagagttgaaggaaaaaaaacaaatccatataatcgagtaaaaattgtaatgcatatacgtgtggtcgcataggtgaaagttattagcattctaagggctcgtttggaatatatgattttcaaaatacgtaaatgaaaaatacaagattggaaggtcctaacacttcaaaccatatgaattgaaaaagttcaaaaaaaaactacaagaatgactgtttagatggagcacgggaaaagcgttggaatcaaaaagagagaagaataagcacaaatgattttttttttcaagaggttagaccttatgttaaaattccttcaaaatttctatgttttgggccaatccaaagaaattttgtaggatttttggatggctattcctttgatccaaagtaccacattggggattttttttaataggattgaagtcttccaaaaatccttaaaaccactttattccaaggagccttgctataacagtaaattgtttattgcaacacaaaccatacatatcttgcgttcgtacaaaaatatatgcatcttgttttgctacgccgacaatcccagcctgaaaataatttgattgtcattgctaccacatgagggtgatcagccagcccagccctcccctccaattgaataatcaccaactaaccaacgaccatatcaagaatcccaagctcctgtcagcgttataataatcacaaaaaaaggagaaatcccaggcatgtaaaatctcaggtaaaaacaccagtaaaaacccaaaaaatttatctcgactttttccatgatccatctcgtgcacatcgatcaaatctctccatctccatctctctctctgcccacaccacaccaccatgtgtgcccacatctcctcgaccaggcctctctctcctactacatcaatcctctcctcttcttctccctcctcagtccctatccactctccttcctagcagcagcagcagcagcacacagcgcggcaagaaacagggagcttcagggtgagaggagctagaatga

SEQ ID NO: 39312 - DNA, 1501 bp, Oryza sativa
tcaatccaaatgatcatttctactgtttctttgtgtttttttctatctgtaggatttaagataacaagacacttgaatttaaaggagccattaagctgatgcgttccaaaggagccattaagctgatgttaaaaggatatttttcatgcattcgtattattttgtgtgtacatgtttttatataattggtcaaaaacacttggaaaaaagtagccagcaaaaattatgatatagttttttaagcaggatgtgcaatttatggcaatttttgtttaaccagaagataaagacaagtgcacccttaaaagtaataatagttttaaagatggaagcaactatgtcatcaatgttgcatttttatcttcttttgtatgaaaggacacctattaataacaaagaaaatctagttgcgaaatcggtcatgaaaacccatagagtataaattattgtgggtcctttcttgttgtccctcttgtcctgtacgtaccaacaaagaaaaaacctgccttgtgctgagttggagagctcacttcatttgtctgcctcttgatttcgaaaccgttctaaatgctatgcttcccccagcaagcacacttgggacatgagggtacatggtggtccattcataaccatacaaatcgatgcaatgtatatgcatctgtaaaggtagttatggcccatgttcaacaattttgatttgtgcttgcctcatttttggtttatacctccttgacggagcgtggggctcctcaccgggagaccgcgcaggcccccctttgccggttcggccgggggcgctaagtgaggttcttcgccctcgatctgaggaacgtcagcgagagaggaaatgcacaagacacgggcgacgtagacaggttcgggccgctgagaagcgtaacaccctactcctgtgttctggtggatctgtgcgtgaaggaatacagagagccggagagcgagagagagttcaggctctagaacccattcgccagagtccccactcccctcctttctcctcctctcctttctttttctaggcctgggcctcctttttatctggtctggggtcaccacatgggcctcctgctgcctaagaagggaaacatgctttttacaatcagggctagtctacagccggaagtgacctctgacaagcagagcacacgcctcctgccccgctcgcccgcttttccggtggacgcccatttcaaccttcatttaatggccagcgacttccttgccatactttcgctgaagcctggaatggatctgaccgggactgacataccaactccaggagttagcatgccggctccggctagggacgagagccaggaagctctcatcattccgacgggacggggcgaggcgtgtgacaggccgcctgttgccacctaacccgcgatctgaccggtctgtgaccggtcacacaccgcgaccggtcacggaccggataagcgtgcgctgcgctgcattaaatgcggcgtggcgcgctcgtcca

SEQ ID NO: 39313 - DNA, 1501 bp, Oryza sativa
ctttttgcctctgttttgctgccttctgcccctcagggcgcttctctttgcgctctgtttcctcctctgtgtcttggttcgacgatgaagtatatgctcctgattcagaaatcttgttcctcttattatggctactctcttcaaggactctacgccatttaggttgatctttaagatctttccacatatactccaaggtgaaaggtttttggttgttgtgctttttgtaccattcacaggctttctccattatcatatcatcagaatacccacttgtgaaagtagttctagctttagaataaaatccacagaacttagtgacatctctcttgacattgtcccaatgtgttctgcattgcttggggttccttttgttcccattactaggcatattgctgttgaactctctagctacagccttccaatattgttctgatttcttgtcattgcctttgatgggatcaactgaattgttcaaccaagaactcattagtcgtatattgtcatcttcagtccaattgatgcgtgtccctcttcttccttcttcactgctatcacttgcctcttcaacctcaactacttctttctcattatgtcttgtatgacatggagaagctgatccatgaaagaagtgttggctgtagccccaattgaagtactatattgcataccaaactgtgatctattggctgcaaatccaaatgcttggttaaatgagtgcaccagattttcttgaagttgaaaaccttccaagcttcctggagtaggttgcccataatattcttgttgctgagcaccttgaaagattggagggtgtcgatatggttggtagttgcttggaggaccaaaaggatggaaattttggagaaaactaggtctgaagttttggggataacttgtgggaaattgggtagaaagggagttttgggcctcactatttgttgcttggcttgaggaaccttggttgaggaggtttgagaagtttcctttgaaaggctccatttagtatgtggggaaactgaatagatcaaaaattgttgttcatctcacttgttcctccttttgtaggcagcagaagaatgctggaggaagacaacggctaggggaccaaatgagcaactcaaatggaatagcagcaacggctagtagtactcgttactgtgtttagtaactgacatgtatattttattggtgtgcacagaaaaacagtaaaggtattgtattttatagctttgttgctacaccttaagcttaaggtgtactttggttgcatcggacttgtggtctgactccacaatgctaaatgcgttgtactgtagcagtatttaatgtctaaggttactttcagtgtacattgtggatgcccttaggctgtgttcgatactagtggttgggaactggtgtgcagtgcacgtaaaacggagcaactcattagcgcataattaatgaagtattagctattttgtttgaaaaatagattaatattttttaaaagcaactt

SEQ ID NO: 39314 - DNA, 459 bp, Oryza sativa
ttagacatttcggcttataagttggcttataagcataaacaaagagggcctcagcactccggttattatatcacatttccaggttttaaagattgggtgaaattgacctgatcgcagcgcgagcagctagcgcaaattgttggactcatgacccatccatgcatgattattcagtcagtcagtcagtaggttcccagaattttctccctgcaaacagggacaaaaagcctctccaaatcgatttgctgttcagaaattcagagatcgaattcagacagtcgaatcgacaagcaaacaagctagctgcgccacggcgaagtgatgcaaacaccatgcttcgtgagcctttccactgtttcactctgctcctgctcctcctcgcggctgccgaccgctgcgccgcggccaccggcggcagcggcggcctgcagttcgcgtacgatggcttctcgggcgcca

SEQ ID NO: 39315 - DNA, 1501 bp, Oryza sativa
ctttggcgaacacgcaaaaagacttgcgcatcaataacacaatatgttattggaaggaagcagattgtttacccaccgctactgactggtagccatcgccgaaggaggaggaggtaacggctgtcgggctattacaactaactagtactgccaatacaaatattcatgcggactcttgcactctacagtaggacttgtcatgattaatcacaagttttacgtgcatctacaaaaatttcctgtcaagagaaagcaaggtgctagttttcatggatgtagtctttaggatctagctaatccgattggtggtgttgtgcagcagctgcttctgtttctttcatgaacttaaatgaacgcatgtgatccatcttcagttcaggccattgaacgcccttcagtacctatcatacaaagactaaacgtataaattgacaagtattaattgaagcggcgccggccaaatgaatttatcaaactatggaccgccatatgacgatagctagaatctcctccacagtgcttgtcaaaatcattcgcaaattgagacgtttgaaaccaagactgatccttgtgaagtagaaacatctcactgtcaggagtcaaaacctcatcttctactacttcgttgaaactagaatagtagcgtagaacaaaggcaccagcatccaaacggcagctagcagagcagtccacaagtccattgattcttcagaaaagttttcttagagagagagagagagagagtcctttgaaacaggtaaaaacaatctctgaataataatctctggtctctttgaccactatattgctcaagtgctactacttctcgatcgatgtgttcgacagaatgcaatttttttgtccagcaacctagaagagtcaccgtcgaaagtacgaaaattaaatcgatctatgcgaaaatcaggacggcgagagagtagtcgtcttaccctgcagggcacggcgcctaccaaggcacacgcctctgaaacttgcagccgccgacgttgatgtttgccgatccagtaatcactattggacaggatgatcaacgcatgcggagtgcagccatcgctagcaagatactccctctgccccctaaaaaaaagacaaacccttaatttctgtgtccaacatttaactgaataagatggacggtcaaacgttggacacgaaaactcagggtttgtctttttttaggacggagggagtatctccgtgaagacagtgttgttgctgactacttgacattgataacaaattcaataatccatccaccaaagtgtactgggttaatggtcgccggccggctgatggttgtctgttcgtgccaaaacatgtccttgtcgatctgaatctttcagctctcatcgctcgacacccaaccactcgatcataagccaagcagtttatgttagccaattgctacaatatccttaagaggcgtcaaggcgaagtgtcacgggaaaaaaaatgggtcgtatgattgccaaattttctg

SEQ ID NO: 39316 - DNA, 1501 bp, Oryza sativa
gtcatacaagacataatgagaaagaagtagttgaggttgaagaggcaagtgatagcagtgaagaaggaagaagagggacacgcatcaattggactgaagatgacaatatacgactaatgagttcttggttgaacaattcagttgatcccatcaaaggcaatgacaagaaatcagaacaatattggaaggctgtagctagagagttcaacagcaatatgcctagtaatgggaacaaaaggaaccccaagcaatgcagaacacattgggacaatgtcaagagagatgtcactaagttctgtggattttattctaaagctagaactactttcacaagtgggtattctgatgatatgataatggagaaagcctgtgaatggtacaaaaagcacaacaaccaaaaacctttcaccttggagtatatgtggaaagatcttaaagatcaacctaaatggcgtagagtccttgaagagagtagccataataagaggaacaagatttctgaatcaggagcatatacttcatcgtcgaaccaagacacagaggaggaaacagagcgcaaagagaagcgccctgaggggcagaaggcagcaaaacagaggcaaaaaggaaaaggtgcaccatcacctttaggggataagccaagtcaaaatatggttctctttcacgaagctattacaactaaagcagcagcattgctaaaggcagcagaagcaacactgattggagcagaagcaaaaaaagagaaggcgattgcaaaaaaagagaaggcaagggcagaaaaataccaaatgtatttaaaactgatggagaaggatacatcaacctttagtgaagcaaaactgaagagacatgaaaatgtgttggaccaattagctagagaacttgctgaggaataaatgactagcaagcaatgttagcaattatgcttattttataatgtcagtattcttgtcatatattaaaattatgtactgtgttgatgcttgtactgtgaacctatttgtactgtactatgttatggtaatttgtataaatattgtgtattacagctatggaatgaaactacaatatccttagtacttgagaaatcaccttttcacatggatctagttggtgttgatggttttccttccatccatgaccaatctgttttttttctccacctgaatacatatgagcaataattaatagagaacaaaagcaagagggatgttgacaaaacctaggaaaatatagctgttgtaaaagactgacaaaagcaagagctagctgttaggatattgacaaaacccaggaaaatatagctgttgtaaaaatctgacaaatctagtcgttgtaaaatgtatcatctacaaataggtaatgtagttcagcagaacaacacccattctcattttgttcaacttcatctcaacagccttcccactttcaaaaaaaaaaatgtccagcaagtcaccacatcaatctagtgagtcagatgattctagctctagtgactacc

SEQ ID NO: 39317 - DNA, 1501 bp, Oryza sativa
cgattcacatgatgcatacgtacaaacagaaaaagaatctgtagtagcagcacttgcacatatttgatgacaaatttaatcgtagcagcagcagcacttgcacaaacagatataaatttaatcaccgggcaaaccaaaagcaagaagagattccacaacacggaaaaggagaggccacggaatcaatcaccttgtctctaacgcagaactcacggacgatgtaggcgaagttgagggcggtgaccgtctagtaggtgctgatggttgagagcagcttcaagtttgtggcgcagacgagacagagaagcacgcgtcggcagcgtcgcggccggagtagttcgcgcatgcagcgtcatcgatgggtgaggccgcgcgcggcaacgtggcaccgaagccacggcacagcgaggtcacagccgaaggaggggaggccgggaggagcagcgacgttggcgcagccacgggaggagcaatcgtcggagaaattggggatccagtgcatgcgctgtgggagaatttggggatcgagcggagcgacgaagagaggaattggggatctgaggcggaggaaatggggatcgaacagagtaacagtggatgaggattttttttcactcgcgcgaacaagcagatggttaggagtgatctgtattctttttctcccgtggggcccagcgggacccaccttatttccatcaaacaagcagtatcattgtagagatttccttaactattgctacctgtagatgggcccactcttgttatgcattttaccatatacattggccttgccctaagaggtttataaaccctaggaaggaaaataactaggctgtcatacttagggttagttcgttttagcaactcgggtaagattttccatagtgccgaaaacatggaagatcattgattaattagctattacaaacttgaagaatgagtttattctatttttttaaaaaaaacttttatatacaatttttttatgaaacgtgccgtttaaccgtttgaaaagagaacgaggaagttgctcaccaaagttgctaaactaaactaagccttaaatatcttaacaatgcgagatggaattgctagcgccagagtttacatgtttctaatgctacacaaataacatgatgagttgatgacatacggtttatatattacttcctctgtcccataatataacaatttagtaccggagaagacacttcatagtacaataaattcggacatgctttttatccagattcattgtattataaagtgtcttatccaatccgagattgctaattataggacggagagagtacaatttatacttaatcgaaataaatatacatgtatttgttacacttgtactactagtactaggagtgcagttactactactgcaggcaaggataagatggggagcagatgaatgatccccgcacataggactcccctccacgctgctccctgtccgccaccctgcagcttaatcatgacgtgggcgaga

SEQ ID NO: 39318 - DNA, 1501 bp, Oryza sativa
ttatgcgacgacacaatttcacaaaactacgggaaaatgcaattgatggagtgaacatgtcatgtacatctattatatccgtattaaaatataaggcaaaatttgctacatgacacttaaaaaaaatgtaattagctagaagacaccataaagacgtgaatttgtccgaagacacttcaaaagtgtgataatttgctgtaggacaccagacgcattaaaatataatatccaccctaatgatgaaatagaaaccacataaaatgacaattttgcccttattatcttcttctcccttctcccagttttcttccgatgctcactcctagcaaggtccatcggtttgcccatggcggacagcaggctagcctcgagccgccacgcggctagctgatcgcgccgccgatgatgatggtgccacccgtgccagctgtgcaaggcgtcgtcgtgctgtccatctagccggcgcccgccggcttgcgtcgttgtgccgtctatctcgccggcgcccgctgacttcctgtgatgctacagctacaacccggcaacccggtgtacaagtagtcctcatactacggcgacggttgcggctacggctacggcggcggcggcgcgtgccgctgcggctcgtgcgccggtggcaacaagccgatggtcggtgtgtactacggagtggcctcggtgacggcgtcgtacgaccaccagggatggtactacggcaactagcagccgtactaccaacagcagcaatgctacgaggtccctaacgccggatgcagcatcatgtgatgtgtgtcggcaggcgccatcggcatagatgggagcaatcagtgcgtgtggtcattctcgctcacactcactcatcactagctcatggccagtgttaaaaaaatctttcttttttttttgtcgatgccccttctctgtttatttagggtgttgagttgtgtatgtgaacagttgagttgtgtggagattatgggtaccccatactcacacggcgtggttatccgactagttataggggataacttatatctatgaaatatgtaacggatcatgacttaggtattacgtttccctgtatattatggaacggcctaaagccctggtttgataagattgtaaagtagatttagaaaaccgataccgtattggttaaggtttctatcttgtaatcatgccccctatcctatataaggtgggcagaggccctctagggagcatgagacaactagatcgtcagatctatactacactcggcggattcaaatccccaaacaggagtaaggtattacctctcattgagagggcctgaacctgtctaaatccttgtctctgtatccatccacttttaggtctcatgcgctaccctttttattattgccgaattcatgtttcgacagttggcgcgccaggtaggagtgcgtcgagtttcctatcaagaagtatgatggattcaactttaggaagaaacgtcgagatcaatcttattgatttcaat

SEQ ID NO: 39319 - DNA, 1501 bp, Oryza sativa
ttggccaacaacgaggaggagagcaaatggaggataaatggagacgcactcagcagtttgatggtggctgtagctggccccacaagctcagaatttcagctaaaaacgaatggatatagccacattacgtgcaggaaactaataacgactgtcactaatcatgagtgttactagatcagaaggcaacagagcaaccaaataatgaaagtgatagatgccattagaatttcttctttttttttatctggcatttcaatactgcaaaataatgtctgattgttagcaactagtatatattttataataattgctgtaaaaaaggccacaatcctaatattagtagacttcaattaaaaatctacacgttggggtctcatatgacaattgtctccgaaaaaaagggctaatcttgctcctaaatctcaagccatccctctgaataaacaactaatattaacatgcaaagctaatccaatcagtgaagcatatccagaaaatcatctgcttttgttgagctttcaagatcgagtagtccaggataacgatgaagtaatatattagtgcttgcaaagcctccccagtcttatctgatacttgttgaaagattgctctttttcgctacttgttggcaggtcaggatctcaatgtggatacagcacgttgtgccaactacggcctagaagattgaggattagcagtaacccactttctttccacattaggcctaattaaacttttcaactcgcttgactctagacagcgaaatctgctgggagcctggaaaatgaaggtatgactgtaagaggtcaaagttactactaccaagttaccatcaggagcagtaaaaagtttcttcttgaaaaaaagatgcaaaagttaacttccacagttagacgtacttagttttttttgttaaaaaaaaactgatctggccacttaatacaaagtaaagtaatcatgtcttgcttgcaaccttccactttaattaaaggaactacggctaagatgtggcaggcaggtgtagcgtcagtcacaatctgtttcccttctatcactaaggccttgtttagatctcaaacaattttaagtcaaaaacatcacattaaatatttggacatatgtatgaaacattaaatatagaaaaaaaacaattacacagtttgcatgtaaattacgagacgaatcttttgagtctaattacgccataatttgacaatgtgatgctacaataaacatttactaatgatggattaattagacttaataaatttatctcgtagttcatacgaggaatctgtaatttattttgttattagtctatgtttaatacttcaaatgtgtgtccgtatacttcaaaaactttacacccaaaatactaaacacaccctaagtttcagcaaagccagcaaagcaccagcagcatctgaagttctacagattttacagtctttgcagaagcatcgaagaatatagcaaatggaaccatcacatcaggtagaga

SEQ ID NO: 39320 - DNA, 317 bp, Oryza sativa
caaggcaagtcatgcttgtcacttgaacatgttgatcctatattgcaaatgctctattgttttctttcaaatactgcattgttttataatgtttctatggggtgtttacctattgtcatagccatgctagtgttgtaccatgtctctttgtcagcttggggttataacatgactagagattggactagggattgcttagccatgcttagttcaactagtgcacaatggggaaaatcttattaatgtttagactgttggtcctaatggcattgttggattagtgccaccgctttggtgttggttaattaaaataaatc

SEQ ID NO: 39321 - DNA, 1501 bp, Oryza sativa
aatgaacaggtagggcaagtgtaccgaaatactactaaaacatgaaggtaaaaagaaacatctagggctactaaaaacaatagtgaaacattaatataattggatgttaagccatcattgaaacacacacttgcacaatgaatatgcaccattcaaggaaaatttttcgcctaaaatgcagcatgctctaggtagctaaaccaagctaccccatacatgtggaggggctactcatcataagaagaacagaatgaaaagctacatagagcctgcaagcactatagtgaaaggaaagttttgtaccttgggtaagggatcacgttttctacccgcttcgcatacgatcctagaataggtcactatggtagcatgatgatgcccagtgtcatcagaccattgtttaataataatgccagtacattgtggtcgcctctgcccatctgcaaacataggtatgatgctgtaatcatctaaagaggaatagattggatgaatcttgctattattttgtcactaaatcataccatccatgatgtgcgaaatgctgacaatggcgcgtgccgcctgcaaaaccaccaccttgtctcttgagctctgtatggcctcggtggtgtatgggtccttgggctcagtcttgatagggatatctttatcacgttctgaaagaaaacaaatttatttagggcttctaaaatggggaaatttaactatttgccactcttgtgacatggcaattaacgatttgccacatcttgtcaatgacatgtgggccctcatgtgtctatgacatgtgggccctcatgtgtctatgacatgtgggcctagtggcaaatcgttaagcaacatccgtaagagtggcaaatagttaaaagcccctctaaaatgtgcattataagattttatttttaaatttctgttgcaacacgcgggtattcagctaatactcataaattggagtaacaaagttggatcaagtgacatatgaatatagacatgtgctcgatcctaccaaaccctaaatcccgaacccaaattggggatttgcaaaatcttagacgattgataaataaatagcgaaactggaaaaagaaaattcagaagcaaactaacaaacctttctcaattttcttgatgatcttactgacctcgtggcactcgtcgttccacttgcgcacatcctcaacattgccatcctctgggaatggcgggtattgaggacgacggggtgcaggagcaaaaggtgagacagttgttccgggcgaagtctgcccctctgccctcagcagcctctgcttcgcttcttccgtaagaagcgcgatagtcgggcgtgtcggtcctcgctgcttcctctttcttcttcttcttcccggtctctgttcttcagatttctcctcagcggcatctccttcgctcctcacggcactcgtttctgatctgctgctgctggggtctggaagagggaggggcacagagcttcttcgacttggagaagacattcgat

SEQ ID NO: 39322 - DNA, 1501 bp, Oryza sativa
cacctcattatctcaataatgacccgtaaaaatctgaacaacattcgcgacttttacttagcgattcggttcagcctcaattgcatttccatttgacccgatttgagcatcgcatgctcatgccaaggactttttccggatccgggttctctcacagagaattattagcaagaggcgacatagtgtcgacacatttatccccacttacacatttaactagatcttcgtcatttcccaaaacgatcgatccatggttgttccgtattcctagcaccataatatgcgcgcattgctaggaatgtcatctccatgacgaacatcattgtgaggtatgtcaccttccaaaggtgagttctcctttcggagaattagaggagtctgctcacatccagtgagaactctaatgctctgactgaggcctacggactgtgttagcaggcgtccccgcataacatgatcaaatgccataagtcttatatggacacgatattattcccgggtctatccacatttaccacaattgggagcattactatttttgacaactatctagttgttcctcatatgattttgttggcaaaaattccgtgcaccaagcaaccaggagtatgaactaaacatacaagttcagctcatttagtgcgttcactcaaagaaatctccaggcattccaaaatgggcaattctctccccctaatgccgagatatcttacaatagcatactaccaatccccatatcgtggcataggattaaggaatttcacctcgatcacaaatgttctcccacgaatgtatgctacggtggtgatatatttgggaaatattacacactttaataggagagatttttccattatatgcagtgagcctggacatataccaatacagtggcatgaatactgttttcttccttcttccgaagggttatccccaacctcctagttaggatatacaggtctgcaaaaaccaccattgctaccaaatgtatatgcaaccaacatgcaaatactttagccaaatgcactctccatggattaatgctcacctagtgccactcaaactcacaatcgattccggatcgacgtgcgttagacatcgcatgtcatatgcttaagaaggcaacctatggtggcaaaacgcattctgatgcgctcaacaaggagtatgatagcaaaatgcgcggccactagcctgcgctgccaagaagatttttgtggtgcagagttgttttaaagtccatctcgtttaatgcccaagtttgaccccaattactcataccaaactctagaattgggtcatagttaagcagcatgtattaggtacgatccatgagcgaattatcaaaccacatttgctaatgtcccctggacatagccatcaagagataatcaatacctctgacaatggtaatattcataataaaaccattatattcagacatatccacaaaaatagtggaatgtgtcggtgcaaccgtcgttggcataacgagctcaacgca

SEQ ID NO: 39323 - DNA, 349 bp, Oryza sativa
ccgatcgatatcggccgtccgttttgaatggatcgatctcgaccgttagatctagtgaaccacctctgtgcgctcggtcctccgcaaaccctagccgctaacgcaataatttcctttttccttttcaaaaataattcattactgcgtcataattcaattagaatcaatataagtgttttaatccgatttaatctttaaaaattcataactaattcaccttagctcggatttagttggttcaagtctctaatttttttctaaattgagatctacatgttaaaaatatccacatgtactgttcatgcttgtttatgtgctgttttggtgattttgctcttttctgtttaga

SEQ ID NO: 39324 - DNA, 160 bp, Oryza sativa
aagtagaggaagatgcaacgttgtcgtcgaagaacaaagaacaggagcagtcgcgcttgaagcgctacccaaaaacttgatcacccgtctacccatgcaagttctcaagcggacggagttccggaggcacctgctcgtcccgtatatctgtgtacacagg

SEQ ID NO: 39325 - DNA, 1501 bp, Oryza sativa
gctccatcttggagcatgtttcatcaggataaagaaagattatccagctacacacgctatgatactggagtagggagtattgaccgctgaccatgatctgatgaccggatcctgacaggtggaccgaaagattatgagatcacacaaaagtcaacgagagtcattgaaatctccttcaccataatacatgcaggcacaaaagggcattattcatctgactcagcagcatccatcttctctgcatggctatcctaaaaattgcaggatttgtagactagtgcctttttgacctgagaaaagagaaagaaaaccagctgccgagcaccttttcaaagttgaaagtttggtttgaaattgatacgatgtgactttgtgtgtgtatgatatgttgatgtgatagaaaaaattagaagtttggatctaaacacagccataaagagaggattgagagctttatcagttacctatattttctaataactcgaaacattttatcaggaaataaaaattaatttataggtaaaacttatatatttattcgtagcgacttaaaagccaacattaataaaaaattatgttaacaatatcttaaagtcaatatcaaaattaagtttaaaaatttaaattttagcatttgctttggtttattaggctaatcgatggggctctaaaaggaggcggcaaagcgtgtacgttccgatgaatggatggattagatgggatgagtggaaggaagaggaagcaggtcgacgaccacatgcaattttgcggtgcgctcacgccggcaacgcggctcctctgcccactctcacttgtatctcagtacagctaagaagaaacacggtaatggtagtagctgtcttgattcttaagcaatggagtagtatatatatatatactgcttattaaatggagcagctcgtggtacaaaatggtacccttgttaattattaggagtagtagtactctagttagcaaaattctttagatacaagccatgttttggaagacatttgtacgttgtggctaataagtcgattgcgtgttaaccggaacaatgatgaaaaatcaattttgagagtaagagctttttttttttttttggtggcgttgccacaatttggtaggatgagaatttttttttttgtttgaaggtagaggatttcaagtagaagtttagagttttcaaattttggtaaagtgctaatggttgaaaatgttatcagtttattacctcactgacatttgtcattgctatcgacgtgtgatagtcagcagaaccatatctggtagtaatccggtgttcagtgacagggtttaaagctatgattataggagcccacgactggtcgctgacttaatctccgatttatgttctgttgagattagttgtgttggctagattagattatagaacccacctcatacttggcaatggtctgatatttctagccaatccatataaattggtgtagtgctattactcttttggggctcgaac

SEQ ID NO: 39326 - DNA, 211 bp, Oryza sativa
tttcaaaatcatgaaggagagaatgtataaaatcttctcaaatgccattgtcgtcagctactcacacaagctgccagttgtgccgtataatgcattcaatccgcctccgcaggtatgtatctgaaatcttcaacttatgaccaaaatagtatcttgtcttcatgttgagttaactaaccatggaggcatctcattcaggaatacgtattga

SEQ ID NO: 39327 - DNA, 1131 bp, Oryza sativa
aacagaccctttattccctctgtttatgtattaacgacggtcatgttagattaatgggctaggcccaattaaatcctaataaattccattgccccacattaagtgctatgggtaataataccaccttgaaaatctaagtgaagatgtctcaacttaaatacagagctagtggagagtctctgttgaccggttgagatggtgcgcggacaaccaggcggggtgaggcgaggcgaggcagacagctgctgcgctctctcgttttgtaatagacggtaataaacacggagaattgatttcgtatcaatgaacgcttcggttacggaattaaacgtcgtgaattgatttcgtcggttacggaattaaacaccgtgaattgattccatattaacgagcgcgtcggttacgagattaaacaccgtggttgatgactccgaacgttactctcgcgctcgcatatatatactccgcagcgaccagaaggattgacgaagttcatcccaactcttgcacttccttcaccggttctgttcacctgtgtacacagatatacgggacgagcaggtgcctccggaactccgtccgcttgagaacttgcatgggtagacgggtgatcaagtttttgggtagcgcttcaagcgcgactgctcctgttctttgttcttcgacgacaacgttgcatcttcctctacttctgcttcaccatggcttctactggagagaacagaggagacaacatcaacggaggcaatacgactacctcaaaatccagcggtgggacgttctcggggtatattttcattctcccgattctattagatgtttctttgttaatactcttcgcaatggcagcattgcgttactatgtaaatgttgatgcttatttcatattaagcatgctcaagttgtatacatctagcactgtcactagatttactcatattgcaaatgtcatgtttattgtcttaatattttggattaaaatatgccgaattataaccaaatttccaacaatccaaaaacttgataggtcttttttggtagttagctttgctgcatcactaaaaccacatgctttcgatggttcaaattataaaaaatggaaagcacgtgcacttttgtggttgacggtga

SEQ ID NO: 39328 - DNA, 474 bp, Oryza sativa
gaaagtacggaagtgctttgcacaaagggcccgaagacgggtctttatatggccagggtgctactatcaaaaccatgcaccccgagcccagcctaaaaccattttcaggattttgaatagagggaaatgtgtgaatccaattccccaataattcaacaattctagtgtgtccaggtgatgagaatatcccaaagtctaaagttgtaaacccacctaatgttacctaattaaacagcgtagcatctacctaaaatcatactagtgataccatgagtagagtatccactagttggggttttgtttcgatctagggtgaacaaggtattaataccaataccaataataataaggtcataacaaaggtaataggcatggctaaataaaacaatgataacgtgggaatttaaataaagcggtaatgcaataatcttaaattaaaataatttcataaactgggattcaatatgttcaagg

SEQ ID NO: 39329 - DNA, 799 bp, Oryza sativa
tgccccgcctgaatccgtgctcgccgctccgccgccgcactccgctccgccgccacgctccgccacctccgctccgacgctgcacggccgcgccgcgttgcctcgcccacggcgacgacgacggtggagagccgaagatgacggcggccacggcgcgcggctgctccgcccgcagcctgaaggagaagagaagagagagaaaagaaaagagaagaggagaggagaagaaaagagaagaaaaaaatatgtgtagctgacatgtgggctccacgtgtttttttaattatttttgctgactaagatgccacgtcagcaaaaccgggcaaaaatactgccaagggacctccggtgaacggtttgagtgagtgtaggggtacacatttcttgttttgtggttaagggatctaagaaaaatctcgctgttaagttgagggacctccggtgaacttattcctccgaagtaacatgaaccaaaaagctacggcccaacttcatccggcccaaacttgaaaatgaatcgaacaggaaattcagccccagaaaggccgaagcccacggcccattagggtttctcgtcccccacacataaatacctcctccgcctccgcctcctccctcgacggccgccaccccgcttaggtttaggtcttctccgcctccggtttctccctccgccgtcgaaatggtcgcctacagggtaagcttctcctcgccgccgccgccgcctcctccctcgcgttccgtcgatccatcgagcgtggctgatctcttcgtttccgtgtttgtgtgttgcgaattt

SEQ ID NO: 39330 - DNA, 1501 bp, Oryza sativa
taaaatagtttccttgcttttgataagtcttgaactcatgatcttttggttaaatcattttaatcttcgatacactaaccaactcaactccatgtcattacttgtatatttgttcctttaattacttatatttagtcgtttagtacacattatcattctaaaaagtgtctctacatagtttaaaatgtctcaacaaaatgcctttacatattagacgcattttatagtgccgaaagaatgcctctacaagataaaatctaacaaactgatataaaaatgtctctagagtaaaagttttctaggcaatttttaaagtgtctctacactataaaacttctgattgtagaagcaatttacaaaatgcctctacaaaagtgcctctatacgagttttttgttgtagtgggtccactgttttttttttgttatttttagatttgtactaggtagctgtggtagctttgagcactccaatttttgttggatgtagtgcattgcaaaattaattttttgtctgtaattaggagatcctaagaatttcaaagagagtgtatagctttgtgtagcatcaagtttggatagcccttttttttattttggtgtcaacaaaaagacaaaagaaagctatacaaagctactcgcagcccagcacaaaagaattttaagtctgatattttttttaagaatataaaaggttggcttgtttcttgctagttatcacggtcaaaatatgtccacggatttttcgctaccgtttcttagagctggcatgacgacaaaagatataaagtgttcatactcaagcttttgggagtgcttccataatagagttattgtagatgtatttatgattcgatattgtaatttgcatgcatatcttcgaagggtaaatgtttcagattgttaggaacaaatctaacattatttttaaagaaaaaaaatccccaatgatagtacaaaataatataggaagatgaataactaccattaaactactttcaatgatatcctttttcattcaaaagggtgatctgccgtatgctttctacatttaattggctatatttctcatagaagtccatttccaagctaacattaaaatagcgtgtgggtgataaatttctttcttttttaaaaaaagctagcattgaaaatagcgcgtgaggacgaactgagctgccatttctgcatttcatttccaggtagagtacttgtacaatccaaggagcgtttcgtaaattgtttccttagtcagggtgtgaaacgaaaaggccaccactgcctataatactagcctcctccccccacatggacccctcatcctcctcctcctcctcctctcccttttctactccattccattccatctcctccacttccaccctcaggcctcagctcgccatcgccattgttgcaacaccaagtgtttgtggtcggaacgagatcgagcagcagccatccatggtgaggaaggagatgggcggcggcggcggcaggctcgc

SEQ ID NO: 39331 - DNA, 1501 bp, Oryza sativa
atcagctgcatacagccatacagcaatcaacacagcagatggatttagaatcatgtatcagcatgcctgtgcctgtggtagctaggcacggggctaaattgctttcagcttatccatctgctgtatgactctcgtgctgtgttgattctcaaatcaattttacgctatgggctgccataacataaacatcttcagggtgtgttttgatttcagatcaacaggggaaattaagagtagatcctttttagcatatccactttagatacctttttacaaggcagtctgcttctttggttcataaattttctatgactgtattgaacagtactcttatatttcttttagtgttttataagtgagtacagctcttaattgctgaacagttgctatctcaaccattgtaattttgtaaatctgcttggcgagaacctcattgcatatttatagctcaaaacttgactctcaactcacaagttacatagttggttaaaaaaacacactaaaaactcagggttaaagattgatctcagggctcttgtttagatcctgtccgttgccttttctcttttccatgtaaacagacaatttaaaaaaatgaaagaaaagaagaaactaattcttcatggtgtaatgctttataaattgtgtcatctactcatgtgtggtaggtcaaaacatactaacattgagttataaccgattcagaatatgtttatgctccacttttgtttttccgagttagtatgatagatcatcgcacttttattattgttcaattcattgataactcatgtaatgtcttggaaaacttgtgtgcatctataccttatccaggttgatctactcttgtccagtcatttctgcagtttgcccccagtacctctttgaggaccaatattggtgcaaataacatgttgatagtgcaaacatattaatgataaattcaattttagaacatatgcaaacaactgttagaaagttatgtatgaccagcacatttggtttctacattatttgtccaaaaaggatgggtcaattgctgtacctaccctccattgataatgccaaaaatattgcatataagcattatagttattcttgatgcttagttactcaggcatgttcctcgtacttctacattattatttatttttttccatgattttatttcacatttcctcttccatcggtgtatgtcctagtttttatccaaatgattttggtagctttgggatatatcatgtcataaggatctgaattggtgcagcttgttgaaacatatacagtatgtcggggaagccatctgatgatacaacaggtcaagtgaggcccgaagtagatggttccgatgagaaagtagaaattgccaaccagaatgaaaaagaggtgatgccttcacctcaggaagaggtactgtgttttcttaacatttgtgattttagtccattagcaccttatttcatactatagtggttaactgggtatttgcaggaagcagcaa

SEQ ID NO: 39332 - DNA, 995 bp, Oryza sativa
gtcatacattaaaatacggagggagtactcaacaaattaagggtgagcatcaccagtagctttcttattctattccctatccttaaatttagaaaattttggttaaaagtcgcatccaacagaatccctagcatgtcttccaataatccagattcccaactctggatatgtcattcccgctcaagggagcgattttttttcccaatcgctctctcgcgcgcgcacagagaaaattaacaaaatgaaggaggaagagaaaaattaattttgtccgttggtacttggtagttaaagggagagcctatttttcattataggaaatcaattttaggctttctcttggagataggttttctcacttcctatattcagttttgaagatccaaaatatatagttttaggaattgattattgggatactcttggtgatgctctactactccctctgtcccaaaatataatacacaaccacttttctctcatgtctcataatataagacgtgcatacatgcatacattaactatcacttcttaatcatttaaatttggtttattttaaatcctttaccatcagacccccccaattggcctcatcttttcgcttatgcttatgcttatcagctaaaatttgaattttcaaccttaaatttggagttgattttgggttttttcatcgaagtttgtttttcagcatttgcttttaaatcgctaagaacacgtatataaaagttttattcacaaatcatttttcgtttgtaaatatgtcgtttcgcttatttcgaaacgatgggctccattgcttgtactccctccgctctctaatataagggattttgacattttgtttacactgttttaccattcatcttatttaaaaaatttaaaattattttttacttactttgttatccaaagtactttaagcacaacttttcgttgtttatatttgcacaaattttttgaataagacgagtggtcaaacagtacaagcaaaa

SEQ ID NO: 39333 - DNA, 216 bp, Oryza sativa
agcatggctaagcaatccctagtccaatctctagtcatgttataaccccaagctgacaaggggacatggtacaacaatagcatggctatgacaataggtaaacaccccatagaaacattataaaacaatacaatatttgaaagaaaacaatagagcatttgcaatataggatcaacatgttcaagtgacaagcatgacttgctctgctgctggagg

SEQ ID NO: 39334 - DNA, 358 bp, Oryza sativa
agaggttgtaagtgaaatggtgatattgttgtcagtttgagctgaacagatgctgcgccagttttggtaatgaagttatcatatttttgtggatgcttccctgcagtttttaataattattgctctctatttgtgctgagcatgtttcttcgctgatgaataccgtgccaaatattttacaccacagggtggcatttttttcgctttgtcttcatacgactgggtatcaaggaatctgtggtcgatcgagcgaaagattcgcaaggaatcttgaaagctgcgttcatcattaaccaagcatgaattgccctaacgatgctgtttgtcatccactaacgatactgtttatcacccaaga

SEQ ID NO: 39335 - DNA, 1501 bp, Oryza sativa
gaggcgctcgagctcccgcacgggcgccacgagcagcgcgcgcagcacctcgtcggcccgcagccgccgccgccgcccgcgcgccccgccctgtccctggcacagctccgccggcacccgcgccgccgccgccacccacgcgacgctgaacaccatctgcctcgtagactcgtggtacgttgttgcgttgcgtgcggttttttgtttgtgggtgggggggtttttcctcgtttgcgtgaagcgctctgtgtgcgcgcgcgcggtggggtggagtcgcggagaaagggagaagggtaaacgtagtacgtagctcgcgcgggcgagggacggagggagttgacgtggataggtgggtgaggtggtggcgtgcgggagggaaagacgaggaggaggaggcagctgctgcgttcgtgcggggcggccggtcgtcgcatcgtccggccggtgggggcgcggggggcgcgcggtttttgtcgggagcggcagggcggttttgaccgtgccgcgaggggctggaggggcgtgtgcaagtgtacaggacgcgtacgcagatgggccggcaggtgtgtggtgatctcgactggtcgtctccgcggcggagcggtcgacgcagctcgcaaaggtgccgtatccctcttgggtggaccatgtctgttgtttgacagagacgacgtcgactctgtaagaaaccgcaagcttgcagcctgcactaccgtttggataagagtgtactctcaccacccttaaaaaaacaacctagtattgcattagacatttcctagtacagcaaatttggacaagctcctatccagattcgttgtgctaacaaaaatcctattcaattctaaatttttttttggacgaagggagtagtttctaagcacctgaaaacacacaacttcattttagactatttagatcacgccaagattcgtgcaacgcaataatcttatcacatcaccacatcccttttctccttcccacacaccatcgcataggagctcacataagtccgtcttccctccctgtaccgtccgcgtcctccgtgtttggttgacgccaattctagcattcccccatcttcctacccttctcggtctgctactccctccgtctccgtctcacaatatagtaatctagtcctaatatagtaatctaagactagatacgacatcacctagtatgtttgttgtgggacggagggagtagatatgtttgtttttccccctcgtaacttcagatcatataacgacaacatagttgccgatgatcacggaagtgggaacttccaatgatttccgtggacgagacattaccctcaccaggcatccgtattatctaaagtcaaggtcacgacaattttatattcttacgaccaaacagccttgaagttcggattggtttcagataatacaggcactgattcttttctttttagaaaatggattggaatccagcctcttcatccacgatggatgtacgcagcccaggcactgattct

SEQ ID NO: 39336 - DNA, 1501 bp, Oryza sativa
gaaataaccgagagtaaatatcaatctttagtgctagggactgaagatcgctatctttagtcccgggtgaaataaccgagagtaaagatcaatctttagtcctactaaagagagggatctttagtcccggttggtgttaccaaccgaaactaaagagaggatagagacagtcccggatggtccccttttttttttgttacttttttattttctcccgaatcggatggcatgcacatcctaaatcaaaccccaaatccccaaatcaaagtaacatcctaaatccacatcacaaatcttaaagttacttatacacacaaatataatacatcacaaatcctaaaaaatttacacataaatcaaatacaacacagattatacatcttaaatctatacaatgaatcacaaaattatacatcttagtgaatcacaaaatatcaaaaaaatataaagagagagaaaacaagctgccggatgccgctactagtgctactactcaagaaatcaatcccacaaccactcaagaaatcaatcctactactcaagaaatcaatcccacaaccgctactactgctacttctcaagaaatcaatcacaaaatatcaatcccactactgctggctgctgctaccgttactactgcgcgcatgtgcttcccttgcaacaatcccacaaccgctactactgctactactcaagaaatcaatcacgaaatatcaatcccactactgccggctaccgctaccattactactgcgcgcatgtgcttcccctgcaacacacgtctgcgccgcacactgcgcgtccgtctaccgcgtccgcgcggcgcggccttctccatctccaggtgagggaagaggaaggggaggggaaggaaggaggaatgggaggatctgtgtaagatctatctccaggtgagggaggaggaaggggaggggaaggagaaaggggaggatctgtgtaagataggagaggggggaggaggagaagagggaaggatcgatctgtgggtgaggaagtggttgcgaattttactcccacttccggttggtactagcaactaggatgtagactaaagtggtaatctttagtcccggttggtattatgaaccgggactaaatatcatcggccccctgacaggggataaaccgggactaaaaattatctttagggcctaaagatcaaaacttttttaaccgggtcccgattttaaatggaaccgagactttttttaaccgggactaaaaaatcgtttttagtcccggttttaaatagaaccgagactattgtggaatttggtcgaccgatcaaagatggtttctccaccagtaagtgtatctagattttttataacttctatctatctaaattaaacggttgagatgattgttagtaaagatttagtaagaaaaaaatagtatgtgtagcagtgttcatatctaaaagactaaatccataactaccaggaacaagctacgcgaggatcgacgatgggggatccca

SEQ ID NO: 39337 - DNA, 1501 bp, Oryza sativa
gtcgtccggtgccgttgctacagcatttgcattgtttccttctcaagctaattgtgcacacaggaccaggcataaatgagataaacgaaagtaaaaaaaaaacaaagaaaaaatatatatattttttcaaaaattatctaaataaataaaatacattatggttaaacccgaaaattgatttacgtacctaaccatactgatatcccatatttatatgaaataaataaaaaaactaaattacaaaaataagtcgaaacattggatgaaaatttgcaatattaacaaccaatatttcttcgaatgtgcatttcactattgatactgtatgcacaattttttgcttaaaaattgccacaattttgaggaaacataactttacgtttttttaatagcatctctaatcatgtgtctaattattggcaatcactaattacaatccaactttgttttttttttcattctaacataaaattaaattccatctttctgagacaaatacaaaattatattccattaattaatatttcctttttgaaagattattttgtgggtgttaaactaacttgtgtaaaaatatattactacaccagtttcaaattaccggtcattctcacatttcaatttctagatcaggatcccctatcttcacctttcatcaatgccacatatatctggtaatcaaggttaacattactcttaaaaccactagaatgtattaaatgagcataacaatgtaatttgctgcataatttgctagagtgataaataattcaaaataaaggctggtaaattttccaaaacaataggtctagataagatatacatgctataaatttaccgacgcgctaacagacgcacagattttctagtataatctaaatttagattagacacgatctagctagtactagaaacatagacataatctcatcgagcattacgaatctagatatgtagatgtatcaaatccaatatatgtagtagtatattttagaacaggataatagctaatgttaacctaccatatatatccaaattcgtaataatacttttctcctataaaacaacaatctaagatatatctcaatattacaatagtagtatattattcgatactagattattactatatccgtttcaggttataagactttctaacatatatgtgtgactagatttattagcatctaatatgaaacggataaaatatattgtaagataaagaaaacattaagtcgtgtctattccagtattagttgctatatttagcacggggcaagcctaatatcctagtcgagctctctcgctggggcctgggggagagtagtagtaacaacaggaaaagggaaccgcgtggcctccattcgcggttaaccccattcgcggggcctccatcgatggaggcctctctcccgtttcaccaccaccaccccgctgcctcctccaccgcggcgcatcacgcggcccgcctcactcctcctcctcctccgcgagacccgcg

SEQ ID NO: 39338 - DNA, 1501 bp, Oryza sativa
cacacgcaaagccaccaaggcggcagcagcagcagcaaccattttcacatggataccgaaaatacccctacaaatacccctaggtccacctcgactcaactgtcatggaagggcaagaccgtccattcccccaaaaaggccacgtcacccaccgtggatggtagagctgcttggtttttaacacaccaccaccaccaccaccaccaccgcaccgctacactactcggctcggctgcttcttcttctccttctcctcatcctccacatcgctgcggattcgagcggcgaggcttggattttctcccggcgagatctccccggcggccgtctcgcgatgcctgaggcaaatgcgggtgggcgggcggcgccggcggcggagcagcggagcaaggtgggtggtggccgtgggagaacactaaagatttcgctgctgcttcgttttgtttctctgggttcttggggttcgtcgccgtgttcatctgaacttggataggctggacgaattggtgtttttttttgttttttttgggggattgtgggttctgatccgaagaagtttggtgtcctgctcctgcgcgtgagcgtaaacggcgtcaggaaattgctcccggatttggagcggattcttgccttgtaggaagatcctatcctatcatatcctatcctacctgagctttgcgagcgtttcctgaaatctttcctgtgcatctgcaagaagccatttatctctttccttaaaacgtagtctcctactacaaggctgattgacttgtataaacgctactattagcccgtaataacacggtaattcttgtttggttcaaaatcttggggtaatgggtaagtttatcctaatccaagcaagctgtattttctttccgggatatagcactgtagatatctttgcccacttaaaaaaaaggaggtatatttttacttataggtttgagccaaaggtgtatcttttccagactgatcattagacttgtcaagaattagggcgatcattagttcaccacagcgggagccgggagtagaggtcaggtcagtttttgtttggtcaggctgcagtgtatctgtatgtttctgtaatccggttctgtgaattacttgttgcagaccttcagtctgtggtttccagtcgtcgagcatagactaggcaaaggttactgtttcattggtttttgtttttgcctttttggttgtgatgtctttggtgcaaggagtattattaggagttcaattgcaagctgtatgtaattggttaactttttttttttggcaaagcttcttagtatcccgataatgcgaaacccttggttttgtgattagttgtgttgcagctgcttagctcttggggaagatgtaactcagtgaatttgtgctttgttccaattcacatgccattgcctaaattatgtaattgttcttggatgccattgtgttttgagacagagtgctgaattttcaatcttgaattttgtccagaacacaacagaga

SEQ ID NO: 39339 - DNA, 1501 bp, Oryza sativa
cttatagactttatttgctatcttttcgtatccgtaagttagaccatacagcaagttcgactatcgaatccaaggaactgacatggacccagatggctacgttgaagccacgggaaatcttgaggcgcaaggtaagacataattaaaattttgatcatatagaaaccttgatataatcttcatatttaaatttgatgcatgatttttgctcttttaacatctcgtggatagatgttaaatgcttttaagcatgatattattgaaagatacattcgagatcattttatgtggtttattattcaaacctctttacaaacttaggaatctggttaaaatgggtatttatgaattgagattgtgaatattgtgtttatgaatgttgttgaattatgaagatggtgtggggagtttggaaagttttgggtggtttaaccggattataattacccccttataccatggaaatgacatagttgcgtccatccacacgatcaagtaattgaacttagcctagtacattgtcccactatatgaaagactgttggttggctcactaggagcaggattggggtgaacgcatgcgtaaggaggttgggggcatggttcataacggtggaacccgtgaaagcagcgaccaagtagccttgcttaggcccaacaagtgcccggctactaggacggatcaatatcccactcgtgcagtaactagtagtaagtgggaccttcgaacggctctattgttctcagcccagctagcagtgggcatcatgtgggtaaaactggacagtctcagcagaggtgaattaaatcattcgaatgtgccgtactctcggttctggagttgtgtcatcagggtgattcctattcctgaagtataagtagttttaaaattaaaatgttgaggataaagatgatttatggttttcattactcctttactttattattgtttatttattcatatctattcacctttaattatttataatatgttttgccgagtacataagtactcacccttgcataatttgacatatagcggaaacgtgctaacaaggagatcagaaggaagcgagattctacggcaacgacaagtttgtctaggctagtctacactcgagcttttgcctgtggagttctttgaattctttggactttattagctgtagttttagtagttgaagagtttaggagtttaatagtttagcactttgaattttcttgtatttcaaataaggatgtattagtttgtattttttcaccctttaacagttgtataattagtctatataaacaaatttgtgtaaacaatcgaaagttgttcagtatatcaatctgtgtgtgatcgaaatcctggacgatcacgagtggattttcggggcaccaagcctaaatatggtgtccccacaatagccacccccttttagtattgccgaaatcttgttttgacagttggcgcgccaggtaggggttgcgtcaagtttttcgccaatcagtgcaa

SEQ ID NO: 39340 - DNA, 1501 bp, Oryza sativa
atatgaactaatatggcacaagatcatccacaagctcgcttcatagactcctcttgatagtacggcgtctatctagcaaatccggtctacaccaaacaccaagaccgggaaaagactaagaaaacattcttagctacattatacctttgccttgcgccatccatcttggggtcaagcttgagccgagatcaacacttgtgaccatccggttgaaccatgtttatgccgaggtcttgtccatactttgtcaagactttattctcatcacaagcttgacttcattcttgccaacatgacgatgcatttggcttggcgaccactaacccatggtgtcattcattagcctcatcgtagtgggacctattccttttcacacctcaaaggagaacattagtctcaacaaatcagttgtcatccttcacttgatgaccaaccggttgcatatgaaagatatggatatgtttgttgagtattcgttaacatcacaagtgtcacatactcgtatgcaagctcaggtgtaaagatccgatataaataataggtgaacaacatggatctagaacatgcacaataaatgtataggatttgctccccctaaatatatgcatacaaataaatatacaagagatgcaagtgtatgcataattagagaatgaccaatgggggtttatcctatacatatagagaaggcatatgtagtaatgatgtagaccaacataaaacatataccttcatgatctccatgttctcaatgtaaatgagactaaataagataagactcgagtaaacattagtctcacacttatatatcaataacatagaaatcatatatatgaacctatcaaaaagtaggagataagaagtagtacatatcgttttatcttcatgtatttcatccttgtcatgattaaggtccatcacaaaagaatgcatgtcttccacatctcattatcaggaaataacctagtagacaacttatgcaaaagagaggttaatcccataaacatcggtttatcatctatcaccaaagtaacaattacacaaattgtttaatccaagatctttcaatcttttctctctttggtgatggataataacccgatataaacaatatagagagatgagatgaaaaatgatttcaaatcaagataaaaatcttataataaacaaaatatagaataagctccccctcaagatgtgcatacatatggatatgaaggaacgcatatgcacataatcaataaagatcaaataggaagctcacactatattttggatccacaagagagaccaagttagaatatgtgaagtttaatacatacctctcatcatttttactttcatatccaaatgagactagtcaaagaaaggctcataaaaacgttagtctcatataattaaatttgtcattaatcaccgaaaccaaattaaggcatttaaacatacaccaagcgacccatcgtcatcgtcatcatccgcatcctcctcatcgtcagacaga

SEQ ID NO: 39341 - DNA, 594 bp, Oryza sativa
acgagtctaataacctaggctatgacccttacccaatcaaaataagcatataacatgccaagagaatgactcttaataaactagtcatctcgaatcaacccaaacagcttttgcaacctaataaagcttacaaaaatagtataacaccttcctgtcgggcacatttttatttgcgtcgtagtaattccaaagaattatctaaccgcgttaaaaaggattttaacaacatcgggtcacatcattgtgtgcacaaattgccaaagcaaaaagcgcctaagtccctagggatcataacgggccacgctggtaataatattgggctgaagtactgtacaggcccaggcccattagcactcccgataccctaacaaaacaccgaagtccaaacgacgcttcgtcttcctcgccgagactctcgccatttccccattcctcgctacagtacaaaaccgcgccgacgaagctagggttcatcaatccactccaatccatcctcagaaactccacgaaatttcaccgcgcgtccaccgcaccgattccccatccctctccagccacatctcggaccaaattagaccattcagctcacattca

SEQ ID NO: 39342 - DNA, 1501 bp, Oryza sativa
tgagatgacgccacctgatggtccgcgagcggtccgatgatatcagtcaaaggaagggcctacgctcaatcaagtcataaagtgatttcgaaaggagaatgcgggatgttcatcgaatatacttatgttgatggcttcatcatgttccgctgcccccttttcacaaaggggcacagggatgtcactcgccgtggtcgggccattggtcatcacttggccgacgcggcgctccacggtttcgccgctcagacctgttaattaagaaccaacctttgataagtcaagaggaatgcgaacacaagtatgtcaagataaatgcgagaaagataccccgaggagaaacccgggtcacgtcctctggctcagaatagttataagctggatgggcccgagcctgaagcagatggatccgcctaccaacgaagtctgcaacgacttcatatcccgacaaaccccgtactcggagatcgtcgatgatgtcgataaacgactgaagagagggggtcaaggggggctttgcggtccaagacggaatcttgtccggttgatcttcgggaaccacgaagacagggttcgagtccttgatctcaagataaaaccacctattcctccacttgctgcgagaagaagggcactggaagggaatgtaatgcgacttcaggccatcccgaagtcggaacccgacgcaaccagataccctattggattccatccaacgcagttcgtagtaaaagcgaaaaagatcaaggaaatgctctaccccaatgtaggcctcacaaagatgcacaaagatgctaaggaaggcgatggaattggggttcaaatggagaagagagaggccatagaaattcaaaaccaggagaagaaattcggaaggtggagggagaaaaccgcagagaacataatcttcgatcgcaaccatgcgacccaagatgggctgaggattagtacctcctgcttccctctccatggttccacggccaggaagagcgccatcctcctggagtttcttcaacgttgcattggtggaagctgatttgccgaggtccattgctgatcgaaggtcgccgaaaagcgagcttaggttgatgaactagggtttcttgcggcggcagagaaggcaaagagtgcttggaggtggtgtgtgtttaacaggtttggcggacttcaagatggactcccaaaattcctttaaataggcgcactaccgacggtgcgaattccagggaacagagagagatacccgccggaaatttctggtcccgttacgcgtggcggttttttggacttcagtttaaaattcgctcacgaccattgagcttcgaatggcgtgctcgactacggtctatctccgcggttctcgcaccgggaatgacagcagtctcgacacccgaagtcgcaaatggttgcacgagttcattttaagcagaagtcgggggctactgtcagggttacgggttaggcataccctttgcccttcgatatacgttacatatcgata

SEQ ID NO: 39343 - DNA, 278 bp, Oryza sativa
gggctactgtgaagattatgatacccaatatctacacggcatgtatagtctggttaggtcaagggtaccaaatatagatagaatatctttaagaggactcgggtaagtttttaaacttgtatgtcaaggaaatacctgggatcctagtcggttatgattgtattttatctgtaatcacatattccgttagggatataaactgtattttgtaatatggactccttccccctatatatggaggggtccgggtccctctggggacacgattttctcccaga

SEQ ID NO: 39344 - DNA, 1501 bp, Oryza sativa
tgtaggataagccaaatggtcaaactttaaggacaaattttccgaaaacatgatttgtgaaaaatttcctttcttctttctccagaattctctgcaaatcattttatcatcctctcgcctccctctttcaacttgagtagttgttaaacttattggagaaacccgaagacgtcaatgtggtttacttatggaggccaagtcaagtgaatcaaggaataagaagatgacggtcgaactgaagtgcagagctttcataatgggatgaagtttggatcctaccatagaacctaaaccaccaaagtgactttgaagaatagttagtagggtagaacgtttgttgcttgcttgtgtgtaggtatggttgcattcccaacattgttgtagttcagtgctgagtgtgtaattatactaggttgcttacttaatcaacttaaacaatataatggactacatacaccagagaagaagagggtggccaaggcgtacaacaaaagggtgaaagcaaagttgtttcaagttggagacttggtttggaagacaattttgcctttgggtactcgatccaggaagttcagtaagtggtctcctagttgggaaggtccttattgagtatgcggcattgtttgagggaacgcatattttttggagacacttcaaggggagcgttttcagcgagcaattaatgggaaatacttgacgaaatacttcccgagcgtttggcaagatgcttaggaggttcaatggtcggtaattggattatcgccctaagaccaaaaaacatgttctgtgcttttagattcacgttgttcataaaaaaggcagggggcatgtgtttacacccaaatttggcacctaggagtaaaatagggaaaattgccaaagtttgaaagtctgtcggttttcctatgtgagggccggtctgaccgccgtgtataggctggtcagaccgccgagtgagggccgttcggaccggcggtgtgtgggccggtctgaccggcagagtccgagtcatggactgtttcgtcgggtctcgaagtttccttgctcgggaaggcatgttttgggtttcctttggattatatcctgagttggacatgtaggagggcttatagagggcaagaccaacccctatataagggacatggccggttcaattgtaactaatcaatctacaatcaatcaatcgaatcgtttttcatattacttttagttttctcttagtttgtccatctttgttaatttgcgctgtaaattgtccgccaccgctgcgagagtgtgacacccctttgtaggtttgtcttgaaaaccttccgttttgcccacgagacgggtagttatctagaatcggctctgctagccggtttagttatcaaaacccatcttgatttatcttttgctagattgaggtggttggcgactttaggatcaccgcaaggtgttcaggtgttgcaatcatgcttgtcaacttgtcacaaaaagttgccaacacaacgtaccccag

SEQ ID NO: 39345 - DNA, 1501 bp, Oryza sativa
atgctccctgttttgatgcatgtaacaatctgagacggaattgcaacaggcgttgtgttgcactgaatatctgagtaaacaaaaggaaacttggagagtgataaccttttgtgctttataatgcagttatgcagaatagcctatgactatgagactggaaagttaaagagacattctaatatgtgttttcctacttgcgttgattgttagttgttgtactgtactgagccggctgctgttcatttatctgaactgtggggaattactctcttgatccagatgaaaggtttaactttgctgttaatgtgttattgattcagatcgatgttttgacttgccaactcaaattcatagaaattttgacactaactccctatgaagcattctgtatctaccaggattttaggctggaaattgccatgttccaaacaaggtcaaatgatttgtacttttgaaacgcatcaaagtccagggtgaacaagagcttcagaactaatcctatatctgatgtttgtattcagaacctctaacatttccttatatccctatggtttgtgttcgactcttttatctcttagagtaaatttcacaaaactacatattttatggttcaagttgtagaaaaccacacatattttgatacttggcacttaattacatatattttggtagtttagtttcacaaaaccacactatcgatgaatggattcactcgtgatatgacgacgtggttgtttcatctagtataaggacgtggcatcgtattaatttcgtgcgatggctggtaataggatgccatgtcctcgtcctaggtgaaacagccacatcatcttgtgggtgaatctatacatcgatagtgtagttttgtgaaactacacgaccaaaatatatgtactcaagtgacaagtgtcaaagtgcgtgtggttttctacaacttggaccacaaaatatgtaattttgtgaaatttactctatctcttatcatgtatatctatacctctaacaaaccaccctgtatcaaaccggagttataggctggaaattaccgtgttctaaacatggccaagtgatgctcgcaaacaagttaaggctgaataagaaacatttcagaactaatccatcgcaaaatttgtactaatcaagtacttccaccatccacaaataaatatagttagtactataagtctgaacatcatatgattaggatatatcacatctcattatattatatgtttgtttattttggaatgaagaaaatgaatgggtgataccgagactcttgagtcctgatgggctaaaaacccagaggcttacgtgtgggccacacagaagatatgtgggccgggctccaagtcgctaagtcgatgccccttaaatattaggaaaaaaaaatcctatttccaaaccctaaattccccactcttcctcccctctccctccccacccaaaccctcgcgccgccacccccagcctccgcccggatccagaccgcctccgccgc

SEQ ID NO: 39346 - DNA, 1501 bp, Oryza sativa
tgcggtaatatggagtcgccaaaaatcgtgatggcaactttttgtgacaagtcgacaagcatgatcgcagcacctaaacgccttgcggtgatatggagtcgccaaccacctcgatctagccaaaaggccaaatcaagatgggttttgtagaaaaacagctaaaccggttagcagagccgatttagagatgaaaatcagtctctagaccgatttagatcgatatgaggataactacccgtctcgtgggcaaaacggaaggttttcaggacaaacctacaaagaggtgtcgcactctcgcagcggcggcggatgatttacgacacaaatagataaagatggactaaaattagtgtaaagtagaaaacatagcagaaaagtaaacataaaagagaaaacgattcaagtatattgtgtgttcgggggattacaattgaaccggccttgtccctcttaaataggggttggtcttgccctctacagactcttctccacgtccaactcgtgatagaaccaaaggaaacacgaaacatgccttcccaagcaaggaaacccgagacccgttgaatacagactcgggctcggaccctgacggtttgaccggccaaatacctgcggtcagaccggagttcaggccgcggtcagactgcccacatacctgcggtctgaccggtcctgtgaaggaaacccatcactttccaaactttggcaattttcccctatttcgcctataggtgccaaatttgggtgtaaacaaatgccccccttccttttttatgaacatcgtgaatctaaaagcatagaacatgtttgtcttagggtgataatacgattaccggccatagaacctcctaagcatattgccaaacactcgggaagtatttcttcaagtatttcccattgattgctcgcagaaaaatgctgtccttgaagtgtctctatgtctttcaaagttttcaaatgcttgtcgatgacgtcttcaaaattgcttcgcattaaggttttgtaatctttgaccaacaaatcgtcttacttgatataccgaagagagccaagatttacctcaaacggcaaaacggctttttgtccataaaccaactcgaaaggagtgactttggtagcaccatatttagatatcctatgagcccaaaatacttccgaaaacacttcatgccacttcttttgaagttcttcaatcttctctttgactaattttaacaatgttttattacttgactcggcttgtccattagcctaagcgtagtaaggaaaagaactcaacaacttaatctcgtaagattctgcaaaacatttcacctccttggacataaaagaagctcctcgatccgtagtcaaagtttaaggaataccgaatctatgaacaatatgcttcaagataaagtcaattaccttcatatgaatcatgttcttgagcgcttcggcccacttggtgaagtaatccatcgcaactagcacggaccgatgcccttttgatgtcgaagga

SEQ ID NO: 39347 - DNA, 334 bp, Oryza sativa
gggggagggagggaaaggggacctttagggtttttctttttataaagccattttaactttgtttatttcttaataattattatttgtgctctgaaaattccactaaaatttatttacgcattttaggcttttaggaaatatacaaaaatcctccaagccttatttgacttttaactttgcacattttaatttttggaggctttcacacggattttaattattctaggcataatttagaggatgtattttagagtcgttttgtgacgtaacagtcattaagattttaaaaatcaaatatgattatcattggggcttatttttttacttttctaga

SEQ ID NO: 39348 - DNA, 1501 bp, Oryza sativa
taagaattgtaatacaatagagtaattaatcatcaatattaatcaacactgaacagcacatccatgctgcacaggcccaaccaaacctgaacaaccaaccccggtcgtacagatcaaacctccaaaccagaaattagccattccaaaccaggagccaaattaattatcacattattatcattaatgagcagtgtgggactaatcacgaaaaacattgctcaccccgcccataaccacaggaacggctattcgaatagttttactatagccagagatgtacatatttacccacaggacacaactccacaaaatgtcaccatatcattatgtgcccatgctgaacatgtcaccatttatgtagttgtgacaagacccctcgcataactcaactcaaagtagtgcaccttttctagatcataatcaccccctgaataaccagaggcatcacgcacttctcgccgcttcacagtctggcgcaccacaatgagccttgctacacaaagtgtccagccattgcccaagctggcttgtggttagtacagttaatgtctcacaacagtagctcgcgaatcgttccttaattgtcatgagcacgaccatcaaaactatgtgctcacaacctaccattaatcaaattttagttggcaagtaattaataaccaatcacgattgaccatcgtgagctaccattaaatatccattattaagtaacagtgaaacattaatcatcccaatagtgtgctagtgtttctaagcatggctaagcatctattataagcatctagctgaaccaaaccaatatataaggttcacgctaatcaaattataacccataggaaaataaagtcatcttcggccataattaaatgggaaaggctcaccacccgatgacattcaaaaataatgcataagttgaaataaaacaatagctttaaacgggttcaatatgctcaaagggttatttgggatccgtgtgacttgccttatgaaaatcaatcaaacctcagttgaagaagttgtgaaggagaagacgtttggcttataccccagttgagctgcctatgggtatggagctaaagcttcgctagattttattttccgctgcagttttcttcgtggtgaggactaagtgcctcttatataagtatttattgctttagttattttgataaatccgtatattaaattgtcagtttgtgtacctcggccgattcctggacgagggttttaatgcacaaattagttcggaaattactagtgaatttctagacgtgacatgtggtctcctttgcagttttgttttgttgcaggaaattctgttttgtttccttttgcaattttgttttgctgcaggaaattcgattttattttttggaaacatgccgaataatctagtgcatgaaaacggaataaagtccgaataagttacgcacgacttatctagttcggttgcgcggagtggagatcgtgcaggtgcccctgatcaagcgtcctgatatct

SEQ ID NO: 39349 - DNA, 1501 bp, Oryza sativa
gtgaaggacaaaactgtgaaaatttagagcctcgaacaacacctaagcaagtgtgaagacctaaagaagtaaaagttaagagaccggtgatttcccagagtagtggtaagttcatgagagaagaatcatcggtcattagagaaaactctcctccacatgatgctatggatgttggtgcggtgttcatcttgccttcgaaatcgtgcaatcaagagagctgattttgctcgggggggcaagacattaatatgcttatgaagaaatcgagagagatgaacggcgatggatacaatgtcacatctttgagccgccgtttgttggatgctaaggcaaggtatgggtttattgtgttcatcattatattatatgcctatgccatgttagaacattgcttgctatctagcacatgtgtgtttttgcttatcaaattgatattatacatacatgttgcaaatgctagttctaagtagtggaattggtaagttggcatatgatttgtttaaagtctaatttggctcatgagtctttgatatttatttaaagccaaatcatatgtgtttttatggatcaccatataatatatataattcatatttattgcaccatgaaagttttgcttattagtaattcgtctaatgtcaatggtcaatgtgatgatttgttctagagttgttatgtttcgaacattggctttgttttaatattttgccaacatgctcaagccgattactaacatttgtagtttattagagttcatgtgtgagaggcatatgactttggtgattcgttattgatcatacttcaagtggctaagtgttttgataccttgatgattattgtttcaaaagccacttaaattggtattcatctagacatattagttgggtgttataattttctcatatgtctagaaagaaggaattttagtccaataatttgatacaccaagcatctggttaatatgtgaagaaaggagtatttttgatattagaaaagccagtgcttgattttaaatctttgggcaaaattggtgaagttccagattggggatggcctgaccgtcgcattatagccggcctaaccgcggatgaccggtggtctgaccgggtagacagggcggtctgaccggcattgcgtggccggtctgaccgatcccgggcagagagctggggggcatgttacaattggttcaaaggccaaattaattgtaaattcagacatttgtgcccaagagtcagaagaaaactagagaatccctttgatggaatatttgaagattctagttttagggttgatcaaaaattcggcggcaagcattcaaatacactttgcttaatggagagttatatcgccgaaatatagacgaagtactttttctaaagttgctatgggagtacttaaagggattcgtggaactcatcaatcggctcataagatgaattgattgcttaggagagcggggttctatcggccgaagatgattgatgattgtttcaagtac

SEQ ID NO: 39350 - DNA, 1501 bp, Oryza sativa
gcctcctgcaacaaacaccagcaacaaatcaagaacacctctcgcatcgcgtcaatggcgaccgatcgagtcggcgcggcgccggcacgcaccgttgctgccgtgcaggagggactggaggctgccgttggggaggtagtcgtagacgagcagccgctcgccgttggagttgcagtagcccctgaggctgacgacgtggcggtggcggagccggccggcgagccgcatgtggcggtcgaacgccttgctccggccggggaactgcagcgcgctgaggcgcttgacggccaccacgatgccgtcctccagcaccgccttgtacgtgctcccggacacgcccttgccgagcacctccgccgacgccttgagcaggctctccagcctcagctcctcgccgccatcgaagcagacgagtccaccaccattgctcttctgccccttctcctcccgattcctcaccttgtcttcctcctcaaagctcagcgccgcatcggaagcacccttccatgaccggagcttccttctcatgtagacgaacatggctacagagatagccacagagatcaccatgagcgccgcgttgccaatgccggtcgccatgagcgccgtcacactgagcttactcaagcctccattactaccaccactactagcctcctccattgccgcactaggagattgtccgacactatctcctaacgcattgtaagcatgaacacatctcggaagaggcaggccacagaggccaagattcccgccaaaagacgagctcgggaacctggaaagatcgccggagatctccccatccagcatgttccgtgaaacattgaagctcctcaccatcgggacgctgagagctcgcaggtcgccatggaagccgttgtgctccgctctcagggtgaccagagaaggcagcgagacgcggaggcctccggtgagctggttgtgtgagacgagcaggtgcctcagcctcgggctggtggagttgtcgagaggagggagacgaccggacagcgagttcctcctgacggcgagcacgccgaggcgggcgagcccgaggaggggggccaagccgccgacgagcgaggcgttgtcgaggaacaccccgaccaccctgcccctgctgcacctcaccccgatccatgcgccggagcacgggtcgccgccgacccagctctccagcgcggcggcggctgggttgtaggatttgaaggagaggagcggagggagatcctggtggccgccattggcgacctcggcctctccgcgcacgcaccacgcggcgaggagcaggagcagcagcaagaaccagcagcaatggtgggaatctgccatcgttggcagctgctgtttgagagagagcagtggttgattgatccagtattcgagtgagtgagtttttatagcagaggtgaggaggagaaggagaagaagaaatgcgcggggaaagtaaagagatttttgaaaggcaacacgggtggaagtggtgacaagaagagag

SEQ ID NO: 39351 - DNA, 1501 bp, Oryza sativa
tcctcacccacagatcgatccttccctcttctcctcctcccccctctcctatcttacacagatcctcccctttctccttcccctccccttcctcctccctcacctggagatagatcttacacagatcctcccattcctccttccttcccctccccttcctcttccctcacctggagatggagaaggccgcgccgcgcggacgcggtagacggacgcgcagtgtgcggcgcagacgtgtgttgcaggggaagcacatgcgcgcagtagtaatggtagcggtagccggcagtagtgggattgatatttcgtgattgatttcttgagtagtagcagtagtagcggttgtgggattgttgcaagggaagcacatgcgcgcagtagtaacggtagcagcagccagcagtagtgggattgatattttgtgattgatttcttgagaagtagcagtagtagcggttgtgggattgatttcttgagtagtaggattgatttcttgagtggttgtgggattgatttcttgagtagtagcactagtagcggcatccggcagcttgttttctctctctttatatttttttgatattttgtgattcactaagatgtataattttgtgattcattgtatagatttaagatgtataatctgtgttgtatttgatttatgtgtaaattttttaggatttgtgatgtattatatttgtgtgtataagtaactttaagatttgtgatgtggatttaggatgttactttgatttggggatttggggtttgatttaggatgtgcatgccatccgattcgggagaaaataaaaaagtaacaaaaaaaaaaggggaccatccgggactgtctctatcctctctttagtttcggttggtaacaccaaccgggactaaagatccctctctttagtaggactaaagattgatctttactctcggttatttcacccgggactaaagatagcgatcttcagtccctagcactaaagattgatatttactctcggttatttcactcgggactaaatatagcgatctttagtcctggatttgtagttccggtcaaccgggactacagggggtttacaaaccgggagtgacagtttctccaccagtgactcatagcatgacacatcagtgttagtaagaatttagtacgtatagacttttcctttaggtatatagtccctactatcattatcattatcatctgaataattatgccagtaattcgctctagtccaaaccatatctcgaactaataagttcgtattttgaaaatcgaaacccgaaattctgaacgtacaactccaatttcacttatgcacatacttgataactgaaggtagagaaaatctatactaatataaaaggtacaagttcatccagcaatcctacaatccttcggatccacttttgtttctgagccattgatctgcgagatcctacgaacgatattcctttcacgatcctcccacgcgcgacccttccctcttcctca

SEQ ID NO: 39352 - DNA, 471 bp, Oryza sativa
catagattcggtattcctcaaacgttaaagaagcttcttttatgtccaaagaagtgagaagttttgccgaatcttatgatattaagttgttgagttcttctctttactacgctcaggctaatggataagccgagtcgagtaataaaacattgttgaaattgccgttttgccagttgaggtaaatcttggctctcttcggtatttcaagcaaggcgacttgtcggttaaagattacaagaccttgatgggaagtaatttttgaagatgtcatcgacgagcgtttgaagactttgagggagatgaagacacttcgagatggtgttttcagagatcaattaatgggaaatacttgaagaaatacttcccgagtatttggcaagatgcttaggaagtcttatggccggtaattggattatcgccctgagataacatgttctatgcttttaggttcacgtctgttcaccaaaaagg

SEQ ID NO: 39353 - DNA, 618 bp, Oryza sativa
ttttaaagcatacaactcttaaatttttttatttgaattaatgacccatattttaaacaaatttgcattgttggatggtagggagtgttaactaattatttgcgtagagcacctgaccctgttttttcacatgtccatatgcgcgggcagcacaatttgtgtgcacattgaccaccctaaattcatgagcatacttgctaaatatttgatcgagctttaaataaccatatttaaacccttgattttggatagttcaaatatccatattaagtatgttcttacaagtaaaatattatgtcgctacaactaaatcaatagttcacgtatccacattattataaacatgcaaggccaaattaatctacataggtacaaacaaaccaaataaatccatctataaatggtgctcttcagctcttgatactttctatcatctttatcctataatgtaagggatcatgctattttaggaggaattaaggggaggaaaaaaaattatgacaactctcattaaataaaggatacatagagagtgggatggcggttgagataaaattggataaaaaataaagatggttgaggtaagattaggaacaaaataaatgaggggtggttcga

SEQ ID NO: 39354 - DNA, 1095 bp, Oryza sativa
acgaacgtgcacgaaacgcttacgaacgtgaatgcacttgtactaaaagtgtgagaacgaacgcgtttctactaatacgattactggtaatacatatatgattatatatgtaacttgacccgtttagactaatacattttcctggtaatgttgcacagaagacgtcggcgtcgtccctcaagccgaagtggtagctagccatcgaaggaattcgcgcaggcaagtgatgtaaataagtgattgttagatatttaatataagattgttacacttagcatacatgattattacacttttaatataagattgttatcgatttaatataattacgattagtagtgatttaatatgagattgttatacttagcatatatgactattacaattctaatataagattattagagattaaatgtaagattgttagagatttaatataagattgttagacttagcgcatatatatatatgattattataatattaatatgagattagtagccatttaatataagattattagacttagcatatatgactattacaattttaatataagattattagagattaaaataagatcgttagagatttaatataagattgttagacttagcatatatatatatgattattacaattttaatatgagattagtagccatttaatataagattattagacttagcatatatatatatatatatatatatatatatgactattacaattttaatataagattgttagagatttaatataagattgttagacttagcatatataaatgattattacaattttaatatgagattagtagccatttaatataagattattagacttagcatatatatatatatatgacttacaattttaatataagattattagagattaaatataagattgttagagatttaatataagattgttagacttagcatatatgtatgattattacaattttaatatgagattagtagccatttaatataagattataagagatttaatataagattagcagagtttcaatattacggttagcaaatacatcctatatacctaacaaatattttttgtatgcacaga

SEQ ID NO: 39355 - DNA, 1501 bp, Oryza sativa
ggcaaaatggaatgggtattttcatccattagacccgattctcgcgggaaggatatgggagagaaaaataagaatatccttctatccgaggatatagagagttgtatccgtccgtatctctcatattatcaaatatatatgaaatatattataaatgcatctataaacatgataaaagattcgttagcactattttacgagctcacaagtaatattgtatatttctccatgatttatgtttttaatactctaattatcttcctaatgtaatatttattaattagagatacatgtagatgtctgttctcaaattcaatacggaggaaaaaatataggaggggtgagtatcatgttatccggtactaaccgtatttggttctgaacttgaacaaaaatatgagttagaatctgactcgatggcaaccatattgtgaccattcatttttttttggtaaatataaaaaatataggccatgcttagaatacctctagtgataaaacacaacaaagtaaataattattactttattttttaataggataaatggctaattaaatgtataaaagtaaattggaccatctattaaaaaccaaaggaaatatttacatcgatgtcgtgccgttggatcgatagagaaatatacgtgcacaacatgtgaatttgcgatcgccctattagagaaacagtatagcatcatgcaatgcaatgtttgcaagctagctagtactaacgaatcaagcacgagccacacacggcaaaacatctagttttaatttccgagtaaacagttacccggatgtgatatcttggggcgccaatcaaacgcggtcaacaagtatatgtatgcgtcttgatcgtctaattaataggacgaggtacgtgtggatcggttgatggacggcctagtcacctttcctctattaatacgccgtctatggcctcgtctattacataatccaagtagtagacgaggccatataaagtgagaaaatatgtagtacaaaccacatatacagtggaaacttagaaactaccgttggatcaagaaatggacgtccgagatttatccacgtcaccatgagttaaaatttaactcgtagagtcactccgagttaaattttaactcatggtgatgtggacgaatatcggacatccatttctcgatctaatggtagtttccaagttttcactatatatatggtttgcactacatattttcccatataaagttgagatcgatgtgtagatcaattggatcaataattcaatatataatagtaatagattgttaattagtcgttgagagcagcagcagcagctgcaactacactactagtagtagtgatcagtgaagtgtgaaagagtaaagaattggcggcgtggaacacgcatgacgcgtacgttggctgtgtggtcgttgttgccaatcagtagtagtagtagcgccacattgtgaacgtgaaaaatgcactcctccaccgctctcgcctcacctgcagg

SEQ ID NO: 39356 - DNA, 1501 bp, Oryza sativa
tcggcgatccgtcccagcttgtccgagcgggagaagggcgcgaaggggatggaggccgcggcggcgccaccgccaagggatgccggcgccggcgcggtgtcgggagggccccagccctccgggttgaaggcgacgacgccgacgtcgaagcccatggtgctcggcggcggaggcggtctggatccgggcggaggctgggggtggcggcgcgagggtttgggtggggagggagaggggaggaagagtggggaatttagggtttggaaataggatttttttttcctaatatttaaggggcatcgacttagcgacttggagcccggcccacatatcttctgtgtggcccacacgtaagcctctgggtttttagcccatcaggactcaagagtctcggtatcacccattcattttcttcattccaaaataaacaaacatataatataatgagatgtgatatatcctaatcatatgatgttcagacttatagtactaactatatttatttgtggatggtggaagtacttgattagtacaaattttgcgatggattagttctgaaatgtttcttattcagccttaacttgtttgcgagcatcacttggccatgtttagaacacggtaatttccagcctataactccggtttgatacagggtggtttgttagaggtatagatatacatgataagagatagagtaaatttcacaaaattacatattttgtggtccaagttgtagaaaaccacacgcactttgacacttgtcacttgagtacatatattttggtcgtgtagtttcacaaaactacactatcgatgtatagattcacccacaagatgatgtggctgtttcacctaggacgaggacatggcatcctattaccagccatcgcacgaaattaatacgatgccacgtccttatactagatgaaacaaccacgtcgtcatatcacgagtgaatccattcatcgatagtgtggttttgtgaaactaaactaccaaaatatatgtaattaagtgccaagtatcaaaatatgtgtggttttctacaacttgaaccataaaatatgtagttttgtgaaatttactctaagagataaaagagtcgaacacaaaccatagggatataaggaaatgttagaggttctgaatacaaacatcagatataggattagttctgaagctcttgttcaccctggactttgatgcgtttcaaaagtacaaatcatttgaccttgtttggaacatggcaatttccagcctaaaatcctggtagatacagaatgcttcatagggagttagtgtcaaaatttctatgaatttgagttggcaagtcaaaacatcgatctgaatcaataacacattaacagcaaagttaaacctttcatctggatcaagagagtaattccccacagttcagataaatgaacagcagccggctcagtacagtacaacaactaacaatcaacgcaagtaggaaaacacatattagaatgtctcttta

SEQ ID NO: 39357 - DNA, 1501 bp, Oryza sativa
atcactcccaactgctaatgtaagcagtagctaagaccattcaacaatgcaacaactacgcctaaaaggagcggatttgtggataaataattaccttagtgatgaaggcacccttgggggcgaggaacatggtggcgaggcgcacggcgtcgatgacgagcgacgattgcgcggtggcctcctgcgcccacgcgccaccgacgttgggggacccgtcgtggagcacgacgtcgaacgcggcgacgccgttggagtccatgagcctccgcacggcggcgcggcacttggtggtggtgatgtcctccgtgagggagtgcgcgccgcggatggggcggatggggacgaggtcgacgccgacgacgaaggcccccacgggcgcgtggttgacggccacctggacccatcccccgggcgccgcgcagaggtcgagcaccgcgcgcgccgtcggcaggaagcggaaccgcgcgtcgagctggagcagcttgaaggccgcgcggctccggtacccctgctccttggcgaggtggtagaacttgtcctgccgctgcttccccttcgtcttccccattgctgcctcctcctcctcctcctcctcctccgccgccgccgccgccgacgagccgccgcctcagctataggcgaagggagggtggggggggagagagagagagcgctagggttttggaggctttgctcgagcggttggtcgttttgtcgcgggctttgctagtaatggcggtgaggtctccatgggctttgttgggccggtcctttctcgttttgggccagcccaagagaagaaaaacgtttcgtcgtttattgggccggcccaagagaagaaaaacgagtggcaaataggcggtatcatctcgcatttcactatttgccactcgtgtgtctatgacatgtgggcccgggacccacatgtcataatccctcttatccccttctgctgcggcgagccacactcccaagccgaggagctctcgcttgcgacagccatggagctaggcctcgcgctgcggctcgtcgcgccgccgcctcgtctcccctgtagagctctccagccgccgccgatgccttgtttctctccgtgtgcggcccgaagaagccgcatccgctcctcgaggttggagcgcagggttggggttgttgtatccggtgggagtatggcttccttggcaatggaggaggaggaagaggaagagtgggaagaagcggaggaagaagcggaaggatggcaagaggaggaggctgcagtggtgacgacgaggccgcgtctggagctcatcgagaagccggaccggagcctgtgtctgctcgacgagtacgagtcggaggagctaggcacctctcattgtgccaaccaccgcagcggtgaggcttctagcttctgtgaaattcacctcttcatttcgattctgaaataacagcctttttagtttatgatctccaaatgaaactattctgcagatgaatattttttcatgttgttgtaata

SEQ ID NO: 39358 - DNA, 1501 bp, Oryza sativa
attggctgatggagaggaagagccagccgccgtcgtaggagccgaagtagcggtggtgcgcgaagcgtggcatggggatggggatggggtgggtgcgccagttgctggggacgcagtggaacgcgtgctcgccggcgttcgcgacgacgagcagcgggagcgggggaggcggcggcccgacttgcagaaacgcctcgcgccaggagcggcagacgccttcgccgaagcgacggtcgatcttgcacaggaggcggctgggatcccgcggacgatgtggattgggaggtccgcccatggcggcggaggctcgccaccatcagccattggtgcagggtgaggaggacctggtggcgggaactcgtcagccattggagagacgggagtgggagcagtggttgtttggggatttggtggtggctaatggcggcacgagacacgagagtcgagaggttgaagacgacgaggaggaagacgctcgctgatggtggttagttacgtgctccggtttgattccttctggcttctggaaggcacggtgcacggaggaagcgagctgcttgtgtcgcaactcgcaagccaacttgcaattcaaattcaaaatcagcttcagacggattcgtatctatagattctagcacgaacaactcgaaatcgcaacctacacatgtctcattttaatttgtaaggaaaagctggttgcatatatcaggcccgtacagtcacaagcagtgtttacactttcgtttttcaaaaaaaaaaaaggattttctgtggtcaccaaatttttgggaatttagaaactcttttggacgaaattatttgataatttaacaaagtttgaatgaatttgaataaattttgactaaattcaaataaaaacaaaaagggggaaatttttggcgaaatgtgattgccgatggagtgagaaatttattatttatctatctatctatctattatctatctattatattattaagactagggatggcaattgtacccgtttgcccgtttacccgtgggtaaaaaccctattagggttgggtttgttctccattttatacccatgggtatcttattggttcaaaagctatacccgatgggtaaatgggcatgggtatgggtaatcactacccatgcccgctttgcccgtttacccgcgaaatctaacttacatgtaggctaggagcaaaatccactagaatacataagccacgttctttgttttctacggtttccttttatttcccttattatttctctcctcttactctatcgccaccagaggagagacacgacaccgagccggagaatatttgatgttttaagttcgattcgaacttagtagcttgtagactttttgttccactgcttttgttgtggcgggtaaacgggcacgcccgcgggcataaggcgccggcgggcaatgggcatgggcaaccatccttacccgtgatgtagtaatgggtatacccacgggcacaaataatctcacgggcat

SEQ ID NO: 39359 - DNA, 1501 bp, Oryza sativa
taataccaacagtactggaagctcagtatctttgttccccacaccttcttccagtatttcatcaatctaaaaggtacaaatgtcagaattttagattgtatattggcataataatttttttttcataattcagtcatctctttcctatgttgcaataccttttcaggcattttgcaagcatcaacaacaacaagcacacaatctgcactgccaacggcactcctaacattcttcatcatcattgtgtctagcttatgcatttcctttttgatgacacctggcgtgtcataaagtattatctgcaaactaaatgataactcagattagcagtgagaaattaacatttccccctttcatagtctataatcctaaagctttagaaactaaaaggtgatacctggtattctggttcagaacatataccaagaatgcgatgccgtgtggtttgcggtttgtctgtcacaattgaaagtttctgaccaacaatttggttaattagggtgctctttccaacatttggctttcctaatacagcaacataacctgtgcaaacacatggtatatcaatattacaacaacatgaaaaaatattcatctgcagaatagtttcatttggagatcataaactaaaaaggctgttatttcagaatcgaaatgaagaggtgaatttcacagaagctagaagcctcaccgctgcggtggttggcacaatgagaggtgcctagctcctccgactcgtactcgtcgagcagacacaggctccggtccggcttctcgatgagctccagacgcggcctcgtcgtcaccactgcagcctcctcctcttgccatccttccgcttcttcctccgcttcttcccactcttcctcttcctcctcctccattgccaaggaagccatactcccaccggatacaacaaccccaaccctgcgctccaacctcgaggagcggatgcggcttcttcgggccgcacacggagagaaacaaggcatcggcggcggctggagagctctacaggggagacgaggcggcggcgcgacgagccgcagcgcgaggcctagctccatggctgtcgcaagcgagagctcctcggcttgggagtgtggctcgccgcagcagaaggggataagagggattatgacatgtgggtcccgggcccacatgtcatagacacacgagtggcaaatagtgaaatgcgagatgataccgcctatttgccactcgtttttcttctcttgggccggcccaataaacgacgaaacgtttttcttctcttgggctggcccaaaacgagaaaggaccggcccaacaaagcccatggagacctcaccgccattactagcaaagcccgcgacaaaacgaccaaccgctcgagcaaagcctccaaaaccctagcgctctctctctctccccccccaccctcccttcgcctatagctgaggcggcggctcgtcggcggcggcggcggcggaggaggaggaggaggaggaggaggcagcaa

SEQ ID NO: 39360 - DNA, 557 bp, Oryza sativa
tttctattcaagttaaatcacacttatgcaattattcatggttacttacattgtctgctctgttaatctatacaacttgattgccaatggcattctctgtagtctcaagggtacatgattatgcttttcaggtcttggctaaatgcatatgaaaaaacatattgattgaactttactaaaaatattgctcgtccgggatttagtaagaatgtccctctgctcttattgatcaaatagaactgtccatatatgcctactctcttttctgatcacatagtactgtgtcaaataaattcaatatgttgctttggtgtccttaaatggcatggttgtttttataagacagtaaatacaatgtgctaaatccagaatatatcaataagtctacccttaatgatgaaatttaacttgtgcttgctgcatatttctgttcttttaaccctgatgtgtattgtagaaagtataatccaattccacgcagctattttctcctccgctttctctgccaccgctgcctggtatctaaatgtttgcacatgtgctattttcaactcagg

SEQ ID NO: 39361 - DNA, 1501 bp, Oryza sativa
ctgttttcgacaacagtacaactaatttcaattcacagcaaagaagatataacataacagatcacaaggaatatctcagtagtcagtacaactacaactaaaacaggtattcttaccttaggaggggaggttgttttcccaatcttttgtgtagcaacagcttcatcatgagccatgccttttatgaaagcctgctgtctgcttatcaagtagaaattcaggttataatggtgtgcagttaagcaactaaaaataaataaaaatttgcgtgagcctgaaatgtgagaaatgtttgatttcaccaaaaggacgttttggcacactgcccaacagtatcgatataaagctatcaacttgtgtaaaaacaattctcaatcttttcataagatgcaaattcctatcatacaagtcgaattatgatttttagaactaaaagcagctattaaaaacaaaagtttcgtcggtctcctacattggagagcacaatttttttttcgaggtcaaataacttttcatatgtttattattaatcctggttccaggaacaggacagggcaaacgcatacatcaacatgaaactgcttcagtaactagatattcagtcacacacccaatcgatacaaactgcaattagaactccaccaccaacgcatcatcgaaatccggaacaaagaggaggacacggactaataatttggacggagtgaacaaatcaatccaacttgctagcatggatctcctatcgctcatgaaagcagcggctaggaagagaacaaataccttcaattcaattgcctcttgtagagagatttaaggaagagagccacttagaacatgctcgctcgccggctccgcaccggagtagccgcacaggggttggaggagtggcgaaggagagggagctcgccgccgcccgcgcgcgcgtgccgggaagcgagacggcggtggaggaggagaccctcggaggaagcacgcggagagagagaggagacgtgaaagcagattgatctccaatgagcagcgagagaggggagagagagaagggcgcggagagaggagggagggagggaggcgagagaaaggggaggcggcaaaggctggagccacgtcacgagacacgtgtctatgataaggactaggccaccgggggttgccctgcaccgccaattgctacgcgtaccctttattgcaccccaacttgagattgattcacattagcgtatataagtaattttacagattgtaggtcgttttggattcaaattcaaattaagcgagcggctgaatttccctcagtatccttctactcctctgttgaatttcgctcgagttactacttcctgccatcagtgccgtcgtccactatgttaacaccgtcagccgccgatgtaccttgtttgttccccccatctccttagccttcagccagccagtgaacctcatccccaagtgctacgtgtaccttttgttacacccctagcttaagattgtctagcattgg

SEQ ID NO: 39362 - DNA, 1501 bp, Oryza sativa
ctaactctccggcgaggtgccagaagagcggctcgaccgggtcggtcctccggtggcggcagcggctcatcgggcggagccacagcgacgggaaggagaagttcgtgttcttgagctcgggctccgacgtccgtagtaaggggaggacgaccacgacgtcgcgcggcgatgccggtggccgtggcggcggctggagatattacgcgagtggaggcggcaatggcggtggccggaggccgtcgttcctcccgtacaagcaggatctcgtcggcttgttcgccaacgccggcgcgttccgccggagctaccacccgttctaacgtattgtagcgttctttctcgctgatcgtttgcttaattaattccttaattatatatatttttgtcaagtcatggtgtgacttcggattgccttgtggtagaactgaagtgtgacagatttgtagtagcagaaaatctttatgcagattttttttgtatgtgggtaatactaatacttatgtatatatcgtggattttgtattggtttgatcactttgatgattcctactacctttttaataagcattggaattcagaaacgtgtagtacgtttctctctctttccaacgtaaaaacgtgtagcagtacgtgaaacgcgattccgccagccgaagttcgaattaattcgaattcggtttagaacataggaattccaagcaaatagtttattttagaaaatggattaaaaatccagcctttataccttaaaggatgtacgcggtcacagtttgaacaactattggtacttaggccttgtttatttcagtctaagctgcgagttgtttgtttctccaatatatgctcttatattggaggtatataagggcagtgggtcttatagattattagattatactaatctggcttatagattataataatctatcttaataatctacttatttattttagcttactcctaataatacagattataataatcatagactgaatcaaacagggccttcgacgtaatccctccttcctattttaaatacaatcatgagtttacatgtccaactttaattgtccatcttatttaaaaaaaataaaaaatgtaagtcgcgcataaaataatattaatattttatcatctaataaaaataaaaaaactaatcataaaaaaataaaataaaaatcaaataagacggaagatcaaagttggaaacgaaaactcatggttgcgttaaaaatggaacaggggagtacaccttaaacaagtctttccaaacaaatagtttacaataacatttgaaaaatgcaacgcatcatcacaccaaacaatgcagattacccaattagctttagctctctcagaatcaaggacgcaacttgtggttgcggcaatggggagtaggattacctgcttatgttaacacatcttatcgatctggaagcctgaagagtacatcggatcagacgtcgcaaatacatacggacgcaacacaacacaacacag

SEQ ID NO: 39363 - DNA, 1501 bp, Oryza sativa
tcaggtaggcatagttagggggtattggctgcataattgtaatagcaagttgttggcggtgtggcatgaagcccttcgaccaaatctaccgaaaccatgtgaatagtggagattcgagcccgagacatcgacgttagacggggcgaagtccccccatggcgaagactatggaacatgaacggcgaggggcgagagatcgtgcgagtaccttgtcaagccagaggcctcttgggcgaagggtgcagggcgaagagtatataccggaggaagatgacttcgccacagcaagttcgcccccgcgagggccgaagaagcctttccgtcccatcaaccccagggaccgtaaggccgacgatcgcccgatggcccatcaggggcccatgagtccttattacattatgtacccatgtaaatgtccctttcataagggcaaccatgatgcggacatcactatctcggatacacacaacaatcctccaacggtcattcaaggaccgataacaagagctcgtgcgcgacaattaaatttagaggtgagctcgttcctatgttcttctttgtatgaattcgagaatagattgctacctaatgattatattgtgattaggaacaatggaggggacaaggagacacttggagaaggacttagacccatggaggaccatcggggacgtccaagtcaaggtggaggcccaaaccaagtcaacgtcgggtgcaattcggagtccaggaccagtctacactaaaacgggcgcccaggtcgcatacgtgctcagattggggcgttctttatacagatggaaagctaagaagataacctttccaatgggaattgaccgaacaagttgacggccaaaatctgtcccggtgttgcgtcaccgtatttgggcctttggcccgtgtatcgtgttggaacccattagggttgcgtcgagaggggtttgcacgaccctaaactctatttatcagtacccgctgccatctttagctttttgggttttgcttagattaatctgtcgagaacagtttggccgctagatcggtttgtaagaccccaactcgtgagcttaatcattcatctgcaattttggttgtttttctatctcgttcttgttattgttcttcgattggcaaacaaggattggccttcttggcgaggtcatccgcgtttggacacgggtgataaccagaggagacatagtgctgcgattgcggggctcaagagcgtgcgcgttcaagaagccggatcgatttgtgtcgcgactccgcccaaatcgttgtttattagaacctttcggaagatcgggaaccctagtgcacatcaagtggtatcagagctcttggttcaccgtcatgttcgctcagtttccttaacctagagtctacagaaaagccaaaaaaaattttagttgttagttaccttaacctagaccgtgtttagcctttacatgattctttttcagagtccgtagtgttgagtttgagtcctagtttaagttcc

SEQ ID NO: 39364 - DNA, 1501 bp, Oryza sativa
tacttgagaagtttccgacatagtcagggagcttccctgtaaaatcattcaagtcgaagccaacttcccagatattttgacagtttgaaagtgtagccaagaagtcgaggctcccttcttggtagttccctccaatattaaaccactcaattgatcttgagctaccaagtgcagttggtactgacccagtaaaactattagcaccgattagaaagacttgtagttcagaaaagttagcaaaaaaggtagggatggatccagtaaaatgattatggtccagatacaatgcattgagttgctgaagctgtccaagttcttgtggaattagccctgataaggtacacgattgaagaccaagggagacaagattagtaatattacccagtgcagatgggatttgaccgataagattattgtaacctagatcaagtaaaaggaggtctggcagtttgctcagccatgttggcacagggccctcgaatgagttctctccaatggaaattatttggatgtatttgcagtttgcaagccctaatggtatctgtcccgtgaatctattcgcaaatagagagatcatttgcagcatggggaggttgaaggtattattgttacctgggatagttccagttaggccccagttgcctccaagagataatatttgcagcttggacatgttgagtatagttgttggaactgggccagagaagtggttagcctgaaaatcgaggtgttggagcatgcctaaggaacccacagaatacggaagtgttcctgtcaaactgttgttcccaaagtctagatattgtagcttagaattgttgctgaagagatcattcggtagtggtccagttaagtaattcgttatgaaatctatgtgcgtaagattgtgcagtttttgcagctcaagtggaatctgccctgatatgctgttgtgccccatgtcaacaacctcaagccttgtgaggtttcctaccactggtggaatgacgcctgacaagctattccggcggaaaacgagaacttcaagacgatgcagctttccgagatcggctgggatggcgccggtgagtcccgtgctagtgaggttgaggacagtgaggaaagagaggttaccaagatgaggcgagatgcttccctggagtggcacatcgtgcagcacaagggcaacaacccgtgcccggcggcgactacatgacacgccgaaccaatgacagaaagatgtggcagtagtccagttggatagaacgccgcgagggtcggcgagctgggctttgaaagccagcagcgcggtaacgtctgtgtcactgccgttgccggcggtgacactgtctggggtcgaagcaatggcaatagaagcaatggcaatagatgctaaaaaccagaggtacagtagcagcgtaatcatgatcgaagtggccatgtatggaagctggttggactggagaaatttagctaatcggctttgtagtttgcttaattatatagcttgcttacaacttct

SEQ ID NO: 39365 - DNA, 1501 bp, Oryza sativa
aaatggatagaggtgggaagatggaaaaaaaacaaacttattatgagtgttttgtatggaattaagttgcaaaggaagtttgaaaacactagtgacttgtaggaggtatttggatatttcaaaaaataaaaacaaaacactctgtatccatgcacaacatataagataaaattattagtccaattcaagagaggtctcacttttagtagtatgatttagtttttctgatttattgagggatatgtattatgctatatttcatacccaacattcttgaaacgtcctgtaagtccttatttcgaaataaaacaaattgtgtattttattcctagtactcttctttcaaattaacttataaatttgatgcatgtattaaaaaagtaggtggaattaaattggagaaaattgtgaatcatttaggagggggagtagccgagtagggctgaataagacccctatccagatctagaatgtagtactagttttctatatttaggcccggtttagttggcaaaaaaatatttgttttaaggtgtcacatcagatatatggatacacatttaaagtattaaacgttgtctaataacaaaataaattacagtttccgcctagaaactgtgagacgaatttattaatcctaagtaatccatcattagcaaatgtttactgtagcaccacattgtcaaatcatgacgcaattaggctcagaagattcgtctcgcaatttacacgcaaactgtgtaattggtttttttccacattaaatactccatgcatgtatcaaacattcatgtgatgggtgaaaaatttttgttttgggaactaaacagggcctaggacagagccagcgaaaaacttcctcacctgagggtttgtttagttcacgaaaaaaaaattttggctgtcacatcggatgtttgaccggatgtcggaaggggttttcgtacactaatgaaaaaattaatttcataactcgtctgaaaaccgtgagacgaatcttttgagccttattaatccgtaattagtacatgtgggttactgtatcacttatggttaatcatggactaattaggctcaaaagattcgtctcgtgattttctccctaactatgcaattagtttgtttaatctatatttaatgcttcatgcatatgtctaaagatttaatgtgtctaaaattttttggaaacattttcgagtaactaacccaggcctgaatcagtaatctcgtcagaaatcaagagattttccaccgtggctgtgtgtaggcccagtgatgtgcataccagagaaatctcccacagattcctgggcacgttgccttcctctggagacatcccttgccttctccacacctccactccattcgattcctcccgccctttcctccccgcttttcctacaaaaacccctgtgtcgctccaaaacctgagctcctctgttctgttcccttctccacctatcacctctcctcggatcgtcagcaacagcggcggcgatgt

SEQ ID NO: 39366 - DNA, 1501 bp, Oryza sativa
cagtttggccgctagatcggtttgtaagaccccaactcgtgagcttaatcattcatctgcaattttggttgtttttctatctcgttcttgttattgttcttcgattggcaaacaaggattggccttctcagcgaggtcatccgcgttttgacacaggtgataaccagaggagacgtagtgctgcgattgcggggctcaagagcgtgcgcgttcaagaagcaagatcgatttgtgtcgcgactccgcccaaatcgttgtttatcagaacctttcgggagatcgggaaccctagtgcacatgtaaattcccctgtataaccaaaaccctagtggtaagaacctttaatgggggctataaatagtcccatagggggatccaagtaaaaatttctcaaattaatacactatagagtaaccacgtctttcgacgtatgcggttgtcgtttcgacaacagctggcgccgaccgtggggacctccgagcgaaaccactgacagcgaatgccaccgaagaaggtcgtgaaggaaaaggttacgaggcgaaaggaaagcgacgccggggcggacatggccgccgaagagggagcagagccttcggtgcccgttgccgaagatggaggagcgccatctgcttccgcacctgtgctatcactaccgccttcggcccctaccacctctgtgcaggtgccgaacgcggccgacatgacgaaggctgctgcggcggcaagggcactccagaccagggcggagatcctttcgacaagccaattgttggtgccacaagacgctccatcgcagccggcagcggccccaaccgcactcgccgccgtgcaggccgtcaaccatgaccccgaaacacaaaccgaagccgacatggaagccatgcgacagaacatgacacgtctccaggacatgcttcgccagatgcaagagtaacagtaagcatacgaggcggcgaggcggaccaagatcacttcggccccaatcctccagtattcggtaggctatgttccacctcaggtttatccacaagtgacgacccagccccttccgccacaagtcgcgcaggcgccaatgtacttcgtcgggcagccgtcgactgcagcagcgcatccggcccctcacgtgcaactgcaacctcaaccggtcgctgcccaagtacaccctcaaccacttggccaagtgccgcaagcaatggcagaaggggcttcggccctgcaggcgcagttccaagctccttcagcagctcaaccaaccccacatttcaagtacaaccccatcggctcgcccggaggggaatacaagtcaaggtgcgcccagttgtttgccatcaaatcagccaagaatgggggcttcgctgtagagtcaaggaccgcagttcgactttatcaatgctgctcaggcgccaaccgtttggccgcaagcaccaacgccaggcttcggagcaagccacgcaccaacccaggtcgccatgacatggtcgcagccaatttttgacccatc

SEQ ID NO: 39367 - DNA, 1501 bp, Oryza sativa
attctttatagtgcgccagactgagaagtggcgagaagtccacgggggtcgctggggagtccatgccttgtttataagggggtgattatgatccaggaaaggtgtgctgtaatgggttatgttgtgcaaggggtattgtcacaactcctttccgaggtaccgtggtggtattgaggcacatggtaacatgatgtggggttgtgtcttgtgggtacagtggtacacctctgatcagagtttaatctattcgaatagccgtacccgcggttatgggtgagttgagcaatgtttttcgtgattagtctcacactactcattagtggtaataatgtggtaattaatttgactcctggtttggaatggataattcctggtttggaggtttaatttgttcaaccggggttggttgttcaaatgtggttgggcctatgcaacatgggtgtgttgtatagtgtttatttaatattgattaattatacaactgttttactattctcttaaaatatttactaaatgctgtttctgcaaatgagctatattatgccatcctttgttatcctgtgcacttgcatttttgctgtgtgacttgttgagtatgtcatatgctcattcttgcaatattcattcatcagaagaggagtatctcagtgaaggtgatgatctggaggattaggcttgttcttggttaagatgcctgtggagtagagtcgccatagctgttccgtagtttgttttagttttaattttccactgcgtagaatgttatttttttgagaggaactatccacctctgtaatattttattatttgcgaatgttaaatagttatttattcgtactctattattaatttgtcattgtgtgcctcggttgattcctggacgagggtttaacacacatgtaagcgtttggaattttggatagaaattccgggcgtgacaagttggtatcagagccaccttgaccttaggataagccaaatggtaaaccttaagtagccttcaaaatatttttgaaaaaaaaatagaactgctcttctctattctcttataaattaaataagttggcagcacatgcaaggttatgcacaaaatttatttaaatcaatttcttttcttttaaaagcaaaaggttgttcttctcaaaatgtttctttttctctttaccaaatcttattgattagtcggcactgtacatctattatggtatcgatttaatcatgctggcaccagtactactcatcccctttaatggtgacattgtaccgtgcttatagtaggtcttaagtattctggttttattttattcacttgtccaaactgatttttctctgttcaaaagttaaattcaaaaagaaaaatatataaaatagttttgtatgtgtcttttcctttattttcttttcgtttattttcttcctttttggtcaaaatcaattaagtctagttggtgcagctaacttaaaaatatgcattaattcttctcttctatgtttctttaga

SEQ ID NO: 39368 - DNA, 1501 bp, Oryza sativa
catatcttgtctgctgtaaaacactacttgtgcaaccagatttatataatctcttcggaactttcaaattttatttgccatattctgttaaagtatacgacctcggtttatcacttgcctagagcaagaccttatggtgtacagttttttttttctctaaggtagtaaagcaaggaatagggattattttcacaaaacatgcacgcaagtctgactgcacattcgaaaattggctttaggaaactatagcctgaaactggacttaatacgaccagaggcttacctaaattaacagaatacataaggtaaatagaggtcaaaagcttaaatacaaccagaaaatactgaattcgcctatattttctagaaccgataaagattctgcacttaatttgctagaaacgaaataaagactgaggacaaatatcatgttgaataacttaaatttggtccaaatatatcaagtttaaggatcctataacgcaaatcataaagaacatcaagcagaatctgaaagcctgacatggaaactaggaaattgaaaggatttttttttaattcacccagaggataacttcttcatctgaatcattccattggtaataagagttgccgcacagatgaaaagtactactacattacgactttgcaacttgatcatatgattggataactagtaaaacgatcaaagcggaagtaactgctaattggtgttgttctccagtgtggccagccaaagttggccttggatcgcagcatgtgagattgtgtttctggataattttgaccactctctccttggctggaacagttgttatgaacagaaatgcaaaggacaaaaaattctcaggtctaaggtcatgtggagttgttgttggggactcttaattatagtgtactcgcccacatgaatgatgcatccaggcaaacaggtgatcaactgctgggcctctgtgtccaatgacactgaattttcaggttgtgcacattaacattcctatatattttcagtgcactgtgtgtcaggattcaggatgattcaggaacagatatttcttccatttttttcataatttgcaatgcatgaagaaatgtaattaagtgaaatgcaagtcaatttatgtctggttttttttttcatctgaatttgcagggaatagctaggtttctgtccacttccagatttgtaaatataactttggagcttctttgcttgacaaaaaaaaagtaagagcctactcaagaatttgaccaaatccttcagatatatgttcacgaagagggactaaagaagagaaatttctaggaagaaactgaacaaggattgagttgtatgaataagcttacggcaaacagggtgcgtcggccatggacaaagtcctccatatcgacatcaaatatcgtacccaaatccagaggcccggccaccagctccaaatctgctccagacaaagagaaatgtggtaggtcaaagaagcaagaactctcgtagcatggaaga

SEQ ID NO: 39369 - DNA, 1501 bp, Oryza sativa
acaggcaagccgcggactcacatggctgcgatgggcggcgatgccgtggcgaagtagacgagtttgggacggagtagattggcgcgatggctagtagttgatggctgattgggggccccgccaaccttctctagtggcggaggatggcgcgcggcgacgggcggcagaggatggtgcgtagcgacaggcggtgaggatgacaagtgccgcgacgaatggtggttgacgtgggatagatgcacgtggaggcgaacgcttcctgctagttgctatgaactgctgctgcttcatacttcctccgattaacaatataagactttataggattgctcatatttatatagatattaatgaatctagacatatatatgcatctagattcagtaacatctagtatatgaatatgagcaatgctagaaagtcttacattatgaaacgaagtcttacattatgaaacgaagggagtagatctatgaagagatgatgagccgtgaatagaaatgatcaaatgagagtaaaccctagctttcttcggtgggggcaaaataaggaaggggaggtgactagctccctcccccttgcacgtgcgggtgctatgtgctattgcatgggcgcagtaccactgtatccatggagccaggttgagttgcgaagttcaattcctgcgtttccgctcggcatggctcaaaggcaatttttgcattgcctcatcctgtctcgagagccaatacaggcagccaaacatatcaaatctgcatgcatggtctgacgaatttgctatatatctctcgtgtgatttttttcttcgtatttgacgttttttcaaccgtcggatctgcaccgcgattaggcgcgacgaatcagacacgcacaaagtggtccagcgccacacgtctcacgggcgacatggtggaggaaacgatcgataagctgatagtaacacagtagacagtagccagtagccggagtatctcagcttccagtcaacagaaaatggatcatgcatggcgccgcatggggcccatgttcaccacggtctccgtgcgatattttgatttgcgcgcccatgcttctctctatttcttttttttctttttctagttaccaaaatttacagtatatttgtactaaaattatagcgcacttacataccataactactatttttacaaatgtaattttagttataaagcactataattttagttataaatgcaatatttaacactttagatacctggacggtttctcaagcagtgcatttatactaaaacgataaatattctagttaccaaattttacattacatttgtactaaaattacagtgcacttacatgccatatctactatttttacaactgtaattttagttataaatcactgtaattttagcatattgcaacccatattgtatctgttttattagtctgtattggcccgatcttatttagacctgtttttgtctgtgtactattttttctaccgttggatacaaatatg

SEQ ID NO: 39370 - DNA, 1501 bp, Oryza sativa
tcggatcaccatttttgtccgaatcattgagttcttttttaagttaaaaaaagttaaatcactgggttgatgtaagtaaatgagaggcccctgttctaagcaggtttcagagagcacggcactcgtacatttggcgaccatggataagttccaggtcctgaagcaacgcaagtgttcctttcgctgcactgtctgtgaacaaagcatacctggcctatgtgtgcatgcaaacaaagttatttagagatcgtgtcacgcataagaatcgtttgtttctggaaatttgtcctctccgaaaacaaaagaacacattacttcgatgtttgaacagacgccatgtttagaacaaggcttgttgattatagtagctactactaatctgccgttctgctttaaagaagagaataaagattataataaaggagtaaagaaagagagatggcgaagcggaaggcttaagaaacgccaaaaaagcctttgaaaaacttggaggagaaaacttgaccgttgcagcgtgggctcctccgcgaaattaaaaagaaccggctaaaattaaaatgcaggcattacattacgcagactcaaggcaggacacgagaaaagctgcaagagtttatccgattattatccacaaggcagaagccaaaacaatctgttaattctcctcctcgttcttccttcaaaatttctttctcctactcagcattgcgtcgtcgatgaaacccttttttcctttctcagtttctttcctgagacttttctatacctgcaaagtgcaacaaagtggtcgaacccccacggtttgtcttagttttttctcaacgaaaaagcggcgactgcacgtgtcctccatggccgcggcgctgggttggttttaccgggttccgggctctgccgggtgcacgaagccatcggtatcagcatcaacctctcctctcctagcctcggatcctctcatcctcctcgcgcactagagaagctagagcttcacccactcgtgcttctctcctcgcctcgcctccctcatctcgatcttccaatggcgacgtgacgaggtggttgccctgcgctgcgcttctgaccaccacgtgcatttccatttcccgctgcatccgatccgtttgttgttgttgccgtggcgtgccttgtgaatttgctgctccgagcgagagcgagccggtggtttggttggttgcagaagctttggcttccgctgaggctgcgctggtgtggccggtggctcacgggtttcaggccgcgcgcgcgctcgcgcggtgttttttttttttttttttttttttttttttgcgctcacaaggaaagtgcagacgcgcagtgtaaaacgtcgtggcaaccccaaccgtcccaatggcgacgccgcccactgcttcccgcgcgtcgccataaaatctcgtacgcgtacgtgcgcgcgctcgtgtgcgtctctccttctcctctactctctcttcacgcgggctggctggctggctgttgatgagca

SEQ ID NO: 39371 - DNA, 1501 bp, Oryza sativa
cggatcacccgcgccggcggtttctaactctccggcgaggtgccagaagagcggctcgaccgggtcggtcctccggtggcggcagcggctcatcgggcggagccacagcgacgggaaggagaagttcgtgttcttgagctcgggctccgacgtccgtagtaaggggaggacgaccacgacgtcgcgcggcgatgccggtggccgtggcggcggctggagatattacgcgagtggaggcggcaatggcggtggccggaggccgtcgttcctcccgtacaagcaggatctcgtcggcttgttcgccaacgccggcgcgttccgccggagctaccacccgttctaacgtattgtagcgttctttctcgctgatcgtttgcttaattaattccttaattatatatatttttgtcaagtcatggtgtgacttcggattgccttgtggtagaactgaagtgtgacagatttgtagtagcagaaaatctttatgcagattttttttgtatgtgggtaatactaatacttatgtatatatcgtggattttgtattggtttgatcactttgatgattcctactacctttttaataagcattggaattcagaaacgtgtagtacgtttctctctctttccaacgtaaaaacgtgtagcagtacgtgaaacgcgattccgccagccgaagttcgaattaattcgaattcggtttagaacataggaattccaagcaaatagtttattttagaaaatggattaaaaatccagcctttataccttaaaggatgtacgcggtcacagtttgaacaactattggtacttaggccttgtttatttcagtctaagctgcgagttgtttgtttctccaatatatgctcttatattggaggtatataagggcagtgggtcttatagattattagattatactaatctggcttatagattataataatctatcttaataatctacttatttattttagcttactcctaataatacagattataataatcatagactgaatcaaacagggccttcgacgtaatccctccttcctattttaaatacaatcatgagtttacatgtccaactttaattgtccatcttatttaaaaaaaataaaaaatgtaagtcgcgcataaaataatattaatattttatcatctaataaaaataaaaaaactaatcataaaaaaataaaataaaaatcaaataagacggaagatcaaagttggaaacgaaaactcatggttgcgttaaaaatggaacaggggagtacaccttaaacaagtctttccaaacaaatagtttacaataacatttgaaaaatgcaacgcatcatcacaccaaacaatgcagattacccaattagctttagctctctcagaatcaaggacgcaacttgtggttgcggcaatggggagtaggattacctgcttatgttaacacatcttatcgatctggaagcctgaagagtacatcggatcagacgtcgcaaatacatac

SEQ ID NO: 39372 - DNA, 435 bp, Oryza sativa
ctcattgggattgcgagttcttcagattctgctggaatgaagggatgaggttgccatctatcgaaaactgccttggatgcagtgatatcatcgagagctcaaaccgatcacgtaatagggataatcggctgagacaggcaagactccctgttcgtcaaagattgggtccgatgaatcaagatcgtggccaagaggatgaggtgatcaggaagaatcaatggtgtccttctggtattttcacggagaatcagaaaaggagggtccagagattgaggagcagggagcgttttcaggaggttgaagaggaaatcaaccatcgactgaggaaaccaaaaccaagacaggagtggcatgtcaagaatcaggttcctgtagccgatgatgctgcagccgatgaggtgaagaggttggcaaaagggaagagtgttatagcgg

SEQ ID NO: 39373 - DNA, 1501 bp, Oryza sativa
actacatatacttcaaccaaaaccacatgtattttttttataacttttggccttaaatatatatagttgtatgatatttttttatgggggtttttatgataaattgaccttaaatatgtagcttcgtgataatttagtgctaaatatgttgttctacgataggtttgtcaaaatatccatagtttggtgaaatttactcgtgaagtttgaattgtttgaccccaactttatacaaaacataaagaattaattgtatgtgcaatctcattaattactcgctgcaaaatttagagaaccctacaaattggcatgccgtttcaagaccgggaaaatccctgtctgtatattaatgagcagattacaatcatcaatcacgttgtaattaatgcgtgcataaaaaaaacacgggtacacgtgatgacccgtctcgatgatctacacgagccagcagtctctccctctcatctaggcccagccggaaaagacacgaatcgcacggcccttggtacggtttggattaagtctactttgcatccctcattcattatcttgatccaaccgtaaaatcggatataacacagttcccatctttgaaaaacgggtacaaattatcttcttggtggttttgaaagcagtttctgtagatggagcccacatattaacgaggtatgataaaaatgttagaaagtgatagacaaacaaacgataaaaaacaatagattaatcgtataagacactagatttaacgtgaaaaccctcccaaaacatgagagaaaaaaccacgggcgccagccagcaaaatatattcactatatcaagggtgaggttacaacgccgcacggcggcttacaagagatatatatatggtggaacactaaaagggatgacgatcggtacctccggcccaagcctaccggcgacaggcctccgccccacatctccctccctcttgcttcgaaggcagcagcggaggcccgcgcgccggatctcggcccagcgggaagcatacggtccggcccaatacaacccgttcgtggcaaccctattccagcccatcgcgcccaccgcatcatgggccgaatgcagcgtcgttgcgttacggttcagcccaaaaaccccgcagatttcttcgagaaaaagagggaaaatccgagagaaatcacgagaagttgccgctggcgctcgcctcgcctcctcctcctcctgctggcctgtccgccacgtcgccgtcgccgttacgcgatcatctcatctcgccgagtcatcagccgcgagaaaagcaagcccagatccaaaaacgagacccccaccaccctcgaacccggcgcgcacgcttgcccatccgcctcggcccccgcgacgggaaagtgaggcctctcgtgggccgtcgccgcccacccgcccggacacgtggacggtcacggtgggccgtgcccacggcttcaataacagcagcagctcacctcgccgtccagttcgtcactcacacgcggagacaaaa

SEQ ID NO: 39374 - DNA, 1501 bp, Oryza sativa
tacgattaaaacacagtgaaattagtcgataatatcgaagattagtaactcacgaaataagaaaaaaaaacaaaatcaaatcgaaggttcagccatggaaccgaggctagaactgaaggggaaaacagaaaaaaaataaaactcaaaatcggagagcagcagttacagaaaacaccgatgcactaaccgaaaaatcaacaccaaaccacgaacagaaaaacaccgatcagttatccaacccagggtaaaatccgatcaaagctgccccaaaacaatccatccagacctaccacccatccgaccaaaaaactcctcaaaaaacaccaaaaacaacccgtaaaaataacccagattaccctcaaacacacaggaagtcaggaacaagcagatccacaccaaaactcacacgaacaccgcaaaatcccccccacctatcaaacagattcacccccacatcaagtcaagcggagtccacgagagctcaccggaaaacgggaggagcagcagcagcaacagcaacaaccgacgtgccgagcactacgggcggtggaggcgaccgcgcgtgcatataaagcgaggcgaggaggcgtgcgcgcgctgccaaccgtccgatcctcctggggctgcggctcagccgttggatcggggtgagtggggtgggaaactgctatatttacccggagaagtggcctgcgtgggggcaagaggagtacgtacctgactcagttaggacgtcgctttttcgcgatttactaattgatttttgttcgtatttcttctgtacctgattaggaatccgatggtttctttgctttgaagtaacgaggtttcattaattttttgcaagtacattaaatacaaggaaattgtatatacggagtatttggcaagtatatcgagttggagccctggaggaaggattatagtattatccacttgttcataaagtttttgtttgcttcgtctcaattgtttatttgtcgagagtggacccattgcatggtggattgggatgttaatccacaaagttcatgagccttattaaactagtactcctatgaaaatttttttctttttttcagaatggttagttgcagtttttccacgtgctttgcgtttagagggtcggaatatctcattacatgatacattaactattaaaatggtcattcagagggtgtgttcaattcacgttaaaattgaaagtttggttgaaattggaacgatacaacggaaaagttaaaagtttatgtgtataggaaagttttgatgtgatgaaaaagttgaaagtttgaagaaaaagttagaaactaaacaagggctctgtcaaagaaaatgggtcattcagagcatgaggtttttgcttccttcaccgagatattccctgctcagattttcaccttcacagaaacaactagctacaaaaatatagcaatatttttttcataaacaacatgctgcattgatgattaagtcagtacatcctgttaagaaaatgctt

SEQ ID NO: 39375 - DNA, 343 bp, Oryza sativa
catgctgatacatgattctaaatccatctgctgtgttgattgctgtatggctgtatgcagctgattcagctcaatccccaaatttcttcacaaataaactgcctattagcaagcactcaaccatacatacagcaaatgagtccgcggagaaatggttggattggaggggggaggggggaggggggagatgtggatcagattgagcacggaaaatcaaagagcagaacaaatcgctcgaaacaacaatccaagcaaaggaaggggggatttctggatgatacctgggttcgagacgaggtggggaggagcgcgtggaggtggaggggaggaggaggagagggaa

SEQ ID NO: 39376 - DNA, 1501 bp, Oryza sativa
atttcttaatacattatagtttgctttttttagttaaactatgaaaaaacacttgtgcattgcaacggatgaagactattttgatattagtaaaagtatatgtttttttttaattttgatagtacttatgtctaatttggaactcttattaagatgatggccatatgctgtatgcttgctttcttatgccctgtcaagaattataaagcaattaggagtctgtctctcatcccgagttagcatgcgagtattttttaaatgatttcttatacaactccttatgtatttcaaaaaatggatgaacttagaaaccgactcaaatacgtacagacgacgtaccaaaatatcggtgaaaacatcttcaatttttacaacaactaatttttttaaaatcttattattgttatacggtttagttaggataaaattcactgtaggaattcgcttggatttttttttttagaaaatcatgagctgcaattaggagttcgactttcatctcaagttagcatgcgagttcttttaaagagatttcttatacgacttttttttatttctagaagcaaacaaacttaaaattcgactcaaatatgaatatgtatttccaaaagcgaacgaacttaaaaaccaactcaaatacgaatgacgtatcaaaatagaatcttgcatagctcgatcaatttaggggtagcactgattaagtttttttttctcttcagattttaacacttattgtcttgatttagttttttttattcacgaggctacaaatgttgggtctgtccggcaatcggtcatgcggctacagctgttgcagcctctagctatcttgtacacatggcactattctgggtggctgcgggctacaacgcagccgtaacccaggtgtctgaacaggaccgcaacctacttccttaccacacttggtttctataacaaacaatatgatgggcatagataccatttatacccataaaaaatcaacaagcttatttcttaatacgttattatagtttacattttttttataaatatataattcaaaaaatagaagttatccgaaaatacatattaatacagagtccatgagtaaatttgcagatttggaggtgaccttatcaaggcaaatttcagtttttgtgtaagttactgctaaacacggaaggaaaaagtaaagcccccactatttattcctcctccacaatccatccatccatccatccaaccccagctatataaagctcggcgcagcggagggaggggaggaagggttttggaattagaagccgccgttgcgtgggagagcaaagtggaagcagccgaaaccgaaactagccgccgccgccgccttcgcctccgccgcgccgcgccgcaccactcgcccccaaggtccctaggggtttcccgcgcgcggagtgtggggaggaggaggaggaggaggaggaggaggaggcgggggggatctctccggcggcgaggatgaccggcggcggcgcggggg

SEQ ID NO: 39377 - DNA, 1501 bp, Oryza sativa
tgaatgacccattttctttgacagagcccttgtttagtttctaactttttcttcaaactttcaactttttcatcacatcaaaactttcctatacacataaacttttaacttttccgttgtatcgttccaatttcaaccaaactttcaattttaacgtgaattgaacacaccctctgaatgaccattttaatagttaatgtatcatgtaatgagatattccgaccctctaaacgcaaagcacgtggaaaaactgcaactaaccattctgaaaaaaagaaaaaaattttcataggagtactagtttaataaggctcatgaactttgtggattaacatcccaatccaccatgcaatgggtccactctcgacaaataaacaattgagacgaagcaaacaaaaactttatgaacaagtggataatactataatccttcctccagggctccaactcgatatacttgccaaatactccgtatatacaatttccttgtatttaatgtacttgcaaaaaattaatgaaacctcgttacttcaaagcaaagaaaccatcggattcctaatcaggtacagaagaaatacgaacaaaaatcaattagtaaatcgcgaaaaagcgacgtcctaactgagtcaggtacgtactcctcttgcccccacgcaggccacttctccgggtaaatatagcagtttcccaccccactcaccccgatccaacggctgagccgcagccccaggaggatcggacggttggcagcgcgcgcacgcctcctcgcctcgctttatatgcacgcgcggtcgcctccaccgcccgtagtgctcggcacgtcggttgttgctgttgctgctgctgctcctcccgttttccggtgagctctcgtggactccgcttgacttgatgtgggggtgaatctgtttgataggtgggggggattttgcggtgttcgtgtgagttttggtgtggatctgcttgttcctgacttcctgtgtgtttgagggtaatctgggttatttttacgggttgtttttggtgttttttgaggagttttttggtcggatgggtggtaggtctggatggattgttttggggcagctttgatcggattttaccctgggttggataactgatcggtgtttttctgttcgtggtttggtgttgatttttcggttagtgcatcggtgttttctgtaactgctgctctccgattttgagttttattttttttctgttttccccttcagttctagcctcggttccatggctgaaccttcgatttgattttgtttttttttcttatttcgtgagttactaatcttcgatattatcgactaatttcactgtgttttaatcgtatcgtcagttagagagttgagatctaacagtcgttgtgttccagtgttttccccatttggatttttcgatctcatcactcctgacgaaaaatttctcatcgccttctgtttggtttggtttggtttttctcgcgatttgccgcagatcgcagcca

SEQ ID NO: 39378 - DNA, 1501 bp, Oryza sativa
acctcggtcgcgacccggacacggactcggtcgcaccgtgacacgacgcgtacgcgacatgtctcgctgtagcgtgagccgtcgtcgcaccggcccggcccggcctgcctgcctcgtcaggtgaaacgccttttctgacaaattactacggagtagtagttacgtgcaggtttaggagaggtaattaatgaaacatttctttttgacacaggctaccactttacatgatgaagaatcattatccgatcgagatttaaaattacaacttacatttggtcgcatttttccgtgcaacacatgtaatcgtggttaaaaaaaaagctgtaaatctgaagattagacacatgtaaaaaaagaaagctgtaaagcagtagtgtccttttttactaaatgtgattaacaagtaaaatcagtcacatttaatacgtgccagccgatgaattcctggcttgcaaatttcggttacgatttattgggcacgccgttttttttccctttgacacgtacggcctctcgcttttccaccgtcgggacgccacagccgtcggatcgccatcggacggagaaggaacgaggaggcatcggcagcgtcatgctaacgtcatcaagctggcccatcgacggtgggcccggtcacgcgagtgggcccggtcaaagcgacacggacacgtgccggtgagggatgggtttgaatggtttgaatggtttgacgcagccccgtcctgttgactcacctgaccggctgcctccggtggccgtcgctgactaaaccctatacgaccttggaccactccccttctagctattcccaccatgttcgcaattaggacattgtttgagccctaataatttttattattactactgttccaaatgtcatttaataaatccacgactctgcaattagaaagctgtggagaaagttagtgaaaggtaaagtaactcacaagccttgacatggtcttgtactcactttttttcttcttctcatttttttgtataagagattaaacaagagcaaaagtttggttgataatatagagaaatgcatgaagcattgagaattggtaaagcaaacaacaagatgttactagaaggtaaaacctgcgaccgaatactaactcgatctaagggtagaaaaactagtgttgcgcatgcaaagtacagtggcgtatagtacacatgacaagagcaaatcaaatcaattaatttttgttaatttcaattatgcgacaaagcccgtgattaactaggaattttcaactaagcccttggcctctcacccaaccacctagctatccccacacatgatcacactagctagcttcagcttgtgctagctcgcttacacacaaatacacacctctccctttcttcttcccctctctatctctctctcgtcgtctacctctcatctccttctcttcactgcatcaccacaccactagccagtagctagctagctagctagcaagtacgatctatatgtgagcaaacgcca

SEQ ID NO: 39379 - DNA, 1501 bp, Oryza sativa
ggagcaagtcaaaagagccaaacataagcatgattatttcagaataaattccattcacctgccacatattaaacaaaaaaaaaactctgcctggatcatggtctctcctttaacaatccttcaagggtagatcacatgaggtagagccttgctgaaaccactgaaagcttccaatttttattggctgctgctcatggcactggtccaaaggggaaacaagaacagaaaacaatgaggaggtggatctccacacaattgctctttgcaacagtggtcatctcttgactttgttcaccaaagttcagcatgcattccttctctagatcatgtagggtgggtttagttcacgccaaaattagaagtttggttaaaattggaacgatgtgacgaaaaagttgaaagtttgtgtgtaggaaagttttgatgtgatggaaaagttgaaagtttgaagaaaaagtttagaactaaacaaggccgtactctcaacttttagatctgttctgctgaccaatcacaacatctactactgataggtactgattttctaataattgttgtttcaggaacggtttatgtaacttaaagccaaaactaaaaaatcacatcagagcttatgaacaatgtgagaaaaacatatctagtactactatgttctatgttctgccaaaagaaatacatccataaatcacaagacaacccagtgactgagttacacccagtactattaacctagctgcttttcagttttcttagcactggataaattggtctaagatccacagatataagattacagttaaaactaattttccagagatatggataagctctttaaataaaaggtgatcctagcttggaccatctactgccaacagctccaattctgaactaaaatcactttcagaatctacagaataagagttttcatattacaaaagcctgatataaagaaagtgcattttatttcagattagaaaaggcttctctttgaaatggaaggatcagagatagccaacctttctacatcctgtctctcagtgggggtgacgagatattgaaatgtgaaatattcctacccattgcctatcaactagcacttgaaagctgcaaacttttctgaacctttcttacgggcatcagagtaatcggtccagctttgcgactcagtcattcaggtcgatgccttggctgagaaaggttgtgacttgtgatccatggtaaactccggatagttgaaaaccttggcattttcagccttttgacggctccaaaacgtgctcgatttggatgtttttgttacagtggaaatgtggaatttatacggcctgtactgcctgatgctgtctatcagtacaccccgtttgaacaaggaaaatattccggctttttctccgaggaaaaactttgctcttttttttttgtctgtctcataccaatctggcagggcaagcaaatgggatgttgttttcatcaaatgaacttttcaaagatgctgctcatt

SEQ ID NO: 39380 - DNA, 972 bp, Oryza sativa
ctactatagggcgaattcgagctcggtacccagtagattagatggcgatattgctagagattatgtaagatatatgataactcgacgaattatataaacaagattagagtgtcataaagatggaagcactaatcctaagaacgcaattcgtcataacgaattttacctcttgttgaagatcgaaatcgatgcagctcaacccgaaagcaagaactcgtcgaaacaaaactaaagcaaaaagggtggtgatgcgccaagattgtattgaatgtgtgtgttcaaaaattacataaggctcggggtctatttatacccgagaattacaagatatgcccatactggacacgaccattatctctaacaaactctaagatactataagtctttgcggcagacttttgcccacatttatctataaggaatttacataacatatcctaattaatagatacaattgccttcccaggactctatccgtgcgtggcaatcatcttgaaatacactaacttgaacccgatgtcgcatacaagttgtattgtcggaatcggctatatcggcttatttagcccgactcagacccaaccgatcctaaccgtagccgatctggattccagccgatccctgctctgcttccgaactcgatctccgcctccaacttcgctttgatcaagtcctctttcccgacacagatgttaccaaatttggttgttaacacatgccccccaagtccgggatattcgataatgttccggatttgccgtatgccgactccgagcgagttttgcactccgccgcttttgaccgttattccagcgctttaaatactaaccgttacccccgagaaatctcacaccgtgacttccgttttcaccgctcaagcgaaaccttttctctctcttctccggcgattcctccggtgcaaaggtgattcctaggcgacctcctcttcgacgagatctccgcccgcggcca

SEQ ID NO: 39381 - DNA, 511 bp, Oryza sativa
cagaaggcagccgattaggttagatcttgatgttggtctagattatataagatatctaccattctatgaaacttctagcggcttgattgtctagatatcactcttcttttcatacttaatactgcatcagttgagtttgatctattaagtcgtgcttagaatatcgatctctagcctgccttctagttgccgattagaatagcatcggagtttcagccgatcgtatctgatttaactatatttgttctatatgctatactgatatgttaaatctgccctttatatcaagatattgccgtatctaaacatgttaggcctttgtttgatatattattcttgctttaatatcctgatatggagtagtatcggagtattagccgatacatgcgagatctatctgatcggctatgctataaacatatatagtcctgttattgatatatgtttcgatctaagtgatttatactatctcggcatgatgaccgatctatcccaatcactttatttaagt

SEQ ID NO: 39382 - DNA, 1501 bp, Oryza sativa
caccaaagatttaagctgaattaatattctcgcttgctcaatcactgaattcaaaccgtaaaaattcttataaatgaccagacattaggaagtactggtaaggaagtcaggtgcatcaccattttacagctacaaaagttactcacaaaagcaggcattttagagtctcaagaaatagttcagctccttctccagacccgttctaatctacatttcgccttggctacttcctatgtctaataacacgttttttcatgcaaaatatttctatataaaaatgtttttaaaataacataaatctacttaaaaaattcaataattactccctctggttggacaaggttaaggttaagcttttataactttgaccatcaataactttaaaaatatttagtttaaagaaactagaaaaacatatatagatttgtctttcaaaacaatataataaaagtaaacatacatttatttattgtatatattattatagaaaaataaggtcaaaggtatatcttgtagaacgtgacattgctcaaagcatcaattaaaatgaaaccggagggagtaatacttaattaattctatattaatcattttcttgttttgcgtccggctaataatccgtttcaaaacccactttggaattaacgaagcctgaaattcaggcctggactgtcatcatgctcatcttttttttctctacatccttttatatgttcgatgcgaaagcatattgagtttacgcaaaccattcttgcaggacgatctcggataatggacagttcgtacgtagtagtagtacgttgggataaaatttggcaatcgaacaatcactttccagcactcgcgtctcactcaccctcacctccacattcattaatgctcgataggtgatggtactactactagaagatcccacccttgcaactgcaagatatccactgatgaccaattcatccaccactaattactcatctctacaggctcatgtcgtcgtctagcttcagttctcaagctagctagctagatactacttctacttcctatatatgtactcatatctgaatatctgatacagtagcaggcaggcgattcgtggtcgttgaagcggcgaggcatcgatcgatcgtcgccgtcgtggtcgcccaggtccagcaggctgtgctcgatcgcaattaatccatccatccaggacgtacgacggcgtcgctttcgccggtggcttgcaaaggcagcctctccggctttgatgggacccaaacgccgactcgctgtcgctgatcgttaccacctcgatcggtcgccgccgcgctctggaccaagctagctacccagccaacccttccttttgccgcgtactcgctcgcatgaatcgacctgatcttttttattttcgcaaacgcgcaaaatgatcatcagtatattagaagaaagtaaagttttaattacacaattgccgtggaacaaggacaaaaaaatggtctccaaaaccaccaaaaaccga

SEQ ID NO: 39383 - DNA, 307 bp, Oryza sativa
tagcttctgaaatttgtttttgctcgattgaaatctcgaaatttttttctagcagggtgataattgcaaaactacataagatctgattgaaaaaaaaaacagcacacgcttcagtcacttttcacctctaccatcatcagaactgcacatacgattcagttatttttaccgctcccgtcaaacttgcacgtaatctaaaaaagcccaaaaagttcgcacgttttggcgtctcccacatataccagccaaaaaaaaaaagaaaaagaaaaaagaaaattcccctctgacctgattctatctctcgagc

SEQ ID NO: 39384 - DNA, 1501 bp, Oryza sativa
ccaaggaatatgcatgcagggcctatcaatacaagaacgtttgtacgacgttttgcaagctagtcagccagccaaattaagccttttggattcacctgcacacacgtacatgtcagacagtccgagtcggtgttaactcagtcatggagatttcgatgggtttggatgaagctgactttccttttgattcaaaggtagccatcgatcgacaccagcaagtaatagcagcttgcattggtcgacgccaattaatgaccggtgcaacggcgaccatcgcggttaattaactagctgttgagaccaagtgtcgttgagtctaagagtggattttaaactgtagatagaacgtttacacgttatttgcatgttactttgagggaatgttcactttgatgtcaaaaaaaaaccttaccaaattttggtattgccaaaattttgataggatttattatataggtgcaaactaaatgtagccacttttttgacaattttatcaaaatttgataagattaaaaatgatatcaaagtgaacatgccctagaaattaacttacctcattggcgattttgatgtaggtatacaagtcagcgagcttgatggatgcaattaagcagatggaaccggcggccgggcgtgtctcgcaagttcagttatctgcccttctgctggggcccttgaatatgctggacaacacagggttaattacgatgcgatgttcttaattagtagtttgcagctggactcatagtctcatatgcggacgtattcactggggccttaattaatgagaacttttactggtacaatatactaccagtatatactggcagtatataaaagggcatattaaaaatttgatagaaaataaaataacactttagtaattttctgttcagattgaatctaattgggagtacccggtcctggatcttatcgtgcgctaggggaggagcatactgaccgccatttgatgacgaagcacgtaatgatagcatgatttgatgatagaataacgaagaaaagacaaaattacccttcaaactttatactgcaatctaattaactaaaaaaatcaaatcaatttacaccgttagatcatatatacttgcagtatatactagcagtacattgtaccataaaagttctataattaattaattccgcttgcagtactgcactgtttccttgagcgctcaattttttgaccttcagagttcagacaacgagtctgcaaagtagcacgatctctcgctcataccaaagtaattaagcattgatctgatgacccagagagaacatatagaagcaattgagtaggagtgtgcgtgtgtgtgtgtttatgtatgaacaatgagctggagtgaggtagaacctcataaggaacataccaacaaagttcatgcatattgaaattggttgtatacacggactaatcatagcttcaattgttaggtccaaacaaatgcacttcctgcaattaattttgtctcagattttcaga

SEQ ID NO: 39385 - DNA, 338 bp, Oryza sativa
aaaaattctcactacaccaagtcaccaaaaatgctcatacatgtgtctgaaaaccaaggggtagagagagagagagagagagagagagagagagagagagtaccttcagcatatagagaacgaacagcttggacggaataaaatctcctggatgaatagtatctttttttggcgcttttctgaattccattgtttcatgttttttgcataacctttttgatttccttgccgctatctgcttgtatcaatgatttctaataaatcagttggtcaggagctcaaggtgtctatgtaactgttgcgcagataacaaattccattacgtgactcaggcagta

SEQ ID NO: 39386 - DNA, 163 bp, Oryza sativa
ttccatctatgcaaccctcgatcagattcttcaatctgattttggaagcgatgtgaaagatgtctgcaggagacttggaaatggaagatacaggattatcttctcctcataccaccaaaattcacaccacctgttcgtccagcaattcattatatatatatca

SEQ ID NO: 39387 - DNA, 1501 bp, Oryza sativa
tctagtagcaaaaatagcaacaaaatgtatcgtcaaccataactcatggcagagatccactcatcaacgcggtcgaatccgtcgcgatatcggctaacactaatccactgactgcatcaacacattgaggcaaatttcatcagtttctatcacaaccaaatgatcataataactttggagctgaacaaacaattcttgcaaacctgcagagtcattgaggagcaaatggtaagcaaattgctcaccagttcactgtcgcggcctcctgcgaagaacgaacacatcggattcctcgtaggcgtaatccgggtccagatgctcccgtggaatcttctcgatcaccgggaaggccgccggcacggcgtcccagaaggcctgatgcgcctccggcgaccggacctggtacccgagcagcaccaccccgcggtcggcgtcggcgagcacgtccatggcagcgacgaggtggggcacggattccgggacgtagacgacgtcggcggcgacgacgaggtcgaagcggcgcggggaggcgagggaggcgaggtgcgcggggcagttccagtggagctgggcgaggcgtggggcgcgcgggaggtggcggcggttgcggcggaggttgcggcggagcgcggggagcaccgcggcgatgtccgtgaggacgaggtcggcgaggccgaggcgggagaggccgaggccggcggggccgcagcccgagccgagctcgacggcgcgggtgcccgggaagcggaggacgtcggcgaaggggagcgccgggtcgcggaggcagcgctcggcgaacttgacgaggacgagggaggaaggccacacggaggtgcccacctcgaaggagtcgttgtcctgctcgaacgtcagcaccgcgccgcccaccggcagctccaccaccggagacgccgtgaagcgcatcctcctccgccgccgccgtcaagcctcggaagcgaagggactggagtggcagccgatcccgcggcggggagtcggcgtcctcattaggccctcgataaagttttaaattacaaacacacccctgaaggactacctatatagtactaatactatttgttgacaatttttttttaaaaaaaagtgatatatgcaattatagcacaacaatcatggtataattatattgtaatttgcatgtacttataatgtaacttatatataactttagaaaatcattcataaataatattttcgtgaaacgaaggtcgtggggccgaatcttctcacatactagttgataccccacgttttattacggcatagataaataaatgcatgttatatattatagaaacgatagatatatatggttgataaatatgaaaatgatgtgaagataatgatttgattgcttgcatattgagttttagaaataataactaaattgtaatgatgtcatgcttgcatgatatttaaaatactctagataataattgctagtgaatgatgatgtaacacacttacatatgatttaaaa

SEQ ID NO: 39388 - DNA, 1501 bp, Oryza sativa
attttttcaaaagcgaacaaatttataaaccgactcatacacggatgacgtaccggcaaaatatcttaaattttttataatagtagagattttttttaaaaaaatagtagaagtagaagagaagattacggacaaaaagtcctttttttgagggaatcgtacttttttaaggaattggacgtttttatttttttttatacggtagaagttttttttctctttttttattttttcttgcctttttttctccgcagatagtcggactttttttatggagtcggacgttttttttacgtagaagtttttttttctcttatttttttctgttttttttccaccggaggagtcagtcgtttttttttttgggtagaagttgttttttctcctttctttgttttttcttgatttttttcccgtcgtctctcttttttttttccaccggaggagtcggagtcggacgttttttttacaatagaagttttattttctatttttttaattttttctcacttttttttcaccggatgacggatatgtcttttcaaaaacaaaagaacttaaaaaccaacttatacacggatgacgtaacaaaataccggtaaaaacatattcaatttatataatagtacagatttcagttgtttcaaaattgtattcctacttgaactctcttttaatttttctaattttggatattattttattttttattctgaattttaattaatcacgtattgggttgttatatggattcttctttcaatatttcttatttttaattctgaatttcagctattttaaaattgtattcctactaggactatccttttcttttctaattttagattttagtttatttttatttcaaattttgattaatctcgtattgggttcttatatggaaacttttttcactattgcttatttttaattccgaatttcagctatttttaaattatatttctacttagattctcctttccttttctaattttggattttattttatttttattttgaattttaattaatctcgtattgggttcttatatggaaacttctttcaatattgcttatttttaattccgaatttcagctattttaagattgtacttctacttggactctccttttctttctttttttttactttttctccgattaatgtaggacgtggtgcctcctttcaaagctgttttaataatttaatagattaagaaagtgagttgtaatttgagtcctattttatcgttaaagttttgctttgaattatatttaaactatttgttttttatttggatcgaataataatattactccgtgtttagttacaaaataattcttcaaacttccaacttttccatcacatcaaaactttcccacacacacaaacttccaacttttccatcacattgttccaatttcaaccaaacttccaattttagtgtgaactaaacacatccttattattgtagtttggatcatcataaataaacttttc

SEQ ID NO: 39389 - DNA, 1501 bp, Oryza sativa
acccacatgttgcctcagaggccatggtactttatgttcacttctaatgaaagtgctgctgggtatgcatatgacccgattctccgcaaatggtatgatttagagcttccatgcatagataagagcagttgctttgtctcttcttcttgcggattagtttgtttcatggacaatgacagcaggaatgccatttctgtatctaatcctatcacaaaagattgtaagagaattttggagccccctggtgcaaagtttccagactacagcacaattgccataaaggtagatcgttcctctcataattacaccattacattggcaaaatgcaagcaagttccagaggattacgtccgatgggatttctctttatacaagtatgactcacagagtagttcatgggtgactgcggttgaggaggtgttcattggttggagagggggtgatgacagcgtgatatgtgatggagtattgtactgtttaattcactccacaggcattcttggtaatattgaaccgcgtcatagcattatcatgtatgaccttattgctgggccttctaaggcgtcactaatgcaatcgtcgatcccagcaccttgctctctcacctgtggacgtctgcttaacttgagggagaagctggttctggttggtgggattgcaaaacagaacagacctgacatcatcaaaggaattggaatatgggaacttcacaaaaaacaatggcaagaggtaggtcgaatgcctcataaattatttcaaggatttggtgagtttgatgatgtatttgctagcagtggcacagacgaccttgtctacatccaaagctatggtgcaactgctttgcttgctttcgatacgaagcagaagcagtggaagtggtccgcaaaatgccctgtgagcaaaagatttcctctccagcttttcactggcttttgctttgaacctcggcttgatattaccacttaattgtaatgccttccaatggaatcaggttggcagtcctggtctttgtgaatatatgcatgcttcattagattgttgcgtcacatgcaatgtgctctcctttgcttatcatcccacattcgtcctgatggatgcaatttcctttgcctcttttcattggattaattaatctttagaatgttgatctctctctctctctctataataatgcctgtttacaaatgtacctctattttctttaaaaacaatgcatagatctatgctatttatcacatttatctgaattctcaagttcagccatgtactgcctcgacaaaacctgcatacaatgtctttgcttgatgcaggccttagaacctgtccatataaactgaatgagctattgtccttacagcatgtctagacagataaattttgcagcgccataagttacatgtcttttcatcgcgcaacttcctgtatgtgatatctaaatttttgtcctttgcggtctcaagggacaagttcaactgtatgcgttttgtttcttgtgatactt

SEQ ID NO: 39390 - DNA, 1501 bp, Oryza sativa
ttctcgttgccaccgccgctctgctcacggatgctcgccatcgcaaccaccacatctcatcagacatcggcgatatgtttttttttgactgaaaaaggtagagaggctctaccttataaccattttattaatggtagtcaaggtgttacaacagaagtacaaagatcgaaaagaaactgaaaagaaacaacataaagaagaacataaaaagagtagggagatataggaaggaagaagaaagaagggagaaagaagagagaaacgaaaaagaaaacaatataaagaagaacataaaaagagtagggagatatagctgctatgctagcaaggcagcccaactgcgcattagagtccggcattgtggcatgacgcggttctcccacatttgcagacattctctgatttggtgcatcacggcagccgctgtatactctctttggttgaatgttttttgattgcgtgctttccataaattgtgtgaacaagcagcgaagcaaataggccatccaggttttagatgcgccggtgtaaccaacagtccctcctcaacgaactggagtatatctgcactctgggtggcctaatcaaataggttgattttcttccaaatctcagataccaacttgcagcgtagaacgatgggcggcctgatcaaataggttgattttcttccaaatctcagatgccaacttgcagcgtagaacgatgtggtctgctgattcaatagctgggcaatctgcgcaatgcggatcagatgcccagcatttcctgaccctattatcattcgtatttagtctgccacgaaaggcgcaatgcggcctgccacgaaaattcgtattcaccatcatcagcgcgtctcacccaacattaatcaaagaaaaaaatcttaacattagatcatggtgtgtccaaattaaaagtatagattaattgatatagttgtatacaaatttcaattatgtctagagaaatagaagtcaagagttgtatataaaatctaagcatatagtaatactagaatataagggttgtatatgaaatccagatcttatagaaatagaacttaagagttgtatatgaaatataaatatacttctacatataatgttacatatagacatataaaatttcagagttgcgcattaaatctaactcccaatgaattataaacttcacgtggtaatcccccactaggtagtctataatagcagcccgtgcaacttgcagatcgaggatcttagcaattttacttctactcctataattttgcttgtgtggttagtttgtttgggccgctttctcccgcaccccgcatccgtgggctgctcattgtcgtctcatctgggcttttcaatgggctaccgtgtggagctcgttcccatccgattggacccacatgtcaggggactaaccgtcccgtctcgatccccgagacagtccacctccttcctcacagcccatctcgcgcgcgacgccgccgccgcctcgccgccggcgatgt

SEQ ID NO: 39391 - DNA, 1501 bp, Oryza sativa
gaaagggcatgtagcggtgtagcctagtggttgcagtggcctgagtagcacacaaggttccgagtttaaattttcataggagtgaatttcagattgagttatttgagggctaagttccctatttgataggctaagttcctaattttttttaaaaaaactttatatatctggttggatatagaggctgggtaaaaataccattctctaaaaaaaaggtgttctatttcccattttatactgcttggggagtaaaaaagtgttccattaaatttgaaaagatgagttctatcatttctacaacgagatgatttacaatgatatttattgctatagaaatcacatctaaattgtagaaatccaatggatcgtatatatttatgatatcactccaattactagtagtagaatgttgaggtcacttttactagtgataatgttggtaatagaataccatgaaaaatgttaaaaagcgaatttctgctaccccagacacctggccggcactccagaaccaaacgtttgatgactctctgcttttgcgtttcagctggaagcacaacttcgcgcgtagctagcttagagcagcaaaccgttgctcaccgcaccgcaccgcaccgaaccaccacagcaaaagcctctctctctctctctctctttatttttttttaatacgcaagaagcgcatctttgtattaagaagaaataaatgtacgtacaaaacaggccaaaaagacgaagcaaggggatagagtacagaggagaaccaaaagactaatctccaactaaattttacgacccttctccactaacatgagctcctctctctctctctcaccttcccggcgcggccggcctaccacagccatcatcacgccatccacggagcggcaaaagctcggcgaaatgcgcccaaaagcgcctctcatttcatcagtatgatcaccacccccggttcccacacgcagcagcgcaaagtccacccccgtagtatatttgcaggagctttcgctgctgtgctcatatcaaaatctcccccacgggccacacgcggcgacaccggcacaccaactgagccctcgttgcttgatatagatcattagatcgttcccattggttggctacaaaggttgttcgccatcttcgtctctcctgggactggtagccaccgcattgtgaggagagatttcagaaggcgatttttggttctttagttcagagttcaggcaggtttctctttcatgttcttgggattctgtggcagtgagaatcttggcagagaggaagaaaggatgcctttgaggtagcatgaggtgaggtgagtgagtgaaggagaggggattcatacggatttgcagcctctcttctcctgccattgttcagtccgaggactgcattgtgtgtggttgcccttcttcagtttagcagttaatttcactgccaaggcttgatttgagggttcgtttttgaggaactcttggtgacttttatgttctaggagtgg

SEQ ID NO: 39392 - DNA, 174 bp, Oryza sativa
cagagtgctccattggatttttttggcgtaatcaatgcaaggcctttggctcgtgatttgtttatggcatatgcaaggtgatgcttctgtcctgtttctgattattgcgttatatcttttatatgcatagctctggttcaacatggttgcatatgtttctgttttgctcacaga

SEQ ID NO: 39393 - DNA, 1501 bp, Oryza sativa
gcgaaaacgagagaacagaagcagggatgatggtcaccaatcaatctacaagtagcgaaatcgagagagcagaagcaggggaagatggtgaatatagccaagctacagatgagattggagacgatggaagcagagcaaagtaatggtacctctcttggccggcggtgtcccagatctgggccttgacgagcctgtcgtcgacgcggacggtcttggtggcgaactcgacgccgatggtggacctggtctccaggctgaactcgtcccgcgcgaaccgcgacagcaggttcgacttccccacgccgctgtccccgatcagcaccaccttgaacaggtagtcgtactcctcctccgccctgtaccccgccgccgccgccgccgccgccatccccccctcctctcgagcctcgactacgtgcaagcccgcaacccaccgatccgccgattcgctccgcctcccccgcgcgttgagctggatgcagcgagcgagcgcaccgcttcccttcaattatacccacgcggctcggcgcggcgcggcgcgttctctcttcttttcgggcgaggttgctttggatttttgggggaaaaaggaaaagaaaggcgtgtggagtgtggtcgcgtggcgcggtgcggacgaggtcgccgcggttagctgcgggttgttgccccccgcgtcgcgctgctctgtctttggtttggtcgtattattatcgggcggtgcgaggctgcaacgatgtgtgtgtgtggattggcacgacgggttgggtgataaggtggagaacgagagcgggcgagccgtgagccggtggcgattttgacgtgagacggttttggtggcgttgtccgggtcttggtttcgtcttgctgaccggggcaaaacgcatgtgtcacccggaccggtcgtttggttttcagttcgcaagcgaatgacgagcaagggtccggtgtgtctatcggtgcacacatttctgaatatttttgagggggggagatggctgcgctcgctgcggtcgtgacgaccgcgggcgtacgtaacagcgtgaacactgacgtctgagcctctgaggaaaagaggatcacgtaaatcctccacaaggttgagcaaacgccgcatcaggcatcactcccaagtccataaaacaacgggttcgacatgtagctgctcttcccaaggagtaccgatgtcgatgtacgagtaattgtggaaagcgagctgggcctcagcgaggtgcttgccggttactgcgtccgtgtctctcaaccgaagccgctaccgatgggctgaaaccatcacaaaagcaataagttcactttagatcccttcagttgtcactgagtctgaaattcgtccctggatagaaataccgggtattgcccatcccccaactcacaatataactttagttcatcggtagtatagtggactgttttcactaacgtggtaagtgggacctacatgtcatcggccacatcttctccctcctctcccaccaggggcgga

SEQ ID NO: 39394 - DNA, 236 bp, Oryza sativa
gtgcacctgcgttggttggttgcagaagcgcggggggctgttcgtacgtgcgcgcgtgtgcatgctgcatggagtgcaggcctgcgcaggcagccccgtgtgtgtctcctcgtgggggttcggctggctctgcaagcccacctgcctacacaaacaccaacatgcattgatgcgtgggagtatacaggggggagagtgtgtgtactgtgcatgtgggtgtggtactcgtgcgcagc

SEQ ID NO: 39395 - DNA, 1501 bp, Oryza sativa
taaagttccaagaaaaatgaatagaaatagtggtaaatcgagcaagcaaataaagaagaatatgacagaagtaagggatagcaactggtgtgacttttaaaactataaaattagaaacacgaggatgatgataaggtttggtctttcaaattcttaagataacgagataaatatttgataaattttaagtaaaatcatattaaaaaaaatataattttatatgggtgctagctacgcaattgcgcgggccatccagctagtttagaaataaaactagatatgtttggcagattgggagatgcagtttgcagagggagtggattttgatccctcgaggggatgtcccctcgttacttgcatgtcactcaaatggttatgaaaaaattttgagaagatgtattaacatatgaaatatcactgcacaaatatgcaagttcaaattcaacttctatatctcgcaacgaaaaaaaacaaattaaactacaactagttaatgtatattcacagtcaaatttgtttttttcgttacgagatgtagaaattaaatttgaacttgcatgttcgtggagtgatatatcatatgttaatacatcttcttaattttttttaaatttttttttgtaatcatttgaatgacatgcaaataacgagtggatatcctctcgagggattaaaatagtttcctgttttgattagtagtactacatgtaccttttctctctatatatttttttcctgatgtaaacggatggaagtactcaatttctgattgttgttgtacttatattgtctcgggataaaaaaaatcctttatatttctagacaagctgagagagcataatcccctatatacaaggtaagagggagtattatttagatgtaaaattaagggttcgtatctttaaatttagtttcgtgcagggccaccgaactctcaaaaccaggctagcagacgatcgatctcgctcccatggtcgcatggacgtagagaagtcgcgcgcgatctgagaggctgcccacgacatcccggtcgcctagcttgccgcactagctcggtccgtccgcccgcggcccgtcaaaccctctctgcaggtggaatgtcgcgccttcccttcccttctcctcgcgttccatctccgtcgtctcgctcgatcgccttttcatctcgtggctagcgccggcgacgacaacatgcaagcatgggcaggggggagcgcagggaatctgcagtggcagggtcgacatacgttacgtgtaggcagccctctcccgtgcggcaggaagaaaccctggatttttcacattttgatccttttaaaaaaacttatttcgcaaatagacccctaaaaaaacttatcccagaaatagtcctttttggggcgccagagtggctggcgccgtcatccaaccggtcttcctgccaccgtggcgcacacgaaccgacgtgacaggaggagggcgccagcatgctggcaccgccctagggaggagggcgccagca

SEQ ID NO: 39396 - DNA, 1501 bp, Oryza sativa
gatgaaaagtgtttggctagcattttaactctagatctgaaattttaaaaaaaagaaaaaaaatccccaaaccctgacagctcgtgcgccgctggccgccgttgaccgtgcgctgtcgcccgccgccggcctcacgtgccgtacgtgcacccccccccctcccgccccccgcgcgcgccgtccccccacaagccgcttgtgcgctagccatgacagaggtgagtaggggagggagagggagagagaagggtgagtttagagtagttaagtgtcatttttgtgtaaatatgttaaaaagttaaagggtagtgggtcttttgaggtagggtggggtggagtggagctgtggagcagaaaaaccctgctccacccccgcattttattttttaggagtagctatgctaacttcactcccaaaaacagagagtctggactgtttttggcacagctccagcttcagataagttgaagttggaagttggacctatgtcaaacagggccttatatgtagtgcatgcataatttctagtgctatctggtgaaaaaaaaagagagaggttaacttcgtattttgaggtcaaatataaattgaaacacaaattttaaacgaacctatttgtactatctattgtttattctcatcctatgtggttgcatatagacttgttatctcagttgtatgcagattagggggtgtttagattcaggggtgtaaagttttggcgtgtcacatcgaatattatatagggtatcgcatgaggtgtttggccactaataaaaaaactaattagagaatccgtcagtaaaccacaagacaaatttattaagctgaattcccggtcaaaaaaatttattaagctgaattaatccgtaattagcaaatgtttactgtagcaccacgttgttaaatcatggagcaattaggctcaaaagattcatctcgcaaattagtcgcaatctgtacaattagttattttttagcctatatttaatacttcatacaaatgttcaaacatttgatgtgactggatgtaaaatttttgtgtgggatctaaacagggccttactgtacagttgttgtgactgcaggcctgtgcatccttacctaagtagaggattggcacttgatttctacataaaaactagacactcaattcgtagatgcatcgtaaatatttatatgagaggcagcgggcgggtcgtacaggagtacagcggcagagccgctgatggttggtgggacttctagaaagtaaaaaaaaaataaattccaatgatagttatgttcaatttttagaatcccaatgataataaagagtaggcggcggacgggttgtatatgagtatagtggcagcatttgacaggatttttagaatttataaaaaaatgaaaccaacaagacaataaaactgtaaaaactataaggtccattttttaaaggcttgggcttctaaaaagtaaaaaacccaataataatcatgtttggtttgaaaatctcga

SEQ ID NO: 39397 - DNA, 407 bp, Oryza sativa
  unsure (1)..(407): unsure at all n locations
atgcatgcgtctggcaagccggttagtagcacgctttagatccctatgcaagagagcctgccgncggtgctagatgatcgattcgccacctgcaaggggtagaaacagtgagtttaatggatgtgtagtgtataacctctgtttgcgatgcttgcccttgcaatatcaaatattaaggacttcctattttctccactagcgtgttagcactagtgctaattgttatgtggcccagctggaaattaaaagattatgtaacatcaaaacaatgtgtttcaaggaaaactgttagcaattgaaagaatacagtttttcatcctgtggcgttgatgcatctacatgcatatagcttcttgcattttagtcattggcatcagcacatgctaacattgctgagtactactaac

SEQ ID NO: 39398 - DNA, 1501 bp, Oryza sativa; identical to SEQ ID NO: 18949

SEQ ID NO: 39399 - DNA, 1501 bp, Oryza sativa
catcccccacaagttaagaatttagagtctagccaagtgtaatacatgtcccggtgctcaataaccgcgagcacggctattcgaatagatttggtttactcacactgcagtggatgtacactttacccgcactccgtgactgcccagcacatgaccctcatcctaacacatgagacccgtcatggcatagcttttcgataacctcgcattgccagtacccgctccatgaacttaaatcctcatgcactctaggcgtccatgtttctagcagtgtgaggagttctggcgctcccgataaatagaagtctcacacatattaaattatggttcaagttaagttctctctctcacacactcatggcagtcctaccaatggtgacaccgatgtagggcacgcctctcagccctacctcaacggctgtcccatcgtagcgcacctgcctcactcaggggtgaaccatctatgcagggatactgcctccgctcggctatctaatccgctaggtctatacccattcgagaagtacggtgtacggggggttgtttcatgcttaacttcatggctcagtccttaattgaccggggacggtactagcctttcccagataccacccaaatcctccgtccgccccagtcgaaaacaattgtttaattttatttctcctttcacaaatcatgtcatcaacatcatggcaatgtggcgctcatgtctccacatgccgcatctcaattaccttcccaaaggtaattgcccaagcatatagcatttgataaatatgagtatgcatgattctagaatagcatttctaagcaattgtcatagttgactagggactcatacgtaaacatggttacaaagatttaagggtaaacaataatcaaggcatggcataatcacaagtaggatgttcatcattgcatgcaattttatttgtaaacaaaacaatttcgcaattgggatcaacatgttcaaggaatagtgatgacttgccttgctcaggataatccttattattgatataatcttgatcaaccttcacctcctggaagttgcagacgttgcctcacgactaagcgatacacaaggtctataatacgcgagaaaaaccaatattcaaacaacaatcaaatatgcgcaacaaaatgtactattcgtgtttgctaatggatcccaatcatgctaaggctaaagtttcttaatttttctattgtcatcgtggcctatttaggagttaaccaacatagcatttatgggatacatatatatttggctaatcggtggtttagtctatcaaatggctatggaaggattatggctatgtatgcatctatctaaataggacggttatatactagaggttctgttgttagatggatttaggatcaatcaaacaattatagtgaattatttgtattattattttattgatggaagctttactttaattatgaacatattttacttgccattataaattataaaagggctaataattatcca

SEQ ID NO: 39400 - DNA, 1501 bp, Oryza sativa
tacgctatgagaaacaccttacacttgcccttgaccgtgggcacggctgttcgaacagttcattaatctctgcagaggttgcacgctttacccacacgagacgaaactgacatcgtttacccgtcggcaatgaaagttcgtgataaggcctttccaaagctaacccatgaaaatcgcatgccacctagttgggctaagatccatagccgagtatcaggcaatgatagccgtcatccactcaggaaatactgaggatgcctcctactcctactggtaccacgccacaatagaagcaaaaagacacccatgatgggcaaaaatgtgtaacacttcgtctcctcatcctcggcatcccacaaccattggcacaccaactcccatgtgataacaatttacttagccagaggcatcccataaatacccgtgtggtcgcactgtaacgtgtttggatggatttcccaaaggaattggtccttaacgacaatacgtagccaaaccacaaaggcatgactccgcatcatcaccactttcacaacacattttatttcacaactactcagtacaacgtaccggatttttaaacatgtatttggaataacccaagtttcccacatggcaaaacctcggtaatcgtataacaataccggcacaaatatttgtggagctatcaaatgtatggaatcatcaacctatgaaatataagtacgactactaggttggtccattggttgaataaacaatccgaggcctaacatgttaatcgtgtaaactaaataatgcatttttgcaaacaatgtatcattgaaaatataggggtaatgtgatcaaagaggcttgccttgcacagggtgcgggtcttctccctcgaaagcggcgtccgaagcttcctcgtacttaggctctaaacgtggaaacaaagctaattaagaaaagccaataaatctagctcaaatcagagaaacaatagtggcactgtgtagatttcaattttagaaaaatttaggaacttgaacggggtcaatcggagttacggttgattttctacgaatttctaaagaataaaagaattttctggaataacaatttttggacggtaagggaatattccgttggaatattccgttagctgggacggcagaagaggggacccacctatcggcgatggatgggaggaaggatgcgcgggcccggcttgtcagtgggggatggaggtaaaaggggcatggggtcagcctgtcagcggctcggctccgccttcttcttcctcctctgctcttttgctcggctcggtctgggatggcgacgcaccgcggcagcgagtcccggctcagcgaccggcggtcggggaggcggcggcgaactccagcgaggcaccgccggcaacggcggcgctaggaggcgcggcgcagcggctctaggcggcggtacatagagtgaaatcgtgagaaagagatagaagagagagatggtgatggtgtggggagaaggagctcgggctgct

SEQ ID NO: 39401 - DNA, 1501 bp, Oryza sativa
gtattggcaaaatggcatgaaattaaatatgcagttaacggatttaggaaatccgtgaggtcttgaatagactccgtagtgaagttgcagcatgtaaatctcgtaccaatgggtattctgataagagtaccatttcccgttgggagaaaatctcattgatggatttttctctgaggggagacctcattgatgaatttttctctgagatacaaaataattagtaagtctgaacacaccatattgtataatcccttggagggattaagacccatttatgacccggtaagattgcgatgaggaacctgctaaggtatacttagtgttgttggctatgtgttatctcccatagtgcttaaattttcagactagctagttactctgatagttacaacatatctttggaaggcttgtagttgatcttgtggatctccaattgttgttgacatcgtcagagaaagttgcaatgatcaagagatgtgtttgcttggcacgtggcctaccgatgaataatgcggtcgagagatgtgtttgcaatatggggcgagatgttgccacaggcagcctagctagctagcttacgaccggcaccgtgcccgtgcagcagccgcaccgcgtcatctctcaaatttcggaccacgaactcgaaggcagccgcggctcctgtgccgcggagacgtggagacctggagaaaaacggcatctcgtcgcctccggccgccacgtgaattggctcgatcgcggcggaatggcgtacacgccagcgcgcgcggatcaggcggtagcagagcgctttctcgtcgcccggcggcactggcgggcggcgtcgagtggagtggaccgattgattgcggcagcgactgatggcatggcttgggtcgtgcctgtgacggcccgccacgaatagaggccttatcgcgctttcgtcccgtacgtgcttgggcctcgttcctcaccgcacggcccggaccattttctatcttgtgcggcacaagagtgccctgtatgtatacttgccacggaattcattcctggaacaaattttactttcgcttttccctttctcttttcctttgcgaaaacaaaaggagtagttattcgatctgtgatctgtgacgtagagccagcaacgatcgaatgcatatgcatcgatgatcattcgccgatcgcttctttcccgaaaattcattggcggatcgcttggctctcaagtaaaataatatagtactatttagtactccccgtttcaggttataagacgttgatcaagatcaaactgttttaattttgattttaacttagtcgaacttgaaacatcaaactcaaaacttcaggcctgttcaaattgtaatcaaaataaacattaccaaattttgacaatattaccatcctagcaaaattttggtatcctagcaaaattttggcaataccgaaattttggcaggatttcttatgtaattactaaatttggcaacaaactaaacgtagatatttttttagcaac

SEQ ID NO: 39402 - DNA, 1501 bp, Oryza sativa
agattgattgatggcagttgaagtcgttcaactgtgttaaccgattgtaccgaaatttttacaatttggctcttttaaaaaactagttaaaaaataagccttttgctcagcgccaaccttaatggtgttgtgataaaacatctcagcggcataaccattggcgctgagatcttattcaaggtggcatgatttcgccatgtaatcaggcctcagtgccaatttagttggcgcggacctcttgacattttaaataaaaaaaaggccatgtataaacctcaacgctgctagcctggtggtggagcccttgctttgcatctggcaggtttcacattcaaatccctagttctactttttatttcctacctgccctcctatttttctttttaagaatttggaatgagcagatttgatgatttaaattattgcatttgtcttagtaaaatatttagcttaatatctactacgaatttacaacaaaacatgtgttttcttttaaaaaaaatggagaacaaaaacctaaaatggtaaatattatataagtgaatttcaattttcaatttcaaaaataaaatggattttgaaaccatgcaattttttaataaaaaaacttaagcagaaagatgataaattgagcactgggtaagtgagaaaaaaataggaggctatggggttcgaaccttgaacatggatgaagcagcaaagtggacttacaactgagctgtacccttaaatctaaatactatagtttgattctgtatacttatatagttcatcccactaagtttagttaatactatttctatcttctctcattaagccacatcaccctaattatttttagcatttgaatgatagatttatagttcaaattgtctcttctttcttctctcataaaactatacaatctcaattatttttagactcaaaattcataagtatcaaaatttattttagtttcaataatcatatcacatcttatttgtacatattaggcaccttaatttcccgtagcaacgcgacgaggtattcatatagttatctatatatcatacactaaggtcgtgccatctcaggtagaatgttagcaccaatggtaaacatctcagcgccatcatggttggcgttgagtaaacggctcatttttgcaattagctttttatacgagttattattgcaataaattttttaaaaggatcaaattgtcaaaatttcggctgattgtgagtgcatcactttggttgtttttggtgtgtggtaggtgcatttgatgctaccggcaagcatttgatgaaccgattgtgagtacaatggcgaagattacaaggtgaaaagattgatccattcatcgagattcgacaacaccgcactcgtatgtcatcctcttattagaggtgttatttcaggttttggatgaaaatctagatctatcttcatatagcaacagcaatacaacacactcatcaaatccttgttgaacacctagagtgagtgatgtgaacca

SEQ ID NO: 39403 - DNA, 1501 bp, Oryza sativa
gaactcggcaatcaggggtggtttcttgatataccaggtgggcatagttagggggtattagccacatagttgtaccatagaaagtgtatactaaaatgactatatatattagaagtacataaatggtgcttttattacttcttctctgcttaacctagacttatattttagtaagagtattttaaactgaaccttctatgtgtcaaatctatccttatcctcaactgattaacccatgcataagactttgatttacataagtaagataagaatttatagcatagtactctcttaccatatcttcccatggaattaaataaatacgataccttggaaatacttacgggtgaaatgctatagcggtatatcgtgcgcttgcggatttatttctgtaaccataagaataccgtctaatatttctgccaccattgttggggatcatattcctagtaatgtcgttaagaaatatcaacaggtataaatatcaacaggtatatcggtgaacgtcgcctccatccatcaatcgagttatccaccacctctcatcgaaagattgggaacaaaccttcacgggttcatatcagtgagcttccccaaggtagctgatttgttcttgttatcttaatttattttgtttttgtttcatttttttggtatattcttagtaaacatagagactaggttaatttcatttttttatgaaatattcctgttttttttaaaaaaacaaccttgtcatgttatcttataaaaaaggcaaccttatgttatcaatatgatagttcctcaaaactagaatgtgaaagatggacaagtccttaaagtggcctcattagcagaaaacgtgtagtagatattatcttcttataaagttgatgcccactaacttctaaaactcaacatgcaaatgtgtcacatatcatccactatcaattattatccagagtattttaaatcacatgtgtaaaatcaaaggtgtttttgattattattctgtgatgaacaattggcataggagattattggttttgttatttggagtttatttacgaagtggttttggagatgattggatttacaggtgaatcacaggtttatcattttatgtggaccggtcagaccgggccggtgcggtcggtcagaccggcgtgtaatgcgtggtcagactggcgtgtaatgcgcggtcagaccggcgcagcccgcggtctaaccggtcgacgctgtgtcggtttcggtttcgggttgtttgtttggatatccgtgattatttcatgattatgacttctagatggatactatacatatgtaatactattgtttgctactaatgagtgaagttggagatagcttggtctcggaatatggtttctttgtttatttcatgtgcaggtgactcgatgcctcgggagagtatttgcggtgatggaccgggagtcggcttggggataagacgacgtccgtggtggtcagagatcatgcgggatacttaggctagagttga

SEQ ID NO: 39404 - DNA, 1501 bp, Oryza sativa
tttggctgcttggcctcaataccactataatgaaacagatggaaactagttcaagttaagaaagcatgagtaataaaattgagcatgagtgttgtccaggcgtacatcttctccaaaacaatgcccttggcatgagatgatccagcaaagggtttcttccactcattgccaaagtggctcttcttgtatgccttgtcggcccatctttggttcctgcggtgggtcttgagcttgcgcccagctcccataccacatgttttcttgcaatgaaatttcaggaccaacttaagacaaatgctacgtcttacgattttgccaaacatctcccgcgtgatttttttcctggcatttgacgtttttttggccacatgatctttgcacaaggcatagaagcccacgaacagcccagcagcccatcatcatgcctaaccctgattgctaactctaaccccggtccactcactgccccacacgaccacgcccgcactcgttccccgttcacatcacatcgcacacacgccacgccgcttggatctgggtccgtggccagcacccgcaccgccgtagcgcgcgccaacgacggtgctgacgtggccgtcttccagcagttggtgcgcccgccctcatctgtcccccttctcgtcgatagatccagccgcctctttgccttccccacacgcatggatccatcagtgacggcgacgggaggggctgatccagcgcccgcttggtgatcaggagctctccgtcactctcccacttctctcttgtttcctctactctctctctctctcccactccgatctggcaccccctccttccccgcaggccgcacatatcccaccgcctatctacctcacacgcgcgtggcctgatccgctccctctcccactgacaatgcgggcctagtctggcagtcgcggaaacggacactacggttgctgtctttttaagatgctatagataacaagaatataaggtcattcacaatgcatctacatggcatttggcctcaactctccaactagactgattgtatacgtggagaagaaaaggaggtggggcccatgtcttcactagcttcgcgtgtccgagagcctcgtcagaagaaaacagctttttcaatcgcatctcagcatctgcacgtgagaaagcatgacacaaagagagaagggggagaagctcaccgaaaaaaaggtaattacaaagagagaagggggagaagctcgccgaaaaaagtaattttagtgatggggctcgcataggaaaatgtttggtggggtccacctgaatccatgccgcattgtggagaggaggagcttcgctgttttctgtacgtggctgtttaggctcctcggaaaaacaggacgcattgctaatgccccaacactcattctaaagctaagagcacataacgtggcaaatggaacattccctgcaaaatgcccacaaatcaagagaagtgaaatttaatggtacagtgtactacaagcaacacaat

SEQ ID NO: 39405 - DNA, 1501 bp, Oryza sativa
atgtatgcgcaacagtacatgtcacaaggtgaaattgcaagaagaaatttatatggttcaccaaagtggttggccgtgggctggaggtatataaatcagctcctagccccaaaatgtcactgtttctaaattgtgatatcaattcaaccgagcaggctgtgtacttcaaatgtttcttattcttttgttctacaacataataaagctgcctatgggctatggtcttgtgtctgtagaattgctgtacgacaccatgtaagagttttcccttgtggaaggacatttggtaccaacagaaaacatgaattattagtaattccagtgctcttatgtttactcattcaattatgtcgatgtacaatgcactacttggactctgctaactgatatgaatttcggtgctttttgctaaacgcatttgtgtaacttgatcgctttcacatggtagtaagacacgaaaaggtacaatagtttagaaagagcgcgtaagaaaaaattgcatgattttgaacatcatgtcatatttcttctgaaattttctacggagcaaatcctttcataggccaaaaaaacaattttaattggaaatttggaatggttaattgattatatatgtccgaggtgagaaaacaaaaataaaaatcatgccccacctacactttataataccgttcattttatcccctaagcttgatttgaatgttgttggtcttgcgtatttaaaagctaaaacgagctgcctcgaatagctaatataacagatataaaactcaactaaattatatacttcctccgtttcacaatataagtcattttagcattttctacattcatattaacgtgtctagattcattaacatcaatatgaatgtagaaaatactagaatgacttacattatgaaacagagaaagtacaaattagataaaaataattatgcaaaaccatgttatgagcttatataaatggtattagaaaattcagggagttgaactagaaagcaagagcggcttcgacgcgcatatttggtgatgggccattattttcgccatgtaaagtgtagatgagccagtccaattagacccaatgtatgaatatatgaatgttcttattattagaaaaatagtccgcaaagagactttaatcatctaaaaatataaaacaagcgaacagatatacgagcattgtacagtttctgtaatgatcatctctaaacataatatcctcacttttcaaaccatcaataatacaatttgttagatcattccttcaatccaacagcaaacggagcatcccattgtgtggctctcaaaaaaatgagctgcaactatagctatttaaggattccccataagcggtgggaaaaggttggtctttcatgtttctactatccgttgctggacaatactcctggacgatcatcgcggaaattgtattgctcataaatcttgaacagcatctccctgcaggggacaccagctctatcttgacgtaagctaggaa

SEQ ID NO: 39406 - DNA, 827 bp, Oryza sativa
cattcctaaatctactttttggagttctattctgaaaattagacatcttttggataattctatcatatggcaacttttttaaggtgatatctcaatctggaatcaaccttggtgttctgtttggaaatcccttcctaatcatattactgattctgcaatgactctttatttacctacaaaagtttctcatctctggaatgataggaaagaataggatatttccaaagtgtctcaaatctttgatccccaagtttcaaatgaaattttaaaaactccaattgtgcattctaatactgatgacaaactttactggattcataactcaaaaggtatttgtacttctcaaagtgcttataaagtcttatcaaccaactctatgttacctgctgctaatatttcaaatttgcaattaaaccttttaaagaaaacttggaaatgcaaatttattcctccaaaagttaaaacctttatttggagacttctcagaaatgctcttgcaactgcaaaaaatttgaacttcagaattcctactatttcaaactcctgctctcgttgtagtttgtctgaatcttgtgctcatctgttttttcaatgtgcttttgcaaatctggtttggaaactgtctgaatttcatttagatacaatcatcattgcatccatgcaaaacatcagtgatatcttagcctatgttctagctacaaacaactctgaattaagcctttaaaaagcttctattcttctttggatgatttggaaagctagaaatgacttctactttaaaaagaaaaactgggaacccattcaggttaattttgcagctcaaatca

SEQ ID NO: 39407 - DNA, 1501 bp, Oryza sativa
  unsure (1)..(1501): unsure at all n locations
tgttaattaagacacaatcccatttcaaataatttggagcaagaaaactggcagaaactaagatcaagttcttgacaggctcctaacaccaaaaatattgtatgctaccatgcataggttctcagattcaagcatttaaaccaagggacgggtgattacacagcagcaaagaattaatatcgcttatgaaaatgtttatcactgacggtgtcaaatctgaccagcactggaccatcaataagctcacattacctacatctaccgcaatctcactctctaccaatccaagaacacacaacaaacgaatcaaccaaacatggcccatagctacacttcttattacaaactaaggcaaagagatagagaaaatgcttctagtgaagacacatgttaacacgagcgaacgcaacggatcgttgcagaaaccactacaatggacgaaagagaagggatcttttgcacacaccccatggcggcggagggagaggccgagagatctccgaacggcgatgcgagaggagggcttcaatgacggcggcggctgaaagtggagtgaggaaggaagacgagggagattctatagtagcaaatctcagcgatttagggttagcgtggtgcgcgctgagattcgtgttggggtgatgggtataatcccacagtcctcgtgaggtttggtgagagactacgaggcggctaggccagttcccggcccaccatgtcattcattgtgtgaacaggtccaaggcctcctattttaaaaaaaaaaaatttcgggccaatttgccagtagatttttagtttgttttctcaccttggacgtatataatcattccgatgagcattaaattttttttaggggccctatgaaaggatttgatccgtagaaaatttcagaggaaatatgacatgaagttctaaactattgtaactntggaaaaaatccaactacccctctaaactttgattggaagttcattaagcaccgtgtactttgaaatcggatatctcttactatcgaatttcatgcccgttctcgagcgattagccccgccacgtggcttcactcgattccagggttcgagtcgtgcgcgcatccgttggattagaaatcaacgggagagatccacaaaaggatctatttataaattttaatcttccaagggagtttatctcaaaatgtggcatccatcatccagattccagagaaatcctttcctcccctcgtctcgccgctttctcctccgccgaatcgccgattcacaagccgtcaccggcgttggtcaccgccactccacatcagtgcgcctccctcgccaatccccatcccctaaaatccctagcccacagctccaccatcgtcacttcacctctccgcgcctccgcatctcgcgagctgagcgttgtcgcctcctcctcgtctcctcgctcccttgccgcccgtccgcttccctggcgcagctctcaagtgggagggctgcgcgccggctggaagtctcttgac

SEQ ID NO: 39408 - DNA, 1501 bp, Oryza sativa
aaagaaaaagaaatgaaaaaaatgtcaccacccttcttgtcgaaacaagattttggcaatactaaaaaggggtggctatcaagctggaaaagtggatgggtttagagacaagaaattttatacaggttcaggccttcttaataagaagtaataccctacttctgttcgaggattgatccgccgagtgttttattgattgtatgatctgagagaaaaatcgtgccccaaaagacacccggacacctccttatatagggaaaggggtccgtattacaaagtacaacccatatccctaacggaataggtagttacagataagatacaatcgtaaccgactaggatcccgggtatttccttgacatagaagtttggaatttaacccgattccctttgaagatattctatctatacatggcaccccatacctaatcggatatacatgtcgtatgggtatggggtatccataatctccacagtagcccctgacacctttacagtcgatgaaatagtcttctctcgtaattcaaatgataatccgagtgcttcaacttcctctgtcttagtcttctgagtagatgcatctaattaggtgtagcccccgactatgtgattagttaaataaaacctaaacatatagtcaaagtgcatcaaaacatccatccgagtggttttacaaccgaatcacccaagggattatatggctaagcatgtgtggcatctgataaaacatccagccgactgctttagctttaatgcgccaaaaatgaggtatagaaaaggcccgagtgagaaacactctaaaggtctataaaccaacatacatgataaaaatccgagtaaaaactctcaaaaagactcatcaaatgtggtataaagcatgataaatgatgagtctaaatagcctaagctatgacccacgccattattaaggtaagcatataacatgctgagagaatgaccatttaaaattagtcatctcaataaggcccgaacagctttgtagcctaaaaaggccaacaaaattagtataacacttttctgttgggcacccttttatttgcattgtagtaattccaaagaattatctaactacgtcaaaaaggattttagcagcattgggctattctgtcgtgagcaacttttgccaaagcaaaaatatatacctaagtccctaaggatcacaaccagccacgctgataataaaattgggctgaaagtattgtttaggcccaggcccataagcatctcccgataccttagtgaaataaacgctaaaatagagcgccgtttcgtcttccccgccgcgatcctctccattttccccacttcccgctacaatgcaaatactgcgccggcggaaactagggttcgcaaatccgcaccattccacccctctcgaagctccgttctcttgcatagatcttccgtacatccatcgcaccaatatcctcttcattcgctgccgccctcgctccaaatctaatcatccatctcgctccca

SEQ ID NO: 39409 - DNA, 1501 bp, Oryza sativa
ggtatcgggagatgcttatgggcctgggcctaaacaatactttcagcccaattttattatcagcgtggctggttgtgatccttagggacttaggtatatatttttgctttggcaaaagttgctcacgacagaatagcccaatgctgctaaaatcctttttgacgtagttagataattctttggaattactacaatgcaaataaaagggtgcccaacagaaaagtgttatactaattttgttggcctttttaggctacaaagctgttcgggccttattgagatgactaattttaaatggtcattctctcagcatgttatatgcttaccttaataatggcgtgggtcatagcttaggctatttagactcatcatttatcatgctttataccacatttgatgagtctttttgagagtttttactcggatttttatcatgtatgttggtttatagacctttagagtgtttctcactcgggccttttctatacctcatttttggcgcattaaagctaaagcagtcggctggatgttttatcagatgccacacatgcttagccatataatcccttgggtgattcggttgtaaaaccactcggatggatgttttgatgcactttgactatatgtttaggttttatttaactaatcacatagtcgggggctacacctaattagatgcatctactcagaagactaagacagaggaagttgaagcactcggattatcatttgaattacgagagaagactatttcatcgactgtaaaggtgtcaggggctactgtggagattatggataccccatacccatacgacatgtatatccgattaggtatggggtgccatgtatagatagaatatcttcaaagggaatcgggttaaattccaaacttctatgtcaaggaaatacccgggatcctagtcggttacgattgtatcttatctgtaactacctattccgttagggatatgggttgtactttgtaatacggacccctttccctatataaggaggtgtccgggtgtcttttggggcacgatttttctctcagatcatacaatcaataaaacactcggcggatcaatcctcgaacagaagtagggtattacttcttattaagaaggcctgaacctgtataaaatttcttgtctctaaacccatccacttttccagcttgatagccacccctttttagtattgccaaaatcttgtttcgacaagaagggtggtgacatttttttcatttctttttctttcttttaccgtgaattgggagaatgggaggggtatattttggactgagggcaatctggtcattttttgaaaaaaaatggttgtagcggtgtggaatcaacggtaagttgacggtgatggcatttttgggagaaaaaggcttgtacgatggtattttcagaaagttgctcttgtcgatggtatttctgggattagtgtactcgccgatggtatttcaaggattttctgatatcttggatactctagg

SEQ ID NO: 39410 - DNA, 1501 bp, Oryza sativa
cccatacccatacgacatgtatatccgattaggtatggggtgccatgtatagatagaatatcttcaaagggaatcgggttaaattccaaacttctatgtcaaggaaatacccgggatcctagtcggttacgattgtatcttatctgtaactacctattccgttagggatatgggttgtactttgtaatacggacccctttccctatataaggaggtgtccgggtgtcttttggggcacgatttttctctcagatcatacaatcaataaaacactcggcggatcaatcctcgaacagaagtagggtattacttcttattaagaaggcctgaacctgtataaaatttcttgtctctaaacccatccacttttccagcttgatagccacccctttttagtattgccaaaatcttgtttcgacaagaagggtggtgacatttttttcatttctttttctttcttttaccgtgaattgggagaatgggaggggtatattttggactgagggcaatctggtcattttttgaaaaaaaatggttgtagcggtgtggaatcaacggtaagttgacggtgatggcatttttgggagaaaaaggcttgtacgatggtattttcagaaagttgctcttgtcgatggtatttctgggattagtgtactcgccgatggtatttcaaggattttctgatatcttggatactctaggatgaggtgctgattgttggattcggttggaaagggcatgccttgggagatattccaggtgtcaggttgaaggttgtgaaggtgtctgcagtgtcactgctcgcactcttcaaggagaagaagaagcagaggtcttagattacttttgataggcaaaaggttggactagactgtcaaggctctgaatgttttgagtaggaaagatcctagctatgttgggaatccccgtggtaactcaagctttataatcgagaattgttccttctcagctgttgctttggttaacagtactattaagagttttgttcccttaatctggatatatattaatattgcgctcgctcctcccttgtgtttgctagttttctccgtctttatatgttgattatatcattgattgtggttttttaggcaattgcacatttgactctattttaaagcgtaactaccaatttaaccctactttttaagtttactcatttgaccctattttctaaaagggaacatcagatgtgaccctatttcgtgaagccaagcaaacggtgttaataaaaggaaaaagagacgtttatacccttctcatttgacctagtttctatctacccagacttcacacgccggcgagctcccatgccgcacagggcaccgctcccttcctccgcgcgcatgctgtcactgcccgccatccacgcgctggcctccgcctccctccgcccacgcccctctgccgtcagtcgttctcgccacacagggcgtctctcccttcctccgcacgcacgccgtcaccactagccgtccac

SEQ ID NO: 39411 - DNA, 453 bp, Oryza sativa
atatgtatatacatatagatatatataccatgcacaaaacagcgccatgcaaataaaaaaaatggtacaccgatctttagtcctggttattttactcgggactaaagatagctatatttagtcccggattcgtagtcccgattggacaactgggattaaagggggttacgaaccgggactacaaatagtttctccaccagtgtattttaactgggattaaagatcgtcatctttagttccggatgcttgatcccggtttgcatcctggaactatatgaggttacaaatcgggataaaagatggtttcttcacccgtgatcttttgttaatcgggataaaagatggtttcttcatccgtatcttttgtttgttacggatgggcgagctgttacagatgatacttgagccgttacaaatagacaggtttgtgttagtggctgctagttgcatgca

SEQ ID NO: 39412 - DNA, 370 bp, Oryza sativa
aatattcaaatcgaagttgccgatatgaaccggaaagtccgacagctgagagtaaaacaataattatgaaattttagctcaaacaaacaatatgtacatgaatcaaaaggtaacaaacaagatatataagaaagatataaaatcaccaagtagattaattaagcattcaaatatatctaagcacaatatgaacaaggcaataacggacaaaccaagagaggagacacgtgatttatttaccgaagtttggatctaccaatcctacgtctctattgaggggctacaaaggctgggtctctttcaacccattaccttacgtggttacacaaatacactactcgattttactcttgctttcttccaacacaga

SEQ ID NO: 39413 - DNA, 1501 bp, Oryza sativa
gttttaggaatagtaatcctaaaatttggacagtttcagttgtgtgaaaattgaaaatttcagtttaagttttaggaagaatattacctggtgcaaatattccaagaaaaaatccactctttaccaaagtactacctccgttccagtaaaaaagaaaagtactacctccatttcaggttataagactttttagcattgtccacattcatatagatattaatgaatctaggcacacatatatgtctagattcattaacatatatatgaatgtgggcaatgctagaaagtcttataatatgaaacgaaggaagtatcaggcagtagttttgccgatacattatccagccttcgcaagggcagaatggtctttacaccatgtccaatggagtagagctgacagagcagtgatggtgatggcatttctgagagaagttgattcgcacgatggcattttggaagttagattcgtcaatggcttttcttggattagaacactcgtcgatggcatttcatagattttcactttgacgtaataattcaatactcatgtggtattcctccgttagagaacatgtaagctttgaaatcagtcgagctttactgtggtctaaatcaactatgcaattctctgtagactcaagggttaattagctccttgccactacaaatataccaaattagaaaaatattactactattcacgatatcagcaacgtgtcactggaatttggggaaattggaactataccactccgttgcattttccatccacttttctatcatccccgttaattctatctgccaactacggtggctagccaacaacgactatgcagggtgctcaactgccgaaagctgtcggacaaggcgtgcgcgcacgaggcacagaatgagctcatcccgctccgtgtggtggtgcaggttctcttctttgagcatgcgcgcgcggtgttcaagattgccatgcatccgatgaagctggaggaggattgatgaggacatcccttccaacgatacaaccatgcctattgcacaacaaggaccaatgactagagctcgagctcgtgaacttaattatcaggtaaaaccattcctagctaatcatacaagttcttctcagaattgggtgctactaaatagttgttgtgatctacttgttgttaggaatatgggagaggaaccagatcgcaagcaacactagcaatgctgatttgatgaagtcaatgctcttcactccggagggcaaacggggcaaatgagtacttgttggaaatatctcatcgtctactttcagctatgtatggcctcaaatttgacccaggctgctcagaatgacgaaaataattcttcacatcagaaacttgggcttgggccttgtatctttacagcccattaggggtccacaaaacctagggtttgctcccacctcctctcctgatcattcctccacttatataaactcctagcagccaccattttgcactttgggttttgtttggat

SEQ ID NO: 39414 - DNA, 910 bp, Oryza sativa
tgtaggtaaaaacaaagaagtgataaaatctctcacctagcaacttgagctctgataccacttgatgcagcagcaggggttcccgatctttcgataagaggaggataaacttcgatttgggggaggacacgacgttggcgatccgactacaactaccacagaggtgctgcgccttagcaaccggtacactgactccacgttgttgctgttcttaccgtgccaagaacaaccttgaacctgcaagcaatcgaagaactagcaagaacaagttgacaaggaaacaactcacgtcacttgtcaagtgatgaaactgaaacaaaccagaatggggttctgaatacaagtatccgggtggtctagccgacacacgcgagtacaaggaagtagctgcagctaaacttacatccaaacaaaacccaaagtgcaaaatggtggctgctaggagtttatataagtggaggaatgatcaggagaggaggtgggagcaaaccctaggttttgtggacccctaatgggctgtaaagatacaaggcccaagcccaagtttctgatgtgaagaattattttcgtcattctgagcagcctgggtcaaatttgaggccatacatagctgaaagtagacgatgagatatttccaacaagtactcatttgccccgtttgccctccggagtgaagagcattgacttcatcaaatcagcattgctagtgttgcttgcgatctggttcctctcccatattcctaacaacaagtagatcacaacaactatttagtagcacccaattctgagaagaacttgtatgattagctaggaatggttttacctgataattaagttcacgagctcgagctctagtcattggtccttgttgtgcaataggcatggttgtatcgttggaagggatgtcctc

SEQ ID NO: 39415 - DNA, 304 bp, Oryza sativa
agattattagattatagtaatatggcttatagattataataatctatcataataatctacttgtttgtttcagcttactcttaataatccagattataataatcctaagctgaaacaaacaggaccttagttcttgttgttcgatcctacatcaatgatgagttctccacaaacgacttatcagtatctatcgaaagatcaggactatgtctcatcattagggcccttttgaatcccagggttaaaaaaagtagagaaataggaaaaatacatgattctgacatgaattaaagtataaaataga

SEQ ID NO: 39416 - DNA, 1501 bp, Oryza sativa
tgagatatcatccaccctccatcactgtgatctgttaccaatttcctggacgaatctgtccagtgatttggaatctgaatctgaatctgaattgctcggggattctgctgacatcaccggcaaacaatggtagcctgacatagattggagtctcataccgaggtggtagctgcaccatggacatcagatcaaaggtttcccttgccatttggggagggattaccgctacctgaaggtatcatagttatcgcggtaacctcccaattatctaaaaatcaagagggttaacgtgcgaggttaccactaaccaacgagttcagagcaaagcaaacaagagatttgtctggaactgtacaatctaccactgcgtacaccagtacaggggctttcagcgagatgatcatccatacaaaaattacaggaagagtggcaggctggcagctgctagctagattagtgtcagagcaattcgtttatgaatgcattacaatcatttcgtactggagagattcatacagcgttcatgggtactgaaactgaaacaagcagccgcactgagatgtttgctccttccaaatctcaaaacatttccttcgttgaaataatccaactgaactaacttaaagctccttaactgtaatcaaagtgcactaaacctgcaaatgtagctctgtaaccaacagtcatcacaaaagtgcactagtaaatatgttctttataacaattattcaagggcatgaacgaattaattatatattagaaagttgatttaaaaggttctttaagaaatgtcaatggaaaaaatttacaaaaaaaaaacatacatttaggagcttaggaagcatgcagttccactagactgcaagataaggactgcacatgatgttggtcatctatttttcctatggagggtttagatttaaagctacagtcagtaaaagtgaagattttttttggcttggataataacttggatgatctgaccgttgaattttcatcggatggtcctagtgtgcactagggactgcaggtgaaccgaatccatgcccgtgacaatccataatccataagcagaaaaggatgacttctcgttcagaaaaaaaaaaagatggatgaaactattatatgttccttgcattgatcatccagcacgtcgtcgtcctgagcaagctgccttcattttccaggacatgggtgcggaagctcggcgattctgctggcatccgagctcgcacggttgcacaaataaactcttcattgttcacgtgcccctcttgctgtacatgttgacaatttggcatggcgcacaagttgaccaatttgctcgccattgtcaggctcgatgcaatctcgaattcaaatgttcatcaaatccctcctcaaccagtttacggcatatgcagtgtccacaaatcaacatacatgcacgaatttcagagaaaaggtgttcaaatttacagctgaacatgtagtagtaggagcaaatgcaggtttggcaggg

SEQ ID NO: 39417 - DNA, 434 bp, Oryza sativa
tgctaagtcttctagtgctatcaatgtgtctaatcatcgtgaaaaatatacttgtttttttttagcaaagatggacatattgttggtttttgtttcagattagctcagaaacagaaaaaggagagagagatgcttttgcaaaaccaaagtggcgaaatctagtttttccctcgagaaaaccagtcagaccgcagtgggtccgcggttagaccggcgacgggtccgaccggctgcagagcctcgctcagaccggacaccggttagaccgtcggtgcagcggcggtcagaccggcccccggtcagaccggccactgtactacggtcagactggcatcggaggaatttttctgaaaattctaaaattgattttgctcgtggatatatgcctattggatcttctggtcgtgtgtctcagtactggactcctaaatttt

SEQ ID NO: 39418 - DNA, 464 bp, Oryza sativa
tgtgtgtgtgtgtgtgtgtgtgtgtgtgtgtgtgtgtgtgtgtgtgtgtgtattcatgatatcctataataattaagaacctttgcaagatatcagtgttaaggaggtagattccctcaaagtcgactttgtatcaaccacatgcgatggtgcttggtgtgcctacattaagtctcctgagattttaattctaaacttgtcgtatgtcaagtacaaatggactaacacatgtgaagtatgtacgctaacatatgggactccatgcgtaccatttgaaaaaacagaaatataatacttaatgtatgtacatcaaacttgtcgtatgtcaagtacaaatggactaacatatgtcaagtatgtacactaacaagaatataataataaaaatgaagaggattcggacgaatagtggtcatatcatatcttaaaccatattttttaagcgggtgcatatagtgtacaga

SEQ ID NO: 39419 - DNA, 1501 bp, Oryza sativa
agtagatacagtcatacagagtactacttggttgagattagtctagttggtatcgtacctgaagaatttggtaccggcaaaacttggattgaactgatgtgtatcttccatccttctgaaagtgtattatcttcaagaagagaattaagattgcttagtggtactgattaagctcgttcttaaagcattatgctgtccaggtacaatgtgttttattatagggatgctaatgtgatgttacataggatccgacttctgcattactgctagctgtgcatgcatgcagctcaaaccatggtctgaaagtctgaaagactgaaactattcaacgagtgaatgcatccatcgtatctcctcttatttcttctgtttttgaatggaccctagttctttttgccgtcatggtgttggttttgagaagatgcaattggtgggttgcttggtcaaatcgaactgagatggcttggaaacccctcaaaaaataatgtacacatggacccatccccaatgctgaaaccaccttccagcctagcattgccaactcaaactaggaactccccaacctcacaaaccaaaggctatgcccacacaacactagtactagaatgcaacaaacaatactagctcaaggatagactaacatattcctcttttccatttttttttgcgaggaattgataaactgacttcactctcattatatttcgtcaatattattggtattcaaaccagcctttacaaaaccacgtggttacctcatgatttaccgtggtaaccatgcacgaccggttttttaaaacctcacattttttttcttggttatctcccgataaacacatggttaccgcattaactgggataccatcaattagcggtgaccctactaaatttgcaagaaaacttgatacaaacttataaaaagtgtatttcgtcaataaccatcatatgcgtggcttgaaactaaatggtcttcaatcagttacacaatataatttcttaccaaccgatatagatagggacatgaatgtaaattaggcttctccagaaacacggagatgataacacacgatatatgattccgaccgctaaaaagacatatagcactaaacagttatataacaaaaccatatggacagatttttcacattttgatgctctctaccgatcgatggtcccaccaaatatgctggaagatgttccatcatcagtgatgcttcttgctggccgggttgctctagcatagctcaacctctaaccgccactagttttttatactcttctctatagccatttaagctctctccctgcagcttctcacaatccaaaaccccaaaaccttctcattttttttgtagaccaagccaagctacagccaaagccaagcatggtgcaacaacagcagcagcagcagcacagaatctacatcctacagttcaggaagggcgagcaggatcaggaggtcgcatgcaaggtctcgacgccgcccaaggccggcaccggc

SEQ ID NO: 39420 - DNA, 442 bp, Oryza sativa
tcgactttacgcctaccatggggacagatatttttgcacgtgcattaatcgttagcaaacatattatcagttaatattggttttgatttcattttcttgtaatatttgatggaacattatatgctgtcaaatttcatttttctaattttcaagagtatttaatttggatgagaataatataaaaaaagggatagaatatatatggtttaatgtgatatttttttaatcaaaatatcgttgacatattcatatttgtaaattttctatgaaaaggcgagagggtggaccgatcgtttgtatatcaatttaattttttatttaagaattaggcgggaaggattaatattttcgttagtggtacgtagtctttacaaagtacgtacaaaattacctcctgccgattctgaccttcttctcctatgtacgcatgttcgtgtcatca

SEQ ID NO: 39421 - DNA, 440 bp, Oryza sativa
ttttttcacccgggccaatgtacatgtaatcgttttttttttttttcgccgggctgatgtacatgaaattgactgtcagggggttttccagttttccttcccggatcattagagaattagacaaaggccttactgagaatgcaaagcaaccatgatatcaggtacagactagagatgtcacttatacagtaaaaataccagcttggtaaccaagaaccctaaacactgccttctcccatagtagctgtagctgtaaaccatagcctgaaaaaaaaatgccctatagaagaagaaagccaagtcctaggggattgctacatagctcctctacccagcacgcagcaaacaaacaagcagcagtcagcagaatggcagatgacagattactactggtagcgggagaccggaaggttaccagtgcgcgcaggtggcggtggtga

SEQ ID NO: 39422 - DNA, 1501 bp, Oryza sativa
atgagtatttgcctcaggcccaaaattttatgagaattggccttgcggtcagaaacacgttaaaataactgatttgtccaatatttcttgataataaaccttggacataaacgacgcacacattttagatcaggcaaaaaaacatcaattttaaccaaaggcaaaaaattataccaaaagggcgtgtatgttagccttccacacaagaaaatcatggtttatcctttattccagaagatccagaaattttgccattatagcagaaacagatgagtattagccttggctcaaaaaatttcaagaccagtgagcattccatcctaaatttcgtgaccattagccttggggtcaatacattagatttctgctcaagatttattgattattaatcttgttgtgcacttgtgctaaaaatgcacaaatttagactcggtataaaacatgatattttttcctttggcctaaactttttggtgctaacctagagcctaaacatgcataaattgtagcctcttacgcagaatttcatgattattaacgttggggtaaaaattgcatggatctgccatcagcctagaaacaggtgagcgttggcgttcaaaccaaattttacattcggcacaaaaattcattagaagcctttgatgcatattaacataggcactctgtccaatttttcatgattattcaccttgtacataaaaatagataaatttggactctgccgaaaacacatggattttaaccatcagccaaaattttagcccccaaaaacgcatgtactttctctgtttcatattataaatcgctttaactttttcttagcatgtacttcctttgtttcatattataaatcgctttaactttttcttagttaagctttaagttcataaaaaaaatatatagtaacatttttaatacaaaacaatcatatttaatgttacaactaatgaaattaatttagtattgtagaggttgctaaaattttctataaaacgacagaggtagaattgcccttctgcacaagaaaaccatggttcgtccaccattaagaaaacacaaatgccaccccaagcacatggccctgttcttttctccaacaaaagttggattaaattttgaatactcgtggcacgcttttcaaactgctaaacgttacgttttgtgcgaaaactttatatatgaaagttgttctaaaatatcatattattctatttttcaagtttgaaataactaaaactcaattaatcacgtgttattataatcttattttacgtaaaatatttaatctttatcttcgtctttcagcacattcatgctacctttgttggcgaccctggtacgataaaagcggctcataaacggcgcattcattagggacagacaggtggagtaggagaaagaaagggggccatacaccacaccacagctcaaaagccaagtcctcctcggctcgccgctcgcggcgcctccctctccttttccgtctcctactccactc

SEQ ID NO: 39423 - DNA, 209 bp, Oryza sativa
cagtttaagtagcccacgcgggattattcgattttggtgtgcggtcgggttatgtcgccggcatggaaaaatagatttcaaaaaaaataaaatttcgaaaaaaaggacccctagaatccgacggcaccggtgtgaatccgcccggcgcgcgtgtgcccgaaacggacggccccgctcccgaccgccgttgcctcctcgttgtcggcagc

SEQ ID NO: 39424 - DNA, 1501 bp, Oryza sativa
atttctcataaattcatataattttaggaatcctgatgtatggactagtaacttgttatacctatgatctgccataacttgtcgtatctcccgatatgtgatagagtttaatatatctctactacttaaaaaatccgtagtggtggtcttgattcctgacatagcagacgcatctgacagacacgcgtaatctcaaccatccaatttgcatatcaagtatccaacgaccgatctcctcccacgctcgctcctctctcggatccgcgtccttcgccctcctccctacgtcgcctcctcacctcgcccaatcgccccagccggcgacgctgccgctgcccacccgcaaccgccgccaacgccgccgccgtcgactccgctccagatcacgccgacgggtctactcctactccttctcctccccgccgccgacgccgactcctctgcacacctgccacgcgcgctgcccacccacctccgtcggcgactactactcctcgagatcgccatcgtcgcccgcggctcgcaacgccgtcgacgccgccttcgatctccgccactagatcgactcgcgacgccggcggcgacctgtcatcgcgccgcctcgtatcgccattgaggtcgtcatcgtgcggccgccgatttccgcctccagatcgccgacgccagcttctgggcgacttcccaaatcaccagccatcggtctcctcccacatcgccttcccctacgccggtcgatcgggatcttcgttgtaatttttgataagaagctagaggcaaaacattcagcctccacagccgaacgccgggaaggcctcgccgccctttcccctgatcgactactcgatctgcctacacacatggcctacgacaagtctgcctggactcggtgagcagttttctttttgcttatatatacttgcagcttaattttcctctctcccactaatagcatacatcagtgagataattgaaatcagattatgtgcatgtgtgacgcaaaatttattatataaatggacttctcattcgattgccgtctccagcataatgtaaataatcctgatattaaattatcaatggctattatgcatttgttcagccatcactcccccattgtgtcgcctcctcatcctgccgcctcgcctctcgacgccgccaccgtaggattcgtgagctccccctggatatggctgcatcgacgagatacaatttccacttttagcggtttcttcatctaccaagagttcacgtgtattgtgttggcttggggattcaatcttgttctaatttgtctttgttcttttctttttggcagactgtattctctgctccaaaaatcccattgaaggtgatatagtgctctgttgcatcctttcttctaatttgtctttgttcttctctttttggcagactgtattatcctaaaatcccattgaaggtgatatagtgctctgttgcatcctttcttctaatttgtctttgttcttctctttttggcaga

SEQ ID NO: 39425 - DNA, 1501 bp, Oryza sativa
gatgcaaagggcaaagttgagaatttttttttaaaagtaaaacagcaagagcactttatgtgtcaccttgctttatatggcttcgtctgaactttggttacctaaattgcaccgcatatgcacttttctacacaattaggttgagcaaaagctttcagacctaaacaaatcagaaactacacaagtattcacaagcagagttcagttgttcagtaatctatctccaagagtcagttgttcaggtgttgcagtccaaaccttttgcaatgatgagaaatttgattagttgcatacattatgatatagttattgtacttaaagtcaaccattctcctcaaatttcatgcactttcacagctattacctggcaacttgacagtccttctgagagagaagctcgcaacctgcaatctataataagcatcagaaaatgggattgcaatttggcatttcaaagttcacacttatagtatatatatactccccccatctatctttgatcagaatataactttgtgaccagttgtattgcctgtgatttctgaaggatgcaacagagcactatatcaccctcaatggaatttttggagcagagaatacagtctgccaaaaagagaagaacaaagacaaattagaagaaaggatgcaacagagcactatatcaccttcaatgggattttaggataatacagtctgccaaaaagagaagaacaaagacaaattagaagaaaggatgcaacagagcactatatcaccttcaatgggatttttggagcagagaatacagtctgccaaaaagaaaagaacaaagacaaattagaacaagattgaatccccaagccaacacaatacacgtgaactcttggtagatgaagaaaccgctaaaagtggaaattgtatctcgtcgatgcagccatatccagggggagctcacgaatcctacggtggcggcgtcgagaggcgaggcggcaggatgaggaggcgacacaatgggggagtgatggctgaacaaatgcataatagccattgataatttaatatcaggattatttacattatgctggagacggcaatcgaatgagaagtccatttatataataaattttgcgtcacacatgcacataatctgatttcaattatctcactgatgtatgctattagtgggagagaggaaaattaagctgcaagtatatataagcaaaaagaaaactgctcaccgagtccaggcagacttgtcgtaggccatgtgtgtaggcagatcgagtagtcgatcaggggaaagggcggcgaggccttcccggcgttcggctgtggaggctgaatgttttgcctctagcttcttatcaaaaattacaacgaagatcccgatcgaccggcgtaggggaaggcgatgtgggaggagaccgatggctggtgatttgggaagtcgcccagaagctggcgtcggcgatctggaggcggaaatcggcggccgcacgatgacgacctcaatggcgatacg

SEQ ID NO: 39426 - DNA, 159 bp, Oryza sativa
ctcccatcctcttgctggtcattgtgggctcatggcgccgccagaatgcccgtggcggtggacgtctcgcggtggctaggcgaccgccccggcctccgccgctcagcgtggtccgtccccgacgccgcgcacctcatcgcagccgccgatagggaggga

SEQ ID NO: 39427 - DNA, 1501 bp, Oryza sativa
gaggaaaccgagacgagttaagccgctaaaaccctagcattccacggagtggtcgcctccctcctccggccgccaccatgctgctccgccgcctcctccactcctcccgccgcctcggccaccgcctccaaaccctaactccggcgagcgcagccaccgccgccgctgcctcgtcctctcccgtctccgctccccttccatttcgtcgtcccctccccgcctccagcctcctctggccgcggctcctctccacgtccggccgcgacgacgaccccaacaagccatgggcgttcacgccggaatccggcgatccggatcccttcgccgccggtgagggcgtcgaagctcccgccggcgaggatccactaggattgagcgccgccggcgaggacccgtgggcgaaggatttccgcgcggagggcagcgagaagggggacgtgttcgaggagatcttcaaggaagaggctgccaccgccgccgtcgcttctggagagaaggctccgggggcaggcgccgacgagctgtggacgctgagtggggaggatgagaaggatcctttcgcggaggccgtgctcgggggtgggcttgaggggatcggaggtgatggcgctgcgattgatgaggccgatgcgggggaagacgaggaggaggaagagcgaaaacggctagagagaagggcgagggagcaagaactaatggagacactcaaaggtaaatctatctttatgcagtaacataatttgtcatagtacggttgctgttatgtgtgtataattagtattatgcaactgattgaattggcgtagtttggagctataggatcatacccgcagacataataaatctctgaaatggtattccaagtaagtgttagatgttgtttacttacaatgctgtatcaggacgagcttgccaggtttgtatacttgatcagtagctaattattttgaggtatcacaaatatccggtaggtgttttaggagcaatttgcttcaatgcagaagttggaatgtgcctgttggtctccactcaccaccagcatttgtttcatgtgatgccactcattcatgtcatttaccatcaattgcaataaggtatcattgaatcgggtagataatttcactcatgatcattgtgatttttgttctgcgtgcttctgcaacctcatgactgatttaattatttattatgccctagttgattctaataatatacaaagtttttctttctgctattaagtaggatcttatgcaggaataatccatagtgcatacatatgtttgtagcatgtcgtaaagtagtttttttgtggttgcaggtccaaatcgtgcatttggtgatctcattgaggcctctgggattacagaggatatgattgctagtttgatcctcttaaaggatgttaggggtgttcctggattacctcccctaagagaaatagaagatgaaactatcgaaaaaatgaatgcaacatcaagcagagctgatgtagaacgccaaa

SEQ ID NO: 39428 - DNA, 314 bp, Oryza sativa
tgaacaaatgcaattgcttaacatgacattgtgtagaaaaaaatgtcatgttcctgaaaatataaatatacacaccagtatgcatgctccatgcatcagtatgatttgttaatgcagccaatgtgatccgcaaaagaaagctagtagccactgtaatgcagaaattgtcaggggctggccattccagttggctgctcatctccttgtttggggccgtgctttgcaaaaaaacctggtgttttgtttttgttaaattgtttgtctccttgtggttctgtgcaaaaaataaaaatctaaacctggtcgggtggtta

SEQ ID NO: 39429 - DNA, 1501 bp, Oryza sativa
tcaacatatttactttcggcgcatcgccaccctctcgcgaggttttatttcgacgagttcttattttcgtgcatgggctgcatcgattgagttcaacctccggctaatcgggccgacccaagtgctgcctatatggtaatatcatctctatcattagttccattactgtttataggcacattgggttagttaggaccttctcggttagttccgatattctgatcaagttaatgtttctttaaacataatatcttgccaatctcatctgatgtgttaaatttctctttcatggttttactgtcttgggtaaatttaatacatgaccgctttggttggttcatattggcttgcttgaatctatcaggcaattatcaaccttatgatgcatcggttgtggcagcgttatggacatctggtcttcgacagcggcatagttgtcctcgcacctcaacttctaatagtcgagttacgactacaactggtcttcaaccagcggcgtagcagtcctcgctccacgtcttcaagtggtcgagtatgtttacgtacctggtctgcgaccaacaattgtagcggttctcctactgcttccgcgaagtgattgagtacaactacacacctggttttggcccctggtggtagccatctcatcaccccatttgcatcattttctgtaagtatttatgcatataaatgtgcaatatttgtccattgattctctttttcttatatcatcttgtctcgaagtcgatcctactgtccttttacgctagtttgacacgccagagtggataaggtgatgtcaggcattgcagagccaaatgaccatgtcatatttggtcacgtcagagtggtgcatggcaccgtactaactaagccgcataaccgggaattggttttcccaacgtcacaactaggggtaggtaatcgcagctttagcttggtttattataagattttaagccgcctatgtggaaaaacgacttttccataaagacagctatggactaggaagagtaccatactccgattactgagggcagctctagcaagaccgcgagagtacttttttattgtcacgtgcaaattcaatttattttcaattttcaaattcacattatatcatgttacccttgagcgttcgctcgggggctctttctatctaacaatctattctgagtattgatttcagaaaagtcagatatcagaacagtcaactcagattttagggctttgtcgcaggctctacagcttctcgattatccaagaatggttggtggagttcgacaaggattatggaataaaacaacggtttgcccgccaagacgaaatttcttgacttcaacccaaattctcgatcaaggctgggcagggaatttagtcgcatactccgcaccttctcggtcgtccgagaacatcaactcgttcatttgcatcgaagtcgggggctattgtcaaggttatggataacacatacgcaataatagtcgactaagctcggtgg

SEQ ID NO: 39430 - DNA, 660 bp, Oryza sativa
tggcgcttgaatgggtcggtgttttggggttttgcatgtttggttgtggtgattactgattagattggtttatgaagctatgagcccatacgtgttttcatggattcatccctagttttgaggccattttggtttatttttctctctatacatgcttctagtggatttgcggtcgccccgaatacattggaaatcagagtaagctgcggtagaggtggttcatggaactgatgattcagattatttaacgcctcctgatcactgttattggataggcttttgtcctgatgcaaaagctacttgcatgtgcaagctttttttaatctctagttgatccttgttcactgcaagttgtcgctgttgcgctgttccttttgtggatttttttaaaacagtagggtagtaagtgaacaaactacaacaaatgcaggtgcgataaacaattatttggtaaggaacggatacatgacagctgtggtggtaggtactgatcgcgatcgaattccaggagtaccacattgtgtaatgcattggtgaaaaaggctgtaatgtactttccatggctcttctggaatgtcttgaatgcaagattgtattctgagtcgcaattatgatgctgtaaatcaagcagtgtgttttgctcttgttgatatcagtatt

SEQ ID NO: 39431 - DNA, 1501 bp, Oryza sativa
gtacatccaaataacatcaggctcatcataatatcaagaaccagacttcagcatgtccaggaaaaatgcagtagtgatcaataacaaaatcaccatcaaatagctgtattttttcccaacacatcaaatcgcatttaggtgatagattatcgtacatttttccttgattatatatatcacatattcctactacattgcaaagttaaacatgtttggtccagctctcaagaaaaatcttcaaacttccagccattaagtttgcccaaattcatttttaagaaaatttaacattgtaaaaaaaagttgtatgtacctaccaaatcccttagtccaatttgtaaaaaagatctatcaagaacctaccaaaccacaactaccagcaaactgacacatgcatagctttctaatatctatatagcttacaaaaaggttacccttggcaccaaagtatgcacataagtaaatgaacatcaagtgccctaacgatcacacaagtatataaaaaacataaacatattcctgtaagtgcactgaacttcataatctccggcttctatcatcaagataccaattctccccataagtctgatcctatgcaaaaacacaaaagagaaatggaggtaccaagttccaacacaatatcgaagcacaatgaaaagtttcaaatcgacatataattacaccaagctcatcaccagtccgaaacagtgaagatacgacaaaagtgacaacttatgcttttcttgcaacatgggaaccctttggaacagcttcaccactaagtgctgccaaatagcaggattctatacctgcttatgagtaagcaaaagatgatattgcactgaagcaagctgccaaagggggctgcagcattcatattattcaattcaacaacgaaaggtgcaatgtttctccttaggacacataattcttgtagtgaagcacatagaacatatacttgcacaaagattgcagaatatggtgcggaatgcactaaatcccatcccaaaatctccttttccaaattacaaaccttaattacaaaatcgagcatatactggccatataacttccataaatcccaagagtacgcaactcaaatacagaaattcttatattttctaaagagtaaatcttatgaagttaccatatttgaaatatgtggtcgaatcattacgtacacacacactgatcatctccccgaacctaatccattcccaaaattccacctttccgaattgtaataccggtaatagaagaatccctaattacccctttccaagaattcacgaccattgtttcatccactaaatttctaacgccccaagaaacaagaaacgtcgctttataacaactcttattattatgaagaagaagcggggggagatctcgaggcagaaagccactcaccgaggtggaactcgtggccgcactgcagcctcgccgtggacctgtccccgccgccggcgaccaccgcgtcgaggcagatcgagcacgggac

SEQ ID NO: 39432 - DNA, 1501 bp, Oryza sativa
agaatctgaaaaaaaaaaacagagtatacaactataagaatctaaataaacaccgggctatttgaggagtttctaattcgaagagaagcaaacaggtccaaaagtatgatttgggtcactctaaacttcgttttaaaagttagatttaatagttagaatcctgccaaatatgaccagttaaccgggctcaaatcttttggcaggatatgcggcaatgccatggcctacctgcagtcggcgtttgtgtcaactgcatatgcggtgcggcgacgactgcatatgctcttgcttggacttgaaagtcatattcatattgcggttgcgggtctacttctgtctctaaacgcggctgttactgcgcgtcgccgttctcaatcacggcatctctctcccacgtacggcagagaatatcacgcgtacttacccaaaaccccaaactgcaacccactattttagctgatttttaaccgaccattatacggttcatgaaccagatccacaacctcacgtgtactcactcagtaaaaaaaaaacaatctagacaaggataatataaggttgtgtttagttcacacaaaaattaaaagtttggttgaaattgaaacgatgtgacggaaaagtcgaaaatttgtgtgtgcaggaaagtttttgatgtggtagaaaagttggaagttttgaagaattgttttgtaactaaacacggcgctagtacaataaatatgaagacgagcattctcagattcgttacagtaggctatatctcattcttacctagcttgtatttttatggagggcctacatctcatctgacagatagccttttagagcaggtacgttagtagactataagccaattataaacatattttgagaagatagatagggagagagacgagcagcgggctacagatttgtagccagctatagcataaattctaagatgcaatctatatatgataggtggcatcagataactattgtatgaattggccattaaaatgactacatataatttagagttagcagttggctatagcccatgagctgcatgccaggatttagttcacacatgccatatgggcacctccatgcaaagacatttttctcctctccttcagctgtccatgcaaaaattctcatcggatttcgagggattcgagtgacgacacgcgcgcaggggtacgtggtgctcgcccattggccggaccgccgcctccgatcacgagctcggtccccggccagcgtcgccatgcatggcgcagaggcagccgaggcccccgccgtcctctgcccgatacgtccaatggcgaggcctcacgggcgggccagggcgcggccgctcgccgtgtcgtttcccgccatggctcacgtgctcccccgctatatagctcgctcggccacctcgccgcaccaccgtgtcacccgccattgctggtctttgccttgctgtggtgagagagatcgatggcgctgagaatgagcatcgcggcgatgtcggtgt

SEQ ID NO: 39433 - DNA, 1501 bp, Oryza sativa
gggagtagtttaggaaatatgcgcgtactaaactagggagtgaggttgggaacctcaaatcaagaacacaggtcttaaaaaatgcaaaggttccggatctgtagttctgtactttttttcctgtactgtgaataatgattagcaggttgtattgggaacgaagcgatttgccatcaaggtacttttctctgaaaggtttagttccaggtgtactgtgtaattaaccaagctgattttttgcctatttgaagttgaaggcttgatcgttgcattcgacctgtcaatcatactttaatgcctttagtcccagcaaattgaccatctgtttgtacacagttttgaaccaagcttggatggttaaggtggtggttgacaggttgttgtactctaccctggtttgacgtcttgtgtgtcacattgatacaacgaattctttcagaggttcagggtatatatgtggaaaaaaatgtttatagtgactgttaatcttaaaatctgattatgtaatctatttattcattggttttcatatggagtggtcgagtgtcccgtgtctaaactgactttatattcgttttaggaaaaaggaactgcttgtatgtttttattggtttaaatagttaatctcaatattctgtagaatacatcatagtaacacgaatctaaacaatcaatatttaattatacttcctctagattttttatatgacgttggctaattcaaatttataccagctaacgtcatacatatacgtatggagatagtatttttagaacggatatattatagctcaaatggcacggcagaattctcctaaatcggaacttgattatgcatttttgagtttatgacagacactttgacaaattcaaccaatgtgaaacaaagaaacagtcttccagtcccatcgtttggcctaaacagccaaagaataagccaaaatttgaatttttgaacttgattttgaagttgattttgaaatgcttttaacgtaatttttgttaatgttggcttttaagtcgctacgaacaaatctacaaaagttttacttataaattaattttaattttctaataagccaaataagccattttgggtaaaatggcaaccgatgggagccttccatcgggcagctgctgcgttgggtcagctataccgtttgtgaaagtagtatagggtagtaaaaattcaacgaaacgatattttttttcctcccttacccgacaaaacggccaaacccaaccgcttaccataaaagaaagccccccgatcccccgcaacatccatccgtccatccccgatccaacggccgatccagcttcacgcgctttcgatcgccataattacgcaggccgccatcgtcgtcgtcgtcttcgtcgtcgccattatccccatttctcccgtatcctctctctcctctcctctcttttcgagcgcggcggcggtggtggggaggaggagggccagcggcagcaagcggcggcggcgacgcgatgatga

SEQ ID NO: 39434 - DNA, 706 bp, Oryza sativa
aagcacttttaagagttttaatagaaactgacgtccagggagacatagttgtgattggtgaagatgggaaagttgatagaaaaatgtttataatggaatacatattttaagtttcggaaatgcttatactgttttggaacagaaggagtatgcgaatatatctagcttatgagcttggcagttgacattgcttacattgtataaccacaaataagcatcgaaatctttagaggacaaatagtatgactgatcaggtggtgtttgagatagattaagatgaaaatgaaattacgcaacacaaaacaaaaaatccattagcgcatgaataattgagttgtaattattataaacttaaaaaatagatttatttaatattttagggtaacttctgtatataaagtttttataagaaatacactttggaaagtgtgcttatagaaaccgaagtaaaatctacatcttaatcttaatgattcaaagtaaaacacctgctcatatttctacataaacatgtctagtgtgacaatgtctttttcaccgtggagaaatatgcaccggttgcagttactgcatggaaaaagtatgcaagcgacgaagcatatgaccgactaatactttttcatactagtgaactgttattgtttcagcactgaattaaatctcagataaatcatctgccactcaaatcagtggtccaaatcagcca

SEQ ID NO: 39435 - DNA, 835 bp, Oryza sativa
gcaacgtctagataacttatcggctagcaccccgataaaacattagcatgaacctatcggcttaacaagacttatattatcaacaacaatctagtaggtcgaacctaaccgatgcagcacgagattgtatatgataatctaatactcgatgagccgatagatctgtctaatgtgatggatataacaaatctatttataacagcattgtgattgtagagatatatcggctaaggcagaagatcagacctaaccgagacattcccaactaaaccgatgcgttctctaaatacaatgcaactagatatagaattgagatatcaggtaggcaaatatatcaaccaaaccagagcgatccaagagatggaagcgatgtagccttgaacaacaccaatgcagccgatagattcaccagggccagcgaaacgtaggacttaccccttcgtcgaagatcgaaatccgatgcagccccgtgtcaggtgccaaattccgccggttgataagtaaaacctcggtaaagagggtggcgatgcgccgagagtagttgtattgatctatgtgataatttacaatgacctcgggtgtacatatttatacccattgggagatactagtccttgtcggacaagaaagaaactctcctaaagataaaaggaaaacagaaagtccttatcggacactaaacacactttcctaaagataaaagaaaacaaactattcctaattaatagataacttgccatgccgcattctctttaaactcggtctcttctggataaacatcctttagtagatcaatttccttaaccgaatatagcaagaatctaacaactgacga

SEQ ID NO: 39436 - DNA, 1501 bp, Oryza sativa
cgtcgcagagcttcttgatcaggtcgtccttggcggcgtccaagccgacgatctccgtcgccggcgggccagcgtcgacggcagcggccggccggcgagggtcgacggccgcggttgggcgaggcctcctcctggacaggtcggcggccctctcgagaagcgccttgaccgtcgccgccgacgccgcgtcaggggagccgtccgcgcgacgagccaagagcgccgcgtcgcacgcgagctccctggcgtggccggaccaggccttggcctgctcgtcgaaccgcgctgggggcacgtcggcgaggtagtcgtcccggagcgcggcgtgcacggccgtcagctccgccgcgaggagctcgacggcgccgccctcgcgtgtttcttcttcctcctccctgaccaccagcatgatgtcgcccaggctggagagggcgctgcacgtcgcggccatcgccgtctccattgctctgccgtctgcaccgcaggctgttgccgccggccagctttgtccttcctcgtgactggtgtggtggtggagccggaggcagtggcaatcagaccaagcaagtgtcagcaagtgtcattgcgatggcgattgtgcagcgccgacggatttgtttagatttgagcgcgggacacctggtgtgtttggttggagggatatccctagatggaagatgacgattcagtttttaaatgtgtttggttggtgggcgaggatggatagggtggtccagagagggaatatttcacgaagatgctggatgagtgtatccgaccaaattggccggacgaggatatcaacctttactaatctttgatcattagttcttaattagcaataattaaagtatattattgttaattagtaattaacttgttaaaattagtgttgattagatatagttactctattttattgttaattagtataaattatggctatattaatgataattaacatattttattattaattattacgttgttgttttcattcaatccattctcatccacccaaccaaacaaaaaaactggatgattatatccacctaaccaaacaaaaaactataccattatatttaagatagccatattctgtcttgaccacgaaacaaaatatagaaggacgcagcgtcccctcacggttccacagaagcgtctagttttagcaacacgtgtaagtgccactgccaccgatttgacgtcgatcagtcaatcaacatttcagctgtatcggcagcaataagaattaaaagtatagccaacgccaattcatataataattatatataaatatatactactctttcttcacagggtaagactttctagtattgtccatattcataaagattaaaatgaatctaaatattcatatgtgcctacattcattaacatccatatgaatataggcaatgctagaaagtcttatattgtgatattaatatttggtcacatttatcataaatacattacgtcttagagtctatgcggcagc

SEQ ID NO: 39437 - DNA, 518 bp, Oryza sativa
atgcacagattaaacggacatacattaaaatgaacgaatagtccagccaattagtctacctaattagcattctcaaattaactcttaaccgttagatctaactgaactacagtaaagaaaatgtaaatttactcaatgttttgttagcaagaaaaactttatatgtaaacttttttttcccatttggagccccctgtttgtactgaatttgccatttgtagccagtcctctcatcctctcctcctcgaaacggctaagcacaaaaacagaaaaccgaaaccgagggagaaggagcaaccaaccaaaccaacggacgccatcgccaccaccatcctcgccgtcgcctctccaactcaccactcctcctcctcctataaaccaacgaagaacacaaactcaaactcctccttcacacacacgcacgcgacaccggtcaagaagcgcgcgcgcgcgcaccactgcaccgcgcgagcggcaacggcggaggaggagaggctgtgagtggtgggcaatggccg

SEQ ID NO: 39438 - DNA, 1501 bp, Oryza sativa
atatacatgggattttctcgaactcatttgtcaacccatgatctaaccctgcattaactcctgaatatttcttttgaactttattactatatggacagcttcgtcagaggcaagaacagaatttcaaattaaattactacaagtgttgtgacagtttacaagtctcagctgacctgccaaaacaagctagtgcatacctggattaggatctctctctagacataacaatatactaacatgcatgcatgtcacatagaggacttgttcaaaatacgcttttgtttataatttactggttaattagcaagctgcgcaccacaggcgccgcaatttttctatgaaattattcttctgcagttggagagagatcgataatgtcgtcgacaaagtctcacgtcgtcactacgcagcgcattttctgcgcaatgtaatgcctgcatgaccatgggacttgcctgcagggcttaccaaacagtcgaaagccgcaggactagctcgaaaacacaaacctcttggtttttaaagtttggtctgagatgaaattggtcctggtccataaaacgaaaggtaagttttgaaaaaaaaaataaagcaagctagattttctatattcgataaaatttgataggattttatcgttaactttcaaatggttttcacgaaaaccgaggaaaccgctgaccttcgttttttttttttggtttgaaaaccgtttggtgaaccttgcttgcatgcacctttgcagatgctatgtaaatgtactatattttaggattaggagtatgtgtctagcttgaagatgctatgtgttgttctactttaattaatatgtaaatgttgtaagcagtgcgaaatgaagagtaagtctgtcgtggcgaattccatttaataatagagaaatgattcaattggttagattaggatccggtcatgggacaatcgagaggaggattggaggaagatgtcaaacacaacagcagcaagagtacttgcccaaaacgtcgtcgccactgacgtatctttcactgaatttatagcaaggcatttcataatgcttaggtgcatagttatactactagtataaattattgcgcacgttataatagtaaaataatacaatttggtctcagaaatgatacacatctctcgactgctgcagtgctgcgacgactgatcagtagatccgtattggagtggagcctgcagagtacgcggctgacccagcttgatcctgctgaaaccttccttccaagtttcacccttagcttgatcctgcgaaaacaataggcagttgacagaaccagttcatctctgaaaagtagaaacccacccgatccagaggaattttcacaatctcaccgtttgaactactaataacgactctaactaccagccaccagcttccgtgcactttttgtcgtaataagtgtcgatctaatttgaattttggccgtgtttagttgttttgataaaaaaaaagtaacatatacggacacacatt

SEQ ID NO: 39439 - DNA, 234 bp, Oryza sativa
aagcttctacaagaataagttccttattttttttattaacacccataacccaattcccaaacatgtgagatatactatgtggaggatataatccaaataagaactgtatggatctccaaagaaatctagaaaaataacaatccagaaatagatgatagatggtagatggtaaattgattcattcttcataaaaaataacatttacacaccttgtatatttgaaaattttcaaaa

SEQ ID NO: 39440 - DNA, 1501 bp, Oryza sativa
cacgacgggatacagtgaaatctcgcgcaacttgggcgtttttttgggcagttttggtggtggtcgctgcaggcgcgtcgcgtatcgcgcgcgggggcggcacgggcgggcgggcgggcggcgcggctgcatctgtgctggtgcagtttgccgtggcggtgagggcgcagcatgtgtgcgtgggtgagtgagaggacgagattgtggtggagatcgtgctagcagggggcgacgtaacctagtcggcaaggcaacgggggtatactggcctgattctagctagcgatcgattgatctcacatgttacaccttacacgtacatgctggaaaacttctctttttttttgatatatttcttccaaaaaaacctagacaacggtatcccgttccagggatacccttctatggatacctgatacctgtcgtggtaccagctgcatggtatccgatacctgtgatacctgttacccggtacatgtgatacctaggatctgacacatatgatactcgtgaaagagaatagttaatatacctatcccattgcaacgggatcccgttttgtagcagccctctatttcttttgagtagttttaaaaaatgatgggataaatcagtgtacgatatgtcaccccttcaaactttcaacttttccgtcatatcaaatgtttgacatatgcatggagcattaaatgtggacgaaaaaaaattaattgcacagtttgtatgtaaattgcgagacgaatcttttaagcctaattacgccatgatttgacaatgtggtgctacagtaaacatttgctaatgacggattaattagccttaatagattcgtctcgcagtttacaggcggaatatgtaatttgttttgttattagtctacgtttaatacttcaaatgtgtgtccgtatatgttactttttttttatcaaaacaactaaacacggccaaaattcaaattagatcgacacttattacgacaaaaagtgcacggaagctggtggctggtagttagagtcgttattagtagttcaaacggtgagattgtgaaaattcctctggatcgggtgggtttctacttttcagagatgaactggttctgtcaactgcctattgttttcgcaggatcaagctaagggtgaaacttggaaggaaggtttcagcaggatcaagctgggtcagccgcgtactctgcaggctccactccaatacggatctactgatcagtcgtcgcagcactgcagcagtcgagagatgtgtatcatttctgagaccaaattgtattattttactattataacgtgcgcaataatttatactagtagtataactatgcacctaagcattatgaaatgccttgctataaattcagtgaaagatacgtcagtggcgacgacgttttgggcaagtactcttgctgctgttgtgtttgacatcttcctccaatcctcctctcgattgtcccatgaccggatcctaatctaaccaattgaatcatttctct

SEQ ID NO: 39441 - DNA, 1392 bp, Oryza sativa
tcctttagaaggggtcgtttctggtctttagctagtgcccctttgtttgagcacttgttggaagcataggggttccccaccatctctctccctctatataggaacagcagctttcgcttttctttctttcttttttttacctcttgcggtcttttttcatgtaactcaacaatgacttatgtttggtctgttatgttacgttgtggaactaaaaattatatctttttctaatatactgacgcgtatttttttacgcgttcacgaaaaagaaagaaacacaaatcgaaacaagcttgattttatttaaattgattgttctgggataaatcataacgattgtaagctaaattattttgtaacgggggagcacgcactagctgcatgcatgcagcgtggccgagctagctttgctagcacgtacgtgtggctcgtgatgctgctactgtgatatatgcctcgctctcacgaggcagccatcgcgcgccgccggcgtcaacccgacctgacatgtactagttgtatgctgctgctgcttgcctgtgccgactgttctagtatatgccaggcagctggcaactgcaactcccttgacttggctgcagtatgatataattcgacgtcagatgagggattgcgggtgtctcttctgtgtgtgcatgtgaattgtgatccattgttctcgacgagatcgaccaatgccggcctgctgcttcgacgatcacgacggaatacctgcatgtattctcctggagtacgtttcaaaaaagtatagttttgcacggtttatatctaacggcggatcgttcgtcttatttaaaaaaattttatgattaatattttattgtgattagatgataaaacatgaatagaaatttatgtgtgactattttttaaatatttttataatttttctaaataaaacggacggtcaaacgttggacacagaaactcacggctgcatttacctttggacggaggtagtactactgttgtacctatacatgattctatcaagaactaatcattctcgggcgcactagggattcagatcggccgcctgggcgaagaagctttcttctccgaggctccgtcgactaaacacactcgcccaacacagtacagtggtctgatctactcgagagcagagctaacatgagcctgtttggatgacaccatcgatcgatcacttcgccacaaaatatttagcaaaatgtagcatgccacacactttgtagccaataaaattgttaaccacaacatcaacaagttgtgctggccacaagttatataactcgggtagtattgactagtgaggtaaaattaatgtaatagtactaccagtaaatagagagtgaaatgaatgctcatgctcgtacagatcctagcaacaaa

SEQ ID NO: 39442 - DNA, 541 bp, Oryza sativa
acatgcatcttgaagtctgtgctgcagctggctacaaatctgtagcccgctactctatctctcctcttttatcccattaaaatatgtgtatagctagcttattaagttgttattgtacctgctcttagccacaactcttctagacagccccctctcgctctccctccgtgatccatccctccctggctcggctccctcgcgccgcttcctatttgcaaaccctaggtagcggcatggtgaggcggcaaccggcggcaggagctgaaccgtgctaccgcggagggggaggccattgctgcggcgggcggtggccggcgcccgacactccgccaagctcaggcggtcaggcctgttggttgccggcggctgcgaggggcaggggcggccagcggctcagcgcttagacgggaatacccaactttgaaatcctggctccgccactggaggcgcggtaatcctctaacatactaaattcatgtaagcgtgtatccatatgtaatcgtgaacaccagaatttaaacctcgtagtctcatgtacagt

SEQ ID NO: 39443 - DNA, 1501 bp, Oryza sativa
tgagaaaaaagagttttttttatatacatgtggtatattcttgtgcatgctagcaatattttgaaggtttatttgtctctagcacagtttgtatgtattctagtctttttatgaggcttaaatattgttttgaagggagataatgcatgacacttaaattctatacttgaattaagcaaatatgcaatattaatgctagcatatggtttgatttataaatgcttatgtatacgctttattaaattgtcattcctcaaatagattttaaattgctcattgtgcactagaagaaaaaaatatctatgagagaaaaaataaataccgaatcattggaaacagtcttgacgataagaacgtatttgatgtgagcaaagttaatggttgccgaatccttggaaacagtctcgacgacgaggacgtacccgaaataattgagagaaaatatgagcaaaaagtctcaaataaaattttaaaaattatcttggttgctttgtgctaaggatgatttgaaaaagagtgatgaatgcaataggtatatatgtatagtgtttatttttcaacctatgtgcttgtaaagatgttgcattataaaacatatgaaatcatgaattttgattattgatttgaacctaattgtaaaatctttggtatatgattatactttagtgcatgcttgctatattatagatgggttcatcttccttttattgcaacacatgacttgatgtactatatgtatgcaaaggtcttgaatattaataaatataattcctatacttatgaaatcattgtcaaaagggggagaaaagaagatacaagtgcatgtttttcaggtcaaggggggatttttttttcttttcaaaagtgagagaagttttcttttgaatttttgagcactccgtgctttttaccatttttgtttttattttttccaaacaataaaacatttttgatgggtttgccaatgtgttcatcaagggggagattgtaaaatcaatagtgtttttgattcttactctgtgatgaacaattggcatctaagattatcggtttgatatttggagattattgacgaagtggttttgaaaatgattgggtttacaggtgatgaacaggtgctattgttttatcgggtctggtgggaccaggcaggtgttgccagtcagaccggtactatgagtgcagtcagaccggctagcccgcagtctgaccggccgactctgtgtcggtttcggtttcaggttatttgattggacatccgtggatatttcgtgtttatggcttctagatggatactatacatatgtaatactgtcgtttgctaacaatgagtcaagttggagatagcttggtctcagaatatggtttctttgtatgattcatgtgtaggtgtcttgatgcctcgggagagtgttgctggtgatggattaggagtcgacttggagataaggcgacgtccgaatggttagatatcatgcgggatacttaggctaaagatcaa

SEQ ID NO: 39444 - DNA, 1501 bp, Oryza sativa
tgtgcttcttctcgtccatcttggacgaactggaccccacaatcaattgtgtcagaaaagccatcttactcaatggaagaaaactgtacaggacctcggtacttctcacgtttggaaagactccgtttatctaccaccacgtgtgcgcatgaatcttacagcacctatcttctacctctagttcaagtgcttaattccccccctctcgtctccccctcccttgtctacttctcatcagctggggcagtgccgcagtggagccccatctccagtgtgaaatacgttccgcgtgcagggatgacgagcttgcctaactatttcccttttctcctctgctatagatccaaattttgaccggagtctaatgcgcaacgacgatagcaccaattacctcatctaacagggtggcacgggatggaagacttaccacgctcccttgctaggaacacacttactcagtcgtctcaattagtagcacactagcaccacgttgcatcccacgccacgagcccgtgacaggaaggacgaggaggaggaagcaggggagcgggttttcgcatcggatatggggctccatcccaggagcaggaggaagcagtggtggagcaccagcttttttatttataataattaaaatcccttaaattaaattattagtaattaagaggaaagatgaaccaaagtaataaggacgctactacaaatagcgtccaaacatggatgctcctaggagtcgcgtccagatgtggacgctgatagtggagggagcatgttgctttcgcaccaacgcaagcttgtcagccacttccctgggaggttgctgcgcgctgctgtctgcctcaactcttgctggtgctgcacagacacccggaggtcgctactgccgtccgtctcgacaccctagagtgcaaagactggagacccgattgaatctgggataggattaccacctatttccagattgtttcctgccaaagagcctataggctgccagatccctccgtctcccctacggagatcctaatcactaaaggctgtgttcgggaggaggagttgggaacccctcctctccgatacgcaaaacggtgtgtgtattaacgcatgattaattaagtattagttaatttttttaaaaaaatggattaatataattttgaaaacaactttcgtatagaaaattcttacaaaagaaacaccgttaatagtttgaaaagcgcgcgtgcggaaaaccagagggataagttaattgggaaatcaggttgtgcaatttattttagggttatttggatttatgctactacagatatgacaaattaaaaaaatacaactactattcacgatatcggtaacgtgccactagaatggggaaattaaaaccgtgtcactttgtcgtgttttccatccacacttttctatcattcctgtcaatttctatccttgcgcaccctattaccagcgcacgaactcgtcgtcctcgtcaccactgccattgtggtcgtgc

SEQ ID NO: 39445 - DNA, 1501 bp, Oryza sativa
tattctgttggaagcttaggtcagatgcagttttctagtggaatgtggaagccaggtcaaacaacactccaaagtcggagatcccaatcgagagaagatctcacttcgtcactagccgatcttcatcttccaaaggtgtagccttacatttcagaatgacatgactagtatgagaataccatcccataacaaaccttgtgtaaataatagctccggactatttgatttcttctctaatcaaaagtcaaattttgtcggtatactgacacttcagtgagatctagcattcacagaattggaggtatgacttggtgcctgctgcctagtcctgggcatgatattttcattacgatgtatgcgcaacagtacatgtcacaaggtgaaattgcaagaagaaatttatatggttcaccaaagtggttggccgtgggctggaggtatataaatcagctcctagccccaaaatgtcactgtttctaaattgtgatatcaattcaaccgagcaggctgtgtacttcaaatgtttcttattcttttgttctacaacataataaagctgcctatgggctatggtcttgtgtctgtagaattgctgtacgacaccatgtaagagttttcccttgtggaaggacatttggtaccaacagaaaacatgaattattagtaattccagtgctcttatgtttactcattcaattatgtcgatgtacaatgcactacttggactctgctaactgatatgaatttcggtgctttttgctaaacgcatttgtgtaacttgatcgctttcacatggtagtaagacacgaaaaggtacaatagtttagaaagagcgcgtaagaaaaaattgcatgattttgaacatcatgtcatatttcttctgaaattttctacggagcaaatcctttcataggccaaaaaaacaattttaattggaaatttggaatggttaattgattatatatgtccgaggtgagaaaacaaaaataaaaatcatgccccacctacactttataataccgttcattttatcccctaagcttgatttgaatgttgttggtcttgcgtatttaaaagctaaaacgagctgcctcgaatagctaatataacagatataaaactcaactaaattatatacttcctccgtttcacaatataagtcattttagcattttctacattcatattaacgtgtctagattcattaacatcaatatgaatgtagaaaatactagaatgacttacattatgaaacagagaaagtacaaattagataaaaataattatgcaaaaccatgttatgagcttatataaatggtattagaaaattcagggagttgaactagaaagcaagagcggcttcgacgcgcatatttggtgatgggccattattttcgccatgtaaagtgtagatgagccagtccaattagacccaatgtatgaatatatgaatgttcttattattagaaaaatagtccgcaaagagactttaatcatctaa

SEQ ID NO: 39446 - DNA, 1501 bp, Oryza sativa
tataaagttagtatatgtaaactttatacgaataaagttacatgtataaaatagaattgtttatgttagattttagtcaaaatgagaaaagaaaaggcccggatatgatttagctaactagtgggcccgtgaagattttgcatatgcataggctaagttgtgggctggagcaacttgtgagcaagagcagacacaagttcgctcgacgcgaacagtcgcgtactagactcacccctttgctggcgcacatgccacacggctggcatgtccgtgccctcacgagttttcttttctttcatcaatttttttgccaatttttttgttatttttttattttagaaattgaatctttcatctctaattctagttgaaagtttttgaatttgagttgaacgtttcgaattttgagatcaaagtttttaaatttgagttgaacgttttgaattttgtgacgaaagtttccaaatcttagtttattgttttcaaatattgacttgatttttttttccaaatctgagtttaaagctttaaaatcttggttaacagttttgaaatttgagttgaaaatttcaaatatatagtagaaaaggtttgaattatttacttaaaagtttttaaatctaagttgaaagtatcaaatattaattgaaaagtattcaaatcttgacttggcagtttttaaatttgagttgaaagttttcaatgaaagaaaagaaatgagtttggattaagtgtgcgctacttaatttgttagcgcatatgcgtaaagtaggaaaccactcaaaggaatgttgttctcgttcatctaaaaccatccaaatagttatattttttataaaaaaatgacaacatttataccatgaaattttgtgtccaaacttaactcactctaaataaattcagcaaatgaatagtatagtggtactatatttatacccaaatttatttcctgatttgtaggttgaatttaaacttgatttttgttggagtgctagatgtcactaaactttacattgttaatttttttaaaatcttttataactatttatattgaattttcaagaaaaatgtacgcgagggaacatcgtatcgagggattagaacccactttcctggctgatgaattcggccatgcattaatacagagcagcaatcatgtctattactcatttttataatatcaattctaccgaatgcatatttctatcagtaaaataatatggaacacctcaaattaatacatacgtacatagatgagactccccaaaccagggaaatctcttggaacaacttcggtaagattgtgaggacctactcagacctaccattattttcagaagaatactctctttgagttgtaagaaactattagatattaggattaattgaattgatgtcattgtaaattcatgttattgaaaaaaaaaactattactattcaggatacctgttacgtgctactagaattttataaaattaaaaccatgccatcttcgtcatt

SEQ ID NO: 39447 - DNA, 379 bp, Oryza sativa
tcttgttgtagtgatttaatgtggtaacataaattctcaattttttttatttttgctatcacatccacctcgtaattctagatctagatctagatcttgtcatatatagagagagaataaaatttttaatatctatttattcggtgcaatcaaaaaatagttatagtagtttgtaatatgccgatgatatgattttgttagattttcctaatgtactaatttggcaagtctgtgtaaaaaaaattgaaataaactttgtttttttattaatttacaattaacctttagttaattagttttgaatagcgataagttttttcagtaaaccctacaaatttggtattaattgtgcaaaattttatgtgcatttttttagaga

SEQ ID NO: 39448 - DNA, 201 bp, Oryza sativa
atgttttctattcggttctcagttacattaacttcactagtgactgatttgtgaatagtcagccaaagtaatccttgactctgctacttggtcagcttgaaaccaggacgaacgatgtccttaattgtagtttaaagctaactgtttagttgtatcttgcttaatggtgcagcattacttatatatattctattttgcaga

SEQ ID NO: 39449 - DNA, 503 bp, Oryza sativa
tttgggcaaggacttgtgcgctttggttgtgtttaggacataggttatcattcaagcgtttagtaattgtcttttactctttggcatacgtgttcatatgcactattgtctttaattgactgtgtctaatttattcacatgttgtttttcttttctttaccaaaaatgtacaatgaggaataactccaccataagctttattttttttatgattaaccgattctctgatattaatttattggtatattacagtcgcgtcgcatgcaaaaattatatcgatcttcacagacgagcctataaacacgactgcatgtgaagatcgatgtccgcatgtgcagcttaagaggccagatatccgcatgattgggctggccggtgaaatcctgatcatagatgaatggccctttcttcaagatgcctcctattcccaaactgtagttttgcgtacgctaaagtttatgttggcctctgctgtttctccgtcagttcacattcttttcagc

SEQ ID NO: 39450 - DNA, 1501 bp, Oryza sativa
cgggacttctagaaagtaaaaaaataaaccttaatgataaccatgtttaatttttaaaatctcaattacaataaaaatgagaagcagcggacgggtcatatcatgtccgacgcgtgccctagacaccacagtccaaagtgactcagcactggcgtcttatccatatcctttcaactccagactagccggggatcccccataaacttgtttcatttatgtcagggcatgctgcctcacagctagctgtcgagcatgcccaatttcccatcaagttctgaggtcgtgtcctcctacgtttaaagaaggttacgtttaaagaaggttgattattctcggatgagctttttgaaggtgtcattgatggaataatatcccaagattatgcatcttgtacatttggatgcccctctagacaaaaggatgcgagtcatactagtaccaaggtgagcccggggcccggggcccggagcaaggccgggctcgaggcaaaccttagtttatggggtgtttggttcatggccacactttgacacaccacacttgtgacttccacaatttgttagacatgtgtttagttcactgccatagttgtcccacatgtcgtagactcaatttttttgtcaactttaccacactttgtggctagcaatttatccaccatacttttgtagctgccacaacttgcctagcgttagttgtggcaaagtgtggccggtaaccaaacacaccctacgccttcatgcttggttagtatcgtcactcctttttcccgagtaacatgtgacttgtacgggctatggtgagccttgggcccaagacttggccgtgcccgaggcaaaccttaactcattctcttaagatatggttcttgcatgttcctacgtccctcttgctgaggaccgtagaacctactagggctagggtgagtctagggcccggaacagggccgagcccaagtcaaaccttggactatattcttaacgcatattgaggtatgcttgggacccaaactaggtcccatgatgcttttcagatttttgagttacatacgcaatattctccctaagccaggggaaatcccgtgtatgaaatcttagatgggcctggggccctccagagtgggcccctaaccttgtcaccctaaagttaccgttttatttttaaagacattctgagcatgctatttatttgataatgatccttttgctagataaatggatacactggttccgatttcaccgacacatattagagtacaatagtgtcatgaaagatttcaaatttgttcgattcaaaattactgcggtcatttatcacttaaatagtatgtgtttatcacaaatatgttaatttttttttttgcaaaccgttcctaatgttaagtacattgtccaaaaagtatgtgtcttttcagaacatataactggttaaattctaaaggggacttagtgtttaatgtagcacattcacaatgtatgcctaatacagaagaaaaaaagtt

SEQ ID NO: 39451 - DNA, 309 bp, Oryza sativa
ttgcagtcttaaaatttttaatcggtagtaagtttgatctaatacaatcatatatacagttcgaatattttcaagtcaatcatatatacacggaaaaaggtttaagattccaattccactgatgagaagttttttttcttccctttgcacatgcagtagttcttttcactatatagtagcataatcttatcgcgcctatccttacatatttttggtggttcatgatatgaagcattctgagtagcttaatcagaaaccaacttggcttttaatttttatttgattagcaagttcatctgtcaaaaatca

SEQ ID NO: 39452 - DNA, 1501 bp, Oryza sativa
ttaactcattctcttaagatatggttcttgcatgttcctacgtccctcttgctgaggaccgtagaacctactagggctagggtgagtctagggcccggaacagggccgagcccaagtcaaaccttggactatattcttaacgcatattgaggtatgcttgggacccaaactaggtcccatgatgcttttcagatttttgagttacatacgcaatattctccctaagccaggggaaatcccgtgtatgaaatcttagatgggcctggggccctccagagtgggcccctaaccttgtcaccctaaagttaccgttttatttttaaagacattctgagcatgctatttatttgataatgatccttttgctagataaatggatacactggttccgatttcaccgacacatattagagtacaatagtgtcatgaaagatttcaaatttgttcgattcaaaattactgcggtcatttatcacttaaatagtatgtgtttatcacaaatatgttaatttttttttttgcaaaccgttcctaatgttaagtacattgtccaaaaagtatgtgtcttttcagaacatataactggttaaattctaaaggggacttagtgtttaatgtagcacattcacaatgtatgcctaatacagaagaaaaaaagttggcctctatctaactagtacaccgttcatcttttgtatcgtgtttggtgcattctgcttcagccatgctctattcatgtttttcattccttcactcaccgtaaagaaacattctcttgtcacaaaacaaatccagtttaacttagcagaaatgctcaacgacgcaccgaatgctctaattattctgaatatattgacatatgatggcgtgaacgacccaaagaggttttattagaactatgatcaaatctggctaattctatacataggggtaccattgagctagtgaaggaagagagagcgactagccctgatctacactagtattctgcattgaataaaaatgttgtaagatcaacgtgtgttttgattcttattctgtgatgaataattggtatatgtgattattggttttgatatttggagattactgttgaagtggttttggatataactgttttgtcggttttgttgggaccggtcagaccgggcggaggttgccggttagaccggcttgtgttgagcggtcagaccggctagccgacgatctgaccggccgacgctgtgtcggtttcggtttcgggttgtttctttggatatccgtgattgtttcatggttatggcttctagatggattctatacatatgtaatactgttatttgctactaatgagtcaagttggggatagcttggtctcggaatatggtttctttgtttgtttcctgtgtaggtgactcgatgcctcggagagtatttgcggtgatggaccgggagtcggcttggtggtaagacgatgtccgtggtggttagatatcatgcgggatactaaggctaaagttga

SEQ ID NO: 39453 - DNA, 1501 bp, Oryza sativa
attgacatgagcatatgtaaatatgaaatagcatagtacctatcgttttctttgtctgtgcttgggttcttattatgtccttctttttaccccttgtttcgtagatgaagtcagtccaattagttggtttgtatgttcttcctgtaggacctgtaagcctcttcctgctttgattgctctggttactgttgtcctgttaggtaagaaagtacacgtcagtattatgataagatgtagtaacgttagcgagagaaataaaatttagtttaccttcgtttcacaagtcatgtttacattttggtttatataggactcttcgttatgatttgatacatgctccctgggatcattttgttcttgttcaacatcctgcaatagcgtcaatctttttttagcggtgtatatatgtaagtaataatgattaacagtctagcatatgatgtttacctcaaacacatgcgtactatcttttcgctttgggcattttgaatcattttccatgcaatctagtatcaatgatcgcatacgtggccaaaaatcctttgtgaaatctttgaaattatcttgtaaagtttggatgctttcttgtaacctttcttgtaaagtgatgtcggctgatggttcagtggatgttatagagtgtatctgaatagcacaagttagaaaaggatgtcaaacatattttgttaaatagagttcgtattaaaaccccataatatatacctcttcagaagtgccttgaaaatcttcattgctatgtgtttctgagtcattgtcgtgcgctttttcattggggatttcattgcaatgtatagttcccctaatatcgtcgacaacctatttttagtgaaaaaggggtattagagattttacagacagttgatataattagtacatagtattaaaaatgagatagttaccttcccttgtccaaaaaggtaagaaattcgctttttttctttttttttatcccagtactgaattagtggcctttgacggctagaatgatatattgtcgcagccaatttatctattcgcactttttcccaataccaaatctgcaagcatttgaacattagataatgagtattgctatgaaaatatgttcatgacaattttgtaaacatactaaattttgaaacgaacctgtaagaggcatacgttcccctcaatgtttgttgtcttctctctaaattttattatgcctttcagtaactgattcagtgttagactagaccagtttagttccctcattttgtcaacgtcgtcgacgagattgagatattctgagcgcacatatctttgagttgtaggacatatgaatgatccaattgagaaaagaataaatcttcgaatgaagtggtcatcgtagctcgaggagttgattattgcttcccgtaatgcttgtaaagtaattgttgtttggccttcctttttgtacaggttgaacaattctggtttattgatttttggtgcctcaaatatgtcatctccttttgat

SEQ ID NO: 39454 - DNA, 696 bp, Oryza sativa
ttgataattaatttttgaaatgtgtgtagtttaataacatatgaattatatattatgaaaatatttttatgatgaataaaaatataagtcttatcatgttaaactatatgagtttatagagattgatggtcaaatattaaaatatttgacctaaaggcctgtttggtaaagctctgacttctaaatttatttttaggagatgggtttaaagtggtgctgtggatcagtctaaacctaactccatcttctatttcattttgtgagaacgcttcactcaactctagtcctatttaagatgaagctggaactttttgattagacgctttagaataggtgaagttgaaactggacttacgctaaacatacctttatattctaacgtcccaatcgtccaatcgatcgtatctcaaaaaagcacgaaaaaaaacataaaaaagagcagaggcaaccgataaaaaaaaaggatgcgagataggtttgcgctgtactccctccatttcaaaatatttgacaccgttgactttttagtgcatgtttgaccattcgtcttattaaaaaatttaagcaattatttattcttttcatatcatttgattcattgttaaatatactttcatgtacacatatagtttacatatttcacaaaaaaaaatttaataagacgaatggtcaaatatgtgctaaaaagtctaacga

SEQ ID NO: 39455 - DNA, 918 bp, Oryza sativa
tttcagttcaatagcagttgaacttgccgaaatgggactaatgtgttacctgaattgctgaatctaaatctgaaaattttcttctggattttaaaagctattgtttttgtaaataccagtccataaaattagttgtttcccatcgatgttttcatatcacatcactggtcagaagtagaaaacagcacattcccttcggtatatttggttatacacattgatatttgattcgtttctgtcagtttgatgcttcagtggtgatgttaacatgtcctacagagtagcaagtgcaaaatgcatctttgagtgaaaaacatatctgccaatgttgaatcattaggattcaataaagatgacctgattcttgtgaacgatgtggcttgtgcaaaattatttatctgataaacgaactatagaatacggtggagatttactcagtttgtcaacgactgttatgtgtgttagttcttaactgtaccgcattggctcgccctctgtgtgtgtgtgtgtgtgttttacaagttattactgttgtgcatgactaggaaatttagctgttaaaagaaccacactttagtttttttcttggtcatcattagcttttcctgtctcaggttgagaagtggaatgaacagagggagagtgggacatttgcaggaccactctaaatctcctgtttgagagtcttctcagatcagtccgctgccctcgtcggtgtcactgctatcatctggtttgaatttagggcgacgctccggtgcaatatacttgaagtattctacttcgagtagaattaatctggaccctttattttaaagggcaggtaagtaatcttctaatatcctttaggggtaattttggtatgggatgttttattctgttcgcattggttcgcatcttcggttcgcatcgcaggtg

SEQ ID NO: 39456 - DNA, 254 bp, Oryza sativa
cagcagcagccctccttgctcacctcctcacagcagctggtcatcgtcgcagctaccattgccaccagttagcacagccctcgcatcgggcctggagtggcgcaaggccagcattgtcaccgccaaccaagggcttccccgcggccgctagttacgttcctcctcttcgtcgtgtcaccactagctcaggcagtatgaggctactcctccccttcaccatcactgacacccctacccttctccttcgccgcagt

SEQ ID NO: 39457 - DNA, 1501 bp, Oryza sativa
acgggcagcgtctttctccaatgggtcggcgtctattctacaaaaagggaccgaattggtagacttagcgtccaactgagcctccttcttacgcaggccttgtatgcacaacttaacatgtttgactaagcacattagtgacatgtttctctttagaagggtgtgaagctttgagttcagtgactcactacgttggttgctgcgcatacccaacaagtatttcccatctgtataggcagctgcccatttctcccttagtcggtacatcagagcgatccattgttcatttcccgtgcctccattctccttaaaatcagcccaacgtctctcgaactcctcttcatccatactctcataaattaattttcttagctcgtcgagttttggcttacgaaggtgacgactcatattctcctctatatgccaagtacacaatctatggtaagcacccggcattaccttactgatagccttcgccattgctaggtcgccatcggtaattaatgattttggatgcacttgacgcattgcctccaaaaaagtctcaaggagccaacagtaagagttgacagactcatttgatagaattccgcacccaaaaattgttgtacttctgtggtggttaactcctatgaaaggaatgaaaggaagattgtacttgttcacacggtaagtgctatcgaaaataacaacaccaccaaaagcagcatagtctaaacgtgattcagcatctgcccaaaacacattcctaagacgcccttcctcatccgtggtgtatttgaagaaaaattctgcatcttcttcttgcttccttgttagatatttcaacacatcttcagcatcatgacccttgatattcttcatctcgtaccgcgtaaagaaattataaaggtccttcatcacaaaaccaacctcgtctaactcatcgtggttattctccataacctccatgacttgaaagggcctaaggccactcatgcgaagctcgaccgcttgggctttcttagaatcactcatcacacgatgaactcctaaaaaagcaacatggtctggatttgcaagttcgtgcgtatgttggttatcaaactccttaacaaaccacacccccttctcctcgttccgctcaatctcaagcttagctaagcaaccgcagtgggtcagtgcccgtggctcccttttccgctctgtcctctcaaagtgcttcaactccctgtacccttcacatgagcatacgaattgcctccatataatttcaccgtccttccgtttaaggttgtttttcctcacactgaaacccttcccctttgcatagtctaaatagaatttgtaaccttcctcctcgcttgaaaaaaccacagtacccatcattttatactcttcctgatcctctagctcacatagctcgaagtcattatgtcagacctcacctacggaaaagtacaaaaaaaacaaacagatcaagcacccaaatataagcttacgtcctttatacctcataagt

SEQ ID NO: 39458 - DNA, 1501 bp, Oryza sativa
atatatatatatatatatatatatatatatatatatatataatgacgaagatggcatggttttaattttataaaattctagtagcacgtaacaggtatcctgaatagtaatagttttttttttcaataacatgaatttacaatgacatcaattcaattaatcctaatatctaatagtttcttacaactcaaagagagtattcttctgaaaataatggtaggtctgagtaggtcctcacaatcttaccgaagttgttccaagagatttccctggtttggggagtctcatctatgtacgtatgtattaatttgaggtgttccatattattttactgatagaaatatgcattcggtagaattgatattataaaaatgagtaatagacatgattgctgctctgtattaatgcatggccgaattcatcagccaggaaagtgggttctaatccctcgatacgatgttccctcgcgtacatttttcttgaaaattcaatataaatagttataaaagattttaaaaaaattaacaatgtaaagtttagtgacatctagcactccaacaaaaatcaagtttaaattcaacctacaaatcaggaaataaatttgggtataaatatagtaccactatactattcatttgctgaatttatttagagtgagttaagtttggacacaaaatttcatggtataaatgttgtcatttttttataaaaaatataactatttggatggttttagatgaacgagaacaacattcctttgagtggtttcctactttacgcatatgcgctaacaaattaagtagcgcacacttaatccaaactcatttcttttctttcattgaaaactttcaactcaaatttaaaaactgccaagtcaagatttgaatacttttcaattaatatttgatactttcaacttagatttaaaaacttttaagtaaataattcaaaccttttctactatatatttgaaattttcaactcaaatttcaaaactgttaaccaagattttaaagctttaaactcagatttggaaaaaaaaatcaagtcaatatttgaaaacaataaactaagatttggaaactttcgtcacaaaattcaaaacgttcaactcaaatttaaaaactttgatctcaaaattcgaaacgttcaactcaaattcaaaaactttcaactagaattagagatgaaagattcaatttctaaaataaaaaaataacaaaaaaattggcaaaaaaattgatgaaagaaaagaaaactcgtgagggcacggacatgccagccgtgtggcatgtgcgccagcaaaggggtgagtctagtacgcgactgttcgcgtcgagcgaacttgtgtctgctcttgctcacaagttgctccagcccacaacttagcctatgcatatgcaaaatcttcacgggcccactagttagctaaatcatatccgggccttttcttttctcattttgactaaaatctaacataaacaattctattttatacatg

SEQ ID NO: 39459 - DNA, 1501 bp, Oryza sativa
gatttgagattatgggggcaacgtggggggtggatgcgctcgatgcatcgagctttttttttttttggctcacaagcgcctcaaaggtgccggttttgaaaccgttaccaatcacttggaatcaatagtgctgcctccctagtgccggttcggaaaaccgacacctaaggggggtttcccaaccagcaccaaaagggtattatgtagtagtgctgtggactaaccaattatattgtagaaattaaagtagcactattcacatgtgataatagatgataagcttggatatttctctagtttgtttccttttcttattcgatgtataacggggcatgcggtagaggctgtttctaccaatatataacaaaggtacagccagagataaagagttcaatgcttctggaattatcacaccaatatccttctccaaatctactcctatgtcaccatgtcacttttggtccatagaaagtaagtgatgaaattctacacgctttttattcggaatcgaccctcctaacagcatcaacatcaaatggacatagctgctgatccagaaggaatctcagctcccatcagtacttgttggaaagcgtatggagtctactttcagatggttttggtcacacatcaaaaattctcttaagttgtcgggaatctgcagaaaaaagccacataccatatgcagcccgagtctaatttgtgctttgggccttataattgtgtcatgggctaagcccaaggtgtggacgccctaagactaactatagaatgttcctaatcatattaatttagtagcagttatagtttagagtagggttttacttagattatttctgtcattgcattttcgctgctagttcggtttgtgaaaccccaactttgagatcttaaccattcatatgcaaattgaattgtaatctacctttgttcttgtttgtgttttgtgattcgcatgtagggattagccatctcgatgaggtgtttgagaaacaaggagattagccttctccgcctaatctttacctggcagaagatcagacatcccattgtgatcaagataaaatatttgagaaacaaggagctacgtgtaaatgtttatatctttatatatatatatatatatattattaattgtagtccttgcgtaaaatatattaaattagagtccactatagaagtccccacattaatttaaaaggtataaaggttaaaaatttccatattaattagcagctacaaattctcacatcaatcattcactcgagggctcctgccttaaagatgctgcttctgcagcctccacctccctcaccgacaaggtcaccgctgcctcgctctctcgttgcttgtgccgccgcacacccatggcttgcccgccactgcctctcttattaccgagggagaggtggacagagatggaaagcaagaagaggggagggtggaggaagaaattaaaatggaactgacgtgtgggtcccacatgcatgggtattttggt

SEQ ID NO: 39460 - DNA, 1501 bp, Oryza sativa
ggttgcaaacttcctattgaaatcaagcaacaatagaggtgcaaatcgatagggaattgcaacgttgccacaactattgcatccttaggcctcctttaacatacacaccgcttaataacctgtaatcccttttgttggcctccataaaaagcacaattgaaggtttgttgatgaactacaaattttcttgtgggcttcaccaggctcagcaggaattctccacggagttcgccactgaatctaaggagcttgagctcaacacaaacaacaaaccttgcatgaacaatgctgctataggaaacaaatagatagaatgtacccaaatccagtcacccataaataccgaagaacttaaatggtggcgaacgaactgctatctatgtagatggacatatgaggttggaaagtggaagtttgtaaatcctgacttctagagcgtagccagtggcagttctgcaaagttagttttccatcgggaaaattccatccatacaacaaaggtttcaatggtaccagataataccacaaaatccttccacttgccagaattagcacaaaattgacggagtgacgggagaatgacggagttagttttgcgatgggatcacccccacaatctacttctctcatctgattcgctcatgcagccctcactcatttctctgctccgccgccggccgccacagtgtgaaatctgagcagggggaccgagccagtgttacatctcgcctgatgccacttttctcctccacaatcgtaccctccgcaaaccgctggcgtccgtgttgcgccgagagtgctacggcctccattcgggcaggttaggcgcatgcgtcctgggcatcagggcacgtgtaggttcttctatgctgcattgcagccaattgattcgtcagttcctggacagcgagctgcacaaaatttatccaggtgtgcctcctgctgtcctacacactaccgctgccgccggcaatgatcgagattgaaaacccgtcccaatcttgctcccagggcatctctgtaatcttggtaaagtttgtggtatattttcgaaaaaaacacttccccattacgggatttggatcaggtgcagtttgtactatgactgcaacttatgcagtccattgccacctgttagatccgaatctaacggttcacatgcacccggatactgtagatcactgtagcaagaaatatttagtatttttgcgctagtactgtagctgatgatctggtccattcatcaccaaaatggacggctgaaatcgcatgcagtggtttatcttgcggtcgctattcctactgcagatgatcccaatcccccattacggtaattctgaaaggtggaagaatttcgtggtattaattgttaccgttgaaatatttgtggtttatgtagatggaattgtccctttttcgtctataaattgagcttcagggtaacctgcttctgtcaaaaaaacacattcagagtttttagtcatcaaaaaagaaaagaaaa

SEQ ID NO: 39461 - DNA, 1501 bp, Oryza sativa
ggagcaagaaaactggcagaaactaagatcaagttcttgacaggctcctaacaccaaaaatattgtatgctaccatgcataggttctcagattcaagcatttaaaccaagggacgggtgattacacagcagcaaagaattaatatcgcttatgaaaatgtttatcactgacggtgtcaaatctgaccagcactggaccatcaataagctcacattacctacatctaccgcaatctcactctctaccaatccaagaacacacaacaaacgaatcaaccaaacatggcccatagctacacttcttattacaaactaaggcaaagagatagagaaaatgcttctagtgaagacacatgttaacacgagcgaacgcaacggatcgttgcagaaaccactacaatggacgaaagagaagggatcttttgcacacaccccatggcggcggagggagaggccgagagatctccgaacggcgatgcgagaggagggcttcaatgacggcggcggctgaaagtggagtgaggaaggaagacgagggagattctatagtagcaaatctcagcgatttagggttagcgtggtgcgcgctgagattcgtgttggggtgatgggtataatcccacagtcctcgtgaggtttggtgagagactacgaggcggctaggccagttcccggcccaccatgtcattcattgtgtgaacaggtccaaggcctcctattttaaaaaaaaaaaatttcgggccaatttgccagtagatttttagtttgttttctcaccttggacgtatataatcattccgatgagcattaaattttttttaggggccctatgaaaggatttgatccgtagaaaatttcagaggaaatatgacatgaagttctaaactattgtaactttggaaaaaatccaactacccctctaaactttgattggaagttcattaagcaccgtgtactttgaaatcggatatctcttactatcgaatttcatgcccgttctcgagcgattagccccgccacgtggcttcactcgattccagggttcgagtcgtgcgcgcatccgttggattagaaatcaacgggagagatccacaaaaggatctatttataaattttaatcttccaagggagtttatctcaaaatgtggcatccatcatccagattccagagaaatcctttcctcccctcgtctcgccgctttctcctccgccgaatcgccgattcacaagccgtcaccggcgttggtcaccgccactccacatcagtgcgcctccctcgccaatccccatcccctaaaatccctagcccacagctccaccatcgtcacttcacctctccgcgcctccgctttccccccgggcccaaaatttttcttttctccgcatctcgcgagctgagcgttgtcgcctcctcctcatctcctcgctcccttgccgcccgtccgcttccctggcgcagctctcaagtgggagggctgcgcgccggctggaagtctcttgac

SEQ ID NO: 39462 - DNA, 1501 bp, Oryza sativa
atatcagtccaatgaaagtaagtattaattgcttatatggatatataaatggagcttacagtgcaattaattgggataacgtattgttagctcaccttgcttgcatggctcactgcttagtgctcactattatgttcgcttgtagctgctcactattcttcggacttgagctcaaggccatccggcatccgccacatatagcaatcatctaccttaaatcacgtgactttaggattactgaaatgtagatccatatcaaaaaagttccacatgtcaatgactcaaaatcatgtgacttaagatagaggatctccatcctagctcaataccctactactattggagttggtgtttatatcaaagttgttgaatgatcagagcacaacaccgtatggcaatgtcatccatgataacgtgggttacttcgttgatgcaagctacaaccatctcgaatgaagaaatataggagacgagcaaagagaaatgatcgtcgtcacacgtagttggatagtgaatctgtgaatgtgccaaatagtaaacattgttgttccttttcccaaatactatatggatcctcacgagcatatatgtatgagttttgaaacatgattgaaccatctttaattcatgttttcaaatcctggaataattaacgttttgccacttttacgagtggttctaaagaatttgccactagacccacatatcatagatatcgatatcgagtggcaaatcattaattggcacgtgacaaataattatgccctatttgtttaggcttaggcttattggcttagatttttaagtcagcttatttgcttatatgatttatatattataagctggtggatttaatgtcttaagtttaatggtggagtcatgcatctacctcacgtaagccaaaaaaagcttctccaacctagcttttggcttaatagtgttagagtggcttatggcttcaaaaaagacaaacgaaaaaactatttgtttgttcaggcttaggccctgtttctttcagcttgagattattataatccagattattgggagtaagctgaaagaaacatacaacttattgaagcagcttattataatctggagtccagcttattataatctgataagctcatttaggtgagctttttccagattattgggtgaaaaattactcaccatgccactccactccctctttagacttgcaaacccaataatctaggctctaataatctagaaaagaaacaactaaccgcttattctactacagattataacaatctagcttatagtaatctgactcaataatctagattataataatcttaagctgaaagaaaaagggtcttagacttttcggcttataagttggcttataaccctaaacaaagagggcctaatgtcccttcaatctcatgtcattcttaacgctgattttacacttaacaccctcaacttcccacacccttccgatccaccctcgcatcactcttccagcctcccc

SEQ ID NO: 39463 - DNA, 609 bp, Oryza sativa
cagagggagtatttaacacgtaaatattccgcagcaatacgtgggggtgtcatctagttaatttatattttgaggtttgcccgtctataagggttggaacccctctcggcatacaaaataaacaacgtttctaccgtctataagtttctagacatctattggaatccatccaaatatttccgacattagaaatttacaaatgctgtctccggcgccgccgctcctgcagccacacttcagaactttctacttgctgtgtttctattgcctgtggaaccatcgacatgatgtggtcttttgaaacttgcaatctcttctcaaccttttgagacgatgtttagaagaaacaaacctctaggaacaccgtttcaaaatcccagagagaatagcagtccagtcttggaaagctatattttccaattctattttctctttgcatttgtaactgctagctgctagctagcttgaacacttcaattgtaccctatttttctcttcaatggaaatctaggtggggaacctctcccctccggtgattattaaaaaaaattaaaacaatgtatcagcgtatgattcattaagtattagtttaaaaattttagagaaaga

SEQ ID NO: 39464 - DNA, 894 bp, Oryza sativa
aaaaccctaattgcgaaattagattcaaggcttggtgtctagtgtccgtgccatctcagatctcaatcccccgatcgatccgtcgagttcaattccgaatccaaatccgaccgaatcaagtccaccgcaaaagtcagcctagccacccccggggtagatgggccgagagaaattcggcccatcgaccccgggggaggcaaaatagacttttgcggaggaattgatttggaaggatttggattcggaattgaactcgacgatagatcggggattgagatctgagatggcacggacactagacaacaagcaaagaaacaaatttcgcaattagggtttttaagagataatttttccgctaggctccatgacggaacgggcgctacagatatatagctggaacatgccaatatcgcgctagctcagaacctcccaagatttttacaaatttggttaaaattaatgatccactaaaagttgttcaaatttggttgaatttcattcaatctggtttgagttaatctaaaaaatgggtttaaattcaagattctttcagcgatatttgattcaaagttgttaaacgaaaaactgggctcctacttgcgaaaatgcaaggtattatggcgtcgagttattgcaattcaggttcgaaattttggatccccaacgagtaattgtctcacccaaaattttcagaaattttcttaattttttatgaatttggtccaagtttattgaaattcaatcaaaatttattaaaattcaaataattttgtgccaaaaagtgccaaaaatccagaaagtaccgaaattttgatcaaaatcgaaaatgcagacccagggataacctttgatttggaaaaaggacaaaaaaaaaaaatagtacacgcattgatt

SEQ ID NO: 39465 - DNA, 377 bp, Oryza sativa
atgttgcatataggaccttttcaacagagtgagaagaagcatgtgacatcttggctgccttgatgtagaatttcttcaaagcttaaagacgaatcccaatttattacaggtttcaaccaacaatcattgactgaaggggcactgaattcctatagatgcaagtaattcagaacatttggatatattcctgataagcatgttcttataaagtggagaatgaaggtttgagatatgtcttttaaacttgcgatgcaaactgaatcattttcgttggaaacaaaagaatatgctcttgggaaagagattgatctgactatgctattccatacatcacccccaaaaggaggtttcttcatcctttacctcacattttgcta

SEQ ID NO: 39466 - DNA, 1501 bp, Oryza sativa
gtcgagaaccgggtgtagccttaactcgaccatttgaagtggaaatagtgggagaatcgctacaccgctggtcgagaaccaggtctagccttaactcgaccacttgaagtaaatgtacgagagattgctatgattgactggttgagaaccagtgagtaggtgtctctcgaccatttgtagtcgtggtacgaggaccgctacgctgccggtcgaagactagtcatagctgtccctcaaccatccgaagtcatctgaagtcatggtgcgagggtcgctacgctattgccgtagtcgtacgtcgaccatttgaggtcgtggtgcaaggaccgctacgctattgctgtagtcgtacctcgaccactggaagttaaggcgtgagagatcgctacgtcctactggttcaagaacaagaagtaggagtctctcaatcacctgtaggggcgctaaagttggtttattacatgtgcatctcatgtggccagcatgactcacatacctaacttatagcgtatccagatgtccgttcacaatcatatcgggtgatcaagccgataacgttcacgaggaattatccgttaacaaccttttctcgaatagcgcagctatggccggtgctatgagataggttgtcggtcttcgttggtaggtatggcacgacgactctgcatttgtcgagatcgttctggataatggggtgtactcgaccacaacctactcgagtgctcaattgttcctgaaaaatattttctagaaggcaagatatatagcagagaatatcgagtatgtactcaaaaaactgcatggatcttctagtattattaggatataacgagcagattaaatatcatggattatgtaaaccgtaaacaagcatgatttatacagaagaaaatagtgcgagcccccagtgttagactatagttggcctaacatcggaaacgctcacacaatagatattgtataaaaaacatgctctaggtaaacataataattattgatctgacaatattgtatgatctgaaaagtaggtaccataaattgcatatataataatgcgtacctttgtagatacatgctggatgtatctacgatattagtagattaatttaaaaaaccaatctaccaattaccttgttgcgtactcgtttgacatcatacggtctgacatcttttggtacgccgtgtatctagaggcttggtcgatctcgagagatcgaactgttgatgacgatggttctgaccttgtcggggcacgtactctggctaggttagacttctcagatccaaagtagttgaagtatccctcgtcaaaaaatccacaatgacgatgacttggcaaaacttgacgatgatcccgatccgccggagaacgtacttcgttcgggtcatatcacccaacatacgaagtcgttgagtagtttgctgttgaagaatccatctcttgaacccatctcgtcaaaatcctgaagcaccaaaatcccctacctggcgtgccactggc

SEQ ID NO: 39467 - DNA, 397 bp, Oryza sativa
tcttctatggttgtcttcataaaaaaattgttcatttgggacttctgaatgattctttttcctagactgactatatatgtgtgcctccatgtatgattctagacttttctagtaatagtgccttcaagtgaaaaatatctgtttacttgagaaattctgtaaaacactcacacttactcacgtggttatcttgttgatcatgccttgaatcttacaacctatgattaattcagaagactacatggttttacatttagttcagcactttgttcatgtgcaacgaatcaccttgtagcaaaatgaaagttgtcatgaccataaatttgtgacgatgctatggtttgaacatctatttgcactcctacaaaatttgtcttttgttgcttttgccatggca

SEQ ID NO: 39468 - DNA, 403 bp, Oryza sativa
tctctcctctacataagtttatagtaggcttatagcttactattatacttgctcttggcatgtcggttttgtcggaccgtgcctctgattataggggccccacccaactcctgagattagcgatgtgattaacttaatagcacggagtcgagattagcggtgccgtagcgtagcgacgtctaccgagacgagcctgtgaccgcaacgagcttatgatcgagtatcgatccgcaccatccatccactcctctgcttctcctcgccaacaataaacaattttgatttgtttcaattaattctgtttttaccgtacatttaattttaagagggaatggacaatagtctcacatgtcagaattttggggagttgatgctggtgacaagccattccattctttaaagg

SEQ ID NO: 39469 - DNA, 236 bp, Oryza sativa
cagtagatataaggtatgattttccataagtacattactctgagtatgaaatgcatgtccagctatgaaagattatgctttgtgttgtatgaacagataaacaagtcagagtattatgaacaaatcaacatggtttaagtcatgtagcaaccagctgttccatctaatgttttagaaaatattctgtcctaaaaaatggattagctttgtttgcctaattgctttttttaacatgc

SEQ ID NO: 39470 - DNA, 1501 bp, Oryza sativa
ataaatagtagatgtgttgaggcctctagatatcgatttggtaaaaattaagtttagagaaaagttaggtttcgagttgagtcaagatttctgagagaagtgttgttgttacactttgtaaacacgaacataggcaatataatttaatctcctttcatgagtcttcgatttgtgtttttgatcaggtgtgggtggttacaccagcgggctaccggctgtcagaccgattacattgcgatggttagaccggccgagcaactgcggttggaccggtggcggctagagacaatgatggtgtgatcacgcggtcagactgatgcatcaactctgctcaaaccgagttccatcagctacgagggtaacttttagttctgctaacagttatcggtttttggtagatcaaccattcaccctctttgattgattagcttagttcttgatgtgctacccaactgtctttttattggtgcacgaagaataaacttctcgagtaaaaattggtccaagaatgtcggtgaacctgcggtaatataaattatcattcatcactgccggctcatggcacatggtgatgtgcgatgtgtgatatctctaggtcatgcccaaaatcatgaaggcgtagcaattagaacaactaccatcagtaatatttatgttggtataattgtctccaccgacgcaaatgtttttttatgcatgcttttaatccttttatattatatcttgataaattttatggttgctgaaaggtatcagttagggttatggataccacatacctgatagtagttgactaaatctcggcaagacccaccacataccatgtcttatacggaaacaaccttcgaatataggaggagttccggataaggaaagacaactagagctctacatggaaacgacaagtactactcggattgtatgcatattggtttcactagttctatttggacaaggagacacctatgggtataaatacaatgccccctaggaggagaggggacacgaaacaatagatcaatatacaagccaacataagccaagacaagccgccggatatcaacatcagagataagcctagtagtccccatacggtacctacgactaccgtcaagagggatctaacgctatctctgatctcgctggacgtggattcgaggaggaagactactttgttgtcgactacgtaacagcacttcagactgccatgtcgacaacagatagataggctaccccaaatattgtactggtgtgattatggtaaataagagcaacaaccggcttcggccaacaggagtagggttattagctgacaattcaggggtccgaacctgtataaaaatcctcgtctccatcttttttactacaatctcgcatatatcctagtaccaacgatccctatactatgcaaataccggaatcgcgacatcaaacgtcgccagtggcacgccaggtaggggattttggtgcttcaggattttgacgagatgggttcaagaga

SEQ ID NO: 39471 - DNA, 1501 bp, Oryza sativa
cctgatggtttgaattgcaatcattaaggagtaacactaggtcatataatagatgaaatataaaagaatatagataggctcttacagataacttgcccatgaagttgttaatatagccttcatcatccttgtactgcttccaatgagggaagacatgaactttagtcctaatgataacaccagcctctgatgcaaacttggcagcttgcaccggttcatctggccttttcttcccttcggcaacagcaatgggcattcttcccatagctttggtcatcttgtcaagcattattcctgcagttggtggccttgattttcttgtgcctcttcgtataggtactacagagtattcaattacaatgttagcattcatcaaatagttaaaaataataaatttctcttcgttgaactaacttgccttcaacatcagaattggtttgctgtgcaggttgctcttcatggttggcatcatggctcgggggcctgttcacatcattatcttgaagcaaatgtccactgcccacatcttcatcaccattgttttctgtttctggaggcagttcttcatggcattacctttaccttgtgctgctatgagttgccttttcgctgaccttgttgagactccaggaggcatttcggttggagcacccgccctcactctctttgatatccttactcctggtggcatcttgaaggtaggtttcttcttcgtcgcacacttctttcgtctagtttgtcgagggtactacaataataaacacaaaagttgtaagcatgtgaataaattagcaacaatcattaaaaaaataatcaaatgctgcacaaattaaatgcggaaaaattattgcagatatcctagccccccccacagccaagatagaagaagcacctcaatcattatggggacgggctgctccggttctaaatataaatcatcatcacactgaaccccttgttcatcatcttcagggagaaactctgatgtatcagaaccttctccatgacttttcttggtgcctgagttttttgtctttgaagatgcatgttgtgtttcgatatgtttaatagtggcagctatgtctttgatgccaagttcatccatccttcttatattctgcaagattttctcttgccgcgttctttcatattcgttttgtgtaggttcttacatgaatacacatattttaatggtcagaatactagatggcattttgatggcatttcctaagcatataagcattttcagaaatagaaacaataaagtatctaggcatttgggatgaaaaaaaaagagaccatgctcatcaacattggggatttaatgatcaatggtgaaaaacaactttacttcaatatctagtaaaaacaacagggtgattcacttttccattttaaaagacaattttgatgagaactctggaaacacttttacagtgaacaacattggtcatataaatgatatagccattatatcattctctttcacctaataaactgt

SEQ ID NO: 39472 - DNA, 435 bp, Oryza sativa
cacctttttatgtgcatcataataattccaaagaattagtgaatcgcgttaaaaaggattttaacagcattgggccacaccatcgtgaacacagattgccaaagcaaaaagtgcctaagtccctagagatcacaacaggccacgctgattatagtattgggctgaagtactgtacaggcccaggcccattaatactcccgataccctaataataccgaagtgaaaaacgtctcttcgtcttccccgccgagactctcaccattttccctatttcctgctacagtgcaaaactgcgccgggcaaactagggttcatcaatccgctccaatccaccctcaaaaacttcacgaaatttctccccgcatccaccgctccgattccccatccctttctagccgtatctcgaactaaatcagaccatccagttcacattca

SEQ ID NO: 39473 - DNA, 1501 bp, Oryza sativa
ttcgttagatggaggataaaagtgacatttcccattctgatttgggcaaatgggcggcaatggaatgttttggggctgtcattggcggtaggtttaggcgccgaacgaaaaatcctccatccatgagtaattaacattatccataaatcgaaaacattcaaattatactaatctatctggattaacaatttgactttaaaaatatactccctccgttcaatattatataacttgaaaatttggattaagggggtgtttagttccagggtgtaaagtttttaaagtatacggacacacatttaaagtattaaacgtaaactaataacaaaactaattatagattatgcccgtaaactacgacacaaatttattaagcctaatccatccgtcattagcaactgtttactgcagcaccacatagtcaaatcatggcgcaattaggctcaaaatattggtctcacaatttacacgcaaactgtgtaattggttattttgtctacatttagcactcaatgcatgtatctaaacattcgatgtgacatttttggaaaaaaaatgtgggaactaaacaccccctaatattatttttttaaagcaactttcctataaaaactttttggaaaacacagacaatttagcagtttaagaagcattcaccgattaatcggaatacggttgtcagacggaatacggttttccacaacactgctttaagcatgactgaatttatttttagaaactagcacctataatatattataggtgtctttttttaattaattggcacctatgacaaattaaaggtgttggttttttttttaaaaaaaagaaaaccaacacctatagtattggtgtcggctcttctatgtcgcgttttccatctactccctatccacgtcgcgaaatttgccgacgctttccctttcccgtgtgtgggagccgccgccactgcactcgatggatatgatcagtgatagggaagggtgctactaaccgggactcgtctctgctgtggacgtctaccacaggggcgcggtcatcgtctcccatgtcatcgagacctccatgtcatcctcgtggttgctcacctcgccattcaccatcgtcaccgtggaatgcaagaacctggttccagcctcggtggcgtcgccggtggatctaaagccaagctggaggatgatcggcgacggaggatttgagccaggcaggtgataaaatcgtctcagtttaccattcatggatactccctccgtcccataaaaaaatcaacttctggctatgaacctggacacatgttgcgtccagatttatagtcagaagttggttttttatgggacggagggagtatataggtccaattgaaaattgaattttaaaaattttatgttcactttaatctgggtgaaccggtcggtgtttgtaggaaaaatgttggaccggccggttttaatagaacggaccgggtggtttggaccgacttacccctcattcttatcggtag

SEQ ID NO: 39474 - DNA, 317 bp, Oryza sativa
ggaacgatggaactcgatgaaaccgacgagatcgtaatcgagttggttcgactagatctcctggcgatttggctcctgcaagctccgacttcataggctgtggtggttgtgttggctatgagattcgatgccttaggtcctctcagggggtcccttttatatcgcaggtcaggcggtttccaagtagaactcggagacatcggaccctacacgatacattgacgacccagtcttgtccgagtaggattctttccatctgtaactccatgaaggatttcctccatgtaggtagaggatcgttcataaacacgtggaca

SEQ ID NO: 39475 - DNA, 1501 bp, Oryza sativa
gctgtaatcgagaatttggattgaagtcaagaaattttatctcggcgggtacaccatctcttcattccgtattccttgtcgagatccaccaaccgttctcgagcgatcgagaaggcgtagaatctatgacgaagccttgtcaacatttgtcgtactcgccttagtcgatcttggtgtagaaccatagagacatggagtcttcaagaatgtcgaatagaattttcctgaaatcaatacttagaaaagaatattagatagaaatagcccctaagcgaacgctcaaagggtgacatgttataatatgtatggaaaactaaaataaataaaaatttacagaccaatgttttgtgtacgagcatcttctcttttatggacttcgatcagtcaatttgttgagtcatacactctccctagcccccagccttgtcatcggagaatcgttctcgaaggataaggctcttggacccttgacctgccttggttgaaaaagcgcttacagtagcccccaacagtgaatttggaaaacccaatttccgattacacagcttggttaatatgctcggtgagaactcttacataaccagatcttacatggtcgttcgtctctgtattacctgacaaggccttatctgctctaggcgtccccagccaaagttcccataggttcctcggaggccttgccagggcggcgtaaagggacagtaggattggtttcaactctaagtgtcgtcgtggtaagggatctctgggtaaaacacttggcgatattgtgtacctgatatcaactttgttggagtagaggtaatgggaggatcgctacaccgctggtcgaaaactagttgtagccccaactcgaccacttgaagtaaaggtagtgggagaatcgctacaacactggtcgaggaccgggtagtagtcgtaactcgaccacttgaagaggaaatagtgggagaatcgctacaccgctggttaagaatcaagtgtagccttaactcgaccacctaaagtggaagtagtgggagaatcgctacaccgctggtcgagaatcaggtgtagtcttcactcgaccacttgaagtggaaatagtgggagaatcgctacaccgctggtcgaggactaggtagtagtcgtaactcgaccacttaaagtagaaatagtggcagaatcgctatgcctctggtcgagaaacaggtgtagtcttaactcaaccactttaagtaagggtagtgggagtatcgctacacctctggtcaagaaccaggtgtagccttaactcgaccaatagaagtggatgtagtgggtgttggtgtttattaacgacattactagaaatataattcccagcaacggtgccgaaatacttctggtatattatggttatagagttcatccgcaagcgcacgcatataccattgtagcatttcactcgagagtattccaatggtatcgtatttattttatccggtgggaagatcatgtagagagaactcaactaataatt

SEQ ID NO: 39476 - DNA, 1501 bp, Oryza sativa
aatcattcactcgaacttgtgatagattacataacttgtgattgactcctcaatcacctttggcatggccatgcacttccataatctataacatcaaggggcccggagatatctctccataggaggggcaaatcccatcttgattattcatatcccactacatgtttcatagcatacccgaaaactacttttataactacccaattacggagtagcgtttagcagtccctaagtaagctactacatatgttgggaaccatgataatctcaggtctaaggattcaacaccaacactaaatgagatcactgacgacacaacacatatggctcttgcagtatctcatgttgggtctatccaacaacatgttcaccaacacgtgtccacattattaatttggtatctctataccatgatccataagacatgatcgtcaattaatacatgtgctgatcatttaaacatatttgttctacatatgatatttgatcagggatcctttagaaatagtaacaaacaacataaatagtcccatgaaagaatcatatattcattaactaataatagtgagttatctatttcaaggaacaatgtcgaataaatatataaacatagtatgtgatacaatcatctttataattggctatagggcatatcaccaacaacccgatcaccataagacaagaaagctgagtttgcagacaatctcctttcaattctattaacaagaggataattgtcattggtacctccttttacactctccctccgttctgatatgttgtaaccaacgtcataaaaatgaaacataaggagtatatattgtatatacaacaaccagctcccaatacacaggttttttgattattgcactatgcatgataatttttgcctcggagggtgaataatgacactggaagccagaacatctctgaacttcagagttccttcttgtaagcatatataatgtgatcctgaaggcttcttattaattgatgaacccacgaatcgatgtgagaaataagcagaaaatttcacaatggaaaaaaaaaggttgttctccgtgcccgatcatccccacaatgttgccaagaaagaacagtgagaaatctcaaggaattaaaaatgctaggcgcaacaagtttgttacacaacttccatgagcatatgaacagtgtacatctagcttagtcataaatcacgtcacaatgtaatgctctggttcaattagtccatggctcacgtcatatctgcttgcttaattgtggagatgagcagcactcctcacatcacattgttgtgctctggttcagttagctagtctgctagtgccatcaataatactgctaaactgcaagtcttcttatgattaaataaacaacatttaatttttggactaagatatgagagtgattctcaagaggtaccaaatttttttactgtaaaattaagtatctctcagcttctccagtgctagatgttatcaaatttgcattgatattg

SEQ ID NO: 39477 - DNA, 1501 bp, Oryza sativa
tgtttgcattttaaaaataaaagtaaacatctaacgctccacagtaaaagataccattaagaggtatttaaaacctagcacatgtacttaggtagttagggtaaaataataattgttctaggagattgagaagggtttaattgtttttagtattagttctagctacataggtacctatcggtaattgtacttgtcttgtcttatcttgttatttacgtgttcgtttttgagatttatatttcttcgtaagaacatgttcacaggtaatcctccgttacattatttaaatgttttgtagaattaattatttatcaggatttacttctccctctatttttttctagtaaactaattcaaactctagaataggaatgaaatgatgtgggagaaaagaaagaagatacaatctgatttttttggtgtgtagatccaatcggtgcttaggaatatttacattttctctaatgtacatgcagtaccgttcaatggagccaggtatccaattcgacaataatgccaatatttcattagttaattactccgctatcaatatatactataatttctatttcatatcttgcccctctacagatgaactgttcatattactccacctctcaatatccctaaatatctcgtgaacaccatagaatctgtcgactatatatataggtcagggcatcaaacaaaaattgcttcaactgcagaggtagctctggttgagagagcgggaaacgtaaaattggcaagaaaattaaaggttgtgctcttattcaagcctgcattcacaggaaactagtgatttttcattttttattgcccgaaagtagtctagaacaactttggtgaacaataatttatacacgctcccttgtgctttagattacaataagaggctcgacatctcggcatctgctaggttcctcgtttgtaaccctgcctctaacctatataagatgggtagggagccctcgaagaacatgagcacagagatttacaaccagatcatcagatctatactatacctgttgaaacaatatttcagcaatataaaggggtaacgcacaagacctaaaagtggatggatgcggagacaaggatttaaacaggttcaggccctttcgatgagaagtaataccctactcttgtttgaggatttgaatccgccgggtatattatagatctgacgatttagttgtgaatcatctgcccctagaggcctccttcccaccttatataagatggggggcagtattacaaaatagaaaccttaaccaatacggtatcagtttcctaaatctactttataatattatcaaatcaggactttaggccgttccataatatacaaggaaacgtaatacccaagtcatgatccgttacatatttcataaaaataagttatcccctataaccagtcggataaccatgccgtgtgggtattgtcagggttacgggttaggtataccctttaccctttgatatacgtcacatatcgata

SEQ ID NO: 39478 - DNA, 1501 bp, Oryza sativa
ggctgctgaaaacataggtcaaatctcaaaagctgaaccaatagatccagatagtttgctgaggaatcagaaatttgtttctattagaatcaggattgatgtggaaaaaccagttcctgatcatgttatcttggagcttcctgataaatctgaacttaaagcttttctgcattatgaaagaactcccataatatgtactttttgtggtctcctcttccataatgttcaggtctgtcctcaaagacaaagaattatcattcaatttccagatgcatccgaggaagatcttaaagataaactaggaaagtggatcactcagatcgattatatgccatcagaggcatttttggatatggaggaatccaacaaaaattcaattgtggaaaaattcaggcaacatttttcttctcctcaattcaagaacattcaagaacagcagaagcagcaagagagaggaagtgggaccagccagtcattaatgcccaagctagattggaaaaaagcgagtgagaaagctttgactttagctggttgcagcactgttcaagggcccccaagtcaagctgttcacactaccacagtaggcaaacaatgtgagaaaaaagacaaagaacctgatatacaaagtacaccagaagttggtaccgaagagatgttagtacatggaagtacagagaaaaagaagctggtttcaagtactatagaggatcatgtcagctgcaactcaaagaatgtcaatactgctggtaaggtgcatcagatggaaccagtccagtctgttccattggttcaccgagtttcacccagtgcaagtgcccatcagaacagtttagttaaccctgctattggcaccaacgaagtgcaacacagaagaagcacaagagctaccaagatttatgagacagcctcacaacatttaagtaagaagagagggtttcatgaagcagcccatgaatctaccaaacgccattgctccccaactacttcagctacctcttccttctcgattgtgggaggtgaagaacatggagggattgaatcaagaagagcttctccaactaaccatcattcagcaccaatcagggttccaagtagaagaggtgggcagagagctacaagatgggatcagagaggaggttatggtggtggaatggtgacctccacttcttggagacctcttgctgctgctcattctgatgtcattcaaagagatgctccaagatcccctcaaagcattaacaattttcatagcaggaagcatacttggagtgctttggaggtgcatcatgatatctttgttgatcaagctgctggagatactcaagggggtggtgcaagtgatgctggagctagctccaggctgatactggctacagatcctagggaatgcaatgtttcagagattcagcttgttgatcccagtgctggaaacggtggagatggaagtggaaagaatgatggatgggcaatggcgccagcccataaggcgtcaagggcgcca

SEQ ID NO: 39479 - DNA, 1501 bp, Oryza sativa
caagtagaactagggaaaaaagtatgatccgagtagtccaagcagcgcaagtaggcctatgtatttcatttattatctaggaatccttccttatctattccagactttatctaggtttgtttctgtattggacttggtctacagtggtcttgcgaggtaaatactatatatagggtatccaatatccagaacgctgacaatattcgaacaaaacatactatgtacaccatgaattttatgttttgtcatttgaagaaacccttgcatgggtgaagaaatggggagcgtcttcatggaatacatttacatttatgatcagtgaagttggttggggaccaaatcacggccttcctcaagtctactccaacaccaccatgccattattgagccatagaaggcaagagatacatggtttggagtcagattcgggtctcctaacaacattaacttcaaacagacttagctgctgattaagaagaacacttcggtcttcctcctaagctgtttggaattttctaaacaaaccacgtcaaagtcagtttttaggtattggacttcgtaattatatcataggctaaacccaaaaggtgtgccttataaatgttttatattttccactaagaatgaaaatggccaaatgaattacctagatttggtatagaaggagggcaaaagagaaatcatagacactaacgacgccaaaggaaaaggacatatatatatataggcccattaaaagaggatatggatttttttcccacggagggaatgtttactcattttcttacatgtcatttaactaatgaaaagcattgaaaaaaaaatactccctccgtcccgaagtataagaatctaggaccagatgtctgtccaaattcgtactactaggaaatgtcctatccgatcctacgttcttatattttgggacggagggagtacaaggtaaaaaagatcgaactaaatagcggtgattctaacgaaactttgtatacataaaggaccctgctaatgcttattttgtgatgaataattggcatatgagattattggttttgatatttggagattattggcaaagtggttttggagatgattggatttgcaggtgatgaacaaagactactgattgagcgggtccggtcagaccgggtagtggttgccggtcagaccggcatgtatcgtgtggtcagatcggccagcacgtggtctgactggccaactctatgtcggtttcggattcgggttgatttgttggatatccgtagataattcatgtttatgacttctatatggatactatgtgtatgtagtattgttgtttattaacaatgagtcaagttggtgagaacttgtgctcggatatggtttcttggttgatgcatgtgtaggtggtcttcatgccttgggagagtgttgccggtgatggatcgggagtcaatttatgagaatatgacgtccggacgatcaggatatcgtgcgggatgcttaggctaaatattaa

SEQ ID NO: 39480 - DNA, 1501 bp, Oryza sativa; identical to SEQ ID NO: 39410

SEQ ID NO: 39481 - DNA, 1501 bp, Oryza sativa
ggtatcgggagatgcttatgggcctgggcctaaacaatactttcagcccaattttattatcagcgtggctggttgtgatccttagggacttaggtatatatttttgctttggcaaaagttgctcacgacagaatagcccaatgctgctaaaatcctttttgacgtagttagataattctttggaattactacaatgcaaataaaagggtgcccaacagaaaagtgttatactaattttgttggcctttttaggctacaaagctgttcgggccttattgagatgactaattttaaatggtcattctctcagcatgttatatgcttaccttaataatggcgtgggtcatagcttaggctatttagactcatcatttatcatgctttataccacatttgatgagtctttttgagagtttttactcggatttttatcatgtatgttggtttatagacctttagagtgtttctcactcgggccttttctatacctcatttttggcgcattaaagctaaagcagtcggctggatgttttatcagatgccacacatgcttagccatataatcccttgggtgattcggttgtaaaaccactcggatggatgttttgatgcactttgactatatgtttagtttttatttaactaatcacatagtcgggggctacacctaattagatgcatctactcagaagactaagacagaggaagttgaagcactcggattatcatttgaattacgagagaagactatttcatcgactgtaaaggtgtcaggggctactgtggagattatggataccccatacccatacgacatgtatatccgattaggtatggggtgccatgtatagatagaatatcttcaaagggaatcgggttaaattccaaacttctatgtcaaggaaatacccgggatcctagtcggttacgattgtatcttatctgtaactacctattccgttagggatatgggttgtactttgtaatacggacccctttccctatataaggaggtgtccgggtgtcttttggggcacgatttttctctcagatcatacaatcaataaaacactcggcggatcaatcctcgaacagaagtagggtattacttcttattaagaaggcctgaacctgtataaaatttcttgtctctaaacccatccacttttccagcttgatagccacccctttttagtattgccaaaatcttgtttcgacaagaagggtggtgacatttttttcatttctttttctttcttttaccgtgaattgggagaatgggaggggtatattttggactgagggcaatctggtcattttttgaaaaaaaatggttgtagcggtgtggaatcaacggtaagttgacggtgatggcatttttgggagaaaaaggcttgtacgatggtattttcagaaagttgctcttgtcgatggtatttctgggattagtgtactcgccgatggtatttcaaggattttctgatatcttggatactctagg

SEQ ID NO: 39482 - DNA, 1501 bp, Oryza sativa
cccttgcgaaggctggataatgtatcggcaaaactactgcctgatacttccttcgtttcatattataagactttctagcattgcccacattcatatatatgttaatgaatctagacatatatgtgtgcctagattcattaatatctatatgaatgtggacaatgctaaaaagtcttataacctgaaatggaggtagtacttttcttttttactggaacggaggtagtactttggtaaagagtggattttttcttggaatatttgcaccaggtaatattcttcctaaaacttaaactgaaattttcaattttcacacaactgaaactgtccaaattttaggattactattcctaaaactgaaatctgcactatgatatacgaactcattttcgagttgtagaccaaaatttgtccaaatttattgaatgtcaggaaccaccaaaattaaactgaatgacaaaatagctaggcaagaactcatatgaacaccactatatgctcagaacagtacaggctagcagaactctaaaaaagtcgatcttgaaaacaagaggaaaaatacaggcaacaatattgcgggtctatgatataaagtcaagcaaagcatatgaacaacacatcccaccacgccgccgctgttgctggaatctcagaatctctgcgtggcaagagcaagccacaaacaaacagcagcaatgctacgagttagctaaagaagaaggcgaggaagaagaaaatcacccatatatagcccgcgacctccgcgccggcgcctgcggcctcctcgtcgtcgcctgtgaccgccgcaccgctgcctacgaagccagcgctgctgcctgtggagcccgcgccgatgcatgtgaccaccgcgccgccgcctgtggagccagcgccatcgccgccgcctaaggaccctgcgccattgcctcggactcctgactgctccttgcgactgccgcgccgataccgccatgtaccgcccgcgcctcctcctggaactactgcgtcaggcatagcggcaccaccaccgtggagtgctgcctcgccgtcgtcgctgggcggaagagacgcctgaatctggtttagggttgtagaagtgtggagattatggataccccatacccatacggcatgtatatccgactaggtatggggtgccatgtatagatagaatatcttcaaagggactcgggttaaattccaaacttgtatgtcaacgaaatacccgggatcctagtcggttacgattgtatcttatctgtaactacctattccgttagggatatgggctgtactttgtaatacggacccctttccctatataaggaggggtccgggtgcctcttggggcatgatttttctctcagatcatacgatcaataaaaccctcggcagatcaatccccggataggagtagggtattacttcttattaagaaggcctgaatctgtataaatttccttgtctctaaacccatccacttctccagcttgatagccac

SEQ ID NO: 39483 - DNA, 1501 bp, Oryza sativa; identical to SEQ ID NO: 39444

SEQ ID NO: 39484 - DNA, 1501 bp, Oryza sativa
aaagaaaaagaaatgaaaaaaatgtcaccacccttcttgtcgaaacaagattttggcaatactaaaaaggggtggctatcaagctggaaaagtggatgggtttagagacaagaaattttatacaggttcaggccttcttaataagaagtaataccctacttctgttcgaggattgatccgccgagtgttttattgattgtatgatctgagagaaaaatcgtgccccaaaagacacccggacacctccttatatagggaaaggggtccgtattacaaagtacaacccatatccctaacggaataggtagttacagataagatacaatcgtaaccgactaggatcccgggtatttccttgacatagaagtttggaatttaacccgattccctttgaagatattctatctatacatggcaccccatacctaatcggatatacatgtcgtatgggtatggggtatccataatctccacagtagcccctgacacctttacagtcgatgaaatagtcttctctcgtaattcaaatgataatccgagtgcttcaacttcctctgtcttagtcttctgagtagatgcatctaattaggtgtagcccccgactatgtgattagttaaataaaaactaaacatatagtcaaagtgcatcaaaacatccatccgagtggttttacaaccgaatcacccaagggattatatggctaagcatgtgtggcatctgataaaacatccagccgactgctttagctttaatgcgccaaaaatgaggtatagaaaaggcccgagtgagaaacactctaaaggtctataaaccaacatacatgataaaaatccgagtaaaaactctcaaaaagactcatcaaatgtggtataaagcatgataaatgatgagtctaaatagcctaagctatgacccacgccattattaaggtaagcatataacatgctgagagaatgaccatttaaaattagtcatctcaataaggcccgaacagctttgtagcctaaaaaggccaacaaaattagtataacacttttctgttgggcacccttttatttgcattgtagtaattccaaagaattatctaactacgtcaaaaaggattttagcagcattgggctattctgtcgtgagcaacttttgccaaagcaaaaatatatacctaagtccctaaggatcacaaccagccacgctgataataaaattgggctgaaagtattgtttaggcccaggcccataagcatctcccgataccttagtgaaataaacgctaaaatagagcgccgtttcgtcttccccgccgcgatcctctccattttccccacttcccgctacaatgcaaatactgcgccggcggaaactagggttcgcaaatccgcaccattccacccctctcgaagctccgttctcttgcatagatcttccgtacatccatcgcaccaatatcctcttcattcgctgccgccctcgctccaaatctaatcatccatctcgctccca

SEQ ID NO: 39485 - DNA, 1501 bp, Oryza sativa
tagaaagtaaacatcttggacatcaattttagatctaatggctagattaatttgaagtgatgtggcaagctgtgaaaagagaaaattagcactagttgcacttagtgagaatgaaccatatagatatataaaattaatgcccttctcgattaattccttcataaaaagttaagaaggatttagagaggattacttaatctccaacattccttccggccttcacataagaattaaccgaacaagctttttttttctaaggcgtggaagaactctttttcaaaagaattttcaagcggatcaagaggatgttttgagaatgaaaagatcgaatgctaattttaaataggacctctcatgttctttttatagagcatgcatgtgtcatacgttcaaaacacgtcaattataaaaaaaaaaaaagaggtggtacactttaactgtatgatttagtgcaagcgcaacaataatgttcagatgatgatgtaatgctgtccgttcttaaactgcaagatttgcagacacttctttgccgactaatctcaaagacaatataagtatttattgatcaccgcttttcatcgaatcaatcactagctagtaacacaccgacacaggtggggcctggcccacgtggggagagccggagagagaccagcaccgcgtctagcttccacgtgcttatttttaaaagacaaaaatacaaatccatgtactcgcacactcgttagtataaatgcacgcgcgtactttatttttataagcaccttcaaaatacttaccggtactccctgttttaggttataacttcaaatttaactaaatttatagaaaaacagaaatattttcaactaaaaataaatttattataaaaatatatttaattattaatttaataaaactaatttggtaatgtaaatattacaatattaaatcttgagttgaaaatatttctattttttctataaacttggttaaactttaaatagtttgactttaaccaaagtcaaaatatcttataatctaaaacggagtatacctttagattgatgaagtcgtcattgatgtcacactatcgacgagtatattatatatcactgaaagatgaattagtcgtaaatgtgaacatatcaagtctagaatttgaattcggatcaactgattccacttcgcaacatccatgtgcttttgaattccacgtgaaggagaaaaagggtttgaaatattggacttttgcaaatttatcttctaaaaagacttcagattccgttgattaattatgtttgaaacgagaagttctggggagttaaaactgctaactggcatggttcagaactgagtcaagcacaccacaacatcgaccagagcaagaattccgaattccacgtttcgaaaatttcttaaaactgatcaaatcaattccactataagtttataattcgctgaatcgtgagcctcttttctcctctttccatccccctccttttcccttcctacttccagg

SEQ ID NO: 39486 - DNA, 1501 bp, Oryza sativa
atctcgtatccaacttcctcacccagtatccttgaccgtctggacctcaactcctccctgagtttagtcccgattcccaccgttgaccgaagttgaccttcaagaatccagactctagtcaccttctcacatggtatcccgaccgcactagacctctgctcctccctgagcatagtcccggtcctcaccattgaccaaggctgacctcaaatcacctgcacacaatcagacaaaacaaccgtttctgggcacagatatcacaacctgacccacattagtcacacgcactcacaccaacatctacacatcttttcaaactaattcattgataaaatcatttgcacagccaattgttcatcacaaatattaatcatgacaatgatttcacaggatgaacttatctggtcctcttattatgatcaagtagtccctcctttgtcatctctaaaagggtctttttgttggagagatatttgtaagttgatggacttctttagagggattgctagatgcaatgtgggagtggtttaacttgttctttttgggatgatgtttggtctgataatccccatctcagtttctcaatgcctagactttactcatttgggattgctagatgcaatgtgggaagtggtttaacttgttctttttggatgatgtttggtctgataattcgcctctcagtttctcaatgcctacactttactcatttgctgcttacaaaaattcctctgtgcatagctatatgacagctccaatttcagacaattttcagccgcctttgtctcaccaagtttaaactgagtttcaggctctttcagatattattagcactattgacctttcagagcaaaatgatatatggtcctatatttggggtagtttgaagtatacttcccaaaagttttatgctctgcatttttttggctttggaagagtaaggttttctccaaagttaaagtatttggttggcttattttcatggacagattgaacactaaatttatactggatcacaaaaactgttcatagattgtgatacgttttgtattctttgtcggcagagatgtactgaaactttgatgcatgttttctttcagtgccctttctcggtgtcatgctggaatcatttaggtatcttgtgggatagttctctcaggctgaccaatatgatcatgaaggctaaacatggtaacagtgagcaatgcttcatggaaaagttccttttaagggcatggaatatttagaaacaaaggagtggtttcatttttgagaatagattacctttgttttccttttggaggcaacttcttaaaggggacctccttcttttgctgttttaggttgaaagtgagtgatcaaggtgtacttagagattagatcctcttgttgtaatttgttgttttgtaaccctttttttttaaataataactttaacaggggaggccccctgttgtgctcctttaaaaaaattactgattataatggctggcattaccac

SEQ ID NO: 39487 - DNA, 1501 bp, Oryza sativa
ggcccgcagttgcggcatggttttttcttgattccaaaacactcgtctgttctgctcacatcatatttccaatgctactagcatgtggactgattttattgctttggctttgtctttcccaccttgagatgttttcctgatccaccagtctagcaatagttcattttcatcatctgtcaggtcaatttcactacagttcagcctacttagaaccctctcccaaatctgtcgcacaaaagggcaatctttaaagagatgttgagttgtttctaggttcctataacatagttgataaaaacaattatttggccattgtctgatctgtagccgatcctctgtccaaatcctattttgtagcaagagccaggaagtgtttgcatttggagggttcccattgtttccagattagttttgctgcagccggtattatccttccattgaactgcgctatataggcggacctcgcactgtattttccattgctcgtccatctccgagttatggtatcgtcgacaccttccgtgagggtgatgccgttgctccatacttggttgaatacctcaaagtacgccttgactagctgatttgtgaggttgcgccagatatcgtctacccattggtcattagcttatctttcctggactgaccttactttgattttggcatgcttgtataaagtcggagcagattccttgagtggttgttccccaatccagttcgattcccaaataattgctttgcatcagtctccaccttagttgctgatccaaatagttttctattgagctcatcacaaggtgggggtgtgtcactgcccaaggcttgtttgggcacacccaactgaaccatagccatcacactctcagtgctctcgcaaatttgtccagatcgaccactcccattcttccgaaagtcccattataaatatggagagcgtatattgttgcagccggtgatgttcatgttacacccattatatatatgattcctaccaagatgacagaattgacactgtggagattatggataccccatatctacacggcatgtatagtctggttgggtacggggtaccagatatagatagaatatctttatgaggactcgggttagtttctaaacttgtatgtcaaggagatacctgagattctagtcggttacgattgtaatttatctataatcacatattccgttagggatatgaacagtattttataatacggactccttcccctatataaggaggggtccgggtccctctagggacacgactttctcccagatcatacgatcaataatacactcggcggaatcatccccagacaggagtagagtattacttcttaactaagaaggcttgaacctgtataaaattccttgtcttcaaacccatccacttttttagcttgatagccacacccttttagtattgccgaaatcttgtttcgacagttggcgcgccaggtaggggttgcgtcaagtttttcgccgatcagtgcaa

SEQ ID NO: 39488 - DNA, 457 bp, Oryza sativa
tagttctaagatcgtgtttacaaaatagccctgagcaactaaatgtcttttaaatgctgtttactgcaaaacttaatccctatattattattcccttgtacctcccttgcattaattatgcatccgccggtgtggcttgctgagtactgtggttgtactcattcttgctcaatccttcccctcttcagtaagagaagctttggagaagatgtcttagggggagtcctggcttataccccagttgagcgcctgtgaagatggagccgtaggcccgctagtccgctgctgtttatttttgattgtcaggcctgaagcgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacact

SEQ ID NO: 39489 - DNA, 1501 bp, Oryza sativa
ttcaacgaggccgccgcctgatggtccacgagcggtccaatgacgtcagtcagagggagagcctacactgcatgaaatcattattcgatccaggagcaaaagtaaagggattgccgaatacactcacgttgatcaccgcttcacgctcggttgcctccttctcacaaaggggaacggggatgtcgcctgccattgtcgggccgctgatcatcagttggccaacgcagcgctccaccgttttgctgttcaagcctgcaagtcatgaaccggaattcggtaagccaggaggagcatgcacataaggaggtcaaatcaaatacaagaaaaataccccgaggagaaacccgggtcatctcctccagcccagaatagtcaaaggctggatgggcttgagcctggagcggctggattcgcctaccaacgaagtcggcagcgacttcataccccgacaaacctcgcactcggaggtcatcgatggccttgacgaaggaccgaagggcaggggtcaaggtaggctttgcggtccaagacaaaatcttgtctggttgttcctcgggaacaacaaagataaaatccgaattctctatctgaagatagaaccaccttgcccgccatttgctacgagaagaagggcactggaaggggatataacgcgacttcaggccatcccgaagtcggaatccgacgcatccagacaccctgttggattccatccaacgcaattcatagtaaaagcagaaaagatcaagaaagggctctaccccaatgtaggtctcacaaaggtgtgcaaagatactaaggaaggcaatggaattggggttcaaatggagcaaagaaaggctgtagaagttcaagaccaagagaagaaattcagaaagtggagggagaaaacgacaaagaatgtagtcctcgatcgcaaccatgcgaccaaggacaggctggggttcagtacctcctacttctctctccatggctccacgaccgggaagggcgccgtcctcctagagcttcttcagtgacgcgttggtggaggtagacttgccgagatccatcgccgactggagatcgctggagaaaggagggagattaacaagctagggttttttgcgggagctgagaagacgagaggcgcttggaggctggaaagttttttcacaacaggcagacttcaaaatgaatccccaaaactcccttaaatagacgcacttccaacggtgcgaattgcaaggaaaggagagagatagccgccggaaatttctaggtccgttacgcgcggcagtcttccggacttcagtttaaattcactcaagaccgttgagcttcacatggtattcttgactacgtcccgtctctgcggttctcacaccgagaacgacgacagcctcgacaccagaagtcgcgaattggttacacgagttcatttaagcagaagtcgggggctactgtcagggttacgggttaggtataccctttacccttcgatatacatcacatatcgata

SEQ ID NO: 39490 - DNA, 311 bp, Oryza sativa
aagtttttttgcatcttcatatcagctgatccctacaccctcaaaacataccatataggcacggatcttgggattagggtataacccatcaacaatggcatgctaggtaggggagcaccggtattcagaggattcgttgagagatggcttcaagagacggattttccgatgagggatatttcgacaactttggattgacaaagcttcaggatgtcgccacaggaggctttgacttgggttgaccacttcataactgatatcaccgcctcagaggaacaacagttccactaacttaggaaccgtgtcaacca

SEQ ID NO: 39491 - DNA, 1501 bp, Oryza sativa
tatactttatttagaatattcttctttatataattcttgtattgaaatactttccgcgtatatgaatgccaactttactttatattcgagttatattgattatactgctagcttatctgggagatgcatagatacgggtataatgtttgcttatgcaattactctatgtcatggcgatgatattagagtaatatctggtagtttaggcgtggtgtctagattattgggtatcattatttggggttatatgctgcggaagagaggtgggccgctgatggtgacaactcagttcgggtattcctccgcgcgtgtatatagtcctaagttaatttcctggggagggtattcctccgtatttagccccggttgtatggtcatgacgggctatggtaaggaactcggcagtcaagggtggcttctcaaagtaccaggagggcatcggaaagaggtattagctagttaatcttataacgaggatgtatgtatagtatgtatactagaagtataggaatagattcttttctattttctttccactcagcttagatagtttaatatgagaatgagtagacttatgtttgtgtgtcattgtaccctttggattatattaacccctgcttagtctatgattattacaagtaacatataaactattagtacggttctctctcctataattttcccacgggattaaacaaatatgatacccttggaatactctcgagtgaaatgctacaatagtatattcatgcgcttgcggataaactctgtaaccataatataccaagtgtatttctgcgccattgctgggaattatatttctagtaatgtcgttaagaaataccaacagtcacaactctcacctacaacactactacaagttgttagcgggctttggtattacaaacgcactattgattagccccatcaagatcagagtcattctctaccctcaacacatatatattcaaatctaagtgtatttttttcctattgttattcgtgtactctatgtaatttcaattgatggtatcttatggaattaacaatgaccacttcaaatatcttgaaaattcattcaaacattaaaacaatgaatttaatgccgtattgatgatatccaatatatcaaatcttatgcattcaatgctacatttatgtatgatcttctcatattgtttatttattcccttaaagcattaaaagaagattatcaaatctattgcattgaatatattaattcttttagtagactaacagctatttagtaaccattggagttctacagataatatatcttttccaagtatcaataccaatcttccaagattttcaaaatgaaagaaagtcaagtgattatcgtcactcttcttctattttgtattgttctaatcattaggggggaagaaattcaacatataaacccaaggagaagtactaatcaagatcttacaaatcaagaggttaataaaatcatccaggtatgtgaaaaaatggatcc

SEQ ID NO: 39492 - DNA, 559 bp, Oryza sativa
aaataaagcacatctctgcacgccaaattgaacagaagctgcacagcagatcagtctgtttgaatgtaaaattttagtactgatgacaataggacaggaaagggaacttgcttaggttgctgaggagactgttgttcatcggaatgagagacagtgggaatatcaattgtacgctgaacctggtcccgacttagcctttaattacagttgaagtttagctcaaacagatatgatcggctaggtgtcaaatatggtgacatcactaggagagttttctttcattctccgttctagctaatgtcttcacattaaagagaaatgagaaacattattggtcttaccaagcttgaatgtcacgggtttctctttattaatgcatgtatagaaacattatgcaatgtgctcattgcaatcttgacactacccattcacaagtgacatgagccctatttgtagcaataaactatcatggagatagatttagccgtgtggatttcgctagccatgcaatggcatctttttattaaaaaaatctcacaaccatgtgttttcttgtaga

SEQ ID NO: 39493 - DNA, 176 bp, Oryza sativa
cacttttatgactttttttttaaaaaataaatatgtatttttttatttcattatctatcaatattttttgggataaataatgcatcgaacaacaaactcataactataatagtcttatgcaagaagcttttatatttttaataatgtaattcatgaatttctttgttcatccaagg

SEQ ID NO: 39494 - DNA, 1194 bp, Oryza sativa
tacacgctggaacacgagagcaagcagtcaaacaaaaaaccttgaaagatcgtactactaaaatagagaattctacggtacttgagaaggtaccataagataccaaaaatttagcgtaaaatttggtacttcatggtatcttatagtacctaggtacaaagaggtactaaatttacaatagaaaaaatggtacctcgtggtacctcctcaaggaccataaagttgctcactaaaatatacctgggaagttgatgggtggttgcctagttcgtgtgcggtttatggctgatatggctggttactaagcttttttgtataaatgccatgcccttgtttctatttgagaaatattgatcaatgaaagaccacacatgatttttttcttgtgaaattattggaattacaattttgctttttcactactgctagtctcaaacagttgtggatccttggaatggaaagcactaggaatttctgctgtccatggaatctatataatgtgggaatgtaacatcagctagaacgtattttttcccacacctataggattgatggagtcgtggtaaaagttacaggccttttggactacgcagacagaaatcttgagagaaatttaaattattttggatagaaggtgcctgccggttagctcatgtcatctattatatattaaaattttactaaacatgtcacaaatgctcttaagctaccatacaacgctttacaaatgctcctatgttaccacatgatgctctaataaattcgaaaaaaatagaaaatatgataattttaactattagatgatccaataaatagatgatcctttaaatagatgatccagtaattttaacaattagattaaaaaaacacccatatgccgccacccccaccataccatatgtacgcatgcacgtatactccctccaccctctgactctcctctcctctcctctcttattttctaagaaaacttctcctattttctagctaacaataaaaaaataataatcagatagttaaatgatcacaactcctgagttacatgtcgttttctcaatttgtttgaattgttgtgttatatataactaaatacataattcaagatacatattgcccatatttacaatatataaaatagacaataccataattctaactacaaatatttgggcaaaatttgcatttcagaagtga

SEQ ID NO: 39495 - DNA, 697 bp, Oryza sativa
tgatgtatatccttgctcattttcttaatctgcaaatgaaccaagtagatttgtttgatgtatatacttaataactttcttaagctgcaaaaggagccaaactagcagtgtcgttttatggctgtaaatgccatttttggttttgcttccatgatgagcaggtctagtcagtagaatttgtctgtgtatatctctaaccactttagttgtttgtgaatctatctatagtttggtggatgtgaattatctgaactcagaacaactctgaactagttgtgcactgccttgatttttagtttcttgtacagaggtttttgtcagtacgtgtgatatgtagagctattcctgaactaagatgtttaaagattaattgtacataacacagatctttgatagttctgttttgttgcgtttctttgcttcagaaactgtggatttcttgctctgtcctgcaaaaggaccacatttatttcctccttcaatctatagcatcagttgcttgcttgcttggccaatgaaatgaggtgggttggtgatggggacattgagttttgttagtgcaatgtattatggggacatcagattggtgttgcaaagtagccctatcattcaaaaactaatatcgtatctgtagattgtttcttgttgtttctctagcgcataaaaaaataatctaacacatggtattgtactatca

SEQ ID NO: 39496 - DNA, 187 bp, Oryza sativa
  unsure (1)..(187): unsure at all n locations
aagcgggcgtgctggtggcgggnaaaagcgggtcncgncnacggttgcgcggcgggcgcaactgnccgcaggtaagnccgggcgcggncggcgtggtcaagcgcgtcggtagcggcggtttaaacgagcgattggatgggagnccgctttccngggcaccgctgagnatgccgatggcnggcaaagc

SEQ ID NO: 39497 - DNA, 174 bp, Oryza sativa
gaggccaccatgccacctcccaccaccaccgcagccactgctgccaacgaccacctcgccgccggccagccgcagccccatcgtcgtcgtccagccgctaccgcaaaataactgtcgccacgagctccgcgccactgcctctgccgcgagaaccccaaagccaccgcagccgac

SEQ ID NO: 39498 - DNA, 1501 bp, Oryza sativa; identical to SEQ ID NO: 39413

SEQ ID NO: 39499 - DNA, 1501 bp, Oryza sativa
gccaccattttgcactttgggttttgtttggatgtaagtttagctgcagctacttccttgtactcgcgtgtgtcggctagaccacccggatacttgtattcagaaccccattctggtttgtttcagtttcatcacttgacaagtgacgtgagttgtttccttgtcaacttgttcttgctagttcttcgattgcttgcaggttcaaggttgttcttggcacggtaagaacagcaacaacgtggagtcagtgtaccggttgctaaggcgcagcacctctgtggtagttgtagtcggatcgccaacgtcgtgtcctcccccaaatcgaagtttatcctcctcttatcgaaagatcgggaacccctgctgctgcatcaagtggtatcagagctcaagttgctaggtgagagattttatcacttctttgtttttacctacagcccaaaaaaaaccacaaaaataggtcagatccgaaatcaccaaaactagttgagcctttgtagttctacttagtctttgcttgctgagttttcgattgcatcgattggttgagttgttggttctagtagtttagtcttttagagtttcgggttctactcacgattttgtcaccacatacacttccaccatcacttcatttatcttcatcccgctgccaccatcaccaccatattcaccacgaaatccacctccaaccccaccaaatttcgtccaccacaaccagcagcaccctcatcaccacatcaaccacccccaaatgcatttattgctgcctccaccaacagccaacccttttgcaactttttgaagtgaatcagcccttcccaagaaagcatttaagtactctcacttttgacttgttggctgaatcatgtaactagccaaccaacccatcattacttcttgttttgatttgttggctgaagcttgtgaaatttcgaaaatgtttgggaaaaggttattttgctaaggcttgttttgacttgttggctgaagctttgagcttgctgtaaaaaaaagaaagaaatgaaaaaaaagaaagaaaaaaatcagaagtgaagagaaggaaaaaaaaggaaggaaagagaggaagttgttgttgctgctgttttgtttgtgttattttcgtgctattttgcgtggctacgcttgtgactaggctcgcgtctctaaagggttttgcctaggaccagcacaataccatcgttgagcgattattcaacttgcattgattaatgtggttctagttgtaccttgatattacttgcagccacctatagctccacaatttttatctactatatcacaggatcgtgcttgttgtcggctccggtactactaaccattgttgttgttcttgctggttgccaatgccttttacataacaaagtaagaacatgtaagaactcgtttgcacaagtttggtagaaatggagatggacaacacctagctccaatagttgataggacatatttcttgtgaattgtttcttcccattaacca

SEQ ID NO: 39500 - DNA, 1501 bp, Oryza sativa
ggaccagagctttgaactagatgtgtgggtatagaaatcctcacaatcgcctagtgaaggtctctcgatcaacatgaaacgatcgaattctatggcattggctactgggcccctcgcctggattttgtcaatgaagtagaggccaatcgggtgctaagcgaagcgaagttgataagtagaaactagtggacggtaaaactcatacgagacatgggagttacaacccgtggagaccccggttggaagaaggcaatgggtgatggttgatatgaagatatcccttctttattaatcaaattgggtttaaaactggcagggaattcaaaattatcgccatccttataggcataccaaattttagcagtcttagcgaagccatagtaaaaggctttgaactaatagctatgatcgacaggcaataatttgcctcttgggtagcacgatgcgacttcgccataaggcatgcatcagctgcgagtaggagctacaccttcagcatgatccaatgggatggttagtgtattaagagtaggccttcctaccacttttgttaaatatgtgatccgaattttgggcccacaatatattcggattagtttgctagtaggattagtttcctagtaggagttcctattaggtttcctattaggtgtctttctattatcccctatatatactcttgtaaaccgtacgggaaggggtgacgttcccattgttattcctctacgtttgtaattatctcctctatagtgatcattgccggtcggcgcccgtggttttttcccacaagggtttccacgtaaaaattcgtgtctccgttgtgcatctattttcataacaagtggtatcagagcattggggatcaatctactagttcccagccaccggcgtgtttatcggatcgaagaaatcgatctcgggcggcaccgtcgtctcgtgattccaatccgaagcaaagttgccgtcgactcggagtcgacgtcgtccttcctgccgccgacgcgtcagaggagcagcgcaggcgcagcagaagcatcggcagccagcagccctaatacagaagcgcacggttcaagaaaaaaaaatcagccgagagagatcggttgtttcgttctgtgcatgctaatttttccagtggaaaattgctacagccaccaaagcttgtgtaccaggaagtttcagatctacgctacgtgcacacgagaagtgtaccaagtttcgcgattttgctaggtttacatcaatttcttactagcaaattcagtattaattcccatggtaagtttgaagtatgatctaccgctcctagaccgagacacaagattctcactttggcaagtgaagatgcgagccgttcttgcacagcaagacctcgatgatgcgctttctggatttgacaagaggacacaggattggtccaacgatgagaagaaaagggatcgtaaggctatgtcatatattcatcttcatctatctaacaatattttgcaatctgaccagt

SEQ ID NO: 39501 - DNA, 656 bp, Oryza sativa
cgccgggccggatgtcacgccgcgcatgtcgccggcgcaggcggcgccggcgcggcatcctcggagaaaagccgagaagaggtccttcttatcaaaggcacgtaactttagttagttgattgattattatctaatttaataattcatttgcaactttagttaattaattatttaattctgtaattcatttgcttcttcgagttcatttttttttaaaaaaaattgcatgctttgtgaattgcaggtgtacaggtgcatgttcccaagggtgagggagtgatgcagaagctggatttgtattattaatccgaccttaattaattactgtaaaactcccaatcgtatacgtatttccgacaggaaatgtactgtgtaattaattaatttgttcgttcttgttctttattacagtcccctggcacaaatcaaatcacaatatgatgagattggcacatgtaacttacctgcctattcttgtgcggaaattgtaaattttgattttagacatccggaaaattttgcgtgtggtcccctttgcaatcttatcctctcgctcaaaccagatcattttgaaagtgaaacggtgaatctgaccaaacttcttatgcaattttgtgaacttttatcaccagcatcgaattgttttctgttgcaga

SEQ ID NO: 39502 - DNA, 666 bp, Oryza sativa
tatcaactagtatcaaatttgaattttaaagcttagttttagagttaatgtggattttttatcatattcttttttaccttagtttttaatttttttataccctagataaagtagactaacaaatatttactcataaattatttttgatgcttgctcgtttttttcctgcactcataacacaactgatcactacttcgggtgcaaagttgtaaactcaactaattaccgtaagagggtcagggtttcaatcatttaggtggacgtccactcatttattgccgttctactatcttactgatggatcggctgtgggaagaggtgctcaattcacaatcagcctttccctttttcagatcagtccgcgtccaccgaagaaatcgcggcaaactcggcaaacttttgacgtttaccggacaggcaaagctaccatcacttcgttgtcgttgctgtatatccacgaccacgtcaaaactgatcccatggcgccaaactgaacaccgtgtcgatctccgacctcgtcgtcgccgcgacaaaaaccgctttgatcatcacctcgtcgtcgacgcacctccaccgcatatgtagcagtagacaagtagcatctgcatctgcgtgccatacacgattgctccagctagctgcacctgcacatcgccatggccatgg

SEQ ID NO: 39503 - DNA, 645 bp, Oryza sativa
acgctgcaattagaattcctaacgccccacattccaagaaatcgctagcatatgtcatctgcacagaacaagcatgcaatttctcattgatatatatcccctccaatcttcattcctagctactcttacaaggaaaacatgtgctgctgcacgcactgtccatgcataattgtttgcattctacatatgcatatatagtaccaagcagacatacctaacatctctcattgttattgaacacttctcaactacctgcagccaactgttttctatggaggacctactagtgtacatatatacgagttgctctatatattcatttttgtcgttggtatagcaattagcacagtagcaccacaatgtgtcatgacaaaggagattctcttaccgtctcaatatcaaaaacaggtgtagtaattaatatgaaacatgagaagaacttctcatagccacaatgtaataagacaacatacccaaactagcggaggcatgaacttgtagtagtgtactactacatccgtcccaaaaataaaagattttataggttgagacacattccagtactatgaatatgaaaaaggggtctatctatattcattgtactagaatatatcatatctagatctaagtttgttttttgtgtga

SEQ ID NO: 39504 - DNA, 1501 bp, Oryza sativa
gatattttcgttgtgaaatttttttaacgaagtacaaatgctccgtctacaactgcacaggcgcccgtctcaaacagttgtgggtagttggaatgggaagcactaggaaattcgcctgttctgttctaaccatgagttgtgttaatgaaacttagccggaacattttttatctgacagctacaggattaacgagaccatggtaaaaactatagtgtttttggaaggatattaaagagaaatagcttgtgctgcgcaaatgatactggcgcttgttggaatgaggggcatttttaggattctaattgcagcgtctacagatttgaccgtgtggctcaatgacataacatgatacattgcgctgagacttggcactatgaatggaagcggtctaaagacgcgaaatctttgagcagttgaatctgaggcagtagtagtccggctacgtgaagaagattagttgacatgatggacattacaataagtctgccaaacggaaactccatgatagtatcgggcttgaattgtgcattcttgatggatattgcactgttcccgtttgtaggctgaaattgaggttctgtggttgtagctgatccataccaaaaaaaaaaaaatgcattttccggtttgaaataaaatgcatatgttggcagcctactagccgagttccgatgcttgtttaatttatcatactggtaatcactgtgtggtttcaaatagaaaatctccctccgtctgtcgtcgtcagcatggcaagtcagcacgggcattgttacactattcaaagaggactaaactatcaaatgacatgagaaacaatatctctattttgttattctattatactgacatacttgcacgcataaacaatcggtggtctcaaatgtttattttacatatttgcttcctactccctccgtttcgaaatgtttgacaccgttgactttttagcacatgtttgaccgttcgtcttattcaaaaacttttgtgagatatgtaaaattatatgcctacatagaaatatatttaacaatgaatcaaatgataggaaaaaaattaataattacttaaattttttgaataagacgaacggtcaaacatatgataaaaagtcaatggtgttaaacatttcgaaacggagggagtagctagtaatagtatacgagaggaggaaagccgtcaaaaaccatcaaaagatcatatataattaattatatatatgttcttagtttgattatccatgcacgacgcttgtcaatgacatcagcgcctgggtgatgagcttccatatattcaaatgcttattgaatcaaatcccggtcaaacccttcacgcccaagtcacaagaattttattttattttgacattaagtcacaagaattaatctagtacaaaacgcacactgcccagatgactgcattcatctatcatcatcgattgacttgttcagacaacaggagaaattcaggaattgctcgggattatggccgccggcggcg

SEQ ID NO: 39505 - DNA, 238 bp, Oryza sativa
ttcagtgcattcgtagaactgatttcaatctgaaagaaaaaaaaacaaattcagtagtagatacacgtctgggatgcggagaactgtaaagacgggaagaccgctgcaactatgacgaggaagtggatgacgacggccaggacagatgggaggcaggcaggacgtgcttctatttgcactaattcaatctattagaaataagagaaagaagggggaggaggatgggggtaccgtggga

SEQ ID NO: 39506 - DNA, 194 bp, Oryza sativa
tatttttttcctttcgcctggttacgaccctctagggttgtaatcttgtaattttttcctgctctatcaataaaacttcgcaccgtctcgtgcgagtctttggaaaaagaaccaagatatttgcaattgttgcgtagctagcgtttttcctgtgtgtaaacagaacagagggtgcagatcgaagaactaagata

SEQ ID NO: 39507 - DNA, 445 bp, Oryza sativa
cattgtactgttgcatgggggtcgattaagatactgatgcaactcgaggtgttcatcacaacaggaagatgcaatataaaagcctgcttagatataccagctaatattgaacttgccgcacctttggttgggatttgtatttgatgccaaataaggggatcaggtacccctgagatttctggttctcattgaccagccacagaaacagaaaaggtaaaaagaactcccccttttggtcatgtacatttgaatttcttgcagtgagttcaaccctagtgcctagttggaagaagctgatccttcttattttgatttacagcacatttccttttcttctgtaagaaattatgtacttagtgttttgtgcttttgaaatgcttcttgaagttatatgctagctgtttgcctattggccgagtgcctgactatatcaaacttccttagg

SEQ ID NO: 39508 - DNA, 1395 bp, Oryza sativa
attagttagacacctatttttgatattgagatggtaagagaatctcaggtgccatgatgcagtttggtgctactgcgctaattactataccaacaaacaaaatgaatatatagagcaacttgtatatatgtacactagtaggtcccccatataaaacagcagtggctgcaggtggtagagaagtgttcaataacaagagagatattaggtatgttagcttggtaccatgtatatgtagaaaacaaaacaattacgcatggacagtgcgtgcagcatctagtgttcttggagagtcggtcaaatgatttccttgttaaagtagctatgaatgaggattggaggggatatatatcaataagaaattgcttgcttgcgcttgtgctgggggcttcttggaatgtggggcgttaggaattctacttgcagcatctacagctttggctggcctgcttgatagaatcggctaagccttggcactgcgaatgcaaaggttctaaagatgtgaaagctttgagccgttgaacctgagacagaatgagtcaatgtctgtgaagaatatcagttgatacaaaggagatgacagcaagattattcaacggaacaccacgatattattgggctgcatttttcattcttgttggggtactgtacagtgcttatttgaaggctgaaagtgaggtgctgtaattgtatggctgatccattaaaaagcacatgtttatataggtttggataaacatattgacagcccaattcggtagcttgtttgattcatcctgttggtaatcaacctgtagtttcaaatataaaatctcgcttcgtcactcgtcatcagcttggcaagttggcaggggcattgtcatgctattaatgattatttctgttcgcgtttatcaatacaaagaggactaaaaatctaaaatgttgaatgaacatgaggaataacaacatttctgttttttacccgttcgtacggacaaacgattagtgggcagaaatattcattttacaaatttgcttcctgtaacacgagagcaagcagtcaaacaaataccatcaaaagatatcagtcaattatggatggaggatgcttgttaatgatatcagcgattgggtgagcttccacgcacacaaatgcttattgaatctgaccccggtcaaactaaacccttcacgcccaagtctcaagaattcagtacaaaacgcgtactgcccacttggctccattcatccagctctacggccgagtttagttccaaaatttttcttcaaacttttaactttttcatcacatcaaaactttcctacacacacaaacttctaacttttccgtcgcatcgttctaatttcaactaaaccttcaattttagtgtgaactaaacacacctgttcagc

SEQ ID NO: 39509 - DNA, 1386 bp, Oryza sativa
ccatgtagcaccagcagaagccaccaaatgctagctgcacaccgaaggtacctgtactattcacaccacgacctgcacaaagaccgggtagacaccattgacgaccagctctgccacctagccggactagcagagctgcaccgagttgtgaagccataccgttggcatcattggacttccaagctctgccgaacgacctcgcaccggagttttggccttgcccgaccccaactgggacgcgccagatatgactagaaggggccaaatctggtcgtccctcttgctaccatcatgaccatcgccagccaccaccgcaataggggatttggcctctcacgttggagagatgcctggatcttgccggagaggggggagggagggaggcaccaccaccgttggccaccaccacagggggccgcatttccgttggaggcgaggcaggcgagacgcgccttcgcctccgtattcgccaacagaggtgacacatgagtctgatttttcgttaatcctctattactataaagttagaacccactaaatcctaaagcttaacatgcaaagatgtcacatcatctactataacaactaggacatttaaacatcatgcaagcatattatgttatctataattttatacttattaaattttatagcttttcaaatgcaagcatgttaaatcattatctcatataattcacataatattttaatatgtctcatcatctcttttcataatatcttatgtacctatatagttcatcctaactcctaacttagttaatgtgctctttatcttctttcattaagccatatcacaacaattgtcttgtccttagatgattatctattgtccaaattattcccctcctttgtaaaatcaaagtgtttttgattcttattctgtgatgaacaattggcatctgtgattattggttttgatatttggagattattggtgaagtggttttgaagatgattgatttttcaggtgatgaacagggttactgttttgtagggtctagtcagaccgggctggtgcggccggtcagaccgtagttatgcgaacggtcagaccggctagcccgcggtctgactggccgactctgtgtcggtttcggtttcgggttgtttgtttggatatccgtgattgtttcgtgtttatggcttctagatggatactatgcgtatgtaatactattgtttgctaacaatgagtcaagttggagatagcttggcctcggaatatggtttctttattcgatccatgtgtagggtcacttgatgcctcgggagagtatcgtcggtgatggatcgggagtcgacttggggataaggccacgtccgtgacggtcagatatcatgcaggatatttaggctagagttcaa

SEQ ID NO: 39510 - DNA, 646 bp, Oryza sativa
cggtacccaaacaactccacaggtcacaatgacatactaatagatgatactattgactttttttctatgttagaccattcattttatctaaaaaattatgtaattataatttattttgttgtgagttgttttatcacttaaaatactttaagttcgaattatatcttatatatttacacaaaatttttaaataagataaatgattaaatatttatttaaaagtcaacaatattatctattgaaaaatagagggagtactctcagttacaaaatgtaactatttctgcgacaatcccctcaaggcctcaacgaatcaccacgttcgttaggagttcaaagtttcaaaccggtctcgctcaccacattcgccgggtcaccaatcaccatcgggaaaaggccaggggaaacggaccccacaccgcctcgtctcgtgaaccggcgctactacttctcctgtgctttgaccacgacctctcatttggccacttccatttccattccccccaccaccgcgcagcggcgcaggcagcgatggtgaccaacgctcgccgccgccgccgcctcaggtgagcacgacgccccgcgcgcgtccccgcaccctggaaggaagagcagcagaagacgactccgacgcccacgcccgcca

SEQ ID NO: 39511 - DNA, 1501 bp, Oryza sativa
tcgcgaacacgagtgctttcatccatgtggtacccgacttggggtaggaggccaggagcacatccgatggcctcggccggaaccggcgttggatggcgatcacggcttggacggcggactcaggccaccacgtcgcctggtactcgaggtaacggcgctcgccgtagaccttcaccggtagggatgacatgaggcggcggtagcagtcgccttgtgactcctcctcctcctcctctggagcctcaggcttggggaacggggtgatggcatcttgctcgatcgcgtctttgatgggaacaggagggcgccagagcgagggtgagctcaccatgtcttcagacatgatcaagaacgaaatgtatcaggtaaacaaagctatatggcgaaatgcagtttacagacgataggctacgtgtgtggaaccagctagcgtgatggcacacctctttaaataaaatcaagtatgctcatgctaatataaaaaaaatatctagatttttttaaacaatttaattcttgatgatctgtttgattaaagaaattgaatgatgggtttgcccatcaccacatcactcctcgaacccataccaatcaagctattggagtaagaacaatatcacttgagaattgacgaaaggacagatcagatgggctaccattggtttccacagccaacgacagataatgaagatgaagtcgttggcagagctaggacaacgtgatattggtggaacagccacgtgataaattaaaccacaaataagggtagcaggtttatgttgttccaccaaatgcatgatgtaacattggttgtgtaaggacaaagaaactgatatataagtggcccggggagcccctcacctaattggctagcgtttgggggtgggaagaccttctactatcctacaacctgtaggcgcaaaaaggatatggaaaaccggacccaaaaaccagagtgagttgattcattttataaggaaaaccgaacaaaaaccttacgtaaacatggttaatttatgtaaaaccgacgaaaaccctggcattggcatactgaacctaataacaacagtccaacaagagaaaaaactcctaaaacgaagccttcaagaaggatacaccgagggaacgacaacacatcacccgatccaaacgaatcttaaggttttcatccggagaaatatcttgatgtagaattgaataagggctccaatatcaatgccttcaataaggtgaacaaccactacgctggatcctctcaccattgacgggcccatatcatcacctctgacgggtttggccctcgtcagagattagtggttactgataactgcacctcacctctgacgggtgaaagcccgtcaatggtgattaacacctctgacggccgcatagaaatagcccgtcacaggtgagaatcacttgtaacggatgactctttccagcccgtcaaaggtgacatataccactgacaggtttaatttatcacccgtcacaggtgtga

SEQ ID NO: 39512 - DNA, 1501 bp, Oryza sativa
gactcctccaacgccacccgaccgccggcgtccgcggcctccaccgtctccttcacccaccagagccgccgccattttgactcttgcttgattttttgttatcttgcaaatgttcattgccaaattttagattaggccatattctgtgttgtttgtgtggatgtctagtttgttaagatgcagatcattaactgtgtgatgtatattgttactcaagttgtgtgatgttggcttgcatcttgggataaatcttgcatcttttgcttcatgttgagagctggtggctgagggcttttgaattttttttttatgatttttcacacctgtgacgggtgataaattaaacctgtcagtggtatatgtcacctttgacgggctggaaagagtcatccgttacaagtgattctcacctgtgacgggctatttctatgcggccgtcagaggtgttaatcaccattgacgggctttcacccgtcagaggtgaggtgcagttatcagtaaccactaatctctgacgagggccaaacccgtcagaggtgatgatatgggcccgtcaatggtgagaggatccagcgtagtggttgttcaccttattgaaggcattgatattggagcccttattcaattctacatcaagatatttctccggatgaaaaccttaagattcgtttggatcgggtgatgtgttgtcgttccctcggtgtatccttcttgaaggcttcgttttaggagttttttctcttgttggactgttgttattaggttcagtatgccaatgccagggttttcgtcggttttacataaattaaccatgtttacgtaaggtttttgttcggttttccttataaaatgaatcaactcactctggtttttgggtccggttttccatatcctttttgcgcctacaggttgtaggatagtagaaggtcttcccacccccaaacgctagccaattaggtgaggggctccccgggccacttatatatcagtttctttgtccttacacaaccaatgttacatcatgcatttggtggaacaacataaacctgctacccttatttgtggtttaatttatcacgtggctgttccaccaatatcacgttgtcctagctctgccaacgacttcatcttcattatctgtcgttggctgtggaaaccaatggtagcccatctgatctgtcctttcgtcaattctcaagtgatattgttcttactccaatagcttgattggtatgggttcgaggagtgatgtggtgatgggcaaacccatcattcaatttctttaatcaaacagatcatcaagaattaaattgtttaaaaaaatctagatattttttttatattagcatgagcatacttgattttatttaaagaggtgtgccatcacgctagctggttccacacacgtagcctatcgtctgtaaactgcatttcgccatatagctttgtttacctgatacatttcgttcttgatcatgtctgaagacatggtgagctcacc

SEQ ID NO: 39513 - DNA, 1501 bp, Oryza sativa
ctccaccccgtacgccgccgggtcggcgagcaccgcggccaccgccccgtacacgtcgccgtacacgatcctcgcgccgccgccgagctcgccgttgagccgcgcgatcatgtcctggaggccggcgttgaagcgcccggcgacggcgttgtactcctcggtgcacgcgccgccggtggcgcgctccagcgggaggcagcccatgggcgggaggccgttgaggtcgaccttgcgtgcgccgagcgcgtgcagctcgcggacgaacgcctcggcgacgccgaggaggtagtcgccgtacgccgccgccgtcgagtactccgccgcgtggccgcgcgccacggcgtagtagttctcgaggaagtcgttggtgcccatgctgacgatgtacagcgcctccgacagcgtcgccgccgccgccgccgccgccgcgtcgtcgtctccccggaagctccggagcctcgccgcgtactccttgaagtagtccagctccttccacagcggcagcaccgactgcaccatggatatcagccaagaacaccatgaaagtggagctaagctagcaatccttttaggcttacgaaaagatcggaggtggcattgtcgtagccggcgccggcggaggcgaagcaggcgccggcgccgaggctgctcatgttgacggccgggtcgaggtaggccgggacgagcggcggcagcccgaacgcctcggagatgaagtcgacggcgaggcggccattggagaacctgccggtgggccggccatttccgcctccgctgacgccggcgccggcgagctggaggtcgcggccgtagggagcgaagtcgctcctgacgagcgtggagaggtagttgttgttgcccgtgtcgaccgtggagtcgccgaacacgatgatcgccgcgaccttgctcttgccggccgccgccgccggctcgccggagaggaggaggaggaggacggacagctgcaagagggcgaccgccaccacaagatcacgcggcgaacgcatcggatcgatcgttgagcgagctcgctggtggcgtgcaggttttcttggctcgccatgagtcgcttttggagaggtcggcgagctaccggagaccggccggggaagagaggtgaagcaagcttaatttaccgggttcaggccaactactgatggagactgcattggaagctttccattccatttgctcttcgtcgtatcgttcaggattacattaattaggacggttttttggaaagtaatttgactaatttcacgagaattccggaggaatttgacagcaaaatgatcaaaaggaagccgccaagcagagtactactaatgaacagaacatttttctttttttttttgaaaatttaaaattaaccatgtagcttttcatttagaatgtataaataaacattttagccatgccacaagctcgagacccgcatccaaatccttgtaaaataaaaaaatcacttaaaaactatattttaaaaaaataaatttgtaac

SEQ ID NO: 39514 - DNA, 1501 bp, Oryza sativa
ctacagaaaactttcagacaaatcatcatggttctgagtgggttgagctatttgttagagagatgatgagtgcatcagacatagatgatgcgcgggctcgtgcctcaagagccctggaggcattggagaaatccataatggagcgagcaggaactgaagcagtgcataatttgcacaaggtgcaaccaacagcatatgcacgtttcatccatagtacttgtactcctaggcaaattaagcagttatgctttgctttcctgcaggaaaatgtgatgctgaaggagcaactggcaatatatctgagagagaacgctgttctgaagagggcggttgctatccaacatgaacgtcaaaaagagtttgacgagaggactcaggaggttcatagcctgaaacaactggttttgcagtatcaggaacagataaaaactcttgaggtactactccttactcctggtgattcttttgtcccgaacactactcccggtgattttgattgttcttacataagtatatttaacattgcagataaataattatgcacttagagtgcatctgaagcaagctcagcagaacaattctatgcctgggcgtttccctcctgatgtcttttaacagatcttgagggcaatattccctctcatagtcttatactcaatcataccaagatatcatatgatgcaaggggttgacctattgctcatggtgtggttagacacttagactattcacccttacgtccaaatcataaacaagcaacgatcctcaaaatggagaaaggcaagcaacggtgaagcatcaattgaggtgtagattaatgtgtgcaccaggaagcttgagtgcttgacccttctctcagaccattgattgtatgtaaagtatggtgagatgtattgtagcatgtaattcaaagtatgaaaggacctgttcactgtattgtagtagcatgtaatacaatttatacaaagcatgagaggatctgttcattgtatcgtacgtatccactgatatatttattccgataaaagaatgcttatcagatgaaagtttccattgttccgtacttttaaaaatttatatcaatatttttatccaaatttcttcttggagaattatgtggagcatgaatatgcctgtctttagttttcacggttttgatttctgaatgcctggtgattacagaaccagagtatgactctatgggatacctgcaccaatatcctgcacgatgactgagcagtttaggactaatgccaattgctatcgacattgcaaggtgcataacattgatcctgcttctggacctcgccttctctgatagtctgattctctctcttatgcatgtgacatgtgacgaacacaaacaaacatgaacacataaaccattttatttagcacttaatccattcgatccaaccaggttacattttcacataattaaggctaggtagtagatgcggtgcacggctaggtgccaccattgccgctcgaggcagctccc

SEQ ID NO: 39515 - DNA, 1279 bp, Oryza sativa
caactccactccagactcaactcctagagttaaatttaggggttggagctgtaccaatcaggccctacttgtacaacttcatatgatctttggggaaacactactgagacaactagccatctactaccgtcgtaaaatatagctatttaggatgggatttgactcatcttagaatatagaatttgaagagacctctgctcagattcgttattataggatgagtcaaatttcattctaaatagcaatattttaatattttagaacgagaacgcggtagcatcccagtatgatgcagcatgtaaccgaaaatgctgccattgatgacaaagacaacctggaagattactgttgcactttgtaactgaactaccgaagctgatggcagcggtagtagaattcttgaattgtctgttcatgatgccctgcaagctaatgcattcagttggagtgattaaagtaggcaataataccatgagtaatgtcattatttgtatcggacaaaaaaaatgtactacctctgttctaaaatctatacataatataactaaaatataaagatagaatcgaatagaaacaaatctgagcacgtctgttcaaatttatcgtattaggacgtgtctaatataataattataataatgtatcttatgttttgggacggataaagtaaattacttgatcagcacactctggtgacatgacagctgtaaagttgactactgaattcagtggaaagaccgtgagcattattgttcacggctgaacacaaatctgtgggccacatcgtgaccttctccggggcccacagaacgcaaccgggcccttctttgggcccaaggaaaaatgggctgctcttttgggcccacgtgggccattttgcctccgttttgggccggccgtgaaatggctagagctgaaattgcaggtgttgatgacgatcgaaagctggatgctaattcaaaaaaaaagaaaagaaaaagaaaagcttggatgctgcacttgtaactgaagctggtgacagcaatagtacaaccttgaattgtctcttctgatctgctgatgcatttctagataatgcatatccagcagatttgggtgattaatccaagtaatgatctcactccactgatagtggaaattgctggcttcagcatcaaaaactgcattgtatgtttgttttttcgttcttttttttggcattgtttcagcttctttatatgaagtacaaattctacactccagcttggccttaaagtgatcgaacacctagcttgcacgg

SEQ ID NO: 39516 - DNA, 1501 bp, Oryza sativa
gacctctcgtctaattcaaaaaaattaaataattattaattcttttcctatcatttgatttgttgttaaatatacttttatatatacatatagttttacatatttcacaaaagtttttgaataagacgaatagtcaaatatatttaaaaaagtcaacggcatcaaatatttagggacagatggagtaatattattgttgagcggtgttcgcctggtatgtgggcgcaggagttgcaaaccagcatcagtgtgtcacttaccttgtttgccgttgagcaaaatttgctaagatgaaaatcatatctgaaaaacccgtaattagctaccaaaatcttcagctcaatttccatttgtattatacagcatcaggatatattatgccggcggcggctagatgatgtctacaccgtagggttgcatgtgccggccgcaaccacccacaggttttatctgatgcggtgaaggtcagtgtgaggcaggcgccattgcaccgaccgaaacacacgaacagcgacaacagcaaacagatactagagcaaagcccccacaaatttaactagattggatatttagttatgctgtgtgttcaccaacaagcgcgggccgagcgacagagacatatgctatcctccaacagtagcatagctatgtactcgctccatttcagtttaaaagaggtttttgacttggctcacaatcaaactactttaagtttaactaaatttatagcaaaaagtagtaacattttaaacccaagataaatttattataaaaatatattcaattattgatttgatgaaactaagttagtatcgtaaatattactatatttatctataaacttagccaaacttaaaacagtttgactttgactaaagttaaaacgtcttataacctgaaacgaagagagtatttttaaaaccacaggaggggaaaagagaagattgagaaaatacgcaaaatgaggtgagccattagcacatgattaattgagtattaattattttaaactttaaaaataggttaataagattttttaaagcaaaattcattttttttaaaaaaacacaccgtttagtagttcaggaaacgtgtgtgcggaaaacgaaacaaactctctctctccggctgccgaaggcagcctaacaagtttgaatgtttattatccattttcagtttttttttaaacattaaggttttactacaccagcgaataatctttttataggtcgtataaattgataacctcatacataagtggatttgcgggttagccacttatgttcatcagtgaataatctttttatacatcgaataaattgataatccgatatataagtgaatttgtgggttagtcgttgggtgagccaccacccggctctgccactataaaatctcccgaggaagatgacgaggagtcagtcaacagttgactagctgttcgattcggccatggccaccgagctcactgagtacttgctgctcctgccgcttctcgtcg

SEQ ID NO: 39517 - DNA, 1501 bp, Oryza sativa
catattctagacctcattttgtatgatatatgtgatctataatgtttttttaaaaaaaaaccgtagtcaacatgagccttagatatctattcctcatcaatttattcgtttttaatctcagtagttgttaggtgagatcatgtgcccgcattgttcatcgatcattgtgtttgtgtggtttgttttaccaggatgtggttatattaggccgtggtttacgggtgatcgagctttgtatggcaggccagatgatcgtcgctgactgttcttacgcttcgcaaattaagctgtaggacactgtttgcatgcactttgcaaagctgtagggcagttgatgtatagagtggcatgtttcactggaaggacgagtctttggatttgcatataggcaacgtacagctagctactattccccatcccataatataaagtattttagatggatgtcacacattctaatacaataaatttagacgtaccgtatatttagattcattgtactaagatgtgttacatttatccaaaatctcttatattatagaaacggagagagtgatagtatcccggagtctcttccgtgcctcgatcgggcgccttctccaggcctccatcgcagccgtgcacagccaaccgatctgtagctgggtttagttgggcgttctattcttaggatcaatctaatctaacgatttataatttgagaacaatgcaagcaactaatgtgattgcttagaaagatttttatgcttattagcaattcctttgttccgaacatcacttttttatgattttcaatcatctattttacacaaacaatcttatcccatttatatgtattttttgttcctacttttttttccaattctacctttcgaatgagccctaagtgaaaattaacggttgaatttttttttcttaaaattcttaagattttctctaatttattagcataatgtgatgatttaagagcattcctgaaaatgtttgatggacttttaatatataatagattgtatgcccaattagattgatacatgacagtgcaaaaccagatgaaattacaagcaacagctaaaaaataaagagatgtaattgatagcacaatagtaaaggacgtatggtttcaaccccaatgtatcgtttttaatctctaacaaatttataatttctttttaaaaatatttaaaggacatctcttccaccatatctagttgtagccacataaacaaatagagacaacacaaccaatatatagtacagaaagtttctgcgtttgcgcaccgtctgatcaatcacttcctgctcaatcttcttttcgtctttactcctaacccctccgactccagtctcacctcaggctcttaccatattcctcatcgttacaagaattgttctgaactactgtagagaatcatccgaagaatcaggtagatgcagatcgagacgtacgggacgtgtgcaggttggaggcatcgcacgctaccgcggcggatatgatgcg

SEQ ID NO: 39518 - DNA, 1501 bp, Oryza sativa
ttgacggagggagtagatgcacgcgtcgcatcatatccgccgcggtagcgtgcgatgcctccaacctgcacacgtcccgtacgtctcgatctgcatctacctgattcttcggatgattctctacagtagttcagaacaattcttgtaacgatgaggaatatggtaagagcctgaggtgagactggagtcggaggggttaggagtaaagacgaaaagaagattgagcaggaagtgattgatcagacggtgcgcaaacgcagaaactttctgtactatatattggttgtgttgtctctatttgtttatgtggctacaactagatatggtggaagagatgtcctttaaatatttttaaaaagaaattataaatttgttagagattaaaaacgatacattggggttgaaaccatacgtcctttactattgtgctatcaattacatctctttattttttagctgttgcttgtaatttcatctggttttgcactgtcatgtatcaatctaattgggcatacaatctattatatattaaaagtccatcaaacattttcaggaatgctcttaaatcatcacattatgctaataaattagagaaaatcttaagaattttaagaaaaaaaaattcaaccgttaattttcacttagggctcattcgaaaggtagaattggaaaaaaaagtaggaacaaaaaatacatataaatgggataagattgtttgtgtaaaatagatgattgaaaatcataaaaaagtgatgttcggaacaaaggaattgctaataagcataaaaatctttctaagcaatcacattagttgcttgcattgttctcaaattataaatcgttagattagattgatcctaagaatagaacgcccaactaaacccagctacagatcggttggctgtgcacggctgcgatggaggcctggagaaggcgcccgatcgaggcacggaagagactccgggatactatcactctctccgtttctataatataagagattttggataaatgtaacacatcttagtacaatgaatctaaatatacggtacgtctaaatttattgtattagaatgtgtgacatccatctaaaatactttatattatgggatggggaatagtagctagctgtacgttgcctatatgcaaatccaaagactcgtccttccagtgaaacatgccactctatacatcaactgccctacagctttgcaaagtgcatgcaaacagtgtcctacagcttaatttgcgaagcgtaagaacagtcagcgacgatcatctggcctgccatacaaagctcgatcacccgtaaaccacggcctaatataaccacatcctggtaaaacaaaccacacaaacacaatgatcgatgaacaatgcgggcacatgatctcacctaacaactactgagattaaaaacgaataaattgatgaggaatagatatctaaggctcatgttgactacggtttttttttaaaaaaacattatagatcacatata

SEQ ID NO: 39519 - DNA, 674 bp, Oryza sativa
gcatccggtccaaaaccaagggagaataatatataggacaaaaaacatttttacccattgcaacgcatgggcattttttctagtgtaagagtaaattcactgtgtacccctgaaaactcactcaatcccttttctacccctgaaattaacccgatcgcttctatatactcctgaaatttcaacttgatcccttccatgcctctaccattacattttccatcgcttcactgttatttttgtccttgatactttaggtttgaatataaccttcaaaaaaattaaaatttttgtttaagtgcgcaatatatgtattttatgaaactaatgagactaaataattagtgcagaaaattttgacataaattttagaaataaaacaaatgttataaattaaatttttatttgaaattttaataggacaatggatttttttatcaggagcattcataaaaacattattgtgaacattggtcctatctttgtatgaatgctccttattttttataatttttttaaaactaaatacatattttttatttcattatataaaaataatttttgggataaataatgcttcgcacaacaaactcataactataatagtctcatacgagaagcttttacatttttaatattgtaattcataaatttatatgtttaaccaaagggtaaaa

SEQ ID NO: 39520 - DNA, 520 bp, Oryza sativa
cgaattcgagctcggtacccataaatagttaggcgcgctgcctagcttcgaaccttccgttttgcggcccctggtggattcgtaaatccaatttaattatgtacgtagtgtgtgtcgcttctttttgtattctgtgtatgcgtttaactagctccatgatcatgcatatgggaggtctggatagttctggacgaagcgacataccacggggttctacggccggttgtccacattttctaataaatcaaaacggtttattaaaaaataaaaattaatttatatataaaatttaaataccaatataaaaaattaaaaatatcttaaaattagcttcaaaattaagataaaaaatttaaatttggctttggcttattaggccaaccgatgatccctagtcatagactagcgcatgggtgcttttgttggtagtattactgccgtcctataatattataagcaacttttagttataaatttagatatatagttgtttagataactaaaagtttatattttaaga

SEQ ID NO: 39521 - DNA, 183 bp, Oryza sativa
tataaatttgcaatttgcagtgaataaagatgtactaattattggacgaggcattaccatcaatctatccagtctgcaaggtgctctaccattgttagactctcgtagtctcgttcccgctgtcctgcacacacgcaaataacaaagaaaaaaaatcagagaatggggattagactcaaggaa

SEQ ID NO: 39522 - DNA, 195 bp, Oryza sativa
ttttgacgcaccacatcaaggttccactgaaaggcaggaagccaaaggacctcatcatccccagaagcgtccgcaatccacattcagaataccacctgttagagataagccgaaagatgattgataaaagagattggcaaagatgttctctagcataaaagaagtaggccgaaaggtgattgataaacagaaaca

SEQ ID NO: 39523 - DNA, 1501 bp, Oryza sativa
aacagtagtaaatccgtatatgtggattagtaaggacggtgaagacgtacatgggaaaaaattgtatggcaccccatgccacaaagcatgcatggcacctctatcaagatcttgtcacctagcgtgcacaaatcttgaagcactgatctaccttcaaaaccatactagggcaaaaactaattaacagactatcactaatctcgcgcgcgcggaaggatggcggcggcgatgcgcgtgacggcgatgcacgtgcaggaaacggacggcggcggtgacgacacgatgacgtgcgtgcaagaaagggcggccgccgccggcaacggcgacgcggacgcacgcagcaacacggcggaaatcgacggagctagcgctgcccagattgatcgcgcggcagaggtgcgtgggctgatcggtcataactcgaggtcaaacttcgctgacgatgccatgaaagacccaagccatgcacatcatcggttcagttcagatgatgagaatcttgaagattgcatgaatgaagaaaatgattcaggcctggtttagttctcaactttttcttcaaacttttaacttttccatcatatcgaaatttttctacacacataaacttttaacttttctatcacatcgttccaatttcaatcaaacttttaattttggtgtgaactaagcacaccctcagtgtgtgagtaattttgattgatgtactttgttgtgctcagtagatacggaatgcatacaaatttgtgtgcactgtacgtgcacgcgaccgccggaatccttccgcgcgcgagattagcgatagccagttaattagtttcatgcggttttgaaggtagaagtgctccaagatttgtgcacgccaggtgacagaatctcaataggtgtgccatacaatttttttttccgacgtacatatcctactagtctatcttctttttatatgatgacacagattttagataattaattgtttcttgaaatttactaaataatatactgcatagagctaacaaatagactgagaaaaaaatatctaaacctttataagtttcttaagtacatggcctatgttgtatgcctgcgtatttgtagggactacctttctagtttagtctaaaaattttgaacggttttttgaaagtagagatgaactccgaatctccgatggaaacaaatgcaaaccacgtgaaagttgacatgtcaagctgggaacatatcctatacacacaagtttctcgtgcacaatttaataatattattgaaaatatgtgtttaatttttctagaattttctgtgaaatttactagttggtgtgcacgagaagcttgtgtgcataggatatgttcccgtcaagctggtcagtcatttatgattctgagacccggtttgaaccaaacgaagtccttatactgaagcaattgactttgttgttctgagacccggttatgattctatttctacccatcgtattgtttcgtttgttgtgaaaggtaattta

SEQ ID NO: 39524 - DNA, 495 bp, Oryza sativa
ttttgctttattggaattttgctgaccgacaacatatataagtttacatttactccatccgtcccacaatataagcattttggactgtgacacggtttttgtgatactactttgaccaacaatatctataaaagtaagatgttttaaataaaaagagttacatattattatagtttgtctaatgataaatctaataatatcaattttacgtgattaatattttttttctattaatagataaagttaaaaacgtttgactcgtcactatagtaaaaatgcttatattttaggatggagggagtatattattatgaccaaatttcactctgggtcatgttttattatctaagtagcatattagactagtttttagaaaaccatttgcgttgaatcatggtttgttaccaaacttgacactttgaacccgtggctcgagatgatcgttgtcggccggcctatccgtcagccctataccttatgcccattctcctaagg

SEQ ID NO: 39525 - DNA, 402 bp, Oryza sativa
atgtaaccgaaaatgctgccattgatgacaaagacaacctggaagattactgttgcactttgtaactgaactaccgaagctgatggcagcggtagtagaattcttgaattgtctgttcatgatgccctgcaagctaatgcattcagttggagtgattaaagtaggcaataataccatgagtaatgtcattatttgtatcggacaaaaaaaatgtactacctctgttctaaaatctatacataatataactaaaatataaagatagaatcgaatagaaacaaatctgagcacgtctgttcaaatttatcgtattaggacgtgtctaatataataattataataatgtatcttatgttttgggacggataaagtaaattacttgatcagcacactctggtgaca

SEQ ID NO: 39526 - DNA, 1501 bp, Oryza sativa
gttacttaattatagagtagtacttccttggtccctaaaaaaaaactttatttttttctgtcctccatttgttctatgaagatctttttttaaaagcaattaatacattaagtttgagatagtaggagataatattttggaggttgatctgagaaggtagaggacaaatgtattggagtttaagaaagttgaagatatattttttatttttattaatatgtataagatatatatatatatatatatatatatatatatatatagagtattttttacatagggaatagttaggacggttattaaaactaaattcagtttttgtgaagaaagcagatgcgtgtatctggcagtatatttattttggatggtgaaaatgtttttctattaaacaaattaattttaaaacccgataaaattttaaggatccattctaaaatgtctatcataaacacccagctcaatgtgacagtaatatcagcaaaacagcatggatgtcctgacagttgctgcagttgtgcatctaattaattagggcccgtttgaatcaaaggaattatgaagacatttcataggattgaaattctaaagaaaattttcctatatagctctttgatttaaaggattgaagttttccaaatcctacaaaattcctatggaatggcttgttgcatataggttttggaggaaacttagcaagaggtccaacctcttggtaaaaatcctttgagtctatctctcttatccgattcctgtgtttttcctgtggtccaatcaaacgatcattcctgtgttttgcaatcctctgttttacacttacattcctatcataatcctatatttttcttattcctccgttttttcattcctacgattcaaatgggcccttagctatagtagtagattatttttttggtgccatgtccctttaccaaaacaatgagacagtgactagccactcgtagtctattcctgcaactacaataatctaacattgcacacattaatgacaaattgatacacaaccaaaaaaaaaaacccacaatatcttctttaatttgaactatttgtttttaatagggtcatgactattgatacacaaaatggcctaagctttaattgtatgataattaacaattatctttttttcccctacactcacgtttatctttggatacagcgggaccagatagtattcaattttaaatgtaaagaaaataaaataggtagcccataaaccgctgccttgtatttacatgtgtgacgccacgtcagacgtcatcgtgttcatctgcaagtcacaaatttttggtataaatttggttgcctcatctcacttgccacagtatcaaagaccaaagctatcgagagatcgatcactgcacgccagctgctcggagaaaaggcgagaagaaaatagtgagctcgcagctagctaagttagcttgcttagccatgggcgaggaagccgcggcggccacggtgacggcggcggcggcggcgg

SEQ ID NO: 39527 - DNA, 1501 bp, Oryza sativa
ggaaaagtccagtctagttttctctacctagaacactgacaatatgataatatgataatgatatcgtgatcagttggttggtgattacttgttggagtaaagctgtgtttagcactcacttctggtcgacgaccatggcggaggcgaagccgccctgggttggccggccgtcggtgtagacgtcgttgtaggaccaaatcctcttgttgcagtactgctccacattggccttgcacggatggcactcgcggcagcagccgacgatgacgccgacgccgacgacgtcgccggcgctgtacttggtcacctccggcccgacctccaccacctcgccgaccacctcatggctgcagacgagaagaggagagaattttcttggtcaccgacaaaatccaacacatgactgaatattggtacgacaatggaagtgtactggaaaaaggaattcttggtcaccaactaattaatccaaccaattattgttgcatacttagtacgacatgcagatggtgtagtagtactaaattactactaattaggcatcatttttcagcctggtgttggggatctatcgtgtgcttatttaaagcccatcagatcagggaaggttctcgctgaggttttctttacacgtgtctctgaaactgatggtgcatctaatctgtactatacctgtcatgaaaggtgttgatcaaaaaagaaaaatgctaaaagcgatgcactaacttatctttctgttccaaaggagtgtgatatagtggtgcatgtgcatctatgccttttgtaaatctgaaaaaagcactgaccagatttgctagttactagtgcctactcttttctgatatgtttgttatcccaatcagttaataagtttatcttcagtctactatagaatacaccatcaaatcaattgctagtagaagatctccattgacatgagccatgatccatctagataactgtgaataatcttacccagggaccatggggtacttggaagcaccaaggtggttcttggcctggtggatgtcagtatggcagataccacaatacaaaaccttcaccaccacatcttcaggcccagtcttcctggtaccaccacatacaggaaaaaaaaagaacattagttgatctgttgcataagatgcttcttcagttattccattctacaagaagacaactcaaggaaattattgatatatatataatcctccttttctttaaggaggcatggcacgagaattgcatagcaaatatatatattagaaaattataaagaatgcttctgaaaatatatatatgtggagccaggcaactagccaaaaagaactccatgcattctgtctgtttgccacaactgctccggattcagggattctgttcctttcacccaacaaaaccaagacgtgacgatgattgcaatagccaattggcggtaggtgaagcagttttggtagtacactagtactacaccactatactcttcatgttggacttatac

SEQ ID NO: 39528 - DNA, 1501 bp, Oryza sativa
gtcaagacaacaatcacgcctgtcttttgtttcgcaagtaaacgtacggtcctaattaacgattacgatgtgtggtgttcgcttatgcgtcttaattgcgaaaaacctttattttgacgaccttcatggtaatgccattttgttctcttttttttttaaaaaaagaaagtctagcagtgtcactccatatatgcattgaatcatagtagtcatattctgttgcatcatttatatacaaaattccaaatttagaccatatatataactacaaacatgtccaaactaaaatgagagtacagcaagtactaccactatactaaatgttgcgttctgacgtgttgttttttttggcggtttgtctaccgtgaaaaccttttatatcaaagtttctttgaaaattcaaactaaccccctcttaactttataataattaatattcgattaatcatatcataatcatttttcttattttgcatgcaaaacataagctcatcataaactccatatcgaatgcagtctaacacctgtagcagcgtgtagaatttggacattgcaatccaatgaaaacagagcaaaatccgaacgaaattatgaactctgatcgggcccatacatggccgggcgaaacgaaggcagcatggccctccacgagcaaccaagatctggtcactgatgcaacagtagtagtagtagagtaggagagacaatagtacatgtgtttggttacgagtactccgtagtagtccgtactaacacacacatgggtccaattctactgttactgaactggaatactccagctagtggttcaatactgatcacctagcgacagagtaaggtatgggtttatttgtgaggcacatgtaatcagtggcgcccataaggccagcatcatctatatggatccggatccgctacagtcgctactgtgactacaacttattctctccgataaaaaaaaacaaatgtaggactgaatgtgatatatcctaatatgacaaatctagataggtgactgtccacattcgttgttttatgatacatcacattcagaatttgtatttttttatggagggagtaagcgatagcagtgcacatcattggatgtaaatcggaaggtctacattacacattgtactgttcataacactgaagcaaaactactgtttgcaccattactgtaacgtggaatcttgaccgttgataggaaaaacgaacggccaaaattatatgcggtggttaacttgcagttccaactataactgcacttgatatggattcaatcgagatgttccaattataactgcacctgatatgaatccgatctatatgtagctcgtcagtgccaatgttaatatcaactcaactatgatgagtgaatattcatgtgggtagaaagatacatgtatgagttaatgagtagtcgagtatgccatttttaaataaatgacaccggaacccttcaccatcaaacattgtattctcatccttttttcaagag

SEQ ID NO: 39529 - DNA, 1501 bp, Oryza sativa
tcgtcctacactgcttatgccatgattattgctttaacattttggattaaaatatgccgattaatgactatatttccaacagaagataccccttaaaataaatatatttatgtgatatttatttaaagggtgattttaactaggaataatttagcacgaaggaattgaaatgggagagaatgtttcttttgtatgtacggcggaactattgaacaattgttctttgatagtcactttgctaaatttcttttgagaattgttcatatttctttctatatgaatccatcaaataacttcttacatttatttggaaattggcttattggtattgactcaaccaagaaacatattttagtagaagaatttgctttatgttgggttctatggattactaaaaatgatatggcttttgacaaaacttcaactaaatcttatatgcaggtttttatgggtaacaactagctaatgttttgggcctagctacaaatatgcgatgacgataaaaattgattcataatgcgtgccagaatgtggagacaatgtaacgaccatgtaaatcttcgccaagctagttttaatggagatttagtaatatgatttcttcctaaataaatacttcctccatcttagtcacatcgcatactaggtagaacattttggaacggaggtagtaattaagttgtatctcctgtgttgagttggtgtgatttaagtttattttctcaccatccttatgtactttgcatttgatgctaccttgaaaggtacatgtagttgcagctttcaaatagtcgaggccggattatccattattaaaacaaaatctttccaatgtaacgaaataataacactggcgcaattaaacatatgagtatgatataagcagcccatttgttctatatatatactggcattgggaaaaaattaatagcgaaaattgagccacgtgcacatgaaatttatgccacggctgggcacaagaactagtgggtgcatgcatacatttatgtaaaaattacttcatatactttctccgtttcacaatgtaagtcattctaacattttccacatttatattgttgttaatgaatctagatagatacatatgtctagattcactaatatcaatataaatatgagaaatgctagaatgacttacattgtgagatagagggagtaattaagtacgacaactttatcaactgggtgcatttgagtatatgacaacttaaaaatttagcgtaacggtgcgagaatttggttacatgtgtgtattcttgacaaaattgaggttgtgccacatcctccaaattaacgcggcttggccaaaatattgtcctaatctgtgggtttcactgaaattccattctcaaatatacagaaatgcatatatagagagagagaacacgctatatatgcatagaatggttttttgcaaacatgaattctcaaacacgtacgccacagaatggtttgtgcatatatagtgaacgaacgaaaa

SEQ ID NO: 39530 - DNA, 221 bp, Oryza sativa
aaatagaacattaacttttcagcactaaattatataacctcaacatctcgatttttgcagcacatctgatagcagaaatttttgtttatcaatataatgaacatgctttgttgttcaaagggcataaacaattttcagcgccaaatcctataagtgtttctgttgtcagcacgctgcccgacaggataggacgccgccgccatgggagccgaccgccagga

SEQ ID NO: 39531 - DNA, 242 bp, Oryza sativa
ggaacagattttaccggtgcactgtaccactgtgcacagcacagtcacacaacctgtgacctgcccagcagcagccagtactactaggggtctaggaggacgcatatcggcatatggggaggtaggctagctaggcctaggagtggtttggcccaacttggtaggcaccagaccaccagtcaagtcaggggaatccagatgcctgcctgcccgttatcatcatggggcgcgcgcccccgaga

SEQ ID NO: 39532 - DNA, 1501 bp, Oryza sativa
aggtcgttacaattgaactttgaccatcattctcttccatttcgaatatgctatgaacgacaactatgaaactagaatcttgtacatggaagtattttcaaacatgtcaatactattttaacggcagtaaatatggatgcttccagactgactattctaaaatcacaaagtttaaatttagaacacatcacgcacttctcatatttatccacagatcaggatgcctcaagaatgccccaaaggcaaattgaccatttcaagtcacattagccatttccttttcttatattatcttgcatggaactctttgcataaaactattataaggggttacttagggcagattaagcagatctcgagaaggatttgtagccgacagagccctgatttggtggcctcacaaggcctaatccttactacctttcaactgactcaactgttcacctttccctagagtttctccatccccaaactccccaacgtttttcaccccaagtcaccccaagatttgtcttccaagggagaagaagagaagaaaatggtcccagtagatgaggcttttcttgtggccaagcgactgtggatccgttgccacgttaactcggcaagtgctgtcgactaagctgtccctgtccctgatctctatctctctatctatctatccccatgatagggggcgtccctgttagcatgtgaggaggggtcacaagtgacaagtcccaccaccttcacaggctaagggataagatgaggacggatgataagtgccaccttgcaagcaataaagggccatgggagatatggagatggaggagagatggggttctttggagttgtgatcaaacaagggaccatccatcaatccatccgaaattcatcttcttccctttttaagataagccatcaagggaagcttagctttggactgcctaacttttcttagggttgcagctttgcattgacccggctttacgaaaagctgagactatcaaatcctagctttccaagcatctttgatgtgaaagacattgagatcattgacgggaaacaagagaagcaactcgaacaggatatgtcttttttaccaccaatgagggaatggagatgggatcttgggttagtgccactggcaaagtggcaacatcaatatcgaagtgaattggagtccaggtaaattgaacatttcttctgatgaactggcagaaacaaaagtatacctgtctagttaccatcttgacaaaatttccaggcatgaaagatacagcgggaggaaaattttccacaggttaggttgatatttaaccccaactggaaattgacatctatagaggaagacggccaaatgtaccgcagcaatcaaacatgaaacatgtataggcaaaacatgaacatcagtagaaggcttaccaggtagaagtagagccgtagagttactcaagagagcacttcatacattcaccggatgataaagatacaaaccacatacccaaacaagcacagg

SEQ ID NO: 39533 - DNA, 1236 bp, Oryza sativa
ctcccatcccaaacacccacttaatctgattaggcaatcaggcacgtcgtccactcgatcaatcaaatcgcatctttcagctaacttaaggcattctcaaggtctgtttagttggcgaaagaaaatttttgggtgtcacatcagatgtttgactcgatgtcggaagaggttttcagacacgaatagaaaagctaatttcataacttgcctggaaagcgcgagacgaatcttttgagcctaattaatccgtcattagcacatgtagatagcactttatggctaatcatagactaattagactcaaaagattcgtctcgtggtttccccctaactgtgcaattagttttttaatctatatttaatgctccatgcacgtgtccaaagatttgatacgatgttttaaggaaaaaaaatttgggaactaaaccaaacctcagtgtatccaacccaacttggtattagtgtgggcccaagcaacaagaggtagtagtgcatgacagagggcacaatgtttcttgcctgctatggagaataagatggggtccaccaagaaaaaaaatgttatttcctatgtagtagaattgctaccttcctcatctaccatgtaaagctattttttttatttgcttgctacccggtagtagcactacaaccaggtagttgttgttacctccttccataatacgtacaacctggtaataagagtgtattcattgcttactacatgcttctgaaccacattgtggttgccttatgctgagttctttgcttggtggtaggaactcatccctctcgcacgtaaaacgggtggcttattagcgcatgattaattaagtattagcttttaaaaaatgaattaatataaattttaaagcaacttttgcatagaactttttttaaaaaaacacctcgtttagtagtttgaaaagcatgtacaccggtggtgtgcgctcaacccaaacatagttctcaaattggatactattgcaagagaaattggaagatagtgccaaaccccagcccaccttaaatacaaaaggattaggatggcgtcgactgaacttctgccttggaacgattaggtggaaacaaaacacggtagcagcgattcgatcaagcctcaccaccacgcattccattctaacccagtgacaacaaatcaccagatgaccactaccacgaagagcaactgtgcctcacaagcgacgccccatgaaacccatacattgtgtcagc

SEQ ID NO: 39534 - DNA, 1501 bp, Oryza sativa
tcacagctgactatatctatagctcgtttttctcctctctacgcttatctcttcttgacatttacttgtagctaacatatagcctgttgtcttaaaaaaaacatatagcctgtatttgctacgcgttgttatatttctaccggtaccactgccctgagttcttgatttgtagcataaggtacaatatttttttcccataaacgtgatcattgaagaagaaaaaaaagggatattgcagatgtgctgactgagctaattaagaataagatattcaggcataaaccaagttagctagtgacttttgcatgcatttgacatgcataagtccactagcaaatatctgcagccaaaaatcatcctaatcctaataatcaaccaaaaaagtccaaaacaaaaggaaaaggtcaaaaggtactcatcgcaagcctgcaacaagtcgcacagcaagacagaaactcacaccagttgggcaggaaaccacatgaccgtgtgtactgcatgccccgtttggctcacaacctaaccaccagcacacgcctaattagtttaatcaataattaccttaccttgtttttgctttcagaattaagtgatcgtctcgtctaagcttcatgacctttacgcatccgatcgagtgacaagagatcaattggagtagttataaataagcgtgagtattataattaggagaagttttactggtgtttttatttcaaaaataaaaaaaaatcaacggtctaaaatagaagtattatataagggtatttaagtatcgatctaacagatgacatggtgaagggtgtcgacaaataaccatattttactgttgattaccctgttgtcattatttactgtaattttattttaaaaatggaggattttcccatataactatataaaccgatgttcaatgaccgaacgaaaatgggaaaagtttcaaaaaggaaaaaaacttttcgccttcaaccgggcctaattcaaaacagcccaactattttgcctctgtttttttacgtgatttttcaaatgttcaatttcaaaaaaaaaaggtcaagttcaagcttgacatgaattttgaccttgtttttacatgcattttaaaatggaaactgaagttcaaaacataggggagaaagcaatagcctagcaaacaaaaccattttccccctccaattggacctaatttgaaacaacacccaattgaaaatggaatatgtctactttgactcccttaactagtgtcttaacctaatttgtatctttaaaccgtaatagcggatattttgacccccaactattaaaactggtgtaatttgtctccctcaacggttttggaggactgttcactatcatggagcatacgtggcggtgttgtaagcgtctgtcgaggagtgatcctctctagcaggagatcgtgagacccccctttcgtgagttcggccggggaagaagctcgcctctagaaatcgcgtatccgtccccaaggctcctagctagctcg

SEQ ID NO: 39535 - DNA, 1501 bp, Oryza sativa
gtcacagaagcattattttttgatgtctttgagctctggagccacgttggttgatcattatttggttcaaacgaaaacaaatcaccactcaaagcatgtttatccattacggaaatgccagaaagcccaatcactccaggttgcttttcttctggtggtgtgtcaaatgtagcccacccagcattgtccattgatggagctgctgtgagcattctatcagtggatggagttgccggaggcatgctagcaaaaaaatctactggttgatccaaaccagttacaggttgttgctgcgcaacaggctcattaaggagatctttctgtgcaatgttggcaacatcagagaaagctgtgaaacttggagtaatgcaatccttcgtttgctgagttctatgagcaatatcagattcaaaaaacatatcagctaagcttgatttgcttgattttgtagatgacgaatctatgtttcctgttgatatagttctctgcagaaagcaatcaaaattaatacatgtcttgtttggtatgaaaagaaaggaaaaccaattatttgtttagagtggaatatttaccacctcagattgagtgattccactagaagcctgtatgtttgattgattttgttgcatagaggggctggaacaccctttatcaaggaaattcggtgagtgtggtgtcgttctaaatgtattactgatgcttgaccctgagcagtcagaaattcttggtccagaattctcattggcaaatcggtcttctgacatcctctcatgcaggctctgtggactgtaagcaaatccagacatcttcccatcatgccccctatctgaaccaggtttcctagttagcatcacggattgcttgccattgcgtctttcttcgtattggtaatcataaggtgggctctgagaaaatgaatggtacgaactagcccttctatgctcttgttcattggtcttttgattctgcattgatggaacatgaattagttaagagagaagcattttggcagaatatacgttgagaaaatgaaaacttaaaatttccaaagaatcacaggaaaaaaaacatgaatgaacttctatgaaagtattcattgtcatctacgcatactgaagcagaaattcaaaagctttgtgataacaaatggacaggtaaagaacagttctcatgcagactaactagatgttgtaaattaagctaaacatacctgtttatctcttggaggcctttcagaaaaccttccaccagcataccttctctccacataaacagcttttatgaattccctaagactgtcgacattgctgcaaaaatagtttagcgtaagcatgtactgtgcccactatatatgtattcacaagacaaagtatgtattggtaactttaaaagagaaggatagaaggatgcccttgaaataataaagaagtagcgattaacaaagcataaaaggtgaaaaacaaaaaggacaacaaaatggaggtgttctcagtggctaacg

SEQ ID NO: 39536 - DNA, 1501 bp, Oryza sativa
agataacatttcactgcaaaagaagtgtctgaaaatggaactcattatactttgagggttccagttcgacatacattaatataaagcattaaaacgtgatgacataaaatccctgagtgtacgattgtttgtctatatttctatccagtaacctatctttacaaatatctatgcacgctctttctaacatgggaactatgatttctcctatggctatacttcttatatgcaagaaggcaatattaaacagtaattaagacaaacaggtagtagaaattacagacatcattcacaaatttcagacatcattttgtggtgtatgcctgtgcaatggccgtcaggttcccaagttcctaacagccactgttgctgtgaactttccctgtgcagagctcgcaacacaataaatagaactaaagagtgatcagtgagcactaatgcaaacttaggtcaggtttaagcactgcttcaaatctgtatgtccaactgggccactggaaattactaagttcactatctcgattcaaaaaatttgcacactataaaagggtaatactactccattctgaatatctcttaagatacaatacaatgagccaccatcattcaacaacacagaacatgcatcgaatttggtattcccgtctcaattcaaacagttagcataagtttcacataccatgtaaacatacggatcactgcggccaccagtgtcattacacctcaagcaccccccatgcttcagcaacctgcagattccacacaaacaatttagcaacatggcaaccatttcaaaaccgcttcaaattggaattaacatgacaaaccatttcaaaaccgcttcatattgaaattaacatgaacaaccattccaaaaccgcttcaaattggaattggaggcggtgtggtactcacaagcgcagggccttgctggtcccagcattgtcgccgacggccgcccggatggccgtctccgttgccgactcgtcgcgccgaacacctaatggagaaacgggagtgttgcgcggaagtagtacctaacagtgggaggaggtggaggcggggacggcgctggcgacgagtcggcgaggaagaggagcacgacggcgccggcgacatcggtgaagttggggaacgccattttcattcattcaagtacttctacccatgctccattttcattcacagccaccctctttgttaaaacacggtatcctcgtgtatgtcatgttacaactttttataaattatacaaagtgtacaagtctcaactctagattcagtgagacagaaggatttctcctccttggttgaatgcaggatctgatagatcaaataaatttaccggtcaattccttcaatcttgtcttcaacctcagagtagagctccctgagcttttccaagttttcctctgatgtctcccagtagcctctgccactggcttctaggaaggtctgaactagcttcctgaatgaattggggttggtgtccatgagcctc

SEQ ID NO: 39537 - DNA, 1501 bp, Oryza sativa
gctcggacattatttcttttgagaaaggtaaattccataaaaactacgtgtactttggttaaattattatagaactacgtatttaataggatgtatcataaaattaaatttatcatagaacaacgaatttaaaatgaaatatagtaaatgatatcaatttaggtggtgttcttttcttctgtaaataagtgattaattaagttttaattattataaactttataatagattaatataatattttagagcaactttttgtatgaaacacatcgtttagtagtttaaaaaacgtgtcatgagtactcaaattttcatccactttttcagtagaaacaaacgggatcctaatcacaaaatgtgaacatttataactcaaatataaaattagagctaaggatttaaacatacaggaatcccgtgaaatttactcattttagtatttttctttttccgcacctttctccaggaattctgtgaagcgttgatcatccatccgacggcctcgaatgctagtgcgttggcattcacccatccgaagcttccagagcgcggggcccaccaccaccaccaccagtccattaccgctcgctcgctgctccccgccggcgactgcgaaacaacccgccgccgccgttgcgcgccgtccggtcgcatcccctggcctggccgtcgccggcccgcccgcggcgcactcctccatggccgccaagtgggcgcagaagacaatcgtcatccccgcccagcgccggggatgccacctcatcacccccaaggtctctccctccctccccgtcgccatgtccgtacatctctttgctccagcgctttgcttgactgagaccttttgcagattctgagggagattgagggcgacctgtccgggttcaagtgcggcttggcgcatctgttctgtatgtagatgcacacactcaactcaactcatgatcggttcattcattcatcatcgctcttgcttagatagctcgattttgttgttgatcgattgctgtgctaggcaattttctgaaagtactttatggataaccgcatacggtgtaggtaaattcccctgaacatgctgatgctgatgtgatgcgtgcttgttcagatccgtcaggccttgttcggtttgaaggggattgagggggtgtgaagttattcccctccaatccctccctctctcttagggattaaccgaatatggcctaagtgggatttaattattgcgagggttttagcaaactattctgatatgatgatatgttaaaaacttgtttttatcttgtgcatgggattgacttgagagaataaatttgtggttgactggaatcgttttgaatccgtgtgaaccaatttatacaaggaagtaatataagttcaacatcaattaatggcatcataagaaaatagaccatcctcattttctttaaagtaatgacaatgtcaattatatgcatgttcgtaagctgataagcatgtccaagtaaacacatgttttcaa

SEQ ID NO: 39538 - DNA, 1501 bp, Oryza sativa
tatttttcttcttccaaaaagtcataccaccttactctttacgtttgaatcaccattgtacatactatttaaatttaaattatcataaaccacattaacttacttaatctgatgttatctagctatcttacaacaggttatttttttttattgttatcatactaaatttcccgcagcaatgcgcgaggtttcacctatttttttaccacttctttaccactgcaccccattgtccaaatcagtgccacgagatacgatatcaggaaggcagtaacaatgattgaacacatttttcgttgatagttaagaaattcgtaggaagtgccagtaataatgatctagaaagcattaagcatcactgccataaaattcacaagtttgtaagataacatagcatgtcaaacatcacacaggaaacagtaccagtaaatttcatagagctccccagcattaatcgatatttagaacaacaattcagtatacggcaggagtcatgattttacatgcccgtgcttcgaactgtccaacattcgctctctttcctgcatcccagcctttgaagaccttcatctagaccccattgagagtgatcacaattttccgggaggaagcattgtcacgatgttcacagagccatataccctacacaaaataagtccatgaaataagtgctcaaaatttaagaagtgtgctctatgatctagacgggttttataattagttattttgctaggttacagctttgcaccggatattatcactgaaactatgcctgaatatgggatacaaagcaccgcattgccttaaaagataagtttaaactcgcgtgcaacataatcaacacaaatttcacatgcacgattgcatggtctcctaaaacttcatgacaactttttatctcctgtatatagattcgagaacttcatgatgaacttaaggtcgctatataaaacaacgaaacatttagtacttcaggtttaacctagtggctaaagtggtacttgttaggctctcaaaccatagagacaagtttatttggaaagttaacaaaaccagaatattttcggttagctccatgtataaatgattatgtatgaggatgtagtgccaaggaaggatttaatttggaagcttagaattcatttgaaaaacaaaatcttcctctggtatttaaagaagggagtgattctcacgaaggacaatctaacaaaaagaaattggaagggcagcactaagtgttgtttttgtaaccacaatgagacgatacaacatctcttctttgattttcatgtggctagatttgtttggagtaccctttttataacatttgggataaatccgtctaacaatgtttctaatatgtttgggatttggctaaagggtttacaatctaggctaaagcaccaaatctttatagggattgcggcgttgttgtgggcaatgtggatttgcagaaatgatgtggtcttcgacggctccaattttaactcttacttgcagg

SEQ ID NO: 39539 - DNA, 1501 bp, Oryza sativa
ttccttgtataaattggttcacacggattcaaaacgattccagtcaaccacaaatttattctctcaagtcaatcccatgcacaagataaaaacaagtttttaacatatcatcatatcagaatagtttgctaaaaccctcgcaataattaaatcccacttaggccatattcggttaatccctaagagagagggagggattggaggggaataacttcacaccccctcaatccccttcaaaccgaacaaggcctgacggatctgaacaagcacgcatcacatcagcatcagcatgttcaggggaatttacctacaccgtatgcggttatccataaagtactttcagaaaattgcctagcacagcaatcgatcaacaacaaaatcgagctatctaagcaagagcgatgatgaatgaatgaaccgatcatgagttgagttgagtgtgtgcatctacatacagaacagatgcgccaagccgcacttgaacccggacaggtcgccctcaatctccctcagaatctgcaaaaggtctcagtcaagcaaagcgctggagcaaagagatgtacggacatggcgacggggagggagggagagaccttgggggtgatgaggtggcatccccggcgctgggcggggatgacgattgtcttctgcgcccacttggcggccatggaggagtgcgccgcgggcgggccggcgacggccaggccaggggatgcgaccggacggcgcgcaacggcggcggcgggttgtttcgcagtcgccggcggggagcagcgagcgagcggtaatggactggtggtggtggtggtgggccccgcgctctggaagcttcggatgggtgaatgccaacgcactagcattcgaggccgtcggatggatgatcaacgcttcacagaattcctggagaaaggtgcggaaaaagaaaaatactaaaatgagtaaatttcacgggattcctgtatgtttaaatccttagctctaattttatatttgagttataaatgttcacattttgtgattaggatcccgtttgtttctactgaaaaagtggatgaaaatttgagtactcatgacacgttttttaaactactaaacgatgtgtttcatacaaaaagttgctctaaaatattatattaatctattataaagtttataataattaaaacttaattaatcacttatttacagaagaaaagaacaccacctaaattgatatcatttactatatttcattttaaattcgttgttctatgataaatttaattttatgatacatcctattaaatacgtagttctataataatttaaccaaagtacacgtagtttttatggaatttacctttctcaaaagaaataatgtccgagcacgatgggccgcaatcttggcccagtcacagtaaaaaaaaatctcgtaaaattgagggggttttacgcattttttggaaaaaaatagcagtagccgcagcggaagcggacagcagcatcacaatcagcgagatgc

SEQ ID NO: 39540 - DNA, 953 bp, Oryza sativa
aaatttaactagattggatatttagttatgctgtgtgttcaccaacaagcgcgggccgagcgacagagacatatgctatcctccaacagtagcatagctatgtactcgctccatttcagtttaaaagaggtttttgacttggctcacaatcaaactactttaagtttaactaaatttatagcaaaaagtagtaacattttaaacccaagataaatttattataaaaatatattcaattattgatttgatgaaactaagttagtatcgtaaatattactatatttatctataaacttagccaaacttaaaacagtttgactttgactaaagttaaaacgtcttataacctgaaacgaagagagtatttttaaaaccacaggaggggaaaagagaagattgagaaaatacgcaaaatgaggtgagccattagcacatgattaattgagtattaattattttaaactttaaaaataggttaataagattttttaaagcaaaattcattttttttaaaaaaacacaccgtttagtagttcaggaaacgtgtgtgcggaaaacgaaacaaactctctctctccggctgccgaaggcagcctaacaagtttgaatgtttattatccattttcagtttttttttaaacattaaggttttactacaccagcgaataatctttttataggtcgtataaattgataacctcatacataagtggatttgcgggttagccacttatgttcatcagtgaataatctttttatacatcgaataaattgataatccgatatataagtgaatttgtgggttagtcgttgggtgagccaccacccggctctgccactataaaatctcccgaggaagatgacgaggagtcagtcaacagttgactagctgttcgattcggccatggccaccgagctcactgagtacttgctgctcctgccgcttctcgtcg

SEQ ID NO: 39541 - DNA, 1501 bp, Oryza sativa
tccagtcagacgtgaccggcgtcaggccggtcacagaccggtcattcttgaccatcgcgcgtcagtttagcacgccgcacgtctgccccactgcattaaatgtgacatggggcagttgaggcgctgtgcggattaaaggaagttcagcctggggcccctcctcgcttgctccccccgccaaacggcggctgggcgagggcctcggggcaaagcagtgcaagggcccgaggggcatgacgtggcaccccgaggccccgacaccccggccgctcctgcggttcgtggaatgcggggacaggaccatgctgtagggacacgtggtaggatggaaaggtagattcccctcacttcgcatacccccgggcccatatctccgacagtttagggcttagggtttaatagttggagagtcgagatatccggtactgcgattcaagcatacgaatcagattcggcccaataatccagatgccaataggacggcccatcaatccagatgcaatacgacggcccatcagatcccgtccccgagaaggaatccccctcaccgttggatccgatccgacggctgagaccagccacacaaaccctcaatatatattcgctcgccccccgctgcgtctcgccgctcctacaccgcgccgtcgccagcagccgccgccgctgcctctcctcctcctcccctcgccgccgatccaatccggtaagcctcgccgccgcaagctccccctcgtccctcccccggatagttcgtcgcctcgtcaggcatctcgccgatttggcgccgttctgttgttctgtttggtggagccgtgcgcgagatttccggtgtttgttgacctgtttagctctgatggattcaccttgtgttagttagttttccgtcgaatggtgtggcgattaggtttggggggattggttcgtctgtgattttgtagctagattttttgaaatctagggtagtgtgagtggggaagctgctggccttagtggatacatgctgttcgtggtctcctggttcttgaaatcatgatgagttagtgctgtttgaaccttgaagcaaagttttaagttattggagttcctgtgcttagatttgtatactattagtgaagagatgcatagctgtactgctgtagtggatataggagtgttgtttttgatttgctggtgctcttccatagcatccggatgcggtgttcaattgtgtagttgtttatgtagttcaatgcactagaagcttttatttctgaatgcctagttattagttgggtatgaagtccaatgtgtgaaatgctgtcatgtttcaacttttagttaagatatgaaacttgagaaacaaatgaaaggtttagattcagtactgatgtacaacttaagtaacatctatggttgtaaattgtaccatgcattggttattgtgaattagctcttttggttgattgaaacaattctctatgtgccaacaggtcactttcagtcttttttcttgagggggaga

SEQ ID NO: 39542 - DNA, 229 bp, Oryza sativa
taatgtttctttactcactaggaagctcttcttttgagagcgtaggctagttcctctaaggttagttacaaggtggtgataggcatgtgaatattggataagcaagtcgatggcattgtctaaggaggaaatggtgtataaggcgacccaatggagaggaggatgaggttggaatgtggtagaggaggtcgggatacaaagaagtaggtaatagttccaactgaggata

SEQ ID NO: 39543 - DNA, 1501 bp, Oryza sativa; identical to SEQ ID NO: 33813

SEQ ID NO: 39544 - DNA, 255 bp, Oryza sativa
tattgcaatggattctctgtatttttttctttttcttttcctctgaagttaagggggtggacctaacaaaattcatggttgcctcccaacgtcaaagtcgtctcttccgttctccctccacttctcgggatccctccacctctcgtatttctactccacgccgccgccgatgctgccgcggcggcggtggtggtagcagcagtctcccgtctccggcgatgtcagtgatgccttcgataaggcggctcctcctcg

SEQ ID NO: 39545 - DNA, 1501 bp, Oryza sativa; identical to SEQ ID NO: 29729

SEQ ID NO: 39546 - DNA, 731 bp, Oryza sativa
gttacaagtgaagtgagagtgctacagagattaagtcagcgagccattggctaatctcgatcggtcgagcgagtttagtggccaaattgcgtacttgtttgaatgcatccatccattcataaggcggccactggattttagtgtgtgtatctagcttagccaatacatgctcatggtattcgttctcaaaggtacattgcataggttgtatgcggatctacaccttttttggacactgaaataccctgaattactattttctgcgtatctttttctcaagcggcaatatagttttatcagtgtaactaccccaagctttcaacaagcctatacccgatccgtcgtaaaaagccatcattaatccattatttctatattaaaataattcattactgctagctatcaattagaaacgacaacaacggttataaccagccaacaggacggtaacccgccaacagcagcaagtgtctaacggctagactgtgcagttgtaatcaaggtacacttagctaccgaacaaccccaattttttaaatcttttaaaatacaaccaaatttgatcccgaatcttaaattcctatttaaaaccaaatttattcagaatttcctaagccatccgatcatcagaaagatcctgaaaactagggcacatgaggattatctgcaaagctccagagccagtcctttaaaccggtagaatatccccaaccccgtccgtacgacccagg

SEQ ID NO: 39547 - DNA, 1501 bp, Oryza sativa; identical to SEQ ID NO: 29733

SEQ ID NO: 39548 - DNA, 213 bp, Oryza sativa
tgataggcggaaacggacggaggaggtgcggggagggtttaagtagggttggaagggggagagagcggccggaggggaaggaaaccggcgcggcgttctcgggttccatcaatggcgtcggcgggattagcggagggtttccaaacgaatccaagggagagggaatcacggggaataattcccccctattgattgcacgcggggacgacggga

SEQ ID NO: 39549 - DNA, 1501 bp, Oryza sativa
gaacttctcgtttcaaacataattaatcaacggaatctgaagtctttttagaagataaatttgcaaaagtccaatatttcaaaccctttttctccttcacgtggaattcaaaagcacatggatgttgcgaagtggaatcagttgatccgaattcaaattctagacttgatatgttcacatttacgactaattcatctttcagtgatatataatatactcgtcgatagtgtgacatcaatgacgacttcatcaatctaaaggtatactccgttttagattataagatattttgactttggttaaagtcaaactatttaaagtttaaccaagtttatagaaaaaatagaaatattttcaactcaagatttaatattgtaatatttacattaccaaattagttttattaaattaataattaaatatatttttataataaatttatttttagttgaaaatatttctgtttttctataaatttagttaaatttgaagttataacctaaaacagggagtaccggtaagtattttgaaggtgcttataaaaataaagtacgcgcgtgcatttatactaacgagtgtgcgagtacatggatttgtatttttgtcttttaaaaataagcacgtggaagctagacgcggtgctggtctctctccggctctccccacgtgggccaggccccacctgtgtcggtgtgttactagctagtgattgattcgatgaaaagcggtgatcaataaatacttatattgtctttgagattagtcggcaaagaagtgtctgcaaatcttgcagtttaagaacggacagcattacatcatcatctgaacattattgttgcgcttgcactaaatcatacagttaaagtgtaccacctctttttttttttttataattgacgtgttttgaacgtatgacacatgcatgctctataaaaagaacatgagaggtcctatttaaaattagcattcgatcttttcattctcaaaacatcctcttgatccgcttgaaaattcttttgaaaaagagttcttccacgccttagaaaaaaaaagcttgttcggttaattcttatgtgaaggccggaaggaatgttggagattaagtaatcctctctaaatccttcttaactttttatgaaggaattaatcgagaagggcattaattttatatatctatatggttcattctcactaagtgcaactagtgctaattttctcttttcacagcttgccacatcacttcaaattaatctagccattagatctaaaattgatgtccaagatgtttactttctagcgtgcagcaagaatgtctttttaagtccaaattttcttgggccatgtcactctaccggttcctgcatgtttacatgcatgccaagccattccacctttattattagccataccattattattggcccactatctttcggtggactgctcatcttctagaaactgccaagccatacaaccagtcaaccaagctataaattaagca

SEQ ID NO: 39550 - DNA, 1501 bp, Oryza sativa
atatatcccatacatatatattacatggttaatattataattacatgtggtaagtccattaaaatttcttaaaatgccctcaagctgccacgtgatgctctaaaatattagaaattataagaaaaaaagcaaagtatctattacttgattttcacttaatcgatgggtccaatattataaaccattagattaaattgatcttagaacaaaccaaatactacgaggttccacctctccaccttcggtacgcacctacgtacgtgggtacctacgcttcccctcccttttttccatttttccctttcttctttttctccatgtatacgcttccctccctttcttattgtatcatgcaccttcatgagacgatttaatcacaagaattttaagtatcttgctctcactttttcatttgtagccatactacaagcaatagtttattatttactcgagaaaaagaacatgattcaaaaatcgtaagtacttaatcaatctcctactcaaaagtttatgaatggattttaaagataccttaagaaaatagaacccttaaattattataaaataacagtatctaaactttagtttgcccttaatctatcagacaaaatttttaaacaaacagtaaaaatcttacctttcaaataatacaagtgctgcgcgggccaccttcctagtttgttataacttgtagaagtcgaaaacttgcatgtttgcatggtgatatatctcatattaacctatcttatcaattttttatttacaactataggtgacatgaaaaaacgaggagataaaaccagttttccgtataattaagtcattgaatatacgaatatatttgagatatctgattagataatctgttatatatgggtggtctctgtatgttattgagccccgttgtttcgcttatttgtggaataagccatatgacatatttgcaaatgaaaagtaatttgtgaataaaacttatatatacatgttcttaacgatctaaaagcaaaggctgaaaaataaactacgatgaaaaatccctaaaataaactctatatttaatattgaaatttgaaattttggttgataagcataagcatacgcaaaaagatgaggcctataagttgtaattaaaatgattatacagataatagtcgtctaaatcacagtatttatgctctgaacttaactgcgaaagttgcctacaatcactattcatgctctgaactccacagccaatatttgactaataactgcaagctgtattaatgccaatgggatggtagtccaaaattccaaatcgctatgcgcctttcattttgcaattatttctcttgcctatgttttcaaactagagatagcagccagacaacaaataataaatgaatcaacttctctctatttatgttcccccccaaaataaaagaacttctccctatttataccatttccatgaagtgctcgacagctcaaaccatggccatggtgcaagacatcaccggct

SEQ ID NO: 39551 - DNA, 1501 bp, Oryza sativa; identical to SEQ ID NO: 39485

SEQ ID NO: 39552 - DNA, 1501 bp, Oryza sativa
ttatcagtccaatgaaagtaagtattaattgcttatatggatatataaatggagcttacagtgcaattaattgggataacgtattgttagctcaccttgcttgcatggctcactgcttagtgctcactattatgttcgcttgtagctgctcactattcttcggacttgagctcaaggccatccggcatccgccacatatagcaatcatctaccttaaatcacgtgactttaggattactgaaatgtagatccatatcaaaaaagttccacatgtcaatgactcaaaatcatgtgacttaagatagaggatctccatcctagctcaataccctactactattggagttggtgtttatatcaaagttgttgaatgatcagagcacaacaccgtatggcaatgtcatccatgataacgtgggttacttcgttgatgcaagctacaaccatctcgaatgaagaaatataggagacgagcaaagagaaatgatcgtcgtcacacgtagttggatagtgaatctgtgaatgtgccaaatagtaaacattgttgttccttttcccaaatactatatggatcctcacgagcatatatgtatgagttttgaaacatgattgaaccatctttaattcatgttttcaaatcctggaataattaacgttttgccacttttacgagtggttctaaagaatttgccactagacccacatatcatagatatcgatatcgagtggcaaatcattaattggcacgtgacaaataattatgccctatttgtttaggcttaggcttattggcttagatttttaagtcagcttatttgcttatatgatttatatattataagctggtggatttaatgtcttaagtttaatggtggagtcatgcatctacctcacgtaagccaaaaaaagcttctccaacctagcttttggcttaatagtgttagagtggcttatggcttcaaaaaagacaaacgaaaaaactatttgtttgttcaggcttaggccctgtttctttcagcttgagattattataatccagattattgggagtaagctgaaagaaacatacaacttattgaagcagcttattataatctggagtccagcttattataatctgataagctcatttaggtgagctttttccagattattgggtgaaaaattactcaccatgccactccactccctctttagacttgcaaacccaataatctaggctctaataatctagaaaagaaacaactaaccgcttattctactacagattataacaatctagcttatagtaatctgactcaataatctagattataataatcttaagctgaaagaaaaagggtcttagacttttcggcttataagttggcttataaccctaaacaaagagggcctaatgtcccttcaatctcatgtcattcttaacgctgattttacacttaacaccctcaacttcccacacccttccgatccaccctcgcatcactcttccagcctcccc

SEQ ID NO: 39553 - DNA, 1501 bp, Oryza sativa
cggccgcttcggctccccgccaccgctccctctccctcgcctccgccgccgcgccaccttctccgccggcgcacgccgttccgccgctcgcggtcgcattacgaggttgggtttttttttctctctctctctctccgtggaaccgcttctgataggatcaggattaaattgttgaattgcctggtggaattttcagtaattatctgcgcaattgcgaaattcctcatctgataattctcgcaaatacaaacagttcgcgtaatttctcccgtatggattcctgcgctgcaagggcatcggcctccggggctgaatcttcttctggtggtggggaagatgagagcgagataatcgatgcaatggaagtgaaatcaagcagcactgctgcttctttccttgctaaagtggcacttgctctgggtgtggcagctactgctactgtgatttcactcttcatgaggcagccttcttcaggtccatctttcagtttgccacagattgttgatgcttcggcgccgccggatgcggcagcgaccatcggatatactttttcgctgtttgggaagaaagttattgttccggaatatactccagggtatgtgcatttcacaattttatgggttatctttctgtttcactcacagttaaaacattgtgttgttgcatattactcctgaaatgcatatgtgctaacccggcaaaaaaaaaaaaatgcatatgtgctgctgaagtaagacaaagacaaatacattgttgattcctggattttaatattccattctccatgagcatccataattttggctgttatatcagattgtgaatttatttgtgagtggaaactacatgctagatacatatgcttttggggataatttccaactaccaaggattttttttttgtcctaactacctaagattaccaccttgcaccattgcaacatatatgatgattaatggtggatggtgaaaaatatgtaaaatgaatcatttatatacacatgtaccatagtcacactaaaagagtttccaaaactttttaaaatataacgaattgctaataaatttcttcaggtgggtttacttttggttgctcatggctgctggatttggactatttattagtgaagaagctttaaatgtttgggtctgtcctctgtactggcatcttcactgtgaccatgcccaactaagtttcaataacttactgcaaacttttatgttcactgcgtaattgattgttgcatgttaagaacatgattactttttttcttgatgtaggttgggatttctttagcacgcagcctttgtttggatggaacctggcagtctcttgctaattcattctcaatgaatgcatcttatataatttccacagtgttatgggtttactggtgcgtgcacagttcctttttgtcagtcaatcgatcatcaattaatcatggaccatcttttgttacctgacccatccttccattcaggggcgtttgtattagtgata

SEQ ID NO: 39554 - DNA, 187 bp, Oryza sativa
cagtttcatgtgaggtatgtatctttttttttctcgagcatgttgctctgcaaaattaaatttgaagttatctgttctgaaaaaaaagataagtttgatgagaagttatctttcgcctttgatttgcatgaatttaaatttgaagttctctgctctgaaaaagaaataagtttgatgagaggttatc

SEQ ID NO: 39555 - DNA, 593 bp, Oryza sativa
tataagcatttttactatagtgacgagtcaaacgtttttaactttatctattaatagaaaaaaaatattaatcacgtaaaattgatattattagatttatcattagacaaactataataatatgtaactctttttatttaaaacatcttacttttatagatattgttggtcaaagtagtatcacaaaaaccgtgtcacagtccaaaatgcttatattgtgggacggatggagtaaatgtaaacttatatatgttgtcggtcagcaaaattccaataaagcaaaagtcttttcaatttttcatctacaatgaaaaatgcagcagatacgaggagtggtaaaagaactagtaataacactctagtagtagctgctgcggaatgagttggcggctcagggtgtaacccatttataggtcaaaataagtggactcgcggcgcttattttagcatataagtaggtttcgcgggttagacacttacaatccttagcggccttcttcagagtcatagcaaaaggtttgtttgtgtggagagatgttatacaatttatggatatcttcacagtcatagcaaaatgtgaggtaaaggatgaa

SEQ ID NO: 39556 - DNA, 1501 bp, Oryza sativa
ggttcctgaaagatcctagtgacatcaagagaccttctgatttttccgttcatatggggctccaaaatcttcaaactgaagctgcggaggtggaggcacttgctgctactactacattgaagaaacttgcagatatggctaagggattcctgagaagtggcaaaactgattctggcatcaatctggttgcatcgccaagtgtaaacagtactagaattgtttccaagaccaaaccaaacaaggaaatggatatgattcttgatgctgaaaaggaaattgccgggctcttttcgttgacagaacagctcattaccgaggctggaatagatgttgctcaccaagcatagcttcagaacccagaaatgtatatcatattgcagttttgcaacatttagatagttgctgtgaagattcagctgaaattgttagcgttttcatttcttttgctttgggtctcatcgccctgtttgctgttggattgctctgctccaagtgcgaaagggagacatcgatgttgatatgcctcttactgtttacatgatatattgcatctgctgaaatcctagaaaaaaaatgataaatttgtgatccaaaaccccttctctagtcagccagtggcggatttgctgacaacctaggcagctgcctgtaattcatattctccaaaactccttcagaccggagttaatgaagatatccaaagcctgtaaaattgttgctgattttggagaggtgagaaatagtgaaggattttactttctggacggataccaggttgcccttgattttggtcagctttcgacatgtagatttgctgaattatatctgtttttctcttctctgtagtttcccatcggagagctgttgattctcatcatgttatccatatgttaacctggaaaaattgtacagaatttgctgctcagctttagtgtatttatttattttttgactgaaaaaggtagaggggctctaccttataactattttattaatggtagtcaaggtgttacaacaggagtacaaagatttagtgtatttatcgtgcaaaaaactgtaagcatttctcgaagtgcataatctagcttcctatttttaaaacataaatctaacatccctgtttcagaacataaatctattgttccaataatctgtatcgccttagtgagtcagagcgcatgtcccagaaatggatcttgcagatgcaccaactttttttttgacttgtagaatttcacactgaagtttatagccttatttcttttctgatgaaaccacgtcgtgattcattttatttaccgaaataaagtgcgcattccccctctcaaaacaaaagtgcaaacgaagtttgagcgcgcgcgctctctctctctctcaaaacaaaataaacaaaagtactctctcaaaacaaacagaagtttgaactctctttcaaaacagaaatacagaagaagtttgagctctctcacaaaatagaagtgcagaagaagtttgagtttgc

SEQ ID NO: 39557 - DNA, 318 bp, Oryza sativa
ccgttgatcaaattcaatcgtacgtgagtcggacagttgggtcatatgcatagcaatttccaaagttaaatagcaaaagatagccttttcatcagaagatagaacaaaacggttttacgtgaaactagacattagacctaatttgttttgtctgttacacggaaaacacgtgcacactgctatgttttcaaaaccggtcagttttagctggttttcataccgtgttgaccgaaagttgttggtttttatcgggtttctataaaccgttgataagcgggtataatttccgatacgaaaaggtgaaccctagccacaaga

SEQ ID NO: 39558 - DNA, 384 bp, Oryza sativa
caaactaatctgttccctttgctgatggaatgttaatatgacaattgaaaattcagttggccaatgggatgcaatgagctatgtcttggtgctttcattacttctcaaggagggcataaatgattagaggctcagtggccaaagtaggcatgtagcaatgcaattctcggtgacagtcttgctaggttatcatttagttaattactaatctaaaagcaaatagaacatgagttattttcttcctttaaatgattgttgtctcacaacttattgtcttgtcattttacttcattactatagttgaaatggacatgacttttgcgtggtgatggatgtatttctttacattcaagagcttagtctaatctgcttctttcttagatt

SEQ ID NO: 39559 - DNA, 415 bp, Oryza sativa
ctctagttgtacatgagttgtacaactggatctcatgagcaattttacggttcttaaggaggtaccaaaaatttagtataaaatttggtaccttatagtacccaggtatcaaaaggtattaaatttacaatagaaaaagtgatacctcatggtacctcctcaagaaccgtaaaattactcggatctcatacatatagcagtactcttttactttcctccctgtttatccctaattaactttacactgttaggcctaattaattttctctacattcgtcccgactggattctcaagtagacgacatgcgtacgtagcatccaaatacacgactcgtgcgcccgtaagacaccaaactcccctcttaaaacgacgcgacaatcacaagccgccgcgcccctgcactgcaccaccctc

SEQ ID NO: 39560 - DNA, 621 bp, Oryza sativa
tctttttcaagaattacaataacgatgaagaactatatatatggagatagttccaaattatgtgtgacaaaggttgatggttgctccaagaaaaggaacaagtataggatattttgtgaattatgctttgttggcaattttattatcttgggccataagttatatttgcctattcgagattccttcacttttgagaaattttgccgctggaaaaagaaaaaaaccaagaaaaataaattttaaaatatatatcttagaagtatgaagattatatgtataaattaatcttaaaaactatttaaataaaataatatatttattgatatttctatatacattataactgggaatagtggtcgaagttatttttcaataccatgttctcgttcaaaacgataattatataagctataggatattattaatatttctttcttggaaatgacctctcagcattgaaatggcaactagcggccagggaagaaaggtacaaaattgcaaagtcatatcatggaaccttgcatcacatcagcaaatcatcccaaaaagaacagagcacacaaacatgcaggaccattcttttgacatcaatatttcttttctttttggctatattcttcc

SEQ ID NO: 39561 - DNA, 1501 bp, Oryza sativa
aaacatgacatttacagaagcactacgattttcagaaaagaaaaaaaattaattaccatcctgataagctacctgaaatgttacagtgaatagaaaagatttgggatataaatgcgatgtaccttggcatatagttcgacatagcggcggaatgtaggatcttcaacaagagccttgtcagtaggcaacttcagaagcccttctgaattctctttcagaagctcactgcattgaagcaaatggtgatatttaattaattctatagatggataagtcatatttaatattacatgaaataggagttatcaaatttcggaggattctttgtccaagcaccatcaataattaattctgtggagggacaagtcatatttaatcttacatgaaataggagttgtcaaatttcagtggatcctttgtccaggcaccatcaaatcctgatctttcgggacgagctttcccctgaaaatgaactattcagaacatgatctctaatttagctggaaaatagtagttgatatattatatacaccagtagaaagatgatgttgcatacgagagtatggccgcctgagagtgctactatgtccttgtctgataagcccatcctgtagaagacttccctcagatgcgcagcaccttttcaaaaaagtaaaatatagtacaagaaactaaatacctttgacatttttgaagcaaattatccagaaaaacaaaatttcgaatttaattgtatcatctgaactttgtgcatacaacatattggaaggtttcagcgctcatttcatttaatcatttataattagcaaaattaacccaagaaatcacagaaaaaagtatcaatgcattggagctgatattttattttagattagtagataggagcagagataacgggtcatgaatcaacctttcttagcatctggcaaacggccttcctctggggaatctgaagaatcctgtagataaatgagaaaaaaaaaaggagaactcaagatggtttcataagatattcagtctggaaaaaaaatcaatgtcgatgcatcaactcaccctcctgccaggaacataatctatagttggcccaccggtgacttcaacggcaacaactccggcaagctgaaattagaggtgatgagatttataattggtatgtgattggtgaagtttaccagcaggaaagtaggattgggcttgttcggatgagattgctgctgcagcgctgcagctgcacggcagcagcagctacagtgctacagcagctagctaacagcggctgtagaggctgcaggcagccaacagccaggccgctgccagccaacaggcagacgaacggctgggctgtacagcacagccaaaacagctgcgtaatcgagctgccgaacaggcccattgtaaggttacttgttagtgttcaaatatgcagctgagttacctgatacaggtcagcataggtaatcttgggatgcttctgtttcatcggttctgcaccacatgaaag

SEQ ID NO: 39562 - DNA, 1501 bp, Oryza sativa
tggaagaacttatcatacttaccacaagccagcgtgggcaacggctgggcttgtagtgtacctttcctctagttgacgcatcaggcaagggtgagcgtgatggagtttggatgggccctgcgacggcctatgcggcttccggattcatctaggcacgagaggggactgcccgctgccttgcgaggagtgggggtgaaacctgaggtgtggtgtgcttggttagagggggttatgcgaagggtcctgtcacggtctctatccggtatgtcgtggtggcatgtcggcgcacggaaacgtatcgtggggctgtgtcttgtgggtacagttgtacacctctgatcagagtaaaactattcgaatagccgtgcccgcggttatgggcggtcaaccagattcaccgtgattattctcagccaagtctagtctaatggaattgaatagcctaggtggatggttgggcctgttgcaacgtggggtagcgttggacagtgggtggttaatattgatttattattacaactggtttactgctttcaactactatttataaatgctcgctctatgcaaacgaacctctatagctatccctagttaattccgtgcatcatacccctattccggtatgacttgctgagtacagtgggtagtactcagtcttgctctattttccccaaaccccagagtttgagtatgcgttagatggtggcttctccgaggagtaggcttcgtccgtgccgtcaaggatgcctgtggagtggtgttcccgctgcagtccaagtcaaggcttagctccagttatcttttaattttccgctgcatttatgtaagattttatgatgtttgtaagacgtggatctgtttgtcaactttgtcgtttgtgtacctcggccggtcctagacgggggttttaacgcacattctgtttggaatcctattcgggaatttctgggcgtgacaagttggtatcagagccgaccttgattgtagtacaagccaaatggaaaacctaagagtctgaatccttttcattgcacacgttctttgcaattggatttgttcctgtggttcaagggaaaaatcttggtcgcttgttcaagtgagatttgtcaaatcaggtcagtctagggttttagtaaaattatttgagatttatttaacagttagtcgggatttgatgggaggagtgcattaggtgctaactaagagatgtgggttgcaagttatttatgttcctattgttattgttattattagtatgtatctaatttctcattattttatcgctatgtaagtccgtctcacttattcgctctcatgcaaaaatgatctatgcataaaattccgctcttattcgcttattttatttgtgtcctttattgctttatttaaattggatttgagcatgcattgatcctacccctttgccttctctagatggccgaccacccacccaaccaccgtggagaaggcatggatgattttgtggctgaattggcttgca

SEQ ID NO: 39563 - DNA, 1501 bp, Oryza sativa
  unsure (1)..(1501): unsure at all n locations
cggaggaagctaacatcaaccatgggtatataggtggtccaaaggggagagaaaaggtagggagaggtgaagagagaaaccagaatctaggcttcacatgtactagaggtgatgcgtcttgttacagatgaatagggccgtatctatgattttggggcccatgtgcaaaacgtaaaatgggccccaaaaatatgaaaacggagcataacaaaagcataaaattttagatatggttcttcttaggaacatataaaacattaatgcttaaatagtttgacctgacctcatgttctactgaaaaacataatccttttgatattctttgaaataaaattttgaattatatcttcatactcaatcttctctaaaacatcattttgaattatattttcatacttaatctnctcatgtaacttgtacgcaatccgatgaaataaagctntcattcatccatatntttctgtgtccacaactctgtgcttgtctgctattgtgctgatcagtagaatagaatggcttcttaanaatgtaccagcacgagtcttcaccaagctaaacaggtaaacagctgagaaaccaatgcctaatgatcatctngntcttaatatgcananntatattctactatagttgaaatgagcagaagaacaatatggcacctgaagtaccatcctctgacattctctcagcaatacatgataacatgaaggtggctctatcgctgttattgtccaattgctagagatgatgcatcctctcagcaatgcctagtaacatgaaggcggctctaccgccgttaccatccaaaggcttgagatgatacatcctctcagcattagttgatacatgatggcggctctgctaccattatcgttaaaatgctagagatgatgaaaggttcctgaagcatcggtatgtaaacttaatggatggctctaccgccgttgcccgcaaatagtggaggcaaacaaaccttctacacgaccctaaaagtgttatggatgtcctttggttctatggagatcacccatatggggccttgctgtcactaaggtcaactttgccgtcaaggctcgtgggctcatagtggagaagtgtttactggtttctattcttttttaaagtttgcacaatatgcatggagtttgtgcccatgtatgctcttcgttttgtttacatgcttactatattgtttgcatgatctttcgtaacattttattttaatgttatataattaatttcctagcatgattcataatatttaatcacgcaatctgtaatcctaaggattacttaaattaatttctatggtaaactgtgtggtaatcctaaagattacacatgctagtgatcataaaaattactcatgaccagtttatatcgaccctgcacatattatttacctgttataaatacaaaatgatgccatgggacatgtcagatagaacaaagaagtaattcatcgagcttgcgttggatggtagcaactacctcactgcat

SEQ ID NO: 39564 - DNA, 1501 bp, Oryza sativa
caagcagtaacaatgtgcagtcaccagcaaggacgaagtgctactgtgctagcctccttgattcgccaccaccaagcgaatgggagaaaccatccctgctactaccgcagccaatggctgcggcggcaatggaggcggagtagataaggtgaagacgatgatggataggccaggttgggggtcagcggcccatgaggttcggaagtttttatgttcgattagtatcgatagacatgactccatagaacttatatgtacaccctcctagtcctctatctcctttctccagccaaaactgagccctggtccaagtatagatggccatatgatctgaggcccatggcttggcccaagcacggcacagcccgactagggtcgtaccgtgtcagcctggcccgacagccggaccgagcctgggctgcaccctcgaaacggtgggccggccggcacggcatgatcgaagaaaaatagtagaggaatccaaaatagacttaaataaccatataaggcaaggcccaaagacaagaggagtataaaacagacttatttttcagccattatggacatagccacagagtcgagggatgagaaatagactaattctgtggagaagcacgatggacccgagtcgtattggaccgtgtgtgtagcccgtgggctggcacgacacggcccggcgtgtaggtcaggccgtgcgggcccgaaaaggctcgaaaacctcggcccagacactgccgggcctaggccgtgctgtgccagacggcccatttggccatctatgggcccaagcaagccagttcaaccagagcctccctccacacatcagttgtgccctcctcatttgctggtttatcaactagtatcaaatttgaattttaaagcttagttttagagttaatgtggattttttatcatattcttttttaccttagtttttaatttttttataccctagataaagtagactaacaaatatttactcataaattatttttgatgcttgctcgtttttttcctgcactcataacacaactgatcactacttcgggtgcaaagttgtaaactcaactaattaccgtaagagggtcagggtttcaatcatttaggtggacgtccactcatttattgccgttctactatcttactgatggatcggctgtgggaagaggtgctcaattcacaatcagcctttccctttttcagatcagtccgcgtccaccgaagaaatcgcggcaaactcggcaaacttttgacgtttaccggacaggcaaagctaccatcacttcgttgtcgttgctgtatatccacgaccacgtcaaaactgatcccatggcgccaaactgaacaccgtgtcgatctccgacctcgtcgtcgccgcgacaaaaaccgctttgatcatcacctcgtcgtcgacgcacctccaccgcatatgtagcagtagacaagtagcatctgcatctgcgtgccatacacgattgctccagctagctgcacctgcaca

SEQ ID NO: 39565 - DNA, 1501 bp, Oryza sativa
atgatgggttcaatactaacattcttaaaagtagaattgaaaaaaatatgtcatatttcaaaatcttcgcacttccaaccggaatggaaagcaaattgaattgactccaccattgatttttttcttaaaagaaaagattaactcctccatggtcacaacgtatgccttgcaaatcgcaagaaaaaaaaaaggaagaattaaaaaatctgcaagacaaaatggcaatacataggttggtggagaggatgcagaaattggaaatgttgcaagcagaagaaatttgaacatggaaaaagaataaggaacaaaaaatgttgaaaaacttgagaagaaacattaaagccaaagtgaaaaggttgaattaatcctaggggaaaaaggagagggtatatacctggaaattgaaataaagggatgaaaaatgtttggatggacaaaacatggaaataaatagaaaagagactgcctatcgaatgtacattcaagagaatttctctcacaaatctgtcaaatgtaactacataattgtaatgaaattacaacataactagtatataactacacaattcgaatgtaagtcggatgtaattcataaccgacaccgtggcttgaaatggaagggccatgcatttaagtctagggttgtgggatcaactcacatcagctactcgcttgtttctcgcatggagcacaaatcttgacacgcatccagtggcaaaaaattgacagattttccctcaattttctgttgaatgtggtacaacagatcctaattgaaaaaagaagatatttgtgttggaaaaaaaccatcaaaatagccacaagacacagagagtagcaagggtccagcctaaaatcaattgcctctctcataactgccactctgccagctgggctcaattcatcgttttcacagtttgagatcactcatttactccattcggtttcattttaattgacattttggacaatgacacggattacaaaatatatctttgatcttatttttctactataatatatacaataaataaatgcatgtttacttttattatagtgctttgaaagacaaatctatatatgttgttctagtttgtttaaagtaaatatttttaaagttattaatggtcaaagttataaaagtttaacctaaccttgtctaaaacatcaattattatagaaccggagagagtatctttttcattgattttcccgacaccaaaattctaaaaaagtcaagcaaagccagtggccaccgctgaactcaaaatagacgttattacataatctgataatcatcatgcatccatctatctcttgcagccatgcatgcatcagctctctttggaagttcatccctagcaattactcccatggcgacaaaatccaactcaccatgacaaagctgcttctgtcacttgccacctagtagtaaacagtaacacctctgcatatatgtatctgcatctgcgtgctgtgtgtgccatggccatggatggca

SEQ ID NO: 39566 - DNA, 1501 bp, Oryza sativa
ggttcacgagtttcggttgtgaaacattaaccgtgccaaccacaagccagcgtgggcaacggctttaccttttgtatagcatggtttattgcggggcaccagactgagaagtggcggagataagcccacaggggtcgctggggagtccatgccttgtttataagggggtgattatgatccaggaatggtgcgttgcggtggattgtgttatgcaaggggtattgtcacagctcctttccgaggtaccgtggtggtattgaggcacatggtgacatgatgtggggctgtgtcttgtgggtacagtggtacacctctgatcagagtaaaactattcgaatagccgtgcccgcggttatgggcgggtctaacaatgtctttcgtgattagtctcacacctctcatcataataaaagatgttataactggtaataatttgattagctcctggtttggaatggtatattcctggtttggagatagaactgtgcagccgggatggttgttcagaacggttgggcctatgcaacagggtatgttctgtagcgttggattaatactgtttaattaatacttaactgttttatcaatttctgaaatatttgttaaatgctgtttatgcaaatgaaaccctactatgccatcctttggtatccttgtgcatttgcatatttgctgtgtgacttgctgagtatgtcatatactcaccttgcaatcattcatcagaggaagagttctacagagatgctgatggtgtggaggattagacgtagccctggtcaagttgcctgtggagtggagtcgtctgcgccgtttatcttattttccgctgcttagatctttattgattgagaggaactatctacctctgtaatgacattttattcgcttattaattagagtaataatggtactctattatcaatttgttattgtgtgcctcggctgattcctggacgagggtatacacacatgtaagcgtttggaattttggatagaaattccgggcgtgacaagttggtatcagagcctccttgaccctaggttgtgccaaatggttacccatagaagccctctaaaaatattggaaaagtagaactgttctcctccctttctcttttaattaaaccaaactaatggcacatgcacttcataatctcttttaatggttctcattcaaaatttattccagtgtaattagtactgtacatctattactgtactaatggctcattttaccagcaaaagttttacaatattgctttatttaatcttgctgcaattaaataaatttcgcatgttaatttataactttcttttatttcttttggaacctgttgttcaaaagtacaaaatttgtggccttgtttccaactgtttcaaattatcctgcaagtttggtttactttttactttgattttccaactttattcaaattaatccaaaaacttgtgctattaattggataaatgtcttaactccctcctttcatttgtctttaga

SEQ ID NO: 39567 - DNA, 1501 bp, Oryza sativa
ttccaacttcacatccgaacacagccttagtagtcttagtatctcaggtattagtatggaccaaaatttatttataacgaatataaagtatcttatggtaaaaaagataaaatcccccatatgattaaaattaatagctctataatggtatacgtaatactcgtcgacataggactgaaaccataaaacactgtagtatgtttgtatgcttccccatttatactttgattttaacaaagcaaccgaactagggtcaaaatttcggaaacccacccacccacaccccacccaaaaccccctctggaaattatttcggccgatttttttttggatatttcatggttttatgtatttggcaaatgttgttaaaatttcaaattatttcggatagaataactaaaaattgagaaacttcagtatccgatacaaataccgaaaatctctccgttttatattataagttgtttgactttttttctagttaaactttattaagtttgataagttaaaaaaaacagcaacacctaaaatatcaaattattttcattaattataacattgaatatattttaataatatgtttgttttgtgttgaaaatagtactatatttttctataaacttatcaaactttaacttagaagaagtcataatataaaatagagggagtaatttgaaccccgaaccaaagtagacaagtagtgcctcaccttgtttggagtagcatgtactacgatccctccgtcccaaaaaaacaactcaacctatgaggggatgtggctcttcctaggacaacgaatttggataaagcgtagcccaaattcattgtattaggagtggtcaaattctcttctaggttgagtttttttttaagacgtggacatggagccaaggttgtcagtatctcgattcgtatcctagtatcttacgatactacgatcctaccaagccgaaacgataccgatcccacctagtatcctatttttatactatcgcgatcctactattcattactatacgatcctacgaaatcttaggtggtattctgattctacgattcctacgatactacaaaatattatttaaaatagcatggtttgaaaataatgtaaataaatatgctcaaatttatataaaaatcagttcaatatatcaaaatcaacgtggtttctcttaataaatgtctctatttgtatgacatatatcattactatattttctttatatagaatggctatatataattaatgtaaatattaattaagcttaaaaaaagaaaatctcatagtatcccgatactacgttacgattctacgatacgatattactttgagcaaaacgttactctctccattctaaattgatctacatattttataggtacaccaagaccaagaaaaactaataactctctcatactatatttactttagcaacaaactcgatgcatacaccatccccaatattttctaagccaatagcaaatcaagatattgcatgtg

SEQ ID NO: 39568 - DNA, 359 bp, Oryza sativa
ccatttggaccatttagaagcctcaggtcactcatggattctgtaaaaggcaaaacgcttgtggactagagttaccaatccacttgttgactagccagttaaatgacatagctttatattccattcgtttcaaaatataaggtttctttgattcaaattcataacacaatataaacattactccctccatcccataatataagagattttagagggatgtgatatttttcaagcacttcgagtctgaataggcctgtccagattcgtagtactagaaaaatatcgtatccctctaaaatcccttatattatgaggcggaaggagtactacactaataactcatatggttcccatcatca

SEQ ID NO: 39569 - DNA, 1501 bp, Oryza sativa
caaatcgcaaataatacacatacaacaaatggaaaactcccacaattttttgttgcttcgttcacgggacttcggcttgtcacttcacttcatctacaactacaagttctcacttgagcatcctgcaatcctacctatgtttcgtcttgttcttttgtccctcttttgccatgcataccgctgttgcttttccagttttccatgacccatccagtcaaaccaatactccctccatcgcaaaaacaaacaacctatgagtaaatttgacactatacaatgaatttgaataggagtattctctccgtcccataaaaaaccaacatagtactggatgtgccacgtcctaatatatcacatcagttctagattcatattttttggaacggaacgagtatatcatgattagttgtactagttagtatcaaattcacttctaggttatttttatttttgataaaaaggagtacatatgatagcatgataggaatacgatgccactaccctttaacaaaaggagtattcttgagcaagagaagcaagcagccattcgttacaaactctggtgattgatcgtgatggccattttccttgtcttccagagacaaaatggctctgattccctcgcctcgggagagcacgcaagattgagatagcctcctccaattattgggtcactcacacacacacacacatctacactgtactactctactggtcactctcgaggtcttcttggcccatgcagaagatggaaacagggaaagcaacagagaattgacagggttggtctcgtcctgctactcctgtttgccgtatctgaatcctgccaagctttcagcagttcagaccttttctttttcttttgcggaggaagttcagagaaattttcctgtggttacaacagcagccagcaatcagtgagaactggctggctgtttatatccaaagacaagtccgttgtttggtccaaagacaagtctggaagaggcccctccaataattggtgtggatcactactcatcccataaaaaaacaaaactaagacatgatgcaacattttttagtacctggttcagaggatttgatcagcgtagagactgcatttacgttaggttacggtcagataacagtaattctacagttcatcagtgtttaactggagccaagggtgtgtttagttccacgccaaaattgaaagtttgactaaaattaaaaatttgaagaaaaaagttgaaaatttatgtgtgtaggaaagttctgatgtgatggaaaagttgaaattttaaaaaaaagttgggaactaaaccaggcccaaatgtgcctttcggacggtcagtgccaccaaaacgagcgaccgaaaaccaccgaattttttttatttataattttttttattaaaagttttacaaaaataattttccattttgaaaattgacggaagtagtcgcctaccgcccaatcgccctctcagagggcggcgaaaatgacgtggcagacggcc

SEQ ID NO: 39570 - DNA, 713 bp, Oryza sativa
cagaccacagtctgcgtcagatatttttcttctctaatccatttgtgtatttgtgttgttcaccagtagtgcacgtctggtatgtacttgctacttccatcttctgaaaacaacgagggaaaaattatctttggcttgtaatactaattaactccttacatattcttgaattcctcttcggtgttccagacactcttgtatgaaagtatagagctattttctcgtagtacaaaatgaggataaaatccctctcattacaaaacaaagagggaggttatgtgtcttatggaagaggccggggatgtaaaacatttctgttgtctttaaaaaaaaagataaaagagggatttgaagaattgtatttgaaattctgaattatacataaccaaaattgatatggattcgggattgagtcggtctggtaattgcagatagtccaacattaccaataaatcatgttggctttcaaagttttaacttaaattggtcgacatggagtactagtattgcacttgtttggctgcttgctgaagtttgcggcacttgagttaggagtacaagtgtttttttaaacggaaaacggtacaagagtgcgccttttcattaaatatagaaagaggttaggagtacaagttacgaccatccataacaaatgtttgattcattgctaaaattgaagcatattaacccttaacctcacatgttattatagc

SEQ ID NO: 39571 - DNA, 613 bp, Oryza sativa
tggccacgttgtcagcagagggagcagtgaattcgcggagggtcttgtcagccatagtcttaaaggttggtggcgtgggaatggctggtttctctatcggaagagttttctgcggagcaacgactcgcggcttgaagctctgaaagaaaacttctggattttccttgaaattttccggcaagttaaaaccagtcatgcactaccctatttccacaatagaagtgaaaacaaccaaggttagcctacaaaggacagtgattatacagaggtaaatataaagtattagttatagtaatcttttttatgaatcttccacggcaacggcgccagaaatgcttctggtatattactcgaaatataattcctagcaatggttgagaaatacttctggtatattatggttacagagttcatccgcaagtgcatggaaataccattgtagcttttcacccaagagtattccaagggaatcatatttgagtaatcccgtgggaagattataatagagagaaccacactaataattatatattacttgtaataaccaaagtctaggcaggggttaatatcattcaaagggtagagtgacactaagaaaaagtatttatactct

SEQ ID NO: 39572 - DNA, 1501 bp, Oryza sativa
gatggcatagtagggtttcatttgcataaacagcatttaataaacatttcagaatttaataaagcagttaataattaagcagtattaatccaacgctatacaacataccctgttctataggcccaaccattctgaacaaccatcccggctgcacagtcctatctccaaaccaggaatgtaccattccaaaccaggagctaaacaaattattaccatttaaagcatttgttatcatgatgagaggtgtgagactaatcacgaaaaacattgttagacccgcccataaccgcgggcacggctattcgaatagttttactctgatcagaggtgtaccactgtacccacaagacacaaccccacatcatgtcaccatgtgcctcaataccaccacggtacctcggaaaggagttgtgacaataccccttgcataacacaatccaccgcagcgcaccttcctggatcataatcacccccttataaacaaggcatggactccccagcgacccccgtgggcttatctccggcacttctcagtctggtgctctgcaatgaaccatgctatacaaaagataaagccgttgcccacgctggcttgtggttggcacggttaatgtttcacaaccgaaactcgtgaaccggtccttaattgtcatgagcacgaccatcaaaaccatgtgctcacaacccaccattatcaggttttagttggcacattaattaattaactaatcacgattgaccatcgtgaactatcattaagccatcattaaattatagtgattcataagttatcccaatagtgtgctaatgtttctaagcagagctaagcaattatatctaatatctagttgaaccaatatatatagcccaactagtcaagttataataacccaaggtatcaaggaataaagtaatcaagaacaaaagggctataacaaacaataggttaattccacccaatgacattcgaaaataaatgcaatagttgaatagaaacaatagctttaaacgggatcaacatgctcaaagagttgtttgggatctgtgtgacttgccttgctggccttggaattcttcaaattcttctcctgcgaaaacggactctccggaaacgacggaatctaagcagaaaagagcaaaatcaccaaaacagcacataaacaagcatgaacagtacatgtggatatttttaacatgtagatctcaattttagaaaaatttagagacttgaaccaactaaatcggagctaagatgaattagttatgaatttttgaagatttaatcggattaaaacacttatattgattttaattgaattatgacgcaataatgaattatttttgaaaaggaaaaggaggattattgcgtcagcgggctagggtttcggtggaccgggcgcacggcggcggttcacgcgaacggacggccgagatcgacttgatccaaaacggacggccgagatcgatcggtccacgaccagctcacgggagagggcgacga

SEQ ID NO: 39573 - DNA, 1501 bp, Oryza sativa
ttctcaactggcctctttccactggcaagctctagcagcagtactccaaagctgaagacatcacagctttcagaggccttcccaagcatggcgtattccggtgcaagataaccgagtgtacccttcacctttgtagtgacatgggttgcaccatctggaatgagctttgcaaaaccaaaatcggcaacccgtgcttggaaattcttgtccaacagaacattgcttgacttgatatcccgatgaatgatatgtggtgtcgcttggtgatgaagatatctgcatggtagagagagatttcagatgtaagattacttctgcatgtactgaaagttgtcatactgttacagcataatgaatatttcataaggatgtaaaacatgcttacgcaatcccttctgcagaatcaatagcgatcttcattcttcgttcccaaccaagatggcattcagctgcatgctgtccatgaaggtgggagtgcaagctcaggtttggcatataatcgtagactatcaggcgttcttggccttcggcacaatagccacgtaagctcaacaggctcttgtgtctcactgtcgccaaaacctccacctcaattgcaaattcagtttcagctttgttgctccaactcttgagccttttcaccgcaatctgtcccatgtagttaacagaagaagcgttaggttctggttaaagtgaactactttttcctgattttggattaaacagatagaaggtaaatagttccaacataatacttatgatttatgaaatgatgttcaaaaacatacttgtcaaaacgatagtttgaatttgatattgtaggggctgttcagattgatgctattttcaaccataccattttttggtaaagctgccaaaaaaatgtctatgtttagtttgttgtcaaatttggtaaatacataagaaatcctgccaaaattttagcaatattgtcatcttaaattttggcaacattgccatcttgctaaaattttggctacaatctgaataggcccgtatttttttttcaacccaaaatgaaacacaactcaccgggatgtagcagtttgggggttatatcaccatgcaacaaactaacaagtaccaatgtagaacagtttcatcatcttcataataaatgtgcaactgtctgatggaataagtcttacgctgttggtcttcttgtgctaattggtctttgtgttctttttgcttttcagtgcatctttcttttatgacagcatctcctttcacttttactttttagagtagcaagccagctataaatatatatcccaacccccctcccctgcgtgatggtatggcacttgtgagaaataaacagaaaattgccccaactctccttcttgagctcccctctgtcctcagtcggcagcaggaacaccggctgttcctacttatccctcttcccctgcgctgacgagcagcagctcctcaaaggcagtctcttccccacgcagcagcccctagtggcgtgcca

SEQ ID NO: 39574 - DNA, 1501 bp, Oryza sativa
gagggagtagatagatagatagatagatagatagattgattgatttatggatttatggacggattgatttagcatatttgataccaaataaaatgtaatttattattcgagaatagaacaatcaggatgaaaattttcaaaaccgatggatagaagtgatattaatcaattgtacacattatgatatgacaacaaaaatattgaagcagtaattcactatcataaaacaaacaattaatcataacaatttggaaaacctatgtttagaagtggctttaatataagataacttaaggataaggataaaacataccagaaaatcctcagcttacaaaagtaattaagtcaacattaatttcttccatatataacacctatctttggtctatatatatgaaccatggatcctgaagttcacactcatcaacattcaactcaatagtcacaataagacacaaaacaaaacatagtagctcactcttcacaatatgaagcacgcccaccttggactcatgttgttctgcttggttcttctagttttctttgctatccctgcacaaatacgaggcaattatttttttttgaatttgtatgttttttcatcattttctttgcactggcaagataataaacatatgactccttatgtctctaggtcaaagcacaagcagggccccggtgggagttagcattggagaacttaaacttagtgtttgcttttcggcccctccatcgtggtcttgctgttcaaaggacaacctgtgctatccatcacttgaggcatgcctggaaaagtgcaagtacgatgaataggcacgcagccgactcagaggctaagtgctccgatgtgtgattgaattggacacaatatttactaataatcatatatccggtatatttgggaataacatatgtatatgttccaacagatatgcattttctaaatccatattgaagcatatgagatgcgtggtgcttatgtttaggagttgttttcataatcaacaaaatataattccatattttcaatgctagaataaatattgggccaaaagaaaaccaagaatctcatttcataaatttcgttatcgcacataaagacccaataaattgagtctatgaaaaagagttgagcatgctagtgggcgtagttgctatagcgacactagacgtgcatggttgcgcttcccatgcaggttttggttttgcttcacgtggcatctttagcctcccgttcaaagatctctacatatcagaactttcagttttcctgaacttccatctccaaaatcacaaaactttctcttcaaacatatgaaaacattcatctgaaaatcacattactttccaaccgtatctaaaacttttatctaacaaatcataacaactttcaattcaactataaaactgtcatctcgaaattgcacaaactaatgattcaaattaaaaacttctaggcaaacttcataaaattttcaattgaaaaatccaaaaattttca

SEQ ID NO: 39575 - DNA, 1501 bp, Oryza sativa
acccttggcgttgaactaagacatctcagtgctaaatagcgtggcgctgaatatgcgttggcaagccgacttagtcacccatccgcggtggcacggtattcaacgccagttgacatggcgctgaggtgtctaagttcagcgccaggtgatttagcgctgaccaaaagagtcaaatttgaaataagttttgacagcagttcatatgtaaaaaaagtttttgcaaagggtcaaattgtgaaaatttcaacgtaccaagggactaattattgcctactattttattatgggatttgcccatatatacatacccagagaagggaagacaaagatgcaataccaaacaataagataagaatggaaagagacaaatgcccctcacaaaatccacaagtgaatgccatcacagctggtagccccagaaggccagaacaggactcctgttggtctcattgaggttagctagccagccactatggagtggagtagtgtattatggagcatagtgacccatcactttaataagcaccggtgattggcacgcttcaatcatggctttgtatctttgtgcttgcaaaagtctcaagcaatcccaaagcaaagcagatggtaagatgttctgcaggaattttgtaatgtcatcatccaatggccatggctttggccccaattgacctgttctcacctctgcctgccctcatcacactaatttttttaaaagatgatcatcaaactaatttaatccactaccatcaattatagttgaaaaagaaagccaaattggaccattgctttaacccgaaaaagaaaactgaaccggtgcttcgctcgatctggtccaattcaaacactgtttatgtaatcgaaaattcgaaccgctctaaactatttgagttgggcaacttcattgtgaatcatgaattaaagtagagattttggaccggttggcatggaaaagagttgggctccacgtatatgaatgaaccaaagaaaagcccaacgaccagaacaccacaattttaaacctaaatcacttaaaatggcgcaagttcatggttgaaaaaaaaacatataaatgtcataccttatggcctaacttttttttttcaaaacacaattaaaatgcaagcttttacaacacaccctacgtccctacacatatgagcacctccgaaaaactaggacagtatatattgagattgacgaagtcatcacgggtgtttcgctgtcaacgttcaagtctaggaagctactctcacttctcggagtaacatatttttcttagacgtatacatagtatatgtgcactcctatttgtccatatttatttttcaaatttggtttcactctccagataggactcttgggcttgtttagaaggaaatggcccacgcaaatactggcccatcacgaggcccaaatctgcgtgtccaaggaggaggagagaagcagcaaagcccaacttcatctgcctcgtctcgtcctcaccccgcctcgccgcctc

SEQ ID NO: 39576 - DNA, 1501 bp, Oryza sativa
cacccggatatctctgtgaaggcacgcacacgcgctgagagcactccgaggcttggagaatgcaggatccaggatgccctgcattacatttgagcgaaaaaaatgattgacagagttagtcttgtacgttgaaaatgagcagtttcaggtttgcagtcaagtcttgggcactgaaaaacaacactcaaattcagactagttcaggactgaaatagctcacctgaagacggttgagaacataggtatacttgccccaaagttctggcctgctttccaccagagacaggtctagcacccggcggatgcaccagacaccgaagctgacaacgagggaggcgcgccagatgcagtcgtctccgcagttaggcagtacgcgcatgtactggatgtctgccttatcacatggtggttgctgagtatcaccaagcagcagttggttgtcactggttccttgttgcaatagcttctctaccgcagcaacttgatcaatcagatcttcgtcgctgccaccattttgcttgaacagccaccctgatccttctagcttcaggagcttcgagatgcagaatctaagagactgaagaagcttcgcctcagactccttgtaagagaaatcatccttggtcatgccacccgatctgcctgcagggttgaactcgcttttagtgagctccgcactcgacacaccaaacagctgctcaaaaggttgcttagcccaaagggatcttgcacttgggtttgggctttgttgcattgagaagatatcccctgggagcttaggtggagagagctcatcaaacgccaagggagctgcaggcctggccaccgagtttgtatactgagatctttccgatgcaagcctgctaaggtacgactgggatccaatggtaccaccacccaactttgattcattcaacagagcactcctgcttgcagcaatcagtgcagatatgtctggtgagctgtggtacttctttgagtaagctgatgaaccagcattttcattcccgtcaagagtggaagggacataataggatctttctgccatcatagtacctatccgggatgttgctgcgatctgtgaaggagtagctcccaatgaagcaagcaagttctggttacgagcatgcatgacagaatcgacataggttggcacagccgatgcagaagattttggaagtcgctgtgggtccaatggcatgctagagtaaggatttcgattagcattcatctgttttaggtatgatgcgagctgatacccatgaatcgttgcaggttggtagaattggttgttgtctgcgtatgatggcgtgctaaaatttgaatttaatcttgcaccttgatcgagtaagctgttgcttgaactctgcagttgggtacttggtaactgcatgccctgagaccaggctgatgacccaatgttattgcccatctgaagcccatatgtcagatccaaattcgacatctcattcttagtagacatcagatcccttgaacttcc

SEQ ID NO: 39577 - DNA, 1501 bp, Oryza sativa
atcgtccctattttaatttttcttataaaaaagagacgacttataaaatgacttaagtgaaacgtcttaaaacaatagttttgttgtagcgcgcgtgctctgcttcttcttgtatacggaaccactataggatccagtaatttattcttaatccgttcatcaagtcaatctcctacataggctgctatgttgcaaagcaaaagcatatactagtatattttaaaaagcgatttcatggacagacgatttggcatgcattatataactactctgagtacagccaggccagtgtttgtcacatggctgatggctcagatatacttttatgtcatggacgttgctggtttgagcaagtcggatgattaatttgatcgatccgacggcagtatgcatatgatgatgtgataagccaactaccacagagaattattagtgaagagtttttcactagtgactcagtggtattattggcccagttcctactgtataagcgaggatttattcgaggaaagagggaccctatatcataccattacccaccagttatcatcgccatctctagctctctcacacgttcgaccacagtctcgtcaccaccatctcccttacacgcaccattttcttcatgatcaccaccatctcacatctttatctattataaaaattaaagatatttttgcctatttttcatacgtcatctcagtccgattccctccccgtatgcgcccgattactcctagatcacccgtataaaaaacatgcaaggattacgtattttctttcttaaagcttttcatccgtcatcgatctcttgcgtaatcaaattcgctaattggctttcaatagagccttcgcccgccgcttgtgccatcatgcacagcataaggcagtccaaatcgatcatgtatttcataatgtaacacagcctaatctctgtccccacggaatgccccagtctttcctcagaccaactttgtcacgtattaatccatccacagccagcataagccgccgcctacgataactgatcttcataggtggctggtttaagatgggactggataaaaactcgtggcttgttagctcgctcggctcgtgtctatctcgactcgacttggctcgccgaaccagagttttagctcgttagctataacgagccagctcgagatggctcgcgagccgctcacgagccatgaaaacatcagaccgagcagccccggatgacacctatccaaaccatgtaagcccaactaggccacggtagtacagtgcacatcctatattcagttaataaaggcgacagttgcggctcggcaacagaaaaaagaagagaaaaaagaaaaaagaaaaggagagaagaaacggtgagactccctcgatcccttctctgatgtcgccattcgccgccctgcgcccctgccgctcgcgctatccgctgtctgccgtcgctccctgctgttccccactgtcggagcaaaggagatccggtggccatcaacct

SEQ ID NO: 39578 - DNA, 1501 bp, Oryza sativa
tcaaaattgctcctgtgaaatgtatgataaggcaatggttagaaaatataaagttctctgctcctgttgagtgcacttctctgattactcggatagcaaaagggctagtggtcattagcgaccaaattgcttttatctcagccgcttgtccatgtattgatgagacttatctagtgcaagggcatattctgaaacatggagaagatggatctttaatttacttttttcccggttgtataaatgaaatcccgttgccaaatgcggggtatcatttgtacaactgtcgtgaactaaccattcccctgcacaccatagaagaatctcgtgcaggtggagcatacagggagacgcgcaacatggcaagaaatgaacagggaagttcatcatcctcaacactcgtgcaaatgtatgaggcaggttgggaaccaactggggatgcacccggatggacccaagctcaacgccatagcatcggagtctcaaactgggcaagtgccagttaggaccgatggcatgcgcctaatgacatacattgggggaataaccaaccttccagatcaagtggtgtgcctccatctcgaagtgaatggcgctcgagttcctctcgttggggcttgggtgaaatcgctaggagaatggacaccctttatatgcagacgggggagatccagtacaacctcacggaacacatagcacaaacgcaagaatggcaacaatctgctgatgctcagttcgcaaacttcaacaacatgatgcagcaacagcacgatgaccttcaaatgtactaccgctttcaacggttcaatccttgtcaaggaccctgagcgaaagccaagcttggggggagagatgtctctccccccactgcggtaacttgtatcacattgcatatttcccttttcaattgcatgtttgctttccaattgcatcttataaacttgaaaacaatataaaaatttgcaaagtagaaaataccaaaaggatacgacaggtttgagtcatgctagataagacaagccagttctctttgttgaaatgatgaatagttgctctgttttatatctcttatatatgggttcatggtaagtgctctctcaaaggttaaatataagtagccaacaattatctaggaacctgaggtaaatgagctgcacttgctaatctgagtctaagttgttgcaagatatgagatagtaaataagtgttactatgatcatgatcctagtttgacttacattccgaatgttctgtttttcaaaatgataaaattgaaagttcctcatttgatataaattcctaccagagcaaaaaatgtgctatcatgattaaaccatatacattttggttacttgccattccattgaactttgtcaaactcttgtgacttgtgtagatacttctcatgctctatgatcaagatcatacacccacatatatgcacattgtcagggttacggataagttataccctctatccttggatgtacgttgtatactgata

SEQ ID NO: 39579 - DNA, 1169 bp, Oryza sativa
agtttgtttgaatgtccgaaaatgtgttacaatgtctcaaacctatttgcatgagtggatatttaaaatttctaaacgatatcagatagacacaaaacctatataaaagttgtagatatagataagatctacatttttctacacttttcattttatcttatctatggtgttaaatatggattataagttcaaatgatagtggtctcaaaacaatagcatttgtttccaagacaagaagtgtttgtaggtgatatggcaaggtgactttgtgtgaagtgagatgtcttgaatttgaatttttcttgacacatttgtatgaatatggattcaaaaattatgtgacttttgggaatgagagtgtgattgtataggtgcctaataaaaataccaaatatttttttcgactttttagcacctgaaaaataaaaaacgaaggtgtgttggttcaagaaccggcaccaatgagcattcatgtagtactgcgagcagatttaggattaattcttatgacgagtttgaagataatctaccacgtctagattgagtacatattctcattatgataagtaaatatttgaagtggggtatttacctaagaggaaaagcacagaaaaaagaagaagaatatttgagtcgacgagagggagcctcactcctgtctagatcacaaggtgatccaattttctgacaaattttgctaccatcatacccaacataccagtaggttattgggagatccaagtactttgtcttgtgcactagagttttgcatttctactagggttacataaatttatggcagcatattcaggattttattccaatagcgagtttgaagtttgtgcatcatgtttcgtgtctatgctaagttcacaccaatggtaagtttgaagtatggttcatctcttttctatcgagggtactacatgatgttgtttggagattgaagatttttatggaggacactacggaacgggtgcccgatttttggagaaaaaaattgggccccctaagcatgcatgcaatcttttcttctgggaaacctccacatgcatgcacgcagtcatttcttctcttccacatgtgaggtacatgcaaacttctcccatccccttgtctcttctcccatactcttaattagcaaattataaaccattttttcttatgaa

SEQ ID NO: 39580 - DNA, 1377 bp, Oryza sativa
tcctgcagccctgcggcgccatcaaccacagcaagagctaattcggccacttatgcagggggttacgtacatgcatgcagacgatgtggtcgtagccatatgttttcttgttatatctcatcgttctaaaatacagaaaaccttgtactcggaaaaaaaagactactccagtataatataaagtatttgtatttgtggttatccatatatttacctgttatgaattgttactacctttgtccctgattttgcatctgttagtgcatagactaaatcccatacatatttagtactcgtggattgtcatgtaactgggctgaatcggtatacatattgagcccatggctagctaggctcaatccgctgcgataagccaatcattcaagccgttacaaaaggagcagatccaacagatggggggatcgaacaaaatagatgaaacctgagttcttccttccgatgctctctcttcttcaacctctgtatctctcttctcttcaatccctggctatctcttcttctccaatctactgctaattctcagtcttgattccatttctcccatttgtatcccaaatactcgtgtatcaagtgttggaggaagaattgtgtgcttgtgctggaattcactaaatcacatagagtgttatttgcggcacccgcactggcccctgggccatgcgtcgcgtacgtttggctagtgaacaacgtgcgagcttggattggatggggaactgcgggcgcgctagccgttacacgatcgaagggtatcagaatccaaaattagtgaccgagggtgggaattacgatgcacaatcacccgaccggtatcaacgacgacagggacgaggccgacgcgacgcacacgacggctggggacgaagcgcgggctgcatgtctcgtgtagcctcgtcgtggcgatcgagcggtgcacgcctctcagtggcgcaacgactatctttgacgcggcgtctcttcgttcgaaatcgttacgacgccacgcttctagttacagttttacaacgtgatattactaccacgacgatggctcagcggcgaaaggttaaaacacgttgctaaatagaggtcgcggcaacgggtgggaaagccatgtaatcaacgtgacgtctccagtttaccgaggtacgagtaccttccaggtcaactctgctcccctctccatctgtcactaatcacttcaccccggcacgcacatccaccatcgatccacgtatataaatcaccgtcacgcctagctcctgctttaatttgctgcaccactacactactactcctacacactgcatcgatcaacaccgacgcatcggtcagtttcactgcgatcgtcaaagctacacacggtatagcagtgaaaga

SEQ ID NO: 39581 - DNA, 446 bp, Oryza sativa
gactactatagggcgaattcgagctcggtaccccttactaacaagagaaaagaagaataaaacgatcgctggcagcgatcgaggccccgttagccttttggcctttatcctatgtattcatttgggtatgaaattgataactaccctgccaatgcacagcttaaaattggcagtaccgaaactgtgcacttgccaatgaaaactgaaattgctaagtagtatatttgaattgcaacacttcaaattaatattaatgaacaataactgacagctgaaatttctatgcgaattttctttgacgtgctaacacttgaaattgatttggttggggtgcgccaggcttaggctgtagtgcaacgcctaaacgacgcttgagggacctagtggcaagccactattgtgagccctcccccataaaaaataaatttaatatcaaagtgggcaca

SEQ ID NO: 39582 - DNA, 894 bp, Oryza sativa
aaagagtggccatcaaatatagcttaattggtagagtagtagttgccttgcaaggatcactcaaatatatgtatcccagtatatgaatatcctagggcattgagtaaccctctagataactgaaatttgcaggtgaggaacagtattttttttttctttttgagggtgagagatatgagatatcgttgattttgttttttaaattaatattattgtttttctttgggaaagtgtcgattttccttttatttattgcatagaagcaaagttgtgtcgtttctcctgtagcaacagggaatgttcagtcaaattacccaatcgtttctttcctaatgctatttagtttcccatcaaacagagactgatcagcggtaattagtttggttatcggtcgactagaggttaccacctaaaagactgtattattcaaattttatatttgaaaattttgaacttttacgacttatgactagttaactaccaattattcattaaaaaaattgaatctgaaattttatctggtaaaattcagtaactgtcaggggccagtagcttcggaaacccggtttctgaaacgcttggcctaaacaattaattacagattgtttaatttcagatcaactaatactactactactcacacgatcatctagaacataatcaaacaggtttaaaaatatcttaagcagcacgattaggacgtgcgaggcaaagaacaagggaggggtagttggacgatgtgacggttccggcgacggtcggataagtttccagtgatctaatcatgctgcccaatgcaacagtgccactgaaatggacgtgatcatgctgctgattcgctgctactactactactacctgatttctgatgattctgacgtcgttgcttgcagg

SEQ ID NO: 39583 - DNA, 284 bp, Oryza sativa
ccttagcgttttactgctatagccttaccgccttaacaaccatgctacatatatggcaatcatcttgatatgataatgttcttggcttattgcatagttagtcacacactattgtttgtagctggcttggttcttcatcagctagtaggccccatctgaattgctaccttttgtctactttgttcatgccaatttggctaatctatgtagccaggcttttacaggtatttcatggattgcgtagttccttgtatactgtattcatgccaattttgttcattgca

SEQ ID NO: 39584 - DNA, 380 bp, Oryza sativa
agagcacccgcaatggtaaagtaaggtgctatctataaaacatgtacatctcagcaatagactcgattaatagtaaaccaccttaatagtatgtctacattggtatctatagctctctcatgcattgtctcgtttttctctatagactatctctaagttagtagatagctttgctctctctcttcatttaatacattccaagtaggaaaatatgctgacatgaatctcttatagagagcctatagataaccattgtgggtgccctaacaccatagattagtagtagataatctataggactgcatgcaatgcgatgatatctaagctcggtgtagattcagaaaccgcatgttcagatatatatgcatttcttttctagc

SEQ ID NO: 39585 - DNA, 753 bp, Oryza sativa
tattaccatattatctgattggtctcatcaaacacatgtgttgaaaagataaactaatagtagtgatattactcgacgagaaaagaaccatgtcaagtgattaacacattccacttccgagttcttacaatggttcaaaagacgcttctcttctcttattttcccctttctttgttgtctcttatctaactttctatccattgggatgtggcaatcttactgccaaaatgttaaacataaaaccaatgatgttttttaacaagaaaaaaatatttatcgacacttgtctggcttactatagtggtttgaaagacaactttctcctatttcatctatgtcacgtgattcctttagggctccaaccgtgtgtccggtgtgacatgggactcttaaaatagcaaatccccttgtgatgcatttgcatagttcatctacatggagattccacaacaaaaacaccaggacaacacatcaagaaacaaaaatctaatttctttttagcttccaaaaaaaatctccttccttcttggaccaaaatggcgataaaaccccaaaccacagcccaacatcccagcataacaaaccaagagagaaacaagcctaaaaaaagcaagggccagcccaatagcccatcaagctcaccattcctcgcctcctaaggtttcctcctatccaatccaccaactccgcctcgccgcctccatccctcccattcccgaacacgtccccaaggtaagccggcggcggcggcga

SEQ ID NO: 39586 - DNA, 670 bp, Oryza sativa
gtaatacttaaacatgttttggtcgaattttctatatgatgagaaaaatctaatacgaagtatgaaacacactggagtgtatggccatgcttgcttccatccatccatttccacgatacaaaaatgaacaagaaaaagatggacacaattaattagcacgctagtctttgcatgtcgcaatacaaggtaggtaaaggccgggggaagcacatcgcaccatcaccacatataaaaatcgtcacatcaacctcatccaaatttcgcatcatcacaaaaacaaatcaaatcccctccaaatttataacccattaatcaaaattaaaaatatcccccaatggtcaacacacacacaaaaacacacacgagatgatcaaaggccattccatcccgccctgacaggtgggccccacctgcagcctctcgccttcgcctatatatccactcgtgacacacacagccccctctcgcttgccacgcacaccaccaaatcgccaaccaaaaagcaaacccccgcgtcttctccgatcagctccgctcgctcgccgccgacgagctcgccccgccgccgacggcgacggcgcatgctagctgcgtatagcccgcggcggagatgaggtcatccagcgattgcaaggttgtggcggcggcggcgaggaagaaggagaaggag

SEQ ID NO: 39587 - DNA, 297 bp, Oryza sativa
gaccaacgcgaacaaaggaacgcatcaacccagcttcaggcaatgcagccaaattaagaccaattcatcagaaagagagaaagaaaaatccagtgatcaccaactcaaactattaactgcccccaaattaaagaaagaaaagcaacaccaccgtctgttgcaatgcaagcaaacgcatcagactttcagagaaaaaaaagaaatgcgccgtaaaggaggtcgcttgattccagtccatgcatacgcgtttttgactcggaacaagcaaaggaggaggaagaggaaatgagccgacga

SEQ ID NO: 39588 - DNA, 1501 bp, Oryza sativa
gaccacatctctactattgcttgccattgctcacggtcatactcttcagcgatgatgttgttctcacttcgttttctggtgtaccatcaaagaaaatattcttcaacttgtacctcatttgtcattgtctagacttgagcaaatcagcacatgcatctttgaccgtctgattattttcatctttggcaaattggccctaatcaagagcatggataaaagaaaattagcattaaaatagaataacatacaacatgataaacctaatgacaggtgaataaaaaaataagtaaaaatctgcataaaatagcaagcaaaatgaacgacatagacaagaataaagttatacaacaagtagcatgtgttcaacttgggagcaaataaagcaatatgaaagaaaaacaaatagcttctaagacttagttgcggatgttcaacttctccatttaaaattcagattagaattgtatagatccaacatgggcatagaaatgaggatgcaaaattaatcagagcccacacaataatttgtagaaactaggacataattcatcttatacatttgcagatactcacataaagcaacccatgaacatactgcaatacagtgaacaattaaaatttaagagtgttgctctattaggaaagaattgatctacttacaaccactttatccatatagtttttaagttgagacttgccattcttatactccttccagtgagtaaagattggtatgtgctgcctaagtacaaccccccactctgatgcttgctttgcaaactacattggtgcttctggccttctcttcccttcaacaatgcgcaccatcttaagggtgtgtttggttgctcgtatctatcaagcctggctcatctccgtcatccaggttgagttcgtcctagttaaggcgatacatatgcagtcgtttggttgtttgcattagtctggcctggctactacgagatactgtttggttgtctgcacgggggatacggttcagatgagaatttgtttggttggttgtatgaaccgtatgtatgaggatattttttcttgggtgagattaccgcttataaatttccactatattagagttcaggtaacctgaatttatttttttcatatatcaatcttcttttgttagtaaaacaactcatcaattgaactaatgtagtggagtacgtaactacacagtaaatcgtatattagtgactaattacgggattagagaacggggatagtagaaaaaggaaaaagaagaaaaaagaaaaagtgctctcgcatctcctcacactcctcgctgttggtattttttaacgacattacaagaaatataattcccagcaatggcgcagaaatactcctggtatattatggttacagagttcatccgcaagcgcacggatataccattgtagcatttcacccgagagtattccaagggtatcgtatttattttatctcgtgggaagatcatgtagagagaacttgactaataatt

SEQ ID NO: 39589 - DNA, 1501 bp, Oryza sativa
gtacccatggcaattaaggtccggttcacgggaaaccatagaaccggtggcgagagtgggcgtgatggagttgggtcggccggggtgtccggttgtccagctgctggattcaccacggtgcacgaggggactgcctgctgccttgcgaggagtgggggtgaaaccttagcgtggtgtggatggttaggggagagttatatgaagggtcttgtcacaatcactcgacgtggtgacgtgttcatcatgggtgcatgatgacgcggtgacatgccggtgaattgtgtcttgtgggtacggttgtgcacctctggccagagtaaaactatttgaatagccgtgcccacggttatgggcgatcgaccagatttaccgtgattactctcacacttaataaatcgactcaatgcactgtagttcaggtgggttggctgggcctgttcaacatggtgtagtgttgatcagtggagatttaatattaccttaattactcaactgttttactgttttgctcaataaaatgttttacaactgcctttaagcaaatagccacaagccattcttgtatccccttgcacgtctgcatcgttggtgtggcttgctgagtacggtggttgtactcagccttgctatttcccccttttcagaagtgttgtgcttctgagctgaagacggagttagaggaccaaggctcagacctcagttgagttttgcctgtggagtggagctgaagccccgctaggatcgccttttgccgctgctgctgctttcatttcggtgtgaggactaagtgcctcttctgtaagtattttatgctttatttacgtttggaactgtttattacttatcgttttgtgtaccctggttggtcctggacagggatttaatacacaaaatagtctagacatttgggctaaatttttgggcgtgacaataatgagtgacgaatgatcaaggtaagcagagatttcatccgaagtaattctaataaataccgctccccgagttattccttgtcacctagaagggaacaacgttggtattctatacagtccaactgtcggggttaatctcgtctcggagtcatttgcattcgcttacctgggcaataaagctataaccctagcaaacaaattcttcaagcacccgaatggaactatcattgaaggatttgggattgtgcaagacgtacctgtctgctttgaaatccaagattttgacattctaattgggcctccaattgagcaactcctcataaatacacctcgattggacagcctcaagataactttgggagggaacgaattctcagttccattctcacgggcaaggatcaccttgaccgacactctcccagagaacgagtttgcagaggaggttatggcagttccccctcacgagtctcccgagacccttctggaaaatgaagtccccaacttcatcaaacaagaaccggagcccggtgagactgacgaacttccaatcatggaactgccgcctcgac

SEQ ID NO: 39590 - DNA, 1501 bp, Oryza sativa
aggatggcatagtagggttgcatttgcaaaagcagcatttaacaaacatttgagaatttaataaagcagttaagtattaaacaatattaatccaacgctatacaacataccctattgtataggcccaaccattctgaacaaccatcccggctacacagttctatctccaaaccaggattgtaccattccaaaccaggagctaatcaaattattaccaattatagcatcatttactatggtgagaagggtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtacctcggaaaggagttgtgacaataccccttgtataacacaatccaccgcagcgcaccttcctggatcataatcacccccttaaaaacaaggcatggactccccagcgacccccgtgggcttatctccgccacttctcagtctggtgccccgcaatgaaccatgctatacaaaagataaagccgttgcccacgctggcttgtggttggcacggttaatgtttcacaaccgaaactcgtgaaccggtccttaattgtcatgagcacgaccatcaaaaccatgtgctcacaacccaccattatcaggttttagttggcacattaattaatcaatcacgattgaccatcgtgaactatcattaagccatcattaaataatagtgagtcatgagttatcccaatagtgagctaatgtttctaagcagggctaagcaattatatctaatacatctagttgaaccaacatatagagctcaactagtcaagttataataacccaaggtatcaaggaataaggtaatcaagaacaaaaaggctataacaaacaataagttaattccacccaatgacattcgaaaataaatgcaatagttgaaaagaaacaatagctttaaacgggatcaacatgctcaaagggttgtttgggatctgtgtgacttgccttgctggccttggaactcttcaaactcttctccggcgaaaacagactctccagaaacgacggaatctaagcagaaaagagcaaaatcaccaaaacagcacataaacaagcatgaacagtacatgtggatatttttaacatgtagatctcaattttagaaaaatttagagacttgaaccaactaaatccgagcaaagatgaattagttatgaatttttgaagattaaatcggattaaaacacttaaattgattttaattgaattatgacgcaataatgaattatttttgaaaaggaaaagaggatttattgcgtcagcgactagggtttcgcggtggaccgggcgcacggcggcggttcacgcgaacggacggccgagatcgatccatccaaaacggacggccgagatcgatcgggtccacggcggctcacgggagagggcgacga

SEQ ID NO: 39591 - DNA, 1501 bp, Oryza sativa
taattaatatacacttgtatgtatttgaatcggagaaatataaatatagagcatgtgtactcacaggaaatttgaacttccgcctaagtctttctctccatttgccgcggaccaaatgacggaatcgataccaagccctacatggagtttaaagctatgattcgtagtagcaattaacataacaagattttcttaattaacagaggaacttatgacggtacctgtctataagttcgaaaaaatagtcaaacgtagactcttttttatccattaagtcatatacgttgacggtgcaggccgacaggtcgaagagtaaaagcacccagtggaatctgcaatgtgcgtgggatgcattacatatgaaacacttagcaagttcgtacgggaatgaaatttggtatgtaggaagacagtaaaattaaactaactctatgttgtacggcaacagtatgaacgtcttgtaatgctgcgccttcaggagatggacgagattgtcctctgtttcttgtggatattggtcaagcattgtgacgtttactctccgagggtcgatgaatccagtatcgaaaaccctccgccgtcgggccctttgaatctccattctacaacgataaaagggagtatattattttctatagtctacttatatacaaggacctaattaattaaaggagacgtatagtaagaaatctaactgaacgatatacttacaaaatccagcaactcataatagagacgtcgagggcgtccagctggtatagttcgtagattcccctgaaattgatccagagaatgtcatctccttgcaagaagtccgtgtccctgatcctcgctccgatcataagaatgtcatcaataaagaccaccacgaacttgtctaggtattccataaacaccttattcatcaagttcatgaagaaagcaggggcattggtaagtccaaaagacataacagtacattcgaacaacccatatctagtggtaaaagctgtcttaggtatatcttcctctttgattctcaactggtgataccctgatcgaagatctatcttggagaaaacagtggcacctttaagctgatcaaacaaatcatcaattctgggcagcggatacttattcttgatagtcacatcatttagtgcacgatagtccacacacatcctctgggtatggtctttcttttccacaaaaataaccggagctccccatggagatgaactcggtctgatgtatcctttctgaagcaaatcgtctacttgccttttgacttctgccaactcattggctgccattctataaggtctcttatggatcggagttgttcctggtcccaaatctattctgaactctatatcccttttaggcggcataccaggtaaatcatctgggaacacatcgggatactcccggactataggaatctcttccaaagttatttggttcagtcttgaccttaaggactcagaagacaatgcatgaacagttacaactcgaccatcat

SEQ ID NO: 39592 - DNA, 162 bp, Oryza sativa
ctgttattaaaatatctctccccatggagcattattttgctgtatacatggtgtgcatcttcgttgggcactcccttgttgtcctcaccaccattagggtggtaatatagttgatgtaaagcttctggtttagcctatattctgtaatgatggagcatccga

SEQ ID NO: 39593 - DNA, 763 bp, Oryza sativa
cattatgtaaaccgtaaacaagcatgatttatacagaggaaaacagagcgtgctccagcgttagaccgcagttggcctaacatcggggacgctcgcgcgatatatactgtataaagaacatgctctaggtaaacataataaattatagatctgacaatgccgtataatctgaaaataggtacggtaaattatatataaaatattgcgtacctttgtagatatatgccggatatatctacgaaattagtagattaattaggaaattaatcttactaattaccttagaatttgtactgcggctttttggctgtttagttgatctatttgcttttggcttacgtcaccagaatgagcagctcgattgccaactaggaattgaattctagtgcaatcacaggaactcctcaactccgattagactacaagccaatgaacagatcaatgcctcacgccagccgagtttggctactcgggcagccaatgccttacgccagtcgatgtcccacgcgtcgagggattggtgttggatcagtcttagatgccgctgacaccatggccctctgccgtggtgacgtgtcgaagcttggtcgatctcaccggatcgaatagatggtgacgatgattccaatctcgttgggagacgtactctggccgggttgaatcttcctggtcggaagtcgtcaagtagcttgttgttggagaatccatctcttaaacccatctcgtcgaaatcctgaagtaccaaaatccccctacctggcgc

SEQ ID NO: 39594 - DNA, 755 bp, Oryza sativa
tattagtcatgttagttaattaagtaattaattaattgagtagttagcgattaagcagagggacatagtagttgctaggaaaatactgggtttgaaactttgacgcacgcatgcagcgggattggcctggcaaactatgtcctgcagtctgcaactggagtagtagttttcttacatgcaaatgtcaccattgacttgcagcaggagtattactggccaggtgcatctatctgcttacctatctctacagaaccgtaccatattataatgttttgttctctctatctcttgactattgtctagcttaattcactaacatctatataaatttaaatacatatatagatagcatatatacttgagataaagtctattttccttcatcgaactagttcactagatcatacaacccctaaactattttttccctcattatataacctatacaaacggtacacgttactctataatggtatttcttttttttctctccacattgtcatggttatggattgcacatacctaatagtagttgactaaatctcggaaggacccaccacatatcatgtcctatacggaaacaacctgcggatatggagggagttccggataaggaaagacaaccagagttctacatggaaacgacaaggactactcagattgtatccatattggtttcccacgttctacttgtacaaggggacacctatgggtataaatacaagaccccctaggaggagaggggagaaccacca

SEQ ID NO: 39595 - DNA, 167 bp, Oryza sativa
gggttggttttgctttcagagggccttttccatgtcctatttgcattagagatcaattagaattcaataaacctcgagcccaagtaaggaaacatgagaactcttttaattggacttggacttgacgctgggtttgactgccgaaacaccatagttcaccctttagt

SEQ ID NO: 39596 - DNA, 1501 bp, Oryza sativa
cgagccgccgagactggtccggcccatcaaaaccgtctggtgccagcgtggcgggccgtgttccgatgcatcggtcaaactctttccgcttttcttctacgcttccaatggacatggtcttcgtggtctcgtggggaccactgatcggtctctacagtgtctacatgtgtttttgttttttttttttcgtaaggaattttgtttacgtttacctaacgatgtcaacgtagttgtcggctcattttttttctttttcgtcctggactaccattttcatacaagatgcttctgtttgaccggattgttctgtttccaatagactacttttagtcttctagaacagatacgaatttgtatttggcttagcagttggcattagcaaacctatatgtcattgttttatgaggcaggattgctggtcatttttgctactggtattgattaatcagggtagctcaatcgttctttcggaaagcatctgtcttatgttctcaactcaccccttccgtttcgtgttaatagtatgttttgtaaaaacaattataacaaaattgctttaaaaatcatattaattctttttaatcatgcgttactctatcacaccactttgcgtgtagagggatggttcccaacctcctcaagaagaacacaggctaactaatagaataataatgcaaatgctaattttcaaccgaaatagtactatagtctacagtcatcgtctggcgtgagcatgccatgaacttcacaccccaaaatgttgtacaacatacgcaatccgcttcaaagaaaaaaaaagaacaaaatgatgatgtgatagtagtagaagattgcccatattctcatttttatagcattttagtatgtcacaaaacgacattcgctaatagaaacaaagaaacaaccataccgactacttccttcatccaaaaataagtaagtatttttagcatatatcaagtcaaatatttataattgtgactattaatagcaaaaaaaataaaaaaatcaataatgtaattgatggtaatttatcattaaataaactataacaatatacaactctttttatttaaaacattttactttttatttaaaatattttacttttatatagatattattgatcaaactagtatctcgaagactgtgtcaaagttaaaaatagaggagtatgacaaacgcaaacagagtatagcagcaactgccagcgttctccaggagcatgcattcgacatcataatccaaaattatcttacaagaacacaagcaccatcttccaagcacaggcacatcgacaattcgacatttcagcagaagtgaaaagcagctcaagataataccagctgcagtagcaatttcagacttcagaatgccaagatcgagcagagcatcatttcagaaatcagaaaaaatgcagcaggcagagttgttcagaattcagaaaagaagatcaatgaggaggaggatgatgatgagctagcagctgagacgaccatct

SEQ ID NO: 39597 - DNA, 1011 bp, Oryza sativa
ctgacagctagctagtacccagcatgcctaagtcatgcctttgatactagcctagctagtaaataaaactggaggtactactagcttgttgtgcatgccaaatccctgtaatagctacctacgttacctagatacggggatacggatatggatacacgatacgtcgatacgggatacggcattttccaaaaaaacaaggatacggggatacgcttttatatatatatatatatatatatatatatatatatatatatatatatatatatatatatatagtaaatttgtttggtgctccatggtgcccgggcaccattgttgaaattgagtatatacccaattcaaatgagtatgaaacttttttaattatttaggtattaacattaactacttttactaactagttcaaagcaagtttgaactgaatttgaacttatttttgttagattttgattctaggtatatagcatccatacatataattagttaggtatgtaatcatggattgtgaaataaagttaaatttgagttgttttgttgataggtataggtacgaatcaaattcttataactaggtatatactcacaattagaaaattttgaaaaatttgagtgattttgtgcatttgaaaccatggtgcccgggcaccatggtgccccatatgagtgtcctatatatatatatatatatatatacacaaaaaaaattaaggaaattgcatttatatataaaaaaaatacaaaaaatcaaggaacttttataaagaaatagcgatataatactagtatcagtgtagcagattccatatcaatattctgcaattttctcttctataagcaattcaaattaacaagcgattaagatcccaaaaaccacatattaatagttcaatcatatatttcttgatgactttgcatcaacattagaagccgcactaagcagtaacctctaggattgctagatgcactagcacttgtatctaataaaaacgatagtactttgtcctaagg

SEQ ID NO: 39598 - DNA, 1501 bp, Oryza sativa
gagatgctacagtcagtagggtatgaaagatttgattggaatgaaaggtttcttgaaaggttaaatgttagtcttctgtttttgcgtgcaaggtatacttaggatttcagcttattgaagaaccaaaacttcatcatgaaagcaatatttttttagctttgtaaatcctaattgtagcaacagaaaaatgcactctatacgagagtatagaagatatttgcttcaaaacaatcttgatcacatatgaattcattttatcttttaaagtcactgattccttagcttagtagcccgttcatacccaggctaagatttaaagtggattttagtgcagaacatactaacataagacagccccactgactatttgcatagatacacattgttgatgtgttcctgcgtatttctgcctactgcaatcctttgtttttctcaccgggccggcctacttccatctccacttgggcatgttcttttacattgctgatttatcactttatttttgtactttgattatagtgaacttcatgattgctggcgtacttttaccatcatgttctcccatacaacttagactgcgcagggtgcaatgctacgattgattttcttttttaccttttgaatttaattgtacaatgaattggatgaatgcccaaaaagcaattggaagttttctgcagccagtcttagttttagcacgattagatgtgagctcatgaaaatttcgtcttttgtgatctcaactgctcaaggttcttttgctgccttttctttggactcaactttgactaagttctttgagctactgatgggcattgatgtttttcttggtgcaggatacttgataatgtaacctaaaaaagcaggatggacaatgaaactgaaagaagcaaagttgtgatgatgagatgagttaaactactggctgataacaaagttgcagtaatttctatgatccccctcatgctcctactctgtctttatatctctttatttgttttttttttcctttgcaactgtgcccttgctttggaacaaaactttgataaccatttaacacaatcgtcaaagcagaaggaaagcttatttgcaattcccttttggaactaatgacatctgtttaagtaacaacgaccaacctcaaaacttctgctgcaacattgtgtactttgttgctagactggatgaacatctagctgatgttctgttttagcattgctttacttgagacttgagagagcctgctaccagtttcacttaaccattcgtgtttatcttcccaggatttaatatgctggaattaggaagtctgaacaacattttgtggaggctactttattaaactgcggtgctgctctgtccaaacttgcgctaactgcgggagagaaggggggctagcgtgaaaagaagaggtaaagaaagagaaaggcaaaggcgcgacatgatgcctcgtccaagctttttgttgtcacgctgccaaagaggacaaggatttggccct

SEQ ID NO: 39599 - DNA, 1501 bp, Oryza sativa
gtaaaatattttaaataaaaagtaaaatgttttaaataaaaagagttgtatattgttatagtttatttaatgataaattaccatcaattacattattgatttttttattttttttgctattaatagtcacaattataaatatttgacttgatatatgctaaaaatacttacttatttttggatgaaggaagtagtcggtatggttgtttctttgtttctattagcgaatgtcgttttgtgacatactaaaatgctataaaaatgagaatatgggcaatcttctactactatcacatcatcattttgttctttttttttctttgaagcggattgcgtatgttgtacaacattttggggtgtgaagttcatggcatgctcacgccagacgatgactgtagactatagtactatttcggttgaaaattagcatttgcattattattctattagttagcctgtgttcttcttgaggaggttgggaaccatccctctacacgcaaagtggtgtgatagagtaacgcatgattaaaaagaattaatatgatttttaaagcaattttgttataattgtttttacaaaacatactattaacacgaaacggaaggggtgagttgagaacataagacagatgctttccgaaagaacgattgagctaccctgattaatcaataccagtagcaaaaatgaccagcaatcctgcctcataaaacaatgacatataggtttgctaatgccaactgctaagccaaatacaaattcgtatctgttctagaagactaaaagtagtctattggaaacagaacaatccggtcaaacagaagcatcttgtatgaaaatggtagtccaggacgaaaaagaaaaaaaatgagccgacaactacgttgacatcgttaggtaaacgtaaacaaaattccttacgaaaaaaaaaaaacaaaaacacatgtagacactgtagagaccgatcagtggtccccacgagaccacgaagaccatgtccattggaagcgtagaagaaaagcggaaagagtttgaccgatgcatcggaacacggcccgccacgctggcaccagacggttttgatgggccggaccagtctcggcggctcggcccaccaccacccatccatccatccatccatcgcggcgcatcgtacggtccagagctaacccagcggcgggtccaaacccgcgtgcggcgcggcgcgtcaccatccaccgtttattcgcagctcgttttatcactacttaaccctttcttcgagatttcccttttcttggaggcgccacgtttaaagggcggagtcgctgtaattagagaagaggatttaaagagagagaaggccattctctcttgattgcttggagaggaagaagaacaagagccgccaccgccgccgttaggtttttatttattttttttctcgatctgatccgaggaggagcgaagcgaagaagggcaagatgcattcgacgaatctgctgctggaggagcccatcagga

SEQ ID NO: 39600 - DNA, 332 bp, Oryza sativa
ataaatttaaaaatgaaaaaatccacgttttccaggcttaaaatggccgtgtcgaattaggctcacatttcggtacggcccatttgtccattcggcccatgtccaacacgccccacggccctctaaaactcacgtgctaaaaatagcccaattcgaaaatttccccacggcgtcgtcgcctccgccggcgaggtgggagatgaatctctccgctaccttccgatcggcgaagatccctcgcgctcttcctcccaaatccggcgagcccgccgccgccgccttggcctcggcctcgtgcgcgcccgggaatccgtcggcggaggccgcgaagg

SEQ ID NO: 39601 - DNA, 1501 bp, Oryza sativa
ttccttttaggattatcatagcaaaactaaactatattagctgagttgatatgtatcgtgaggtacggaccattctggatagctatcaaaatgtgccttactaattgatcctctactcaataatgtttggctaaattttggattgaagccaattcttttatcaaatcaatattgatgtcctacgaaattattgataataccaataaatataattggatagtaaagaaccaaaatgaccattttattgaactgaataaactttaaagtcattgaaagtttctccatacctcattgttctagaaatattgcataacataacacctccccgttaacactaataatgcatttacctttcaagacggtagaaacctccaattaattttagaatgaatgggcacattatgggtggttgaatcctaacgccaacgtcattggcccccaacaagtgtaataaatgatatttctattaagctacatcatcacctccattattatttttaacctagcatgattaatctacaactaaatcattttccttctcatttcacattatcacactgtcacgggcttgggccctaagtgggctggccatgaagacccaccaggctggaaggttaacctgctactccctccatccctaaatgtttgacgccgttgaccattttaaatatatttgaccgttcgttgtcagggttatgtatactacatacctaatagtagttgactaaatctcggcaggacgcaccacataccatgtcctatatagaaacaatctgcggatataggaggagttccggataaggaaagacaaccagagttctacatgaaaacgacaaggactactcggattgtatccatattggtttccctagttctacttggacaaggggacacctatgggtataaatacaagcccccctaggaggacagggggacaaccatgatgagacgatcaacacgatcaacacccaccatgacgagacaatcaacacccaacacaatcgacatagaagccacaacatacaagccaacatactccaagacaagacgccggatatcgacttcagggataggcatggctattcccctacggtgtctccggataccgtcaggagagacgaaagcgctatctctgatctcgccgggcacagattcgaggaggaaggctaccctgttgtcgattacgagtcagatcttcagaccgacatgtcgataacagttagataggctaccccacatattgtattggtgtgattatggtgaataaaagcaactccggctccagccaacaggatgtagggttattacctgacagctcaggggcccgaacctgtataaaaatactcgtctccatctcttttacctcagtcttgtgtatatcctagcaccaacgttccccatactgtccaaataccatagtcgagacatcaaacgtcgacagtggcgcgccaggtagggggattttggtgctctaggatttcaacgagatgggttcaaaaga

SEQ ID NO: 39602 - DNA, 1501 bp, Oryza sativa
ggatgtttggtccgacaatatcccgcggcaatataatatcctgttttggtttgttatagcactactaaaatattggttcgataaagttgatgggtatagaattggctgcacctgtggtacagctaacatgaacaataatctgtgttagcaatacagttctgcagtgctaatattgataatgtcaaatttatagcggaatgtttggtttgctaaacgcaacacaaatttgggtaggaaagagaattaaaacaacccttacctttttcctttaaaaatatataaatagtattattaaaattaaggggacgggacggctcgtagtatacaatcaagacgccgatattaggaaaagacttaatatgaaataattagaaggggtgaggttttaaacccatatcgtctagcccactaccttgtggagctagctagaaaacccctaagcatttatgattctccttatctcttcatcctcgtcccgctcctcatcccatagataccgcgtagtttcatctcgcgtgttccaccctgctcactccgtttgtgcgcgttgcgccatcccaccgtgtgctctagatcctcacgtttgcgttgcacaccccacgcgtcagggtggaaccagctcatagccaccttcaactaaccattgttgaacacatagtaaaaaaaaaatctaatctctatgatacatggtgttgttttaagaatgtttggtttgctaaacccaacacaaattatgggtaggaaagagaattaaaacaagccttacctttttcctttaaaaatatataaatagtagtatcaaaatttaggggacaggatggctcgcagtatacaatcaagaagctaatattagggaaagacctaatataaaataattagagggggtgaggctttaaatccatgtcgtctagcctattactttgtggagctagccgaaaaacccctagacatttatgattctccttatctcccgaggatgaagaaatcgggccagaacatcattagagttctgaattgctaaatttgcaaagaatgaagaatgtgcatcgaaaataataacatattaagactgtggtagtattactagcacggcaattgttcgatagttttcttctaaactgacacgatgatgcccaatcacaccggaccatctcgtgggctcgtggcaaatgttcaaaccggcccggttggatgcagcattaggccgacatgtaaaagctctgtatgcttgtagcccacaacaaaaactcctcgattacgagcttacggctaactccattcggccgtggacacaacggaggcctctacaagaatccaagacgcaaatgctcaaatggcctaatgaacaaagaaagggacaaatggcctggtgaccgagacaatcaggcagaacacaggagaaatacccaagaatcccttctctagaacagatcaacgccatcaaatatactccacacttccacagatcgacacgcatggatgccggattcgacactctttg

SEQ ID NO: 39603 - DNA, 975 bp, Oryza sativa
tcaacggtaataataataaacagaggctagcttgcctcttgtcttgtgctatacaaagctctcagcgaaagtcggttgaattgtggcatcattctcaaattctgatgtaccttgtgcacgcgaaagatgacagattttgcagcttgaacgaatcatgcgttttcccttttttgacttcattggagaatactacacactagttcagatttagtgttccatttatttctaggtttagggttccattcatttctaggttgattcttcatgcgacagaaatagtagtttgtataaagattataggagcccttgtttaattcctaactttttctttaaacttctaacttttttatcacatcaaaacttttctatacacataaatttttaacttttttcttcaaacttccaattttagtcaaactttcaattttagcgtaaaactaaacacacctaagtaaatgatttctgaacacgccagcctgatgtaacgcccgaaacacgttttgttccttgtcatttttctgtgaccttgatcagcatcttagaaaaaaaatcatttattccacatgccatggaattttatctgagaaggttgaaataaggggaaaaaacccaaatgctttgtcgcttagctatcgccattcgccaggcagtaaccagcacggtttatttgtgaaacagctgcaaagaaccgttctaactacatgctgttactgttgatttagcgcgttttgcctgtataaattttggtttaaatttcgcagatcttacagttacaggctggagccccacgttcttttcccaatttcaaacgccgtttttttttcaatttaagctaaatataagtagagatcagtgtcatgagagagctggctaaatcatatttccaaagtctctctcgtctctcccgcgtcgcgagcaaaccttccccccaccaccgcggcatggccggcgagatgcctgacgccgacggcaagc

SEQ ID NO: 39604 - DNA, 153 bp, Oryza sativa
tcctgcagccccagacaaaacacacatcaagcttagcaagctaccactaggtgcttcttcgatcaattcttgtataaggagctactgtgtggtgttcgattaattctcacctcggaaacctcgtcgccattgccggtggcgccatcctgaagc

SEQ ID NO: 39605 - DNA, 1501 bp, Oryza sativa
ttttctcctccatttcaggatgctagttgctgcaaaattccaaccatatccagcgcatcctcctctggctagcaagctagctcagatgttacatccgtgaaacggctctttgtggaaacgtttttagactttctagtgaaagaggactagaggagtgttctgttttcagggatcagacaaatccaagattagtaaggattgacaataagcgtaccgtttgccattctgttctttgttttatctttcctttttcttgcgttggacaacgcatccctctatcactgaatattctttccttgcacacagatacacagtagtaggtttttggtagggtcggaaagtctcataatagaaaattatcaatgaattaactatgtttaatagtcctacaatttgatataataggatgttttttattttctaagtcaaactttttaacttgatttaatctattaagaaaatatagcaacatatataatatcaaattatttcaactaaatatgccattggttatatttgtatagttttttcttgaatactataaaactatatccaacaacgaattttattaaactaatatggcattgttgatgttgttacgattttttagaaatgggacaattttttaaaaataacttataacaaacaaaaaaaacacttgtagtataaaaattggatgaagtaaggtcattgtctacggctgattataagatataacggcatattagcgataaaaaataatttatagaactttttttactatatcctttgtgacttaaaaactaattacaatgcttgaaaaaaaaactatgttgaaaaaattatcaaaatttaaaatttaaaatttagcattgctttatatgtcacagatcaaaggaagcttttaaatcaaaagtatgctaccaccctaatctgtatttactactatggcctggtttagttcccaactttttctttaaacttttaacttttctatcacatcaaaacttttctacacacattaacttttaatttttttcttccaacttctaattttagtccatggaaggcatatgttcaagacgaaattggcagtttgtttgcctgtgttggcacctacacaagtgtgaaccaacaaatctactcgtgttttgtaaccacgcggccgactaacaaccttagctagtgcatgggtgtgggcctgcctgcttacttccatcttgaattaccaatattaatcaccttctgtggtctgctgttaattaactaacctcagacgacgtctcgttaatctgagttgctatagctttacgaaaggccacacctcggattataaatactacccagctcatggcaccaccacactcttcagtctcacacaaacccaaaaacccaaagcttagccaagctactagctagctcctcacttcttccagcttcttacactaatacagctcgagccacttcgtcttctcctctcttgcagcatagtttaagtttgagataggattggcgatagata

SEQ ID NO: 39606 - DNA, 218 bp, Oryza sativa
ttcctgcctgcctgtgacctttgtctgcctctgaacaaattttatattactccatgaccatacaaccttcctagtagctcactcactgaagaacagctactactactagtactgtagtatttgtttttctttaaatttctccaagacaaccaatgcgttcgatctgtcaccctgtctacagtgctagctaagattatgggctttatttttttttaagt

SEQ ID NO: 39607 - DNA, 1501 bp, Oryza sativa
tggtaactctgtccatgcattgacatggagggattaggattaggatgcattaggaacccggcaagaatagtgaaagtgatgacaacccaagctcgtgtatcagtattatctcacagatacataccatgctgtaaaccactccactacataccatggtgagggatcatactatcagataacactcgttactttggcatgtagatcaggatgttcagtagctcccagaagtcagcagcaaaagaggcattatcatgtgtttctatcttctctgcttttctgcttttggaacctctcgaaccaccgtcatggtgtggtttccagaaatgaaccactatcattacatcgccttttggtgaagtgtataaggatgctactctgggctgaacgacttcgagaatagacttgtaatttcagcttggaaggatctcctcttttcctcctttcgttctctaaatctgtaacgatcttgtaatgatcttgtacttctaggcacccttttatcaatgaaatacaggtggggaaactctcccctcctaatgacatattctaaaaaaaatgttagatcaggatactaagtcttccttttaggattatcatagcaaaactaaactatattagctgagttgatatgtatcgtgaggtacggaccattctggatagctatcaaaatgtgccttactaattgatcctctactcaataatgtttggctaaattttggattgaagccaattcttttatcaaatcaatattgatgtcctacgaaattattgataataccaataaatataattggatagtaaagaaccaaaatgaccattttattgaactgaataaactttaaagtcattgaaagtttctccatacctcattgttctagaaatattgcataacataacacctccccgttaacactaataatgcatttacctttcaagacggtagaaacctccaattaattttagaatgaatgggcacattatgggtggttgaatcctaacgccaacgtcattggcccccaacaagtgtaataaatgatatttctattaagctacatcatcacctccattattatttttaacctagcatgattaatctacaactaaatcattttccttctcatttcacattatcacactgtcacgggcttgggccctaagtgggctggccatgaagacccaccaggctggaaggttaacctgctactccctccatccctaaatgtttgacgccgttgaccattttaaatatatttgaccgttcgttgtcagggttatgtatactacatacctaatagtagttgactaaatctcggcaggacgcaccacataccatgtcctatatagaaacaacctgcggatataggaggagttccggataaggaaagacaaccagagttctacatggaaacgacaaggactactcggattgtatccatattggtttccctagttctacttggacaaggggacacctatgggtataaatacaagcccccctagg

SEQ ID NO: 39608 - DNA, 1501 bp, Oryza sativa
cacagtggggtttcatttgcataaacagcatttaataaacatttcagaatttaataaaacagttaagtaataattaaacaatattaatccaacactatacaacataccctgttgcataggcccaaccattctgaacaaccatcccggctgcacagttctatctccaaaccaagaatataccgttccaaaccaggagctaatcaaattattaccagttatagcatcttttattatgatgagaagtgtgagactaatcacgaaagacattgttagacccgcccataaccgcgggcacggcttttcgaatagttttactctggccagaggtgtaccactgtactcacaagacacagccccacaacatgtcactatgtgccttaataccaccacggtacctcggaaaggagctatgacagtacccctcgcacaacacgatccaccacagcgcacctttcctggatcataatcaatcaccccttataaacaaggcatggactccccagtgacccccgtgggcttatctccgccacttctcagtctggtgctccgcaatgaaccatgctatacaaaaggtaaagccgttgcccacgctggcttgtggttggcacggttaatgtttcacaaccaaaactcgtgaaccggtccttaattgtcatgagcacgactctcaaaaccatgtgctcacaacccaccattatcaagttttagttggcaagtaattaattaaccaatcacgattgaccatcgtgaactatcattaagccatcattaagtaatagtgaatcataagttatcccaatagtgtgctaatgtttctaagcatggctaagcaatcatatctaatatctagctgaaccaatatataaagctcaactagtcaagttataataacccaaggtatcaaggaataaagtaatcaagaacaaaagggctataacaaacaataggttaattccacccaatgacattcgaaaataaatgcaattgttgaatagaaacaatagctttaaacgggatcaacatgctcaaagggttctttgggatctgtgtgacttgccttgctggccttggaactcttcaaaatcttctcctgcaaaaatggactctccggaaacgtcggaatctaaacagaaaggagcaaaatcaccaaaacagcacataaacaagcatgaacagtacatgtggatatttttaacatgtagatctcaattttagaaaaatttagagacttgaaccaactaaatccgagctaagatgaattagttatgaatttttaaagattaaatcggattaaatcacttatatggattttaattgaattatgacgcaataatgaattattttttaaaaggaaaagggaattattgcgtcagcggctagggttcgcggtgaaccgggtgcacggcggcggctcacgaaaacgaacggctgagatctttccatccaaaacgaacggccgagatcgaccggtccacagccggaccacggaagacgacgacga

SEQ ID NO: 39609 - DNA, 1474 bp, Oryza sativa
ctgctggctaaattgcagcaagcgatcaatatcatctacatcaagcagtaggcagaggccatcttcaattgtgattctagcagccagcattggttcttggtcaagtgtttttgaagcagatttttcagtaacgtcatcacttgattcagaggtttgttcaacatcgaggagcggacgaggcctgcggatggaagaaaatggtaaccttccaagagcatcaacctggagatacgcatgtggctcatctttactccgtgcacgggatgatggatctctaatcaaggtcggacagaagtggtgcttgagttgacctcctgctgactttttagctaaacaggcttgatgatagtaatcatcaatgtacggatcattgatctgagtagcagcttgctgcatccttgcaatgttctcaatttcaggcgtggacatgtacttggatctgaaccgcggccacccattatccatcctcataccagcaagctcaaaaccttgggggagataatgctggccatgcactccatggtgcagcattgctcttgctctcggatcactcaagtcaggcattgccaaatttgcatcaaatccactcatcatttgtgatggacgctgaggattgtacatctgacaaccttttggtggaggatgccgaggaccaagcatctgagcatggaactgtgagaattgtggcggagagtgttgaattggggccattccatgttgtggatggcgtgacagcatttgaggtgggaccaatccatttggacgctgcagattgtgctgcaccaaacctggtgtaagcatggcaccatttggacgaactggcccactgtttagagcattctgttgcaaattattagttgataaacctgctgaatccaaatgagccatgctccgaccaagtggccctggaggcataccaccacgaggaaactggggatggtgtaactcattttgtgcagatacaggcatttggaatgaagtgggaggagatggcatgttcatgttatgtggttgacctggcgaagaatgggatactgcaccagatggagggtacggaatgaatgatgatttaggtaccggaattggttctgtgtgactgtattgaggctcttgttgtgggtatgatgaagttctatgcaacagagatggcattgctccaagaatatgttcattaggattgtattgagcatcttgctgcggcgatgaggatgttctgtgcagtctagaatcagcaaagcgggctaaatgaggtggttgagaccaccggctttcattattcagccctggttcagctccaaatataggctgtgtaggccaatatgaatcttgtgcccagtccagagtagaacctacacaaattgaattcattaacattagaatacaatgttaataaatcagaaaccatatataagggcccctttgaatcgtaggaatgaaaaaacagaggattctggcaggaatacaattgtaaaac

SEQ ID NO: 39610 - DNA, 592 bp, Oryza sativa
cgccctagctagccgccggcagcaccgcagcactgcaggtctgcaacggcacggcggcagcgcccagcgggcagccggagtactactactacagcctacaggcaaccagcaacctgcagccgagcaagcaaactgcattgcacaagcagtcaagcacaagcaagagactaaagagtaaaagataggtacttatttttcttttaactagttccagagaatttcaatttatcatctattctagttctagtcttatttttaatcctattatttgatttctaacttgttaatagcaccttttcaattatccagatttaatgatttatataagctagggaagaactgaaagtttctctggaagggacaaggacatctgttgtcctgtagtcatcagtccatcaaggcatcaaccatcacttagtaaaattgtaagcatactgtgacaccatcataattgctaaataatttgtcttttgggggtgtacattattctattgtgcagtgcacttatagtctaacataataaaactatttaattgacaggttatagacaagtaccttgaggaaagcgctcgatagttccaataatgcagct

SEQ ID NO: 39611 - DNA, 504 bp, Oryza sativa
aactctaagaaattgcctttgttgtatgaatcacttgattcatcatggccccgaaaaggcaaacctagcttaacaacctcctagcaacattaattgatccatttaatcgaacaaaatatgcatttttagtagcttcgctttgcacttgcatatgtatatcgatgtgttgggctctttgcaacaaagcatcacaatttttcatggcttgattatgtaagctaccaacaccactaacatgctcttttagcctactttttctatgccaaccattccaaccatcaaccacaaaggctttatacccatcctctttcttattgcgatctctaaaacaacattctctgtcttttgccttgtatattcaagccaacttccaaattcatcaaaccattcctcaataaactttctgtctttacctgagatctttgtaaccggaaaagtgaatagacatggttggcaaggccctttctgcaagtatttccttctgactatatccctcttactagg

SEQ ID NO: 39612 - DNA, 1501 bp, Oryza sativa
tgtctcatctaataccaaattattatattttagattggagatagtaggaaatatcaacaaatatgctggttgtgtttgagattgattaaaaagaagatgaagtcacagcaagcaaaacgagaaagacattagcatatgattaattgagttttaattattacaaactaaaaaatagatttatttgatattatatatatataaacaccgtttattagttttaaaatcatgctaacaacaaccgagaataaatctatttctgagcggttacgtgtttgtaacttgaaagactaagctcggaatatgaatcgtatcattgttaacaatgatagagaaagactacacaacggtataccgttgaacagtataccacttatccctcatgccgcggccccgcgtgccggcttctcccgagtatgtcgtgtgctgctagaattatcatcacgcaggtttgttgtggtatcaaggtatagtcttgttcctgacagctagctagtacccagcatgcctaagtcatgcctttgatactagcctagctagtaaataaaactggaggtactactagcttgttgtgcatgccaaatccctgtaatagctacctacgttacctagatacggggatacggatatggatacacgatacgtcgatacgggatacggcattttccaaaaaaacaaggatacggggatacgcttttatatatatatatatatatatatatatatatatatatatatatatatatatatatatatatagtaaatttgtttggtgctccatggtgcccgggcaccattgttgaaattgagtatatacccaattcaaatgagtatgaaacttttttaattatttaggtattaacattaactacttttactaactagttcaaagcaagtttgaactgaatttgaacttatttttgttagattttgattctaggtatatagcatccatacatataattagttaggtatgtaatcatggattgtgaaataaagttaaatttgagttgttttgttgataggtataggtacgaatcaaattcttataactaggtatatactcacaattagaaaattttgaaaaatttgagtgattttgtgcatttgaaaccatggtgcccgggcaccatggtgccccatatgagtgtcctatatatatatatatatatatatatatatatatatacacaaaaaaaattaaggaaattgcatttatatataaaaaaaatacaaaaaatcaaggaacttttataaagaaatagcgatataatactagtatcagtgtagcagattccatatcaatattctgcaattttctcttctataagcaattcaaattaacaagcgattaagatcccaaaaaccacatattaatagttcaatcatatatttcttgatgactttgcatcaacattagaagccgcactaagcagtaacctctaggattgctagatgcactagcacttgtatctaataaaaacgatagtactttgtcctaagg

SEQ ID NO: 39613 - DNA, 835 bp, Oryza sativa
tttttgagttccagattctatgtagtagtatggtgtcatgaatttttgtaatcaaaacaaacgactgaagtcgttgttcttgcagttaattttatagccaccttgttagacagtgattagggtctaaagaatcatgcaagtgacctgactcactgaaccatcccacttaactagatctttcgttcactttcaatacactgccttgcattactataaaaagaaaataattaggtgcagtggtgatttctttaccaatctgaaaaaaattacccgactgcccttatgtaatgtctgtattgtagacttgtagtagtactagtcttctatatcatattttgttgtaggagtatatacatatcacaagctgttgatccagaagaacagcgtttaaatggtaaacactaaagtgctaaaccaaggaagttttggaaatctaggattcatgctctccttacacttaggggaagtggctattggtactcagatccattgtagtcataggaggataatccatgcccttttggctgcatttcaagtcaagtttgcagaatctgtaatcatgtcaaagcaggaagtgataaactgattgattaatagaaatcttcttcttcgacctagaatgagtttttgcacacccgtgggtctggctaaaccagagactaaacctggccacctaagtaccagttttttgtgcacttaataaaaatccccattttttttactggtgtggccctgacaccctgtcatctcttgcactgctccactaggatgggaaccccccactgataaatcagatgcaactaaaactacttccggcattttagggttttaggga

SEQ ID NO: 39614 - DNA, 1501 bp, Oryza sativa
gggatgaggaggggccagcattccgatgcgcggcctcgaccaaaactgaccgcctcctgtacggttctttagtgctcaactgcgcaacgtcaagcatatcgtaccagactactactcctcctcctacctatagaagcagcatttttcaaatcaaatcaagcgaaaaagtacttgaggaacgcagggcttgccgttactctaatggaccactagtattttcgtggagcatttgagaaagtttagaagtaaataccgctataatatggccctgtttagtttccacacaataaatttataccctatcacatcgaacatttaacacatgtatgaagtattaaatataggctaaaagaataactaattgcacagattatgatcaatttgcaagacgaatcttttaagcctaattgcttcatgatttgataatgtgttgctacagtaaacatttgctaatgactgattaattaggtttaataaattcttatcatcgtttactgacggattctgtgattagtttttttattagtgaccgaacatcccatacgacaccctatataatactcgatatgtcacgccaaaactttacgcccctgatctaaacacccctatcttcgtcgtaaaatatcttaatctagtaccgtgtctgttcagatttgtactgtatctaatatgttacgtctcatgctagattaatttattctgagacggacggagatagtagttgccattaccatctttttcctaaaaattagtttatttttcacacatctcacatatatcaatacaaaaccacattgattaaaatacctctactttatcaaattgcaataccataatttctcattttatctactctcaatataattatattctattttgcacaaactcctatgcaataattaatttgaaaataaaacttattttatgacaaatgaaggatgctacaaataaacttaatatgagactgcgcaagtagtgttgtcgtaatagctttttttactctccctctctctctttgtgaacttaatactccctccatctcaaaatgtttgacgccgttgacttttttaaaaatatttgaccgttcgccttattcaaaaaatttaagtaagtattaattattttcctatcatttgatttattattaaatatacttatatatatatatatatatttacacatttcacaaaaaaaaatttaataagatgagcggtcaaatatgtttaaaaaagtcaacatagtcaaacatttagggaataagggagtatatctatcttgcttcttgcagtattgtataggagtagaacaatctcttagtatatggtactgtagtcaatactttataattttttaaaattctcttctctacatagcattatagttagcttataatagctcactactacgcctacgttatccttgcgtttactataataaacccgtctactctatactctggtctcgtctctcatgtgcacgatgaatatagtaggattattat

SEQ ID NO: 39615 - DNA, 1501 bp, Oryza sativa
atttggtgatgtgaatttgggatgttagttagatttggggattgatttagggatttgcctacttgattcgggagaaaataaaaatgaaaaaagaaaaagaaaaaggaaccatctgcactgccgctattgtctctttagtcctggttggtaacatcaaccgggactaaagatccctctctttagggaataaagatgtatctttagtcccggttatttcaaccgggactaaagatggacatctttagtcccggatccttactcccggttggaaaaccgggattaaaggggggttcccaaccggaagtaaagatggtttctccaccagtgtcccaaggtgatcttaggtgatcaagagatgcttggagaccccctacaacattcttttatgcggatttgaagctcgaaggtcaataggatagtttaatttttgaaattgagtcttagaaaaaaccgtactattaagaggggttctaagtgtggttctgagatataaaaagtgctcttagtggattcttagtgatagaatatttttgggagccatttttgcaaatgggtccagaccggacagagaaggctggccagaagttccggtccctgacattgcattgaatgaaacttgcctaagtgttggccggaagttccgagggtcaggaacttccggacttcttccagttcaaaaatgtgagtaacggctagacgtcacctagccattatatatatccagatcgcacccagctcactttttggctattccacttcagttctttcatcccctaggttgttctagcctctcccaagatccctttgcttcctccactcaaatctaaagccattcttgtgagattgagagaatagatgagagtgtaggagtgatttggagaaggtttgaagactaggtatggttgagtactttggatatcttgtgggttgtcacttgggcttattactcttgaagatcttctcctagacggataggtgttgcccgcgagcttccaaaatcttgtggatgtcccgggaaagttggtgaaggttttcctcacctccgcaaggaaacgaggtaagtgagtaaagattcttgtgcaaagatttcagaggttctccttggtagaacaacttgcacttgtggtattttctagaagtatttgtgagttggatcttggtggtcattcaaattctagaaaatgacctaggagtgttttgtttaaggccttggacttcttctgggttctttgcacaggtgaggcagggggttaatcgagacccggctctttggagcatctcaacggagagtagaattgaaagatccgaacttcgggaaaaaattccccttgtcttctctgtgatgattctgtgcatgctgctgtgattgtgtatctgctctgtcttcctgtagtttaattcatgcaaattagtttaagtctctgctagatcttcaggtttttctttgctcggaagttccggacaatctgagcagactggaagttccggtattccacacccg

SEQ ID NO: 39616 - DNA, 1501 bp, Oryza sativa
cagggatcaaggattttgtctgcatcacggctgtacattgatgaatccaattgcactagtccatgtctctctaaagtcaggccatgaaatgccatcacgcttgagaatctagcaacttttgctttgctagctatctatccagtccagggtacgtggagtagttggttggcctttctatcatcttttaattcgctgccatgacggttgaggtagacagcattctatctgcacctgcattattgttgatccctttctcgtcgtttttttggttttgttttgttagagcaggtaaaacagcaaactataaatcagatataaccacatatcaaaaagaaaaaagaagagagagaagaaagcaggctacagatttgtagccggctgcaacacagacttcaaaacgttatgtgtgtatgagaggtaggaccgggcattaatggtgtagtatatttttataattaactattataagaatagactattagattagctatagatgatttggagtcagtagctggctatactattaaacttgctcttatctttctatctttttgaccttttagcagccagttgaagctagacatgttcacccataagcatgtgaaaatggaaataataaattaaacaataggactaatgtaaaggtgtccaattataaaatgatatgcaaaatcatctaagtttccgtaaccgcagccaccttggaagaatcgtggactaggaatagagtatttgtctgatttggactttggaaactatgggcacatataccgttccacgcatagttcccccgagatgatcgcataagatgcatcgtccaagtatgaatcaagaacaaactaattagagccattttggtttgaagttaaaatacacccctaccaaattattggcactttaaatagtattttggttagtgtttggttttgctactaaaatgtgacaataacatatataacttgccaaaacttgggccataacaaaagtttgcttaggttttggcatggtggcaaaccatgcaaattctaaggaatcacattaaagaggcttagtgctccctgaaaaggtgctcacttcattctattttacctgttgttttaggacatgttatatacgttaatttgatcattgtctttttgactatatattcaataaatattatataactgcatgaaaatatctttattgataaatctttttttaatgaacgcaaaagatttgcttccattaagcaaagacaaaaaaaacagtcttctgataaattatgtcatgtctttttcacatattaatttttaaagtaaatttcacaaaactacagatatttgactaaattatcacaaaactatagatttaaggtgatttatcacaaaactacagatttaacaataaatttatcagaaaactatagattttaggctaagtatcgctaaactatggatttactaatgaaattatcacaaaactatatattttgggttcaaatccttagcactaatgctat

SEQ ID NO: 39617 - DNA, 1501 bp, Oryza sativa
tctggctccgtgtactgtcgtcttctggatgggttgccctctctccctcgtggcagctggttctaggactggtggccgtcctccagggcctatttacctgagcatctccgcgctagcttcgactccctggtgctccttgtctcttggcagctgtggaatgaacggaactctaaggttttcgactttgcactattttcagtcaccgtggttctggagtccatccactcggagggtcatatgtggtctttagctggtgtagccgctttttgggacttgttaggagtgtagcgtggctcagcccttcccgctacttggagtttgtgtttagccgccgtagttttctagcttcagttttttatttcgctttttctcccttcccttggcataaactggtctggttaattgcgttgtgtaactataacttttttcttctaatatattaacgtgcaatcttttcgcacgttcgcgaaaaaaaaactgtaaatacgagcattgcatcggtatactctcgatatttgagaatcggtacctatttaaacatttcgaagacaatctaaaactgcacccttcgaggaagaaaaaggcatcaaagtaaaagaagaacattttattacttggcgaatggggatgtgtgctgaacaagtaaaatatctgcccaagaggccaaaatggccgttgagcgttttcctggcttgcgtgttgttcacaataaatcgcaataaatcaaataaaaataaaactgcacacgatgcatcatccgtcaccatcttcacacctcactaattcattacatgcgtttgtttttctctttttatcatcaatatagctaaccggtctccgtgcacacaatattttctctagaaatttctaggttccgtttcttgtaatctcacatccattaattccataaatccccaattgtccatatatactagcaacagaaagttcagacttttgtttcagaaaaggccataaagttactcattttaatttctccagggaaagaaaaagtaacaaagctctaacttcccgtgtcaaatatgtgcaccaatacccacagattatacaagacatgattagcaccggtaaaaagtgggcattgacacgtccaaatgcacgagaagtttgtactttttttgttgctgttttgtttcgtctatgcaaaaaccaaaaataaaaaggaatttgtacaactgaaatgatgatgaaccacaagaaaagaaaaacattggtgtggtccccacgtaattagcaaaaaaaaaagaaggaaaaaaaacaaaggctttgtggctatttaagccgcttcttctcctccatttctccatccatccatccatgtcgtgttgttagcttcgttttcttcttgtttcatcaatccaaggagtgtggaaggccacacgccaagattatatctatgctaatttgattagcagtaggattaattcagtggctagcgtagcttgattagttggtttaattagttggagagtaaagaagatgt

SEQ ID NO: 39618 - DNA, 212 bp, Oryza sativa
tattcaaccggtaatggagtcggtagcggtagtaatcaagcattgtaacatagcgtcgtgaattaccagaaatgctagggaagtcagtgtactttatacctaaatggaacgaaactcctaatgcgcgatcaatcgttgggcgacaggagcagcgatcgatttccctttccgccacttgccgccaccacttgccttttctggcttttctcagc

SEQ ID NO: 39619 - DNA, 530 bp, Oryza sativa
tatgagagcaaaattagttgaagaggacaatagtcactactagtcataaaatatgagaatcaaatgaaatgtgagaatcaaaaatcagttgatcccagaatcaactgaaattgtatcagaaaaataaaattcactagcagtcactactggttcccccaaaaattatgtagaacaaagcaaaatctgtataagttgattgcttatgagtgctgatgaggtggcagacatatgcatatccacagtgagaaaaaaaagagttaagctaacatgaacccacaaatggcaaatagtgagggcatatatgacaataaggcaaaaagatccccattcagtgctagtggtcaaaaatgccaaaaagtgcagatgggccagtcaatcacaacaatatatgctcatgaaaatttttacaaaaatcatcaaaacttcgtgactacctgcaaccagactgaacttaactcagtataagaggataatgagttgatgactgcaggaatacaaacttagaaatgcagaggtgtataaatctgcag

SEQ ID NO: 39620 - DNA, 452 bp, Oryza sativa
aatgatattttacaagtgaaaaactgttcaaaaacaagataaaaagaggcaatcaatatcaacttaatatttactaattaagattatttttcttctcgaatatgcatgagagttatgtagcattgcattaatggaagaacggaggaatacgatgcaaatacaaagattcagaaaacacgaaaagagagaaaacataacacgagcaaaagaagaacaaagtgcctcaccaaggttctcctaccaacctgaatcacaggccttcttaactgggatccataatcaacggaagtccctatggccccgcctaaactccataggtgagcctcgtcactcgcaagaactactcaagccaaaatgcttgaggcagcctcgttgaaaacataattgttttgatgcttccaaatagtccatgcaccaagaatgatcagattatttatacccttccttatagc

SEQ ID NO: 39621 - DNA, 195 bp, Oryza sativa
atctgttgattcttcttatgatgttaattatacacaatctgaggtttctcgctactttttgaatggtcttgacatgcctatttggagatgaaagttacagctattcaggagtccgttgacatgtctactttgactttggattcgctttacacaaaactcaaaacacatgagatgaatattcttttctcgtaaagt

SEQ ID NO: 39622 - DNA, 1501 bp, Oryza sativa
ggccgaggtggagtgtgccatctgcctgtcagagctggcggacggcggcgtgctcccggcatgcgggcacagcttccacagcacctacgtggacggaaccaagaagaggaagcaaagaggaagtacgacgagttcatgaggagaaagaggggcaggaactccgccattgccaaaactcttctcgccattggagttgggaaatggcaccgtcgccgagctccttcgccgccgcatcgaggccgagtgtcggagttgggaaattaacagggagtggatggaaaacccaacggagtggcacggttccaatttccccaaattcgagtggcactcagctgatatcgtgaaatgtagtgacatttttctaatttggtatatttgtagtggcatggatccaattaaccctatctttaattagctctcttccctcctctgtatttttgtttttttaacaaatcaaccagcgtcaatttcatttattagaacaggatatcttcgctcctctcaatcagcgggttaatttctatgatatgttggagcataactcagggttaatccttcattcatcgcacaagataccaagtggtgaagggagatacaggttcgtagactgggagaagaattagacagggaaaaatagctaggttgggattcagagaaaaggattttgggaagaggaagcatccagggagaaggagaggctcgttccttggttcagttcatcgatgccttttgccatgtctccctgttcgtttatactcccttattgtccaaatgtttgacgccgttgactttttaaaacatgtttgaccattcgtcttattcaaaaacttttatgaaatatgtaaaactatatgtatacataaaagtatatttaacaatgaatcaaattatagaaaaagaattaataattacttaaattttttgaataagacgaatgtcgacgtttgatgtctcaactacggtatttgaacagtatggggatcgttggtgctaggatatacacgagactgaagtaaaagagatggagacgaggatttttatataggttcgggcccctgagctgtcaggtaataacctgtcacaccctaaaaatcctaaatatataaattgttgtttaattggaatttattttaaaaagcctagaagagaagatctaattttaattaataaattccaatataaaatggggccagataaaatttcattaaatactttgcttaactctataattcctagatttttctgagatttatttgagctaaggaagtatttttaataaatggaattacatttaatgaataatttaaattgtaaaaggttttaaaaatcctcttttggctttgggccgaaagtcggcccaaaaccttttctctctctcctggcccaatccggcccgcagtcgagccgcccgctcgcgcgcgcgcgtccgcccgctgacaggtggggcccacctgtcggactcgtcgtcctcctcgcgtcgtcgcccggccggaaccctagc

SEQ ID NO: 39623 - DNA, 1501 bp, Oryza sativa; identical to SEQ ID NO: 39596

SEQ ID NO: 39624 - DNA, 1501 bp, Oryza sativa
ttccttttaggattatcatagcaaaactaaactatattagctgagttgatatgtatcgtgaggtacggaccattctggatagctatcaaaatgtgccttactaattgatcctctactcaataatgtttggctaaattttggattgaagccaattcttttatcaaatcaatattgatgtcctacgaaattattgataataccaataaatataattggatagtaaagaaccaaaatgaccattttattgaactgaataaactttaaagtcattgaaagtttctccatacctcattgttctagaaatattgcataacataacacctccccgttaacactaataatgcatttacctttcaagacggtagaaacctccaattaattttagaatgaatgggcacattatgggtggttgaatcctaacgccaacgtcattggcccccaacaagtgtaataaatgatatttctattaagctacatcatcacctccattattatttttaacctagcatgattaatctacaactaaatcattttccttctcatttcacattatcacactgtcacgggcttgggccctaagtgggctggccatgaagacccaccaggctggaaggttaacctgctactccctccatccctaaatgtttgacgccgttgaccattttaaatatatttgaccgttcgttgtcagggttatgtatactacatacctaatagtagttgactaaatctcggcaggacgcaccacataccatgtcctatatagaaacaatctgcggatataggaggagttccggataaggaaagacaaccagagttctacatgaaaacgacaaggactactcggattgtatccatattggtttccctagttctacttggacaaggggacacctatgggtataaatacaagcccccctaggaggacagggggacaaccatgatgagacgatcaacacgatcaacacccaccatgacgagacaatcaacacccaacacaatcgacatagaagccacaacatacaagccaacatactccaagacaagacgccggatatcgacttcagggataggcatggctattcccctacggtgtctccggataccgtcaggagagacgaaagcgctatctctgatctcgccgggcacagattcgaggaggaaggctaccctgttgtcgattacgagtcagatcttcagaccgacatgtcgataacagttagataggctaccccacatattgtattggtgtgattatggtgaataaaagcaactccggctccggccaacaggatgtagggttattacctgacagctcaggggcccgaacctgtataaaaatcctcgtctccatctcttttacctcagtcttgtgtatatcctagcaccaacgttccccatactgtccaaataccatagtcgagacatcaaacgtcgacagtggcgcgccaggtagggggattttggtgctctaggatttcaacgagatgggttcaaaaga

SEQ ID NO: 39625 - DNA, 1501 bp, Oryza sativa; identical to SEQ ID NO: 39608

SEQ ID NO: 39626 - DNA, 1501 bp, Oryza sativa
caacaaatatgctggttgtgtttgagattgattaaaaagaagatgaagtcacagcaagcaaaacgagaaagacattagcatatgattaattgagttttaattattacaaactaaaaaatagatttatttgatattatatatatataaacaccgtttattagttttaaaatcatgctaacaacaaccgagaataaatctatttctgagcggttacgtgtttgtaacttgaaagactaagctcggaatatgaatcgttatcattgttaacaatgatagagaaagactacacaacggtataccgttgaacagtataccacttatccctcatgccgcggccccgcgtgccggcttctcccgagtatgtcgtgtgctgctagaattatcatcacgcaggtttgttgtgtgtatcagtgtatagtcttgttcctgacagctagctagtacccagcatgcctaagtcatgcctttgatactagcctagctagtaaataaaactggaggtactactagcttgttgtgcatgccaaatccctgtaatagctacctacgttacctagatacggggatacggatatggatacacgatacgtcgatacgggatacggcattttccaaaaaaacaaggatacggggatacgcttttatatatatatatatatatatatatatatatatatatatatatatatatatatatatatatagtaaatttgtttggtgctccatggtgcccgggcaccattgttgaaattgagtatatacccaattcaaatgagtatgaaacttttttaattatttaggtattaacattaactacttttactaactagttcaaagcaagtttgaactgaatttgaacttatttttgttagattttgattctaggtatatagcatccatacatataattagttaggtatgtaatcatggattgtgaaataaagttaaatttgagttgttttgttgataggtataggtacgaatcaaattcttataactaggtatatactcacaattagaaaattttgaaaaatttgagtgattttgtgcatttgaaaccatggtgcccgggcaccatggtgccccatatgagtgtcctatatatatatatatatatatatatatatatatatatatatatatatatatatatatatatatatatatatatatatatatatatatacacaaaaaaaattaaggaaattgcatttatatataaaaaaaatacaaaaaatcaaggaacttttataaagaaatagcgatataatactagtatcagtgtagcagattccatatcaatattctgcaattttctcttctataagcaattcaaattaacaagcgattaagatcccaaaaaccacatattaatagttcaatcatatatttcttgatgactttgcatcaacattagaagccgcactaagcagtaacctctaggattgctagatgcactagcacttgtatctaataaaaacgatagtactttgtcctaagg

SEQ ID NO: 39627 - DNA, 1501 bp, Oryza sativa; identical to SEQ ID NO: 39598

SEQ ID NO: 39628 - DNA, 1052 bp, Oryza sativa
tttttaataagataaatgatcaaatatcacgttaaaaattaacagcatcaaatatttaaaaaccgagagagtagtttggaacacatgtttaagttacagtcatttaaacttgaaatattggctattattattgaacctaggaacaagatagtagttccaaaatttaaggtgtgatatcatattttgtattatccattttacaatatattgttgatactatctttttatggaccgccacttcgaaaaagcaaataatacttatctcagtctccagaaagttaccaggaccaaataaataaattttcaaataagtaatcttatttttcagtaaagcaaagcaataatgaacttatgattttaaggcttgctattcactctataattatatattgccgataaaattcatcacaacaaaacaaaatagtgtcaggaggagtagatttgttgagagaaaaagaccgagaataacgtatttggcccaattaagtatatacatatgtaatgcgtaatatacctacatgtgttgattattttcggacaacttttgagtattcactccaatacccaagagcctccctgtgtcccaccctgaagcaaacaaaccaggaagaacaataacaacagcatgggtagatatgttggcatccctgtaaactctataactcaaacttgaaatcggcagctctaaattatttaattagtaactggactaaaatatatatttctcgaaaaacgaagtggacaaattagaacttccataaatttagttttctcattaaaataagattttgttcagatttaagcatgatattctgctggtaagttatatgatattatatggagcatgtgatgatttttttaaatattcttttaagtcatttactaatgcaaacatagttgggggttaacttggaccaggttgtcgaaaaactagtataaagccacacagccacaagctagaatatccatcaataaacacatcatactgccatctccctcaactagttgcaaaagcacacgttcttccaatattccatcagccatgcctggag

SEQ ID NO: 39629 - DNA, 201 bp, Oryza sativa
cgtacacggtttctagcagtgagaggacttctggcgcacccgggaagggaagactcacacaaatgcattaagttataattatgtttaaattatcacatggcagtcctaccaatggcgacaccactatagagcccctgccttacacatcaagaagccactatgcatggatactgcctccgctcagctatttactccgctagg

SEQ ID NO: 39630 - DNA, 1382 bp, Oryza sativa
ttgtggaaccccaaattcgagtgcttagtcattcatatccaattgtgttgcaatctatcttgttcttgcttgtgtttttcgatttgcatacaaggattagtcttctcggcgaggtcaactgagtagggcacggctgataaccagagtttggatcatgttgatcagaagctggatcgtgtgtgtgaagtttccacgagagttatcaatacctatcgaaagatcgggatctaatttcctcaaatagagcgaattttgtcagctatcatcaaagataccgatggaattaagggatggaaatatacttttgtaagaatatgaagttgggaaattttctagtccctactccctagctaggctacgtgggagactgtttctaatgaaattcgcatattatacttggatttcaaatggagcattagtttcagtaaactgctagaaaacaaatgataataaaaaaaacatgtatattgcaagaacaagagtattatcaatagtgatagcgctggtacgatcattctatagagaaacgacgttctttaaccttttccttttctttggcttttacagatactcccaaaattgcaagacaattgcctgcattatttcctttttaaagttggtagttcctatggtgttcttttgcacgaggaatcgcttgtttctcaagcatatgcatgcaaagttaacttctgtaatatgtagctttcttatttatttttcaatggaattgaattatctttatcccatttattaactatccataacatcacaaaatttttctcagtgacaataactgtaaaattacaactatcatatcatgattttatatcggcaatctagcaactttagtccgatttatgttcattttcagtttttcaccaaatgtttacttttgtggagttcatgaaagctttctaaaatacatgccctgattatgtggccactgtctaatgttgcttatcgcatttcagtgtatatctcacaacagatggtgaccatcgatgaataatataatcaatcatagaagtggctatattagtcagtagtttactaaaaagagatggacaaaacttgccattttgtaggaggatgtaacctacctaggagttcatcagttgcatgcatttggaataatatttgccatcaacaacttgctaaagtgagaaaggggccctggagttcagtaaactatttctcatgctttgaatctcctgctttatctgatcttccctccactccagtggtatataagaagcactcttttgagctccctccaagccaagccaaccaaagtcctctgctcccctgctccttcactctgcttcactctcactcactcaccttcttggtacattgcaattttgcaatggccaagaatggtg

SEQ ID NO: 39631 - DNA, 1501 bp, Oryza sativa; identical to SEQ ID NO: 39599

SEQ ID NO: 39632 - DNA, 1501 bp, Oryza sativa
ggttacttcgccggtaaaaaccctctagtagttgtatttttcttattttgcactaccttagtgcctattttatctttacgttgaattgatagggtgatagaccggagaaaacgtgatatgcctatttcttctgttctcgacaaaaacagatttgttgagtctgagaagctgactagccgttgtcgtatgtaaccgaaaatatagcttgtaaggtcaagcatgtaatgtctacatcgttaaataatgtgatatgctacaaaacggaaatgtatatcttgttgtacgagtgttgcaataaacgtcggagaatcataaccgctacccgttttgaagcgttgcaagtagttaaagcttccttatttgtcgattatacggacgttctaatgctctcgtcacacaaactacaatggattggagtacatggaatacgttatggccaagactactcgtttacaattgaatcattaaaagcttctttatatgtcggttgtacggacgtcgtattgctcttgtcatataaactgtaaatgtaatgcatggaatacatgacgaccgaataggacaagcgctcgtgcatggatggtttggttgcatgttttttcacgtaaaatcttaatttttgcatgaaacatattttcatgcgtcggtgtcatcctacgtacaatttgctaaatttttcaccaagtcttttgagaaacattcaaaaatatttttttttaagaaccccgaagaccaaaatgctgcagagtcagtcttaactgcaagttacagaggctagaagggctaatatgaaatttgcagaaaaacaagattttctggacactttttcaaaaaagcaagaaaaaaccgacattgcgagctcggcgtaaacatctgatgagtacctcacatgttgaacatctccctgtacttactgacaagtgacaaagtgggtatttaattctctcttctcttcaagtcttttgcaagagccccaggcttcccttccttcacaatctgtggagggtgcaaagagaaaggccttcttccaggcaaggctgcagtgccgaaggcgaaagcaaatacaaaagggtaagaggagatggtgctgcctgtgtttatattaagctctcttcttcttcctcctctcccttcttctctggaccaccggcttaatagtagccccatccttcttggttttctgcaaacacgcaaactctaataagcctatatgtttctctctctctccatagcactaactcttggtgtgagtgtgtgaagggagagatattatattggaggccattaacttatcttcagaaagaaggcatttttcttgtctgttttgctcatcataccttctccctttcttcagagagggcaatgtttactggttgctgctgccttgttgttgttgttgttgttctgtccctgatttgaggactctttgtaccagatctgtgaggaggcctcctcttgtgcttgtgttggtggggggcgccgcacttgaggtggtcaggga

SEQ ID NO: 39633 - DNA, 1501 bp, Oryza sativa
aaaaatgaactaagaagtcagaagctgggtttcatctgtagttacagattctgaaaaatgaactaagaagtcagaagctatagaagctgggtttcagagtttttccaaaatatcagaagttagctaccaaacagctggttttcagagtttttccagaatatcagaagctggctaccaaacagctgcttctcagaatctaaagctcccaaaataggccctagagcatggcgacaatcttgtgaaatcaagcgcagtatatgtaacattaactagacaaaagtcatcgtgaattcgtcatatgacttcataacttgagaaacaaggcctctcgacgttaaacaggtttgccagataagatatggagaataattcagcatagaatgaatcggaatcctctgaattgaactgaacgtcaacgcttgacagatcatccggatgacaccaatacggcataggtaccggggatgaacaattaattttaaattttgttgatgcaggttcagtcaaatcataattttgaatcaaatatatattttgttgtgtttaataggacagttgctgaacttggccatgatccacctcacgtgcttgattggaagactgatggagatagctgtgtttggtctaacaggcatggcattgctatcaagttcaatgtttgtctaaataaatttgtggataacattacattgtgggcaaattattgaatggaagatgatcattatgatagaggaccattatcactgcagaagcatattgaatacaatacccccctcttaaaaaaaaattgaacctagctaggccagctaactcaccatcttatggagctaaccaaaagacccctaagcatttttcattgttttcgccaacaaaaacaatcatattcccctcacaacaatcatattaactaacacaaagccaattttccattctaacacaattaaccatagaaacttgcatggttctctctcaaatatctcattattagcatattaatcatgaaaatttacagtatgtacattcttaagtgagaacatcaactttcaatccgattgaaaggaacacgtacgcgaattgtagaacaaccaccaaatgaattagatacatacaatacgtttctcacacacaagctatggccgcatcgacctttcaacaatcaacaatgctatccaatgttttgatcaagctaggacgacgatcgatatggaggatgtggccagccacactcgtgatacacacacccatgtatgcccaaatatatatgggatatatatgccctggagatggagaccactactccagccagctccacattctcccagcagctagctagctacaatcctgcacctcttctctgtctactgtctagcgatagcaaaggcacacacaacatattaacattataacacacatacaatcgatctctgaagtctgaagctagctaagttcagctattgctgagacatggcttaccctcctagctctgggtacccaattacag

SEQ ID NO: 39634 - DNA, 1501 bp, Oryza sativa
atcgtagcataacattggtaaataactgagatttgtcgaagttgagattaacattcagaaatagaagtttgatgctcaagtcagactatgaggattcttacacaaagttatcatgaagcgttccaatgtctgggttatcagggaatctatttattaacttaagaggtgactttgcggatctgcaagatggaaacagaaattttgagccatgacataagcaaatgcagtataacatatactactaaataacctacctgtacacattccactttccagtttgcaacttctcagggagtacagcactgtagccctgcactggagaagctatgcacattgagttgtaaactttaaaaaaaaaaagcattgctatgtcaagaaagataacttaaaacatgcagagtgcagttgagaaaccgcaactagcatgcgtcggcgtactaaaaaataggaaaagaagcatcccagtcagttaaaagctaacgagctcggagctaagcaattattttagacggttaccgagctcagcaatggaattatggcatagatgcccagtctaagcacaaattcagaaagaggaagctatctctacagcttaagaattgggaatttgggagtggttgcacttgttattctccactttatccactttacgctcgagcggtgcgcgcgcccagtaggccccacgcaatccaaccccaagatccaaatcgcggcatcaatcatgcacgggatggataaaatcacaaatgcataccacatcactagtaagtagcaagtagtagtgcagacgaatagacgatcgatcgatcgatcgtacgtaccgtgcgcgtactcgccggcggtggggttggcggcgaggtcaacgccgccggactccgtcggcggctggaggtggccggagacggcgcgcagccgccgctgggccgcgcccattggggccctctcctcctcccgctgctgctgctgccgcgccatgcccttggctcgcactagtcgtctactactcgtctcctgtttctccggcgaggcgttgcgtgggaagaaggcgaagaaatttgtggcgcgtgggaagcagaggacgaagcgtgggggactccgactcctcgtctttttttcactagtggaagtgtactactagcgtttaagtaaagtttttttttaaagaaaaggaaatggtgggtttgaatttggagaggatttgggaggataaataagttaccgggaagggtaggaactaggaatcgtagctttctagacgaatcccatagaaatctcctgtgctttttgtagttttttttttgtttgcctgtttggtggcacgcatagtatatttatctgttttatcttatccgtttttctttttgagggcaatttttatcttatccgttcgtgctgcttgcgtcgtgtgcgccggccctcacgtctcgtcgtgtcgtgcggtgcggctgcggccggcggtgtttgcttttgttgcgttggtatgtggattggatgctttctt

SEQ ID NO: 39635 - DNA, 1501 bp, Oryza sativa
cgtctcctagatctacattgaagagggaaaggccgccgccggcgtggggaggaaaaaggggaaggccaccgtggggagagggagaggcgtcgtggtcctccttctcttcgctgccactcttcttcgcccccggagaggagcgtcggacaccgcctcggcttcccgctcgccgtcctcaccgcttgggctaccccgccgctgctccggtcgccgccttgcttcctccgccgctgcctcgcttccttttactggtggggaatggatagaggagagatgaaaactgagggtagaaaaaaaggcgggtgggacccattcaaaagaatatgcactgcgcagtatgtactacgtatctaacaatgtttctaggtatttttaagctgagttggaggctccgcaaatgtttgcgtcgcactgctaataccttaggccgagtttagtatcaaactttttcttcaaactttcaatttttcccatcacatcaaactttactactcacataaaattttaactttttcgtcacatctttccaatttcaactaaacttttaattttagcgtgaactaataaacacagcaaatataacgttattcttctctctctctttttatttggtttgattgattgatatggctttcgagacttctccactcgttaaactcacctcactcacagcttcagcagtcccacagaataatcacatctccaagttccgaccatgaaggcagacaggcaggcaatcaagaaaaacaaacgactctctgaatgggtagtccacagcacaaacaaacctgctttcttgacaccacaaacaaaacatcttcttgccccctactacaatcaacggacccgccgcctatctactggcctcacattggatgcgtttttaccgctgatgacaaaccggctgacaaaggaacaataaaaagaaacagctgtgcgtaggactatgctgctaccctcgtgtccttctctgtcgagaaaaccggcaacacattgttcaggttatggcacggcaggattattaccctaccgtgcatgagagagaagagaagaggagaacacacactcatcagagagaagaggagaggagcagaggccctacgcttaaagccgccattattgcggcctcctcctgctgccacaataaagctaccacttcaaaccagctatgtggacagctatcctaactctacgacgatcactttgaagcaaacaacaacagcaacccaagccccctgcaatgattcagtgcagttgcaccccccaaaacatggcccggaaatcgcagcctatttttttttgacctagcatacgcctaccttttctcagctgtgtgtgtatgcgcgacacgtttcgctgacaagcagctgttgaatagtcatccgatgatttatgtgagagatttatatttcctaccttcaatttgacacgattttagtaacttcattttgataatgaataatttacttttagattttataactgtagattttcataattt

SEQ ID NO: 39636 - DNA, 1501 bp, Oryza sativa
tggtaatctacggcacggcatgtttttggttccaattggggacagcggattaatctaatccggagagggatgattgctgttgctgctgatgctgttggtcccaacagtggagcgcccctgatacggagcagagcgtgagtctcctgcgcgaaatccagtggggatggatccaccattcgcgacaactaacatcgaatctcaagcatcgagtgtgcggcaaataccatgccaactaaacaaaaactttgtactactatctctgtataggtgtagccctctaaaataatgacagtactaagatccgtttaggtgaagaaaaatgtggtcaggacaatggtagtatgatactgtatttacaattccaaggcttgattactagcagtacaatagtactgcatacaaaagttcagacaattgttgctctgatcatgagtctgaatgctgcatatactgcgatatttttctcaccttttaccgcggtagttgggggtggaatcaatcgttgtgagggagagggaccaagcagttctatgatcagggcaggcagaagcagtggtgcttactgtggtcataggattgaaatgtgcaattctggtgtaagggcctgtggtcattagttggcgaaaaaatttgcccccctgtcacatttaaaatattaagcatgatctaataacaaaaacaaattacatattccaccaaaaaactaacagacaaatttattaagcctaattaatccatcattagtaatgtttacagacaaatttattaagactaattaatccatcttaattcatcattagcaatgtttattgtagcatcatattgttaaatcatggagcgactaggcttaaaagattcgtctcgtaattttctagcgaactgtataattagttttttttatatttaatacactatgcatatatacaaatattagatatgacaaaatcatagagcgattaggcttaaaagattcatctcataatttcctggcaaactgtataattgatttttttatatttaatacattatgcatatatacaaatattagatatgacaacctgaaaaattttgtttgggaacccctaagccaacctgaatgcagcagctgctgctgctacgggacagcgctatcttaccccatcaataatgtaagtgcagggtgcaggaaaaggttgcaaccatggccaaaactgcagcagctcctctcctctatgacttccctcttcctcctcacataacacatggaccaccaccaccaccacagccatcatcatgatcatccatcccctctcctccattgcattgctcccacaattatcattgttatcaccttcctcaccttgggatggagtattataatctttcttctctcacaccaaggaagaaagaaaagcatggcattgagttgacaacattccactactagtggcatgtaaaaagagcactatagctagggcacacatccactgtcacagtcacagaggcacaaacaaaccatttg

SEQ ID NO: 39637 - DNA, 1340 bp, Oryza sativa
ggccgggtgccaaccttgttccaatcttaaagactgacacattgcacatactccgaccggacgaaacgcactgtctcatccaatgtcgtttgagaagcactcacttagactttttagaaaagagttcaaacaaaatcaattacgaaaacaacagcctttccttgaagcctgcattaaacacttatttcccctggcttgctgagtactcccgtactcacccttgctccatataaataatccccacctagttgctgaagaagatgaagtggatcctgctgacgaggagttcttccaggagcaagccggctacgatgagttttagggtttcggcctagttcccaagtcgcacctgtgatgattggtccaagtcctggcttccgctttccttttgtaatgcagttgtgagctcgggatctgcccgcagcccaacatgactgtacttctactctataataaagagacctctgttgctgtgatactctgtctccctgtgataccaacactgtttcctaggactggtatcgattaacaggttaatttggagcgtcacgggctagttccggtcgggactagttcggggcgtgacacttcacggcctgcctgacgtccctcctttttaatcgtcagtaggattctatttgatgttttattaacaatttttatatgtcgtatcaaccgccaccactctactcatttataggcctgttacttaatttatttttattccaaattttaattaatctcgtgtattgggttcttatatgaactcttcttttaatgttccttatttttaataacgaatttcagctatttttaaattgtattcctacttggactctcatttccttttctaattttagattttattttatttttatttccaattttgattaatcttgtattgggttcttatatggaaaattctttcaatattgcttgtttttaattccgaatttcagctatttttaaattgtattcctacttggactctcccttccttttctaattttggattttattttatttttattttgaattttgattaatctcgtattgggttcttacatggaaacttctttcaatattgcttatttttaattccgaatttcatctatttttaaattgtatttctacttggactctctttttttcctaattttggattttattttatttttatttcgaattttgattaatctcgtattgggttcttatatggaaactttttttaatattgcttatttttaattccgaatttcagctatttttagattgtattttctacttggactctccttttcttttttttctttttctctgattaatgtgggaatttctag

SEQ ID NO: 39638 - DNA, 249 bp, Oryza sativa
ggccgggtgccaaccttgttccaatcttaaagactgacacattgcacatactccgaccggacgaaacgcactgtctcatccaatgtcgtttgagaagcactcacttagactttttagaaaagagttcaaacaaaatcaattacgaaaacaacagcctttccttgaagcctgcattaaacacttatttcccctggcttgctgagtactcccgtactcacccttgctccatataaataatccccacctagt

SEQ ID NO: 39639 - DNA, 292 bp, Oryza sativa
ccgtctctggtcaaaagataaaaaacccaagaagaattaagagatggcaccggcgtcctttataccagcataggcccaccggtgccaatgaaggccccgtatcccaataatctggatactcgccttttgttacatgatttgggatacaatagtatgctttcctctcttgccaactatgcgacacttactatatctgttatgggcccttggcccacccccgaagcatagctttggcttctaccatgaggtacccgggtgccacatcccccacacgctgccaccataggctagc

SEQ ID NO: 39640 - DNA, 593 bp, Oryza sativa
atacattccaaggtcaaaagatctgctacatatgctaaatagatagtgcatgtgttctttcttttgcaggcttgtcagtctgtactgtagaaataaattaaccgcagaacatttttcttgatgtgtgatggaaaatagtcaatatcctgttatgatagtactccgtttggaatacatgggaatatcacaatgaatactagtaggtctatacatgtgtttttttaagggaaaattgtaaccatgccattataattttgcattgaaaaattataatggcatggttccaaattaccctttttttaaaggtacacgtggttctcgtatatgcacttgaatgaattatagctatggtattggtacctaacacaactgcaagcagtttttctattaattccttttggaaattaatgtagatttgtcttcccctacaaggctacaaggggataatatgttcactttccacagaaaaagtagttctgtagacctgcatgtttgccttcatgaactatagttgtaccaaataatcagatattctaatataaatttcttgctcaatcgactacattaatgccattccgttgctattttgcagt

SEQ ID NO: 39641 - DNA, 163 bp, Oryza sativa
gggctcacctcgacggcagacacaaggggatccacagccatggatgacggcagcggctccccatcgtcctcgctctccccccccccccccccaacgctctcgccgctgacgccctccccttctcccgcgtcgccggccgacatacctcctctcttgccgcagg

SEQ ID NO: 39642 - DNA, 1501 bp, Oryza sativa
aagaaattgattaatcagattatagttgcttgacttaactaccactccaccaacatcatttatccgaatactttttatcatgactgaacaccataaggcagctataacttatttgtttccacagaactggagtaaacaacatcatgaaatagtaacaaataactgaaccatgacatggcattgcttcaacatcagtaaaataataacaacaactgaaacagaatttaacttggcaagatccatgaggctaaacgggaacgaaatcaagtataccattctcaagcgcttcttgcgttctctgaagcaatgaaatcgattccgcatacggatcagcactcgacttcatccctgatccaaggtcaccattgttccccacactcctctgagcagcatcagcatccgaatcaacactcccctgtgccaatctcctcaccaccacgctcccattctccacattgcagtaatctctggccatcaatggcgtctcctcgccgtgatcacagtgatcggcaagaaccttgtggattccattgccggcaatcgattgccgccgggagttcacggcattagagcagcgcagcgagtactgcgcctcggcggcacgcgcgcgcgcggcgcgggaggagcgccctgccctgtcggcggcgaagggcgagaggtcgttgtggcggcgcggggcgctcgctgcggtggaggacctgctgccgctgctccggtcctcgctgtggtcggagtcggcgccgcccgcgccgacggagaatcccgaggaggcgacgagcagcacgccgaggctcggatccagcttcgccggcgggacgaagcgggactcgacggaggcggtggagctctcctcctcctcctcctccaagaccacctcgtgcagcttccccctcggcgcgccgccgggcaggggtatccgccgcttgtgcagctgcgccgagccgctgccggcggcggcggaggcggctgatccttccttgcgctgctcccgcgggatacggcgccatcgacggagcccacggcctttggtctttatcacgggagagctccccggagatgcaccggcctccacctccgccgccggcgacccgacggcgccgttctccatatcggccgccggaggtggcatcaaagaatcgacgaaatcatcgttgaacgggggttgtcggaatcgagcaaggtcgtagtaacgaaaattttcagttcgtttggtctcgtggaaaggagatcgagggaggatgacgaactggacggcgacgacgacgaaagggagaaaagatacgaaaaagaagtgatttttttcccaccttaacagcagcccttttccagttctttctcttcttttttttttccaacaaaaatggcgcgttcgcgtacggtgtctgcgtcagttacagccacgtctcggcgaaacgcattttaaacaagcgagatggcgacgacgtggctagctctgcttagctcagcagcttgattgaactgctatgttttttttttaaga

SEQ ID NO: 39643 - DNA, 1501 bp, Oryza sativa
agctcgattgtttaggggagtttttgattctgggaaagctgcaacaactataagctccccaaacaagtttcaagattattttagttggggtgaatgaaagaagaagagcgtgacctcttttaaaagacaaaatggatgattttgtttggaatcagtaatatgtatggggctgttcggaataagcagaaggaaaaatttctaattgagcttgtacatatttgttaacaacaaaaacaccccctgctggtaggggatttcaatattataggtaaggagaattacaatagatggagttttatttttaatgctattattgaataacataatttgagagaaattatcatgggtgggatgaatttcacttattgtaagaaccagagtaatatcacgtatgaaaagttggataaggttctagtttcaaatgatttggagtgtaagtgtcccaacggcagaagttagaagtttggagagggtcggctaacacagggcaaaatcctattactcattctggttttaaatttgaactgagttggtttcttagagaagacacagatgaggtagttagtaaggtgtggacagaacatgggactcaggggtagtattgaaagatggcaaggaaagatgaaacacatgaggaaagcacttaagggttggaatttaaattgggaagtgtctacaagaaagagaaaaagaaaattctagagcaattggataagattgacaagtggtatgaaagtaatggtatgaatgcccaaacaagaggaaaaaaagatcttggaggaacaattgagattcacagtaagggaggaaagaattagagagaatcccttatatgccactagaatttgaccagttcccttatatgccactcaaaattggcttctcccttatatgccactacttcaagttttttcacccttttatgccactcccaccactatagtgttagttgactgttagtcaaaggttagtttttttgtaaatgaccaatatgccctctcaactaaaaaatatgtaaacttcaaaaaatcataactaatttattttaaatcctttttgagtgaacaaaattttgtcagaaccagtgaaaaatgctctttatattaaaaatattgttggaaaactgcatgtttcatgcttacattgaaaatttatttgtgatggtaatggctaaaattgcatgtgatgcagaaaaaatcaattttcatatgttgtatccagtagctatattagtactaaaatacctattattggttgtatactaattctcaagggtaaatgcgtctttttacaatgaagttaacggtcaactgacggtgtactgacggcaatggcttaaaagggaggagaaatttgaaccggtggcacaaaagggagaagccaatttaaagtggcatataagggagccggttaatttagagtggcatataagggattctctcaaagaattaagtggtttcaaagaagtaaagaaaaggagattatggagggtgtgatgtga

SEQ ID NO: 39644 - DNA, 1501 bp, Oryza sativa
ctctgcttcactactaaagtctgaccactaataaaatgaaattgtccagtcaagattgattaatttttatagctttatcatgcaagatgcttagttttgtactttcaggtatttatttattaataaaagttttagaatagataatacaatacgggatgtgtttgtactgctaagaaacattgatcaaaacagtaaaattaacatcaccaattactacactggctttgtaacggatagagtagttaattgcagtgcaataaatattgctcaaagtaatgaacttcaggcacattctccaacgtgcttgattttctctttactctggaaatatgaacaatgattaaaaaaactggattgagggagagagtacgtccacattttcattcaaaatttgaaatatattcgacgaatttctaagctctcacaacctactcgttagagttaacgagcaagtataatagcatactataaaccatctataaacacattttgaggagataagagaggagagagaagagcagctggttgcatatttgtagccagctgcaacacggacttcaagatgcatgtgtgtatgataggtgggactagatagtaattgtatagtatattttattggtaactattgtatgaattagctattaaattgactatagctgaattggagccagtggtaggctatactattaaacttgctcttatgtgtcgaactttgatcaagatcggttgaaaacttaatttttttaagatattgcaagattcatttatcttgctgccttgttggtactcgaactttagctccaaaacaagattgtaaactacatgcgattttgcatgattttcatataagacaatctaatttgagaaaaaaaatctaatttttcaaatagagctttaaatgtatttgtgtagtttatttcacatattatttcgtttatctatcaatttcttgactgaagatactgtgtgtatgagttctcatcgtactgttcattaagatgggcgtaccctatgctgtagtactccagtacacttttgcagtccaagtgtccaactaatccagctggttggtcaaaggagagagagatagagacagtcacattaaccccgccatttttgtgcagtctccacctccaaaatctcatttttattcatgtcatctccccatcttcaaattctttttcccagctactactatacttgctgtgctgcctggtgataaccagacacaaagcaaaactagagtgaggtgtctcactgtctcactgttgtttgtcttcctccttggtttggttgtgtccaagcaagaaaaccaagaaaaacaagcaagaaaaccttgtctctctctctctctctctctctctctctctctcatgcttgtacatggagggatcaagatcaagggagtgcattgctgtggcaagtggccatgaagcagcagcagcgccagcaggctacggcctgttcatcagaacagcagattgttccatggctgaagcag

SEQ ID NO: 39645 - DNA, 1501 bp, Oryza sativa
ttcagtccacgtcggatagtccgatattttaaacctccaaggcaaggagaaacagagaacgaagtttcatgaaatttcggattttccgagacatcagactatctgatattaaatcggagtatctgatattttagaagcaaaaacttcatcttcaaacagagactcaagttccatgaaatttcggagtctctgtatcattggactatctgatccaacatcggatactccgacacttagaaaaactcactcgaaaggatttttcaaacaaagacagagagtgaagttctgtgaaaaatcagatagtccgatacatcggatagtctgatttcaaatcggatagtctaatgttgctcaagcaaaaatgcaataactttttactctgaactccgatttcgaagatcttggactctatggaaagctagtttcgtgggctatcaaacccaacataaaacatggtccaaaaccttcaagagatattgaaaaacttgcaaagaaacccggtgtaagtgttgtgacaagtgaaacaactcgggattaaaaattttggcttaggtttttcaactcacacaaacatgaagcattttgagcactagtatttaaccaattatatgcatgtggtatccctcttaatagtacagcatcctaaactcaaatttaaaaagcaaagttataccaataggagtaccttcacaccatattgattcttcacttggagggttaccaacgtcaaagtcatttgatcatcgggaagatctcatcttcttgatctttgacatttcatcttccatttctcaaatgattaatgtggataatccatggcttcaaatggcctcgcacggttcatcacgacacagtattcactcgcccttcaccaccggtttcggttcgtcggcgccaagccccttgcttgcccttcaccaccgcatggtccatcgcaactgagcgtcgcttgtgcttcaccgtcttgccataggtagtcacttcatacccgcatcttcaatatcttctctttaattctcatccatcgataagtctatttcctagcttcttcataggactaatcacttgcttatacactcaataagtgcattagtcccttaatcgtttgtcatcaataaaccaaaacccactaggggcatagatgctctttcaaatagttacaaaaaatataaaaaaattaataatatatattatgtgataaattactccacaaatatgcagtataaaatttaacttgtgcaagttacaacgaaaacaaatttaactatgagaatacgttaactgatcgtagtttaatttgttttaatttgcatatttgtggagtgatctatcatatacttcctccatatgttattctataacgtcaatgactttttgacttacatttgaccattcgttttattaaaaaaatattatataattataatttattttattgtgactggattatgatcaaatgtttttttaagtatgacataatatgttcatatttgcaaaaaaa

SEQ ID NO: 39646 - DNA, 1501 bp, Oryza sativa
atcccctaccctaacacgcttatacgcttacagataacaatgacactgataataggattagactgataattaatttggccaaaacatacccagaaatctggtgttcaatggaagcgccgggatgcagactgacggaatggataccaagtgatttcagaggcttgcaaatcgaacgcacctgcacaaaacaccatcaaatgaatcactgattcatcatttaggaatcaatcttaagtgaattaaccaaacgagcaaaaatggcggcactaacttgcacggccttttcctgggaggggacgaggtagagtaggaaggggcaagagacgaccacagcgagcttctccttcctggcgacgatgtcgcaggctgtggagacgagccaagccgtcttctcccgggtggcgcactcgccgctggtgtcgagcacgtgcgtaggcggcgcagccgagcagcaattccagagctccacgccccacgacccggtgtcgtggatgccgccgccgccgccgtcctcggacgccgccgcgtctcggatggcgttgaggcagaccaccaggaacttggacggccggtcgtactccgccccgtccttctccctagacttggcgttcgcggcggcggcggcggcggcctccctcgccggctgcttcttggcgctcgaatccttcttcttcttcttcttcttcttcttcttggattcgtccctgcctgcggcggcggcggcgggggcgtctccggtcggctcgtcgtcgcccttccgcttcttgccgtggcggtcgttgaaggggtcctccggggtggggagggagaagcacatgccctcgcaggcccgccgcttgccggacttgcggcggcgcttggaggcgatgatgccggcgacgcgggccgacacggcgttctcgctgctgcgcatccgcttccgccgcaccttgttgcgcttccgcgccagcgcgtcgtcgcccttcgccatggcccccctccccttctcctccgctccgacactcgcggcggcggcggcgacgcgaggtgcgagacggcggcgagagagacggttagccgccgcgaccccgagcacgcagagggaaaaaacctagcgaagccactaaaaaggccgggccggtggtagtgggccacattttctagatgggcccacttaagttgcatcagttgctcggtgaggcccattactcagtgagacctatattggcccaactggagagtcaagctttagcatgcgttggcccatgagaggattggcccaccagtcagtgacagacaagggggcctttctttcgtatgggccgcataaattacgcagtggaatgattatgcgttcggccttgttggcaccaaattttagcatttctcatttttttattcgcagcagaccatacataaccatcacaatcttatgataattaaacttctggtcactcacttggtaattttagaaacatcaactcacacaaaactatactgataattctagaaactcctcaaa

SEQ ID NO: 39647 - DNA, 1501 bp, Oryza sativa
taggcttgtgaaaagaattacaaaacttgctttgcgcaaaagaactatagccatcctttgaattcccctgtcatgtgcattattgctgtggtggcttgctgagtacggttggtactcacccttgcaatatacaaatttaatcagaggtcggagatgaagcttcggaggatccctacgcttactaacaggagggtgatgaagacgatggcgcccagtaggtcttagttacggtcattgcctgtggcaatggcgtgccgctgccttaactccgctgccttaccttcttctgtttttggaatgtattccggaccgctcggtccgatgatttaagactatgcctgcgggcttatgatgcaatgattcatactagacactcgtgtatgtgcacttgatatttcagctaagaattcgtgtgtaccagactacttgatccagggaaatggtactgtttacacgattgattcctgttataaaaacgggggtccacatagatccgccactgctccctcctttccttcatatttagactttaataatttggattttcacaaatgttatctaaataattaaataaatatcatgctatcgaagtatattacataaacataagtattaaactttctttcattatgatttaacaaaattgctagaatgctagaaaatttttgtcaaaactttcagatttgttattattggatcattttaagatgggtgcattgaatagaaaaataattgctagaaagaaatttcacataggctacggataagatcccggtgctagtcaactaaactagtcttaaatacaggtttatatcagttatactgtagctataacatagccacggtataaattaatgtaattacaatgcggttatagtgcagttacaatgtaattacactcaattacattatagttacatttgaaagttttccctcaaaaaacttgatagttatttttttaagatactctaacgatttaatcatctcaaaatttttaataattaaagttatagatgaaccggtaacaattattacctctgtttcaggttaatatgtcaaagtcaaactactttaagtttgactaaattatagaaaataaacattttcaacccatgttagatttattataaaaatatatttaattattgatttaataaaactaatttggtattataaatattactatagttatctacaaacttagtaaaattgaaagtagtttgattttaactaaagttaaaacttctaataacctaaaatggagggagcacaccatattttataccaaagtactgtcagcaattagctgatcggtagagacgctgagtaactgcacgttcaggtcatcacgcgacctaccaatttaacaaaacgccgtgtcgtcttgttcttcttcttatctttttttttagtcattaattgatctgcaatactcatgtaagaggtccagatagctagagaggccattgagagatcatcatcggagctagctagctagcca

SEQ ID NO: 39648 - DNA, 209 bp, Oryza sativa
ttgaaaatcaatttattttgaagaatccctggcaactcttatgggaacatgagagaacacttgatagtggctcgcacgaaggaataacaaatgagatcgcgctattcatgacccagggaaagcttcttgcggttaattagcaacatctatgactagctagtggctattcctttgacgaagctggtggtgggatcaagtagcagcatcta

SEQ ID NO: 39649 - DNA, 1501 bp, Oryza sativa
ctatttcgatcactcagttttttcttttcaaatgaagctattttctcatatatctatcatttcaacgaatcacaatcatcttttattttatttcttcatccaatttcttttaccaatcataatgtttcctgatcattttttacatttttcaagtagatgtggggtcctgagcgaagttgaccccactgctacttgtggaattgccagtaaggcgtcaatttggcgcgacaattgcagctttctccaagaggacatgccaaacttgacaacaacatttccgtaagatgctagagtgcagttgtcacttgcatatacagcagggagaaatgatgacgaggtttttggcttactgtattagcattaggacgtttagttcacgctaaaattgaaagtttgatcgaaattggaacgatatgacggaaaagttgaaggtttatgtgtaggaaagttttgatgtgatgaaaaagttaaaagtttgaaaaaatagttggaaactaaaccaggccttagtaacaccgtcccaaaataaggttgcgttcgggagggcacgcaaaacggagcagcgtttagcgcgtgattaattaagtattagattttttttcttaaaaatagattaatatgattttttaagcaatttttgtataaaatgtttttttaaaaaacgcaccatttagtagtttgaaaagcgtgctcgtgaaaaatgagaagaatgagaaggagggaataggaacagccactgctgacgttttggacattctaaatactagtgagtaattaattagaatccatattttccattttttccatattagatatcaattttatggagacgaagcaacacatctctacatgaacgtaggggtactctggaaagctaaaacatcgatattttccatccacaagctattaacctcatcgttaattaaaagtgatctaaaaaaattatttattatttattttggaacgaaggaagtacgtaccatctgatcttatagttaaaaagatacatctgatcttatagttaaaagatacagagagggtttggttatcataggtttgggaccacgggtaacaaaaacagaaggtcaactctggtttccgtggtgaataatttcccgaaccttgagaatgccggaggttagcttcgttcagacttggcttcagccttcatacgaacaattttcaagtcagatgcatcattccatattgtatattttacggagcatattttacttgttttagcttctttccaatttttctttgttttttttccaattacacgacaaacccactcacaagctaaatcaagtaaaatatgctctgtagttttcacaagctaagggtgtgtttggttggactgtagcttttgaaaaagcggctgtgggctgtgacttttagaaaattagctgtgagaaagacaaaagctcgtttggttacacacaggtggcttttgaaaaagcttctctcctgacgagtggaccccacatgtcatacacaggta

SEQ ID NO: 39650 - DNA, 1501 bp, Oryza sativa
ggtactctggaaagctaaaacatcgatattttccatccacaagctattaacctcatcgttaattaaaagtgatctaaaaaaattatttattatttattttggaacgaaggaagtacgtaccatctgatcttatagttaaaaagatacatctgatcttatagttaaaagatacagagagggtttggttatcataggtttgggaccacgggtaacaaaaacagaaggtcaactctggtttccgtggtgaataatttcccgaaccttgagaatgccggaggttagcttcgttcagacttggcttcagccttcatacgaacaattttcaagtcagatgcatcattccatattgtatattttacggagcatattttacttgttttagcttctttccaatttttctttgttttttttccaattacacgacaaacccactcacaagctaaatcaagtaaaatatgctctgtagttttcacaagctaagggtgtgtttggttggactgtagcttttgaaaaagcggctgtgggctgtgacttttagaaaattagctgtgagaaagacaaaagctcgtttggttacacacaggtggcttttgaaaaagcttctctcctgacgagtggaccccacatgtcatacacaggtatcttctccatctacacagacacaggaaaggcagggcagacgagcgaggtggcggcagacatgggcggcggcgggctagctcctgctccggcgtcggcgaggagggccgtcgccccgtggcatctgcctcctccggctccgggtctggctcgtcccgcgcgtcaccgaagaagttggcgtcgatgcggtcgtcggtggcgccgtcctcgtcgttgtcgccgtctccccacgagcagttgcggcgggagccgccgcggcggcggatgcgctgcggcgtgcggcggtagacgcaggcggcagggcgaggaggagcggcggcgacgacgaagtgaggaggaggaggaggagcgacaccgggggtagaaaaaagaaacgcgaaccgtttttttgtgtaatggcagagatgggtaattttttccccaaaaagcaggtgaaagcagagggtagaggtgcttttgatttatactacactaaaagctggctttggacaaaagcaattgtagcttttgggtcctttggttggctttaagcttttgcaaaagcaaaagcaggttgaaaagtctaaccaaacacaccctaaatcttgctattagtgagatatctcagtctacaaatgtaggcctaaaattgttcatatttttttgacgagctcgcacatatgttctttttcttagtttgacctcagagtatgctttacaaatatttgcaggaattcacaaaacacgtggaattcaactattttccaatcttataattagcttgtcgctgtcgtatgaccgacgcatagtccgtcatgttacttcccttcataaaaaaaaatcaatctagataaagatgtatccatcacctaaaacaacaaat

SEQ ID NO: 39651 - DNA, 1501 bp, Oryza sativa
tcctcccggtttctctcctccttccttcttctttctctccctcggcttctcccttcctctctctctctcggctccctctctacccggcggcacggcgacaaacagggggggcagcagctcaccgacggcggcggcggcgacgacggcgcacggcgcggcacactgaggcggtggcgcggtggcacgaatgcggcggcacgacagcacgagggcggcggcgcggcggctcaaaggcagcgacgcggcggcacgacgacggcggcgcgtggagaaggggaagaggcagaggagggggagatggagtgaggagaggggagaacggtggagcttttataggggagaggggggagtaaggggaagaggggagagaggggcgggtgacgcgacggcggcgcggcggcacggggcgagaggcggcgatggaacgcgcgcggcgacgggacggcgacggcgacggcacggcagtggtggcgcgcggcgcgaggcggtgatgggacgcgcgcggtgatgaatctcttccaacgtagcttgttccttcggcactcgtaagcacttctttaattgagacacatggaagactgggtgtacatcggcgatattttttggtagctgtaactgataggcaacttctcctcgtctagcgatgatttggaaaggtcccacatatcttggtgctagtttccctttaaccttaaatctttttgtacctctcatcggagaaacctttagatagacgtaatctccttccttaaattctaggtttcttcttcgggtgtcggtgtaactcttttgtcgtgattgtgccacctttaaacggtcacggatcaagcgaaccttttcttcggcttcttggataatgtcaggtccaaataccgcccgttctccagtctcggaccacattagcggggtgcgacatcgtcgaccaaataatgcctcatttggcgacatctttaggtttgcttggaaactgttgttgtaggagaattcggtgtagggcaaacatctctcccagtctttgctaaaatccaatgcacaagctctcagcatgtcctccaagacctggtttgttctctctgtctggccatctgtttgtgggtgataagctgtgctaaacgcaaggtaacttcctagggcttcatgtactttctcccagaaatgcgaggtaaactgtgtgcctcgatcagatataatcctcttaggtataccatgaagacacactatcctggtcatgtataactcgactagcttggcactgctataatttgtcttaacgggaatgaatctcgctgtcttggtgagtcggtctacgatcacccagatggaatcatatcctgttgcggtcttgggctgtcacgcccagaaatttagcccaaatttccagactattttgtgtattaaatccctgtccaggaccagccagggtacacaaaacgacaagtaataaacagttccaaacgtaaataaagcgtaaaatacttacagaagaggcacttagtcctca

SEQ ID NO: 39652 - DNA, 464 bp, Oryza sativa
tcccccttttcagaagtgtagtgcttctgagctgaagatggagttagaggaccaaggctcagaccccagttgagtttggcctgtggagtggagctgaagccccgctaggatcgcctttttccgctgctgctgcttttgtttcggtgtgaggactaagtgcctcttctgtaagtattttacgctttatttacgtttggaactgtttattacttgtcgttttgtgtaccctggctggtcctggacagggatttaatacacaaaatagtctggaaatttgggctaaatttctgggcgtgacaaagtggtatcagagccaacttgactgtaggttgagccaaatggtcaaaccgtaaggacaagttttctgaaaaccctacttgcaaattgtctcctctcgcccttcggcatttctttgtgaaacggtttttcaaaattctcctcccaatctctccaattcttttagt

SEQ ID NO: 39653 - DNA, 1501 bp, Oryza sativa
tgggggacatcgacgacggcgaggagggagaagaccggtaccctttcgctgctgctgcggcttcttgttgtgcagctgcttcagccatggaacaatctgctgttctgatgaacaggccgtagcctgctggcgctgctgctgcttcatggccacttgccacagcaatgcactcccttgatcttgatccctccatgtacaagcatgagagagagagagagagagagagagagagagagacaaggttttcttgcttgtttttcttggttttcttgcttggacacaaccaaaccaaggaggaagacaaacaacagtgagacagtgagacacctcactctagttttgctttgtgtctggttatcaccaggcagcacagcaagtatagtagtagctgggaaaaagaatttgaagatggggagatgacatgaataaaaatgagattttggaggtggagactgcacaaaaatggcggggttaatgtgactgtctctatctctctctcctttgaccaaccagctggattagttggacacttggactgcaaaagtgtactggagtactacagcatagggtacgcccatcttaatgaacagtacgatgagaactcatacacacagtatcttcagtcaagaaattgatagataaacgaaataatatgtgaaataaactacacaaatacatttaaagctctatttgaaaaattagattttttttctcaaattagattgtcttatatgaaaatcatgcaaaatcgcatgtagtttacaatcttgttttggagctaaagttcgagtaccaacaaggcagcaagataaatgaatcttgcaatatcttaaaaaaattaagttttcaaccgatcttgatcaaagttcgacacataagagcaagtttaatagtatagcctaccactggctccaattcagctatagtcaatttaatagctaattcatacaatagttaccaataaaatatactatacaattactatctagtcccacctatcatacacacatgcatcttgaagtccgtgttgcagctggctacaaatatgcaaccagctgctcttctctctcctctcttatctcctcaaaatgtgtttatagatggtttatagtatgctattatacttgctcgttaactctaacgagtaggttgtgagagcttagaaattcgtcgaatatatttcaaattttgaatgaaaatgtggacgtactctctccctcaatccagtttttttaatcattgttcatatttccagagtaaagagaaaatcaagcacgttggagaatgtgcctgaagttcattactttgagcaatatttattgcactgcaattaactactctatccgttacaaagccagtgtagtaattggtgatgttaattttactgttttgatcaatgtttcttagcagtacaaacacatcccgtattgtattatctattctaaaacttttattaataaataaatacctgaaagtacaaaactaagcatcttgcatgata

SEQ ID NO: 39654 - DNA, 636 bp, Oryza sativa
aaggaaagcacgtgaatgagtatatcaagaacacaccgttgtgctttcaacaagtttaggccctctttgtttaagccggtggatttaatgtcttaagtttagtggttgagtcatacatctacctcatataagccaaaaaagcttctccaatctaacttttggcttaatagtgttagagtggcttatggctttaaaaaagccaaacggaaaagctgcttgtttgtttaggcttagacttttcgacttataagttggcttataagcctataaacaaagggggccttatagtgatgtccgttgtctctgcctttttgagcttgtgttagaggacgttttcacggataggtgaatatggtgtccacaaatacgtcttccgtgtaacgggaaaaaaagagtaaaacttaaataaagaactgatgatggttgtcactgtcgccttccattgacactgacattttcaccactaataacaagcgggatggtgtgattatgatagcttttgcggttctcaatatatgattggcaacgatgcaatctgggattatctgttacgctcgttacgatttaatgattcaaacacttcatgaaaaaaatgttcataccaaataaaagtactaaaatctctaattctacagc

SEQ ID NO: 39655 - DNA, 168 bp, Oryza sativa
ttaatattgaacaagttaccatgcatgaaatagatacgttcagtaagatggaaataccggggagattaaaagggtaaaagctacatatatgagggcctagtcatgcacctgataaatatttttgtcacaccctatcctgtgttgaagctgacacaacatacctctttc

SEQ ID NO: 39656 - DNA, 191 bp, Oryza sativa
caaaatgactagatgttggtttaggaaatgcttagccatgcttagttcaactagtatacaaatggggatcacattattgcatagactttgactattagcatagctttggattggtgccaccgcaatggtgttagttaattaaaatacactgaatggtgggctgtgggtgcatggttttgctggtcgcacca

SEQ ID NO: 39657 - DNA, 216 bp, Oryza sativa
tgtgggtaatgctagaaagtcttataatatgaaacggaggaagtattatttttatatgcatgataacattatccctgagcatactgtgttgtttctcaagcagtcaaatcaggtttgagatgccatgtatttatgcactctgtagtaaatagttatttcattttgcaatcatttggcatggcatttcatttcttttcatatgtgacaatgttatgt

SEQ ID NO: 39658 - DNA, 167 bp, Oryza sativa
tcctgcacccccgtcagcgattaccgcgcgctcgccgggctgatccgagcgcggtgaggggaaaggtgctgccgaaggcgggcaagggctgtcatcctgccccgcctaagcttgaaatagaaagaccattccgttgacgggaagcgactaaacacgcattttagtga

SEQ ID NO: 39659 - DNA, 1055 bp, Oryza sativa
ccatcgatatgatccagtccgcctcttgtcccgccgtgcaaccacaacactatgtatgcatcacaccagcagtcccttgttctctggctactatttccaattaaatggcctcactgtttggagtttatggtttataccttgaacccactctgtctgcccgtctgcccggatcatatatatcatgacatctcgtacgtatcctcttctactacctcattgtctccaccccccccccccccactgtcctctcttgccctccaaacattgcatggatatatacatcacttaattgatcgtcaagacgtcaatggtgaatgtttttctattagtacataattccactattccataaaaaaaaactcaatctaaaaggggatgtggtttctcctagtacaatgaatttccaaaaaaaattaatccaggaggaatgtgacccctcctaatacaatgaatttggatagagagttgagtttttttctggaacgaagggagtatatatctatgtgcttgttaattgctctacacttccgtggcactgataggcgagccactccgtattctacgggtaaatttgatttctttttttttctacatagggttagcggaggtcaactagtggtcaaccgatgacgatagatggcaaagaaagaaagaaaaaaacgcttcatggcatttcgtataactcacgtttctcaattcgtacaactgatcatttgtcaattgcaaaacatagaactaatctctaggccatgtgatcaagttttgcatatacataatttagaaacttttatactactatgtaacttgtatttttcacacaggactaatggatcgatctcccttggtgcattcgggtgaggccggattatatatgtacaggggatcgcaccgatggctaatcaattggaacagtagccggcggttggacagggccactacctagctgactgctcgctctgcacgcagagagagagaggatacactgtgatgcacagctctcacacttaatctgacgcctcccctccatcacccatatgcatcgatcggagatggaa

SEQ ID NO: 39660 - DNA, 1501 bp, Oryza sativa
ttgtagaaacggaagcttgaaaggtatgtatatgtactacgccttgtttaaataaggcagtgtaatgctccaatattgcttgttcacacttgtacttcatccgtttcataacgtaagactttgtagcattgctcacattcatgtaatgttaatgaatctagatacacatatatgtctagattcattaacattctatatgaatgtgggcaatgctaaaaaatcttacattataaaacggagggaattagccagattaaggccctgtttgggggagcttgtcccagctgcagcttttcccaaaagctgcttctactagaagctgcccaaacagtccacagcttctgagaatatgtagttacaaattctgaaaaatgaactaagaagctggagaagctgggtttcagagcttttccagattctcagaagctggctaccaaatagctacttctcagaatctaaagctcccccaaacagaccctaaaccaagataaatagagttggctagctttgggaaataaaattatggaggcaatccgatccatacaaatcaaagccgttactgaactttgatcgaacaacttcttgagagacatgaacatgtggacgagtgatgattacagtactagtaaacaccatgcttaaaaacactactaagtcccaaaataagtgcaaccattacacagctgtacttattttagtacggatagagtgtgcatatatggattgaaacatcgagaatcaggactgctaggttgaaatttatgtgacctgatgacgacctagctagacaaggacatactgatagtcatatttccaaatctgaaaaatttatttttaataggcatatttcaatccaacaacttatcatcttaatgactttcttggatttaatgcatgactcttcattcttccatacatgattggctacatgggcattgagaaatgtaaatattaatgaatcgcttgtttacgaggaatgactagtagcatatttaaatggataataagtagaattaattatccttggtctgtgtgccaagatgaaatatgactatcaaaagtagatggagggagtacacatgcatgtacatcccactagtccgacaagtagctagctactccatttccatttagaccgacctttggatagttatattttaaaatggagggattacttacactattgacaagcgttactttaatccgatagtcgatataatattttgatgaacaaatattgtgtaatcatatttaacatacaacatacttcaataatattttcatgaacaaatattgtataatcatatttaacattacaacatagtacttcaataataccatggtatatcttcaaacattttacagatttattactcaaataagagtaatcagagtttgattgtaaacagtgtctggtgagtatttgggaacggagataataactaccaactgatcgatcgacaggttcatcaagtgacaacctttaattttctgcactaga

SEQ ID NO: 39661 - DNA, 182 bp, Oryza sativa
atttagaagttcctttcacagaggaagagataaagagagcggttttccagtcaagatcagatagtgccccgggcccagatggtttcacaggtggtttcttcaaaaaatgttgggaaatcattcaacaggatctagtccaggctgtcaacagggccttctcctccccgccagaccgtcttaga

SEQ ID NO: 39662 - DNA, 303 bp, Oryza sativa
atatgcaacaggtgatgcatccggacttcatagtaccaagtttcttaattttcatgcaatttttctctgtccaggctccagagcccctggcgttcttgatgttcatgtgatgttcttagtaacattttttgacttttgtgaaaacagacgattaccaagctgacagctcagtgcagtgagaaggcttttgaattagaggtgatattttaaaaataaatgtttcagtatgctgtctaaaataaaatttatcccataccaagtattaacttttctcacgattgtgcctttttttaatgctacagt

SEQ ID NO: 39663 - DNA, 1154 bp, Oryza sativa
caaccgcaatgctctacccctattgcattatctccttgggatgaaacaagtgactatcaaggtgaagctgttgattctgctctatggggtgtccaagatgaccaaaacaatgaaatgtggtcattgtcttcaccaacacctactctccaaccttcaggttaatggaaatacctttttttaatcactttatttgtttgcttgataatatttaatcttgagatattctacaggtattggagctgataccaaaggtgcttcctgtgctatagaagaggtgatagtagcccaaggaaatagtggtgttgttgaaccgtcaccagcactggagaagaaaaggattgaaaaagtaccaagtgcttccatagatcgtggagtaccagagcaggtaatgctaacttaaatatttaaatactaggcaaaattcatcagcattatgcaaagagaatcctagcaacatgatgtacccaagttttaacagcagttttattttgacttgtttaggtaaaaccaaaatcagatgctgcattatctccagaagagagcagaaaaccttcaggtttgcaactatcaagcacatatctacaagggagcacaaaatcttcaggtttgccaccgtcaggcacatctctagatgggggcatagaaccttcaggtttgctaccttcaggaacttctttggagtggggtacaaaaatttcaggtgtgcaatcctcggcctcatctctagaggggagcaaaaaggcttttgttaggcaaccatcaggctcttcactagagggaaacacaaaagcgtcaggtaggcagccgtcaggttcatctatagaggggagtaagaaaccttctgataggcagccatcaggtgcatctcaagaggggaatacaaagccttcaggctggcaacaatctgtgtcgtctcttgaaggtggcacgaaaccttcaggctggaaaccttcaatttctatagacacgaatacaaaagcttcaggttggctgcgatcgagctcatctcctgatgtgggcagaaaagcttcagcatggcaatcatcaggttcttcgcctgttgcagggagctcaaaagcatcaggttggcagccatcacctcgcgagagctcgaaatctaagcctaattccacatggggtgccggccaaagccg

SEQ ID NO: 39664 - DNA, 1501 bp, Oryza sativa
atctacgtagctacagcctaactactcctatacaggaaaaacaatatgaatgaatgatgttttcggaagaaaacaatggccagagaaaataccatttataatgataactgctgaatttgacattggtaattgtatataaacaaagtaactaaagatgactggataattcaaaaaatgtaaataaagaaaaggaaaaaaacccaattagcattttctcaaatattctggaggacaatgatatatattttcagaatttcctttcaagatagaagatacttcgagagtgaagaaccaaagtttctctaaattaaggaagatctctctggcaagaggctaacagcgtcggcatctcgtaactgattgaacacataacaaagtttcaacctcatggttagccggccagtgattagtaaatttcaggtttggtgcacttttcagttttggatatacttgaagatgctgcaaactgctttagtttatcggtgaaccaccatgatggctttggaaactgaaaagcattggggggtagttttaacctgaaagttttttggtagagggtacaaaaatatatagttcaaatccaagcacatatttaaacaattttcttccttttagggtgaactagttatatattacaactggatagtccatttgtaaatatagtactagtgtgttgtcgcagaacttgttacaattgtatagtcctttagttttttgtactaatgtcatattggcaacacatattccttgttgagttggtactacctgcatcagcaccttaatctttcctagtttgctctgctaatgatgaacaatgttatcaccaagttagagcagttacgtaactatagagtatttgttgtacaaatttcttagcctacttgccactaataatataatggcaatatattcactcttctttacgagaatacatccatcaaaatcagatatgatctttgtattatcaataaattgtttatctatggggtccatgaatatgtgattgtggcttaggtcgtgttcgattcagccgtctggcagtattattgtttgtaattagtattatctattataaacttaaaaataaatatacttaattttaagaaatttttatataaaattttttacacgaaatgtaccatttaacaattttaaaaagtgtacttactttatgagaaatgagtaataaagctcatccgagaatccaaaaagaacgaaccttaattaggccttgtttgtttcctattgagtttttgtcttcaacttaaagccaacgaaagcttaaggttctcgaaacgaaattgtagcttctctacttctggaagaggctaaaagccaaaatggaggttacaaatgtatctatcagctgtgatcgggcccacatccatacatttctttaaagaaaaagaagaaagagaaaaaactctgtagctagtttttttttttattttttgaacttttaaattttaaaaataaacccttataaaacttgttttcaaga

SEQ ID NO: 39665 - DNA, 1501 bp, Oryza sativa
  unsure (1)..(1501): unsure at all n locations
cgccattgccgcgatcggatggcttggctgaggctcgccggtgggcgtgggcgcgggcgcgaagccgatcgaggaatcggtgccactggcttagccgcggcgcgcgcgcggaggcgaggcgagggcgaggcgcgtgcgccgtgcggggcgtgtggcgcgtgtggcgcggtgggaatggctgcctggctcgatcggcgccaccccgtcgcgcgcgcggcgcggcatgtcgctcgcgcatggcggggcgcctcgcgaggtgcaagtggtgttcgcgtcctcgcgagcggatggcccagagacatttggatgggcctcaatcacggcccgtttacgtgtagccatacacttggatgggccgagattgaggcctagctaacgaggccgtaatgtgagatatttggaataagtttacctaccgtctctcaattttacatgagtatgtaggccatccctatcccaatatcaaaaatgtctaccctcaaatggtcaaagccatgcaaataggtctcatggcagtatatatgggtggctagtggttacagcgaatgagcatgtgtatatccaaggtaaagggcaagagactctgtcaattcatccaatgagtaagcaggacagttaagttagaaatcctttaagtccctcttgaatttaagtaaactccgaaggactcccagactagctccgcagtacgagccccatacggagccgcgcccttgtgatatgataagaagaaaaggggccaggccgccctcttttcttttccgcaccaagccttctcttcttgtaaaatcgggtgtannnnnnnnnnnnnnnnnnnnnnnnnnnnnnnnnnnnnnnnnnnnnnnnnnnnnnnnnacgtgacatcctagttagcaaggagggaataaaaaaaatttgtggaagcccacatgacatacttactcctccctctactctatccaacgtttgcctagaccatggtctggaccgtctagaccccgtctagacgcaagaccgtacataggtttttgtcttgtttagggcctaaacactattttcttgtctagatggtcaaagactgtctagtccaagtaattagaccatgctgagccaagtctagaccgaaacaatgatacctagaccatggatggacccaaaacatttggtgggtaggagttcaaattttctggcctaccaaggccaagatgatttaaatttgaagctaattgaagattcattattgcaaaacaaggtaaaccttaaatctcatcttttcttgctctcaaatgttctattgaacttttgacttgttgagtgaatttacatatatagcaacaaaatatgctggtagcataatatatggtatacactctagattgagagttaccgtccatctagcatctagcgtctaggtgaacactgactctatctcctctctctctctctccccccctctccagtagcgcaggcgggcggtgtcgggcaaagcgacagcgcacgaaacaggccaatggggcggagt

SEQ ID NO: 39666 - DNA, 349 bp, Oryza sativa
tcagttatttttgaacttgcccttcatgccttcaccaaaggattggttgatgacctacccagattgtgcataaaattgttctcatatatacatatagaatttactggctgcaccattgcccttgtaatccacaaccatttctgctggctatattcttctgtttccagctttgcagttagttactgcctagccttcatatttccaatcctatagtgtaaatactgtccaagtgatacctatgactatgggcagtgccacatttatttaagaggtcttgtcaaattttgaggtttgttagatttagttgtattctatatgtagttatgtacattcatctcaatggatttaa

SEQ ID NO: 39667 - DNA, 1501 bp, Oryza sativa
tttccatcacatcgtttcaattttaaccaaacatctaattttagtgtgagctaaacacacccaagttgcatgagtctcctctacaatggccgagtttagttccaaattttttcttcaaacttttaacttttccatcacatcaaaacttttctacacacaaacttctaactttttcagtcacatcgttccaatttcaattaaacttttaattttggcatgaactaaagttgggaactaaaccacaagcgtcagtgaggatctttttccagccaagccatggccatatcaaccccgcatgcaggcagccatgcatgccatgcacgcatcggcatcactgtccaaacggcagctgcactctgcaaaccgttcctctcgagctcgaagaagtttggagtttctcccctggaaggtactccctccgttttataatagatgatgtttttaactttttattcgtaacgtttgaccattcgttttatttaaaaaattagtgtaaatataaaaaaagataagtcatatgtaaagtacttttgataataaaacaaatgataaataaaataaataataatttcaaaactttttgaataagacgaatgatcaagcattgacaaaaaaaaactcaaaaagacaagtaatataggacggagttagttgcagcatctcgctctcactctcgtagtagtcagtctcgtcacgaggcacgagctagtatacctggaatcccaaaatccagcgccccaatctcccctccctgaactgtcatgtcacctcaattctagcggaatctccccgtgctgtagcatggcaacgcccgctgctatattgctatccgaagatctggcgatttttggccggcaattcgacaagttttttagatcgctggccaatatagtgcaaggatcttggcgaggccattggcactgggcagggggggcccgtggatgcatgtggcgttttccatcggttttaggtcggtttggtactttggttgtgtgtttgtttgatttgtcttatagtttggtttggtactttgatttgatagttgcacgaccctattgattcacttatgtttatacatgtaagaaaaaatttaaattttaaagcttaattttaaagttgattttgtagtatcattaatcatggtttattttatagcatttattttttatcgctaagaataagtatataaaagttttgagtaaatttcacaaaactacatatatattgaccaaaatatcacaaaactacagatttaaaatgatgcatcacaaaactacatatttaacacaaaatttatcacaatactataaatttaaggtggaatatcgtaaaactacagatttaattacaaagttatcacaaaactacaggtttagcatcaatttaattgcaaaacatggttttttaaactcaatcataacattagtgctaaggatttaaacttgtcagggttacgggtaaggtataccctctacccttcgatatacgtcacacatcgata

SEQ ID NO: 39668 - DNA, 1501 bp, Oryza sativa
tgagccgccgccgtgcacccggtccaccgcaaaccctagccgctgacgcaataaacccctttttccttttcaaaaataattcattattgcgccataattcaattaaaacccatataagtgttttaatctgatttaatctttaaaaattcataactaattcatcttagctcggatttagttggttcaagtctctaaatttttctaaaattgagatctacatgttaaaaatatccacatgtattgttcatgcttgtttatgtgctgttttggtgtttttgctcttttctgtttagattccgacatttccgaagagttcgttttcgcaggagaagaatttgaagagttccaagggcagcaaggaaagtcacacagatcccaaacaaccctttgagcatgttgatcccgtttaaagctattgtttctattcaactattgcatttattttcgaatgtcattgggtggaattaacctattgtttgttataccccttttgttcttgattactttattccttgataccttgggttattataacttgactagttgggctttatatattggttcagctagatattagatatgattgcttagccatgcttagaaacattagcacactattgggataacttatgactcactattatttaatgatggcttaatgatagttcacgatggtcaatcgtgattggttaattaattacttgccaactaaaacttgataatggtgggttgtgagcacatggttttgagagtcgtgctcatgacaattaaggaccggttcacgagtttcagttgtgaaacattaaccgtgccaaccacaagccagcgtgggcaacggctttaccttttgtatagcatggttcattgcggagcaccagactgagaagtggtggagataatcccacgggggtcgctggggagtccatgccttgtttataagggggtgattatgatctaggaatggtgcactgtggtggattgtgttgtgcgaggggtactgtcacagctcctttccgaggtaccgtggtggtattgaggcacatggtgacatgttgtggggctgtgtcttgtgggtacagtggtacacctctggccagagtaaaactattcgaatagccgtgcccgcggttatgggcgggtctaacaatgtctttcgtgattagtctcacacttctcaccataataaaagatgctataactggtaataatttgattagctcctggtttggaatggtatattcctggtttggagatagaactgtgcagccaggattggttgtacagaatggttgggcctatgcaacagggtatgttgtatagcgttggattaatattgcttaaattactacttaactattttattaaattctgaaatgtttattaaatgttgtttatgcaaatgaaaccctactatgccatcctttgttaccctgtgcacttgcatatttgctgcgtggcttgctgagtatgtcatatactcaccttgcaatcattcatcaga

SEQ ID NO: 39669 - DNA, 1501 bp, Oryza sativa
atagtagggtttcatttgcataaacaacatttaataaacatttcagaatttaataaaatagttaagtagtaatttaagcaatattaatccaacgctatacaacataccctgttgcataggcccaaccattctgtacaaccaatcctggctgcacagttctatctccaaaccaggaatataccattccaaaccaggagctaatcaaattattaccagttatagcatcttttattatggtgagaagtgtgagactaatcacgaaagacattgttagacccgcccataaccgcgggcacggctattcgaatagttttactctggccagaggtgtaccactgtacccacaagacacagccccacaacatgtcaccatgtgcctcaataccaccacggtacctcggaaaggagctgtgacagtacccctcgcacaacacaatccaccacagtgcaccattcctagatcataatcacccccttataaacaaggcatggactccccagcgacccccgtgggattatctccaccacttctcagtctggtgctccgcaatgaaccatgctatacaaaaggtaaagccgttgcccacgctggcttgtggttggcacggttaatgtttcacaactgaaactcgtgaaccggtccttaattgtcatgagcacgactctcaaaaccatgtgctcacaacccaccattatcaagttttagttggcaagtaattaattaaccaatcacgattgaccatcgtgaactatcattaagccatcattaaataatagtgagtcataagttatcccaatagtgtgctaatgtttctaagcatggctaagcaatcatatctaatatctagctgaaccaatatataaagcccaactagtcaagttataataacccaaggtatcaaggaataaagtaatcaagaacaaaaggggtataacaaacaataggttaattccacccaatgacattcgaaaataaatgcaatagttgaatagaaacaatagctttaaacgggatcaacatgctcaaagggttgtttgggatctgtgtgactttccttgctgcccttggaactcttcaaattcttctcctgcgaaaacgaactcttcggaaatgtcggaatctaaacagaaaagagcaaaaacaccaaaacagcacataaacaagcatgaacaatacatgtggatatttttaacatgtagatctcaattttagaaaaatttagagacttgaaccaactaaatccgagctaagatgaattagttatgaatttttaaagattaaatcagattaaaacacttatatgggttttaattgaattatggcgcaataatgaattatttttgaaaaggaaaaaggggtttattgcgtcagcggctagggtttgcggtggaccgggtgcacggcggcggctcacggaaacgaacggccgagatcgatcctaaccaaaacgaacggccgagatcgaccggtccacggccggaccacgacggacggcaacga

SEQ ID NO: 39670 - DNA, 1237 bp, Oryza sativa
atatgatgatggaacgacgagacgttcctaagcaagatgtgctcccgaattatgcgtgctcgatggtcttatcagttctcgaagaaaatgcttgtactggctggaacgcctgcccaaacctgactgagaccataaagaccgtaggcatggaaccgatgattctgatctagatacgtatggaaactggggagcaccacgtgttcccggacatggcgattccatttttggtactgttggaagaagaggatgtgtggtttctaccgatgactgacgaagacgcccaagggggcatacagctataccggaggagagcagcggcaactctgcggcgcgaagtcgccactggtggagaaaccatctttcgtcggtcggccgatttccacaatagtcccggatgcaataaaaaccggggctaaagatgatctttagtcccggttcaaaagggaaacgggcatatttgatctttagtcccggtttgtgtcccaaaccgggtttaaagatcatgcttagtccgccttcgaatgctgtcagcacctgtcaggccccgccgggatctttagtcccggttggtagcaccaaccgggactaaagatcttaactttagtcccggttggtaataccaaccgggactaatgatcccggcgatctttagccccggttggtgctaccaaccgggactaaagtcccacccctatatatatgtcttcttcctcctccagctgcccgagcaagcttcaaaattacttcaaaaaagaggggaggtcatgccaaaatttctattgaatttattttggtgattacatacaaatcggaggtgtctaaaaggtttgcaatttcatcctccaatgttttttttgtcatactacatttgcacctatgttttgcacacctttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtgcggtttttttgacacatgtaga

SEQ ID NO: 39671 - DNA, 397 bp, Oryza sativa
cgaggtaggggatgacgggtgggccccacccgtcagcgagggtggcgggcgggcccgcccgtctgcggcacgcgcgcggggaggagcgcattgggccacggggaagagagagagagggagggaggtgggccgagccggcccaagaggggaaggggaaaaaggactttttagggtttttctttttataaaacctttttaactttgtttatttcttaataattattatttgtgctctgaaaattccactaaattttatttacgcattttaggcttttaggaaatatacaaaaatcctccaagccttatttgacttttaactttgcacattttaattgttggaggctttcacatggattttacttattctatgcataattttgaggatgaattttagagt

SEQ ID NO: 39672 - DNA, 741 bp, Oryza sativa
tgtatatatatatatatatatatatatatgttacttcgcatttatcctaatacatattttttatcttgtagaaaagacgtgctgtaggagtcgtccgtcaagcctgagtggaagagctagccctagaaggaattggagcaggcaagtgacgtaataatataaatgattgttatatttgtaatgcaattaattaagattattagacctgtaattagacttatcatataagattgtgtagtgttcttatattatttgagttttaatataagattattttattgcaaattagacttagtatgacattattgactacggaattggtgcgactcctaggaattgactattgtagtcttaattagacttagcatatacgcacgaaacacttagcatacattactattttagtcttagcatgtaatattatttgagttttaatataatattactttatttgtaattagacttggtatgtaattattgactacggaattggtgcgacaagtagcaattgactattgtagtcttaattagacttagcatatacgcacgaaacacttagcatatacatgactattttagtcttagcatgtaatattatttgagttttaatataagattattttatttgtaattagacttagtatataattatttactagctagggttgtataatatacatgacttagattgttaaaacataaatgtctcgtgacttagcagatgtttcttgtatcaacaga

SEQ ID NO: 39673 - DNA, 1501 bp, Oryza sativa
accccttttattattgccgaattcatgtttcgacattacccgcgagaaatcccctcccagaagcgcgagcgcaagccccggccccctcttggcaccttcaattctccttttttttcctaaaaaaataaataaacaatctaaattcttaatcacaaaaagataagatcgaatttatatatctaatacgtaaggtttcctgttgtttttttttgtccggctttgcttgcgttagaatatttgccacgtgcgtcaaaaaattttctgtctatagttgctcaaaaattcatgtgcatgttatcgcgtgtgtcattcccgtggcaagaaagagaaataaacccgatcctaccctattctagcatagtatttacccgttgcaacacacgggtattttttttctagtatatctatacctaattaaaaagtaagcaatgtttccgtaaaaaaaaaattcgtccgtcattttttttctttttcgttattttttccttttttttctccatctgtttttttttatttctttgtgtaaccgtataggactctgtggattcaatgaaaaaaccggacccaaaaaaaaccactaatcacgacccactaataaaaaatcggacggaaaaaaaccagggaaaaacggcgtgctaaaaaaaccactcggacagaaaaaaaccggggaaaaaaccgatctgctttttactttttttttgcctttattccgggtttttttcatatgttttttcttcattgctgtttttttagttgcatttttccgcacgcggtaaggatttgtgccatattttttttgtcgcgcgaccaaacactagcgccactgccatgtcaatctacctccccatgcgttccctcatccaattgattgctaaaaatcaattccccgctactccctcaccattttcctcgtgattttccattttaactccgctttaattcactgaatttaatctccatttaaaaatcaccatttttatcccaagttttgtcgctccgattttaataaaaacggaaagagaagaacgagtgtattaaaaaccctcaaccaattttggaagatcgagaaagatttgactaaatttgatgtggaggatttgatggggaggatcggttttggcatgtacggacatgacattgtctttcggaggttggaaacgacagtgggctatgcgagctgacctatagctccacttgacaaggaaggaatgaaatgagtttttggtccaaaaccaaaaaataaaatatatagcgatccaaaaatgtttttacccgttgcaacgcacgggcatttgttctggtaattaaaaaataagtaaggcttcgggtaaaaaaatccgtccgtcttcttgtccggtaaaaatctaggcgtttttttatggtttcgctgattccgtctcatccgcctggctcgcacatgggctcaattgcgtccgattgcatctgacacgcgtgttcgccttgcacacacccgctgcccgcctgcgctcgcctcgcgcgc

SEQ ID NO: 39674 - DNA, 215 bp, Oryza sativa
gttattcacccgggactaaagatagcgatctttagtcccggattggtaccccggtttggaaaccgggactaaaggggggttacgaaccgggactacaaagggtttctccaccagtgcgcgcgaggcgagcgcaggcgggcagcgggtgtgtgcaaggcgaacacgcgtgtcagatgcaatcggacgcaattgagcccatgtgcgagccaggcgga

SEQ ID NO: 39675 - DNA, 805 bp, Oryza sativa
gtgtgtcgacgggggataccggtagactggatatagagggtattggggtacgctggtacgacgatctacgtaatacgacatcaagcaaacaaaaagacaaggattatactggttcaggccccttgataggtaatagccctaatccagttggtatggattatatgagaaaaaccacagattacaaagggaatagcaaaactcgatgataccgaggagaccgtagtcgagttggttcgactagatcacccggcgacttagatcctgtaggctccgacttcgtaggctgtggtgggtgtgttggtggtgagattcgatgccttaggtcctcccagggggtcccttttataccgcaggtcagttgatctccaagtagaactcggagatatcggaccccacacgatacagtagcacccgacttctgcttaaataaactcatgtgaccaatcgcgacttctgatgtcggaatcgttatcgctctcaactggtcgatctcggtatgataaccgtagagacatagagttatcgataacattgcacgaagttcaacggtcatgagtgaatttaaattgaagtttgaaaactgctgcgcgtaacggacccagaaatttccagcggccatctctctcctttccttggaattcacaccgtcagtagtgcgcttatttaagggagttttggggatccattttgaagaccgtttgctgcaaaactttccagccttcaagcgccccttgtcttctccacttccgcagaaaaaccctagtttgctcatctcggtctattctccaacgatctccggcggtga

SEQ ID NO: 39676 - DNA, 1501 bp, Oryza sativa
caagagcatctccagcaggggccctaatcacaaagctcaaactgatcttagggctaaaaggaaaaaaaaaacaagctccaacggggccccaactatagggaacgcccccagattctcctccataggcctcgttcctaggggttctatccacagcccccatccaaattttttggcgtatccaaaattttttttgttcgtgcattcggcctctcctcccttccatggtcacgctacaacactacggactctattcctgtcggttgcgctcctgccgccggtctccctgaatcttgtgtgggtgggtcacaatcctcctcgatgtctcctgcaggttgtcttcctatggccctccgagctcatctgataactgactactcccaacagctacctatcagggttatcgatacggcatacctcttattcttggggttatgaaatatatgaacagggtatacccttaagtacacaggaaggttactttagttacaaggaattggaccaatgcataaggaaaccaactccccaaatagaaaggtgttagaatcctatttcagaggaggtgttagaaaccatctcgtatatgcaaagttctctccgagttctacttggaagccaagccggtttgaggtataagtatttggccccagagggtacgggatcatcgaatcataatattgctacctgccataacagaagcaacccggaggactcgaaaccaactcgtcgattgatctcgtcctcaacaaaggtgtaatcggtaactcgtcggttctgttgttatctattgtaatcttggttattctcttcataatcccatataaactggattatggctattaccttacgagggatctgaaccagtataaatcttgtcttctgtgcgtttgatgtcgtttcgtgtagatccttgcttcaacatacccccaataccgtcaggatatggtccgcaggtatcacccgccgacactaccctcgtatagaggctccagggctgcgcttctcctctaccggatcgtcctcactactcccacagtgtcagggttacggataaggtataccttctacccttggatgtatgttgtatactgatacggtatacctgcgcgtatacggatgtttcctgtacacgttaaggaaatccatcacgtaacagaaacagagtccacggatggaaggagtcctactcggacagaactgggtcgttactgtatcgtgtggggtccgatatctccgagttctacttggagatcaactgacccgcggtataaaagggaccctccgggaggacctaaggcatcgaatgtcaccaccaacacacccaccgcatcctacgaagtcggagccaacaggagctaagtcgccgggtgatctagtcgaaccaactcgactacggtctcatcggtatcatcgagttttgctattccctttgtaatctgtggttttgctcatataatccataccaactggattaggattattacctatcaaggggcctgaacca

SEQ ID NO: 39677 - DNA, 1501 bp, Oryza sativa
aagggttgaaaattgtttctaagttggatcaaccttcaaaaaaataagtgaggggtaatatttttgccaagcttaaagattgaatttgatccatgtgacactgtcttcaaggtaaacatgatttctatttttaagattgcattttggtttgcagtagacgtacacattataactattgttttacttttagttcatccatgcttattaaagctccatttatgcatacagaatctgtatttttcgacacctccccccccccccctctctgaaaatcaggtatcttttgtatgcaaatatagtgagttagaaagtttcgcaaccatataatcatattagagttcagaaccatatgaatcaaccataaatgatggatggccttagtagaatagtatgtgtgccgctgccatccaattaatttttgtaccatgccaaattttaggtatgcacaatgattttaagaaagtcaagattcacaaaaattgcactccgtacgattgtaaaacacaagggggaagtgtgtgcttgttcaggtaaagtaatttcataatccttgtgtggattctggctatttgtgctgaaaccatgatcagatggaaaagtaaaagatcgaaagaagtgaactataaactgaaattttgaacttcaactcctttgtaagatgataaacccagagcccggaaggtatcacctaactctggtgaaaatgccatactcttctatctccatctgtatcccctgcaaatctgcactgcctggcccttctattcattttcataaatatgtatcagagtttagaaatagctaaagggtgaattcatatgttgaacttctctcttgggataacaaattagtttatgccatctggtgggaaatcttttcccctcctaaaactcgtttatgccaccatcaaattaaagaagtgtttgtccatgatgagtcctaaaatttctaaaagagttatatttttcccgttgcaacgcacgggcacctaactagtgtaacttatgtttatatcagactatattgttcaagctatcttacacattatttttacttattgttattaaagtaaactgccgcaacaacgcgcggggtttcacctagttgttaagaaactaactacagggtgatctcatccatataagatgggatcagcaaccgacggcaaccgtgccttctccccactcggtgctccttggaaacgggcgcgatggttcctaaccattgcgtctacggttgccacccctttcccatctatatgattgtcccgcattgatcaataaagtaatatctttgtctcgctcaatctctctcaaactttctataatgcgctatcagcacttccgctctctcgcgaaggagaaagagaaggagaaacaaaagggaatcaacagagaagatgtctaaggatattgttccgattggagaggaattatgtcttgtggataatggtaccacaaactctatatttagggagctcaaatactttcaaactctcaaa

SEQ ID NO: 39678 - DNA, 1501 bp, Oryza sativa
tctaatgacaataaaaaaaatactagtcataaaaagttaaataaaacagacgatcaaacgttgaaaaaaaaacaaaatactgcacctaaaatggaacggagggtgtacgttgcaggcaaataatttcagaagataattaacctggtcattgatgaatcaaattaatatttggatttgccaaaaaaagtttatttaattttaatttttaaatatttgattgctattcctatatatgatataagtatgtttcgatctcttatatctcctcttacaaggagataataaaatacaatgtaaataccaaaaaatataatgtaagttatagggtaaagatgatttgactattttttttaaatatgacttaaatatatctactcctacaatcttagtgaatataactaataatttattttcttttagctatccttttctccattaataacaactctaaattaatgactgtctatatatatgctcttatctcgaccaaaagtcatcgtattgattcactcgcatcaatcgattcatctaaaagtttaaacttacgagaaaaggacatacttttgtttagcgatacggacgattccgtcgtacttttaacacgttgaaacctgcaagtgtgaagcgttggactagctgccttttcaattcgggcgtctaaaaagaggctttcggcaaaattcagtttgacccatacaaatacctctgactgacaattcttggcacgatcgatcctgccatccacacgtgggagatacaaacaaaccaaaccgtatatatgattgagaaaacatgcgtgcgctgtgcgtcgccatcgatatggctttgagcgagccatcgaacgattagacaaatgcagcgtgatatatcatattatatgtacttcgcaatccagggattcatgacatcttacctcggtttttttaagcatattttctaaactgataaacgatattttcatataaaaattttctacttaaaactttttaaaaatattagataaattcaattttagagtttaaaataattatacctcatttgatcatcatgcgctagtggctttcttgttttacatgtgctaactttatttttatcttaatatatctcaaacaccatcgtcgcatgcaagttgcagcgtgcatgcagcgagattatcaggttaaatatttgcaaagaggtttggcatgtgcggaacgtacactcctcgataaatataaagaagctatttaggtcatctttggcaaactttacatccaaaatttttaaacctggatatttctaacaccgcaattctatagattttagattcgtgataacgttgatagcatttagataaattattttgttaccattttaataaaattttaaattttcaaccactataatttaacgtataaactttaaatctatcgtgatatgagatttagagttttgccaaagaaagccttaattatcgagtgactggctttttctttcttactagtcgatttgcacgtaaatc

SEQ ID NO: 39679 - DNA, 366 bp, Oryza sativa
ttttagtacactttatttttccaaccactgttgagtaaccacgtcttttgacatatgcagttatcgtttcgacaacagacatatctactagatggtctaatgcgtgtgttctatcgacatgaaaccatgcctttgctaacgaaatatctcaaattgttgattgctatcaagttgatccagaacctaactctgactagtgtggcagcattatttggtcacgctggtttggctagagtggtagcgctatttggccacatcaccctcgccgacgtggcaggataaaactgttacacccgttatgtgtggagtgtcaatgttgttttgtcacgcaagacggactggtgtggctaaaaggttcagatttta

SEQ ID NO: 39680 - DNA, 261 bp, Oryza sativa
aaacaaacagttttttcgtttggctttttaaaaccataagccactctaatactattaagccaaaagctaggttggtggaacttttttggcttatatgaggtagatatatgacttcaccactaaattcaggacattaaatctaccggtttataaatcatataagccaataagttgaattaaaagtttaagggcccctttgaatcgcagggtagaaaaaacggaggaataggaaaaacataggattctgacaggaattgaagt

SEQ ID NO: 39681 - DNA, 1058 bp, Oryza sativa
atgttatgaaaataacgccagcaacctatctccaagcccgggccggcccggcccgagccttgctccgcgcaagggtaacgtgccgcacgattcccgttttccccgtctcccacacttctcctctctgaccacagcacacacgcaacaccgggacgggcgatccggaaggttctggaaccttctagaggctcgtaggagcctccggcggaacccctctcgcctcgcctcgcctccgatgggctcgaagccgccgccgccgccgcagcccagcgtctccttcaagctcgtcctcctcggcgacggtacggctatctccctctcccttccgatcccgcgaaccctcctcccccccttctcaacccccttttctgccgaattcccgatccttcagtttggggttggcgtgcgcaagaaaatagccacggaatctgggtgaattttggctgctcttgtggtgcgtgctgagccctagctagggttaggggaaagccgcagaatcatttgatctggtaccctgtgtaggtagctaaatctatagcttagacgagggagttgagcggttttgagctaagcttaccttttacttgattgccttcgaggcttagcggagtccaggagatgattagaccgagagggctactcatagaaacaatctaacaagtagaagcatattcgttcttatatagaagatttgtctagtgctagctgcagcggggactgctgcaaattcatgtggacacaaagtggcagctgaagggtggccatggagctggtggcagggaattcgtcttatgcaataggggtggataatatttcattttgatccgtgctctctgtccgcttttaagcttggattgtaatgtccagctgatctagttctatattaattggtggttttacttttcttgtcattaccttaaccaacccttgaaggcagggtcctagaaaaaaaaaattcagtatgactcagctttttggtcatctgtgtatgatgccatgggtcttacccatgttcctctagagaaagtgatgtgtgcctttttggaaaaatgatacag

SEQ ID NO: 39682 - DNA, 1501 bp, Oryza sativa
cgcagtgtgcaggtgttgtgaggagaaggaccaagctgacctcgcgccgtgccgccatccatccctccaacgaatgttagccaacgaccggcaagagcatgctcgcattcgattcacattatcacttatcacatatgcataagctctgtcagatctaatggggagaaaatgaacaggaaagagggatggagaaagaagataaggacaatttggtctaaaaatcttaaaaaatacaatgggtatgtaatggtataaatcaaataactattaaattgtaatggcataagtctaaatagttgaatattattggtatatttccaaatcacaaaaattataatagcataatccaattaacctgaaggttaggttaataagaggtagactggttcctgatttgtggcgctagtaccacacctaccaaaaatatattgttataccattcaaactattctgccttattcctttagttgccactttgatatctttcaaaccaaattttcatacacttcttttaaataaccaaattttcagacactcctttcataccattcaaactattctgccttattcctctctcacgccgccgcgcctccttctcctctcccacgccgccgcgcctccttgcctcccacgccgccgcgccaccttcttctcatcttctcccaagcagcagtcggcggcgtgatctttcggagttgcggcggtcgtcagcggcaacttcagtggtctttcggaggctcatcagcacctcctctcccttgatcttggcggcggctcgccggtgcccgggcggccgccggttcttggctcgtccggatccgagttgtgctggcggtcatcggcgcggggccgcggattcgccgctggatttgggggtcgtggcagcggatgtggtggccgcggggaggggggcgggagcggacggcgcgacgccgacgggaagccccggcgaggaggaaacgggcgcgcggcggcgagattattgattgttttttttgtgcatgtgggatgtgttgttcattggttaatatgagatctgggccctggatttctcttgtgttcttgggacggatcgagatttctttgtttcttttgcttcttggtgattcctcttgtgttcttgggatagatcaagttcttttttctgcgttcttgcttggggtgtttcggtggcgggaagaatcgtgggcgaatcagggttttctccactcgatgcggcgcgagggcacggcgcggccaagaaccgcaccccacagcgtgcgcgcctcgcgtcttcctctccttatcgcgccctcgttttggcaaggtttcgcgcggctctgcttgggggcgaggagctctgctagggtgcgattccttatgccacgtatgcttcaatccgagctggcaccgtgtagcaccggtccagctcaccgcactgtgagaggccttatctcttcatgcactccagccagcctcatctccctcatccatcatctatcattctcatccacttgttcca

SEQ ID NO: 39683 - DNA, 1501 bp, Oryza sativa
tgttgggaaaaaaacatgtttactaatagcggtatgatattttgggcattatatgttcccgacatgataaaaatatacacaatgtcatatgtaggctgctgtgtaggatggtctttgaaatgtgtgtggcaggatgcccaatgctaaggccctgtttgattcagcttaggattattataatctggattattaggagtaagctgaaacaaacagatagcttattatgatagattattataatctataagccagattactataatctggtaagccactctaaaagtgcttattttagattattgggtgactagcaactaacaaacatataataatccagagaaacaaacagctaccagcttattctatgttggcttattataatccagcttatagtaatctagttctataatctagattacaataatcttaaactgaatcaaacaaggcctaaatctcgcagctaagtgtcgagaatatttttagaaacggtttttattgaaggtctatttgtaaaaatatatttttaaaaacaatcaagattaaaaaaaagaagagcttatcactctccctattttcagttttgaccctctcatggtctcacattgtttctgttttgttcctcaccaatataacaattccttctatccttctctatccctggacactagtgcctctcccctcttctcgactatccatagaaaccactgttggaccaacacctcatcttaggccgtgtttagtttcccccctattccctactttacatcacatcatatcacatcaaaaactttcctatacacataaacttctaacttttttttcaaactcctaactttcttcaaacttccaacttttttcaagaactaaacacacccttagtcgtctagatatgcccgacattacacgctagccctgtgttcggatttcagggatgggaactcatccctcccacatgaaaaacggaaagatctattagcacataattaattaagtattagctaattttttttttcaaaaatagattaatttgaatttttaaaacaacttttgtatagaaactttttgtaaaaaaccgcaccatttgttagtttgaaaagcgtgcgtgtgaaaaacgaggaaggaggggtgggaaagttgggggccgaacacacttgaattaataagcgcataggtagacataacatgcacccatgagcccatgagcttgtcgaaagctagatttaaccatgagctatctatcttctttgagcataacctcacattctcactatgtgaagctaccatcgtttcaatagtcattgctcgcggcctatgtcaatctgttgctcgatcgactagtgttggccaagcaaaccacttgcgggcgacatgagtttaccccttttgacctctttattttagatcgcacttttctcctcaagctattctctctacagaaggcacacttaaccccaattaaaaaacaccatctcgccttatctctcctctacatggtgttagg

SEQ ID NO: 39684 - DNA, 1501 bp, Oryza sativa
tgatattattagtaatggctaagtagatcgacccaaccataaaagtgcagagacaatgataaaactgtagtgggcttagcatagcacgagactatcatctaatggacaactcatcttttaattgtgctagaggaaaacaattagattacagtttgttctatgtaatctttaaccattcttttcatttacacaagagctaaatttacatttcaattttcaatttggaccactccattatatccatctccaagtctggtgactccagtcactccaccacagctctatctccaagtccagtggctctacgacaactccacacactaactctctctccttgttgctccgataaaaaagggagcccaaatctagtgtctctgctctctgtcgggttggttcctgcctctcgagtctcagcaagtgtgtcacctctggtcccaacgacaaccattacaataccgtgcatgatgatagcggaggagaaaagacatgttgatgcctaaagggtgcggctacacatgcgaaggcagagaagaggaacgatagtggcttatggagaaagaacggtgatggcagtgcatggagcaataactaatagttgccggtggtctaaaaaatttactatcaacataatatgtaatcgagtttattataaatttttaagtaccgctgacatgtggatcatccatcatcataaagaatgggtaacataggaaatttgagagaagttggactgctaagtgtcctccctccccttcccttctcctaaaagaaaatctcctgtctcagtctcctccgctccttgcgccatttcgcagcttgaacaggggaggggcgcgggcgccgagctccatctggcgagcagggtaggggaggggaagggatcctggtgtgcatctacatcctcattctgattcatctctctcccgacctatttttgtcttgaatctgtgcttgcgttaaccctagcttcctcctctagatctggaagaagctcctctcttaatttcagagtcttaaccttaatgcgagtagcagtttgtttgttcccccccaaaagtttgggggtttaactgaaccccaatgtcccaagttggatccgcccctgacgtacaattgtttgctaatttgaaataggcatgtatgcttataattattccgcataatcaaaacttgtgaattttaggagaaaaaaaaaggggcaaatgaatcctgtatttcactggtcagaaatggttactaatgtttttccttgatataatgtttctggatatgtatccatgcttaacaatgtgggtcagcaatattgaactatgcaaaccattactctgtacaatcttttcttttcaaatgctggccacattgcgctcgagcttactgctcatgtgtgcagctcatggaccctgagatctagacgtcaacgtgcttcctggaaagagagaggctcaggcatgagagcatacctctaaaataatgtccgtgcttacctatgtgcttgataaca

SEQ ID NO: 39685 - DNA, 251 bp, Oryza sativa
ccctccaatgaatcttgctctaccaagcatccaccagtatgtagcactacttccactatgacttctttccttgcggaggcaaggtatcaaccttcacaaacatctccatggcacatcacactccacttggttggtcttgggtttctccttctccttctcttaattacaacctcaagttctccaacttgaagcacacaaactccacatcactctcaattccacactctagctacacttgaacacacttgaga

SEQ ID NO: 39686 - DNA, 278 bp, Oryza sativa
aagtgccctccagcggtcatcaggcatgcatttggtacgtccacgccaaaccccacatgcaacggtgaaagtggtggttcgcccgaccagggggtcgggccgaacctgggctaggccctcctggcctggccttcggttggtggactccctggaccttcctctatccatttctcggagttttggattgatttaccgatgtttcaacgaagttctcaacccctccttgtatggatacataattctcctcactttagtctgattttcctcccaacttcagg

SEQ ID NO: 39687 - DNA, 224 bp, Oryza sativa
gcagcccgggtgatgatgtgatatttttgcatgttaagttttaggaattagtgatagtggatgatgatgtggcatctttgcatgttaagtttgcaacacgttcgaggaggccgctgccagggtcctattcaatggcgaattgcctgagcagcgagtatcacctcgtcaagccacccttccgcctcgaggcaccagtgaccaccgtgaccatctaaatggccacc

SEQ ID NO: 39688 - DNA, 651 bp, Oryza sativa
gattaataatattgtatagttctaagatcgtgtttacaaaatagccctgagcaactaaatgtctttaaatgctgtttactgcaaccctaaccctttatattataattcccttgtactcccttgcatttattctgcatttgtgggtgtgtcttgttgagtacggtggttgtactcagtcttgctcaatttttcccaagcccagaagaggagctccttgaagatgaaggctttggtgtctagctcgtgcctgccgtcaagcgcctgtggtcgtcgccctagtcttccgctgtttctcgtttgtctctgtgtgtgctgggccttcgctgcccatgtaataagttaactatttacgcttccgcttgttaaactctgatttgtatcaacttttggtgtaccttgcctcctgggacaaggattcatgcacgcacgtaaggaatgcccgttgggttatttccggtcgtgacaagttggtatcagagcctcccttgaccctaggacgagccgtagatcccaagccttagcaatattttcaaaaataaaaatcctttgttatttgtgaaaactgtctagtctctctctgtcttgctgcttcacttatcatcaaaatctgacctttaaaatgttgtttctctttttgtttttgtttgtaga

SEQ ID NO: 39689 - DNA, 297 bp, Oryza sativa
tgatatgaatatcccaaagtctaaagttgtaaacccacctaatgttacctaattaaattgggaagcatctacctaaatcatactagtgataccacgagtagagtgtccactagttggggttttgtttattctagggtgaccaaggtaataataccaatagcaataataataaggtcataacaaaggtaaataggcatggctaaataaaacagtgataacgcgggaatttaaataaagcgataatgcaataatttaaatcaacataagtttataaactgggattcaatatgatcaaga

SEQ ID NO: 39690 - DNA, 1501 bp, Oryza sativa
gactcggcacttttcttcatgacgatcatgacgaatctgggcataaaaaggagcattcccaaatccaatgacaaaggacatcgtacgcaactcctggacaaaaccttcaactccaaacaggtactcaggcttgtaacacggcatctaaagacaagtgaaaggagagagttaagacatctatccaattaatagcacaagtttttggattaatttgaataaagtttgaaaatcaaagtaaaaaggtaagtaattaaagtaaaccaagctttgcgaaataaattaaaacagttggaaacgagatcataaattttgtaattttgaataactggtttcaaaagaaatgaaagaaaattataaaatcaacatggtaaatttattttattgcagcaagattaaataaaacaatattgtaaaacttttgctgataaatgagccattagtacagtaatagatgtacagtactaataacactggaataaatttttaatgagaaccaaaaaaaaattatgaagtgcatgtgccattagtttggttaattaaaagagaaagggaggagaacagttctacttttccaatatttttagagggcttctatgggtaaccatttggcataacctagggtcaaagaggctctgataccaacttgtcacgcccggaatttctatccaaaattccaaacgcttacatgtgtgtgaaccctcgtccaggaatcagccgaggcacacaataacaaattgataatagagtacaaatattactctaattaataagcgaatagaatgtcattacagaggtagatagttcctctcaatcaataaagttctaagcagcggaaaataaataaacggcgtagacggctccactccacaggcagcttgaccaaggctacacctaatcctccacaccatcagcctcattgtagaactcttcctctgatgaatgattgcaaggtgagtatatgacatactcagcaagccacgcagcaaatatgcaagtgcacaggataacaaaggatggcataatagggtttcatttgcaaaagcagcatttagcaaacatttgagaatttaacaaaacagttaagtaattaaacaatattaagccaacgctatacaacataccctgttgtataggcccaaccattctgaacaaccaccccggctgcacagttctatctccaaaccaggaatgtaccattccaaaccaggagctaatcaaattattaccagttatagcatcttttataatgatgagaggtgtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtatctcggaaaggagttgtgacaatacccctcgcataacacaattcactgcagcgcaccttcctggatcataatcacccccttataaacaaggca

SEQ ID NO: 39691 - DNA, 1501 bp, Oryza sativa
cgagtttcggttgtgaaacatttatcgtgccaaccacaagccagcatgggcaacggctttatcttttgtatagcatggttcattgcggggcaccagactgagaagtggcggagataagcccacgggggtcgctggggagtccatgccttgtttataagggggtgattatgatccaggaaggtgcgctgcagtgaattgtgttatgcgaggggtattgtcacaactcctttccgagataccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacacctctcatcattataaaagatgctataactggtaataatttgattagctcctggtttggaatggtacattcctggtttggagatagaactgtgcagccggggtggttgttcagaatggttgggcctatacaacagggtatgttgtatagcgttggcttaatattgtttaattacttaactgttttgttaaattctcaaatgtttgctaaatgctgcttttgcaaatgaaaccctattatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctacgccgtttatttattttccgctgcttagaactttattgattgagaggaactatctacctctgtaatgacattctattcgcttattaattagagtaatatttgtactctattatcaatttgttattgtgtgcctcggctgattcctggacgagggttcacacacatgtaagcgtttggaattttggatagaaattccgggcgtgacaagttggtatcagagcctctttgaccctaggttatgccaaatggttacccatagaagccctctaaaaatattggaaaagtagaactgttctcctccctttctcttttaattaaccaaactaatggcacatgcacttcataatttttttttggttctcattaaaaatttattccagtgttattagtactgtacatctattactgtactaatggctcatttatcagcaaaagttttacaatattgttttatttaatcttgctgcaataaaataaatttaccatgttgattttataattttctttcatttcttttgaaaccagttattcaaaattacaaaatttatgatctcgtttccaactgttttaatttatttcgcaaagcttggtttactttaattacttacctttttactttgattttcaaactttattcaaattaatccaaaaacttgtgctattaattggatagatgtcttaactctctcctttcacttgtctttaga

SEQ ID NO: 39692 - DNA, 1501 bp, Oryza sativa
caattttgacgtgaactaaacacacccttaacttaactatacctggtaggcattcttttcatttccctgtcctctgctcagaaattgtactcgagcagtacgtgttgagttccgcacacagaatgtaatacgtgcagaatagaacaatactagtactaccattatgtagatgtggatgtttctgttgtaaccatgataaattcatcatggtttcttcgggaagcatgatgtcggtgacatgggaccgggagtatcatgactagaggtttgggcaggagcaatcacccacgtggcctgaccccctcgggggggtcgggcccgaaggtgatgaggccgcccctctctttgtctccccgagggatcggaccactcccgtttcggccccgagggccgaggcgccccgaccccttgtgggttttgcgccgcgtgtataggttaggtgagcacggcggggctcacctaaccgcatttattgcggtttgaacgagcgcgtcacgccgcatgtaacgcagtgcagcgcgctcgtttatccggtctgtgaccggtcacagaccggtcagatcgtgggttaggtggcaacaggcggtctgacacacgcctcgccccatcccgtcaggataagagcctccaggcacttgtccctagccggagccagcgtgctagctcctggagatgacacgttggtcccggtcagatatatgccaggcttcatcccaaccgttacaagcaagacattgtatgaagaagggtgaacatgcagattgataaactgacgcgtggtggacaagaatgaccgatttgtgaccggtctgacactggtcatgtcgttggcagacagccatgttcccacgtcgcacctgcttccggcggaagtggaggtaggtatgggccgtcccatcagaaggtcattcggacggcaaccattacaaatctccgcccatttatgaaggaaaggcgagccaagttttagtgaaaagaggatgggtccccaccaaaaagagaaataggtagaagtggtgcatgtggtatccccttgagatataaaaggaggaccttgcccacttagggaggggatccggaccagaggaccaggggaggagagattggagactcccggaggatccaggagaagatcccacgagaggcaaaaaggaggaaaggggtttctagagtttgagctctctggttctccagctctttgtagcttcttcgtacacagatctaccagaacacaggagtagggtattacgcttctcagcggcccgaacctgtatacattgcccgtgtcttgtgtgtttccactttcgcgaacattccacagactaggagcttagaacctcacccagggcccccggccgaaccggcaaagggggacctgcgcggtctcccggtgaggagccccacgctccgtcatctgacgcgccatgtagggggttctgcgtgtgtttttctaagctctcatactctttcgtgtgcgccaagcttttcctgttcagcccaa

SEQ ID NO: 39693 - DNA, 1501 bp, Oryza sativa
ttgcgaggcggcgtctgcagacggtgggcggccaaaggttagggatgggcctaacaggtgggccctacctgtcagcgcccgagggagaggggaggctcgggcgagcggatgggctgtggccttcggtcggcccagcaacggcgcgggaggtggaggaaatgggccggcggcccatttgggaaaaaggaggggacaaaggaagaagaaaaaaagaaaagaatttccaaggattaaataatgctggtgctcatttttaattggttaaaattatttctagagctctaaaaattccactaaaaatcttgttagcatatttcgacatatagaactcaagaaaaatcccacatgccaattccgattattatttgcattaatttattagggtttgtcttgctttgacaccggtattttctctaggtgatttataattttcatttaggcttgggaaagaaacttcagggtgtgacacgaaccccatgtaatcagttaacacactcgttcaatacaatttcggtgcatcaccacccttttgcttttgttttatttcgacgagtccttgctttcgggttgagctgcatcggtttcgatcttcaacaagaggtaaaacttgttatgatggcttgcgttctcgggattagtgcttccatctttatgatactctaatcatgtttatgtaattcatcgagttatcatatatcttacataatctctggcaatatcattatctaacctacaatcgactaacatctgtcagtagagggcagccgattaggttagattttgatgttgatttagattatataagatctccaccactctatgaaacttccagcggcttgattgtctagatattgttcttcttttcatacttaatgctgcatcacttgagtttgatctattaagtcgtgcttagaatatcagtctctagcctgccttctagttgccgattagggtagtattggagtttcagccgatcttatctggtttaactacatttgctctatatgcttcgttgacatgttaaatctgccctttatgtcaagatattattgcatctacgtatattaaactttggtttggtatattctgcttgttttaatatcttaacatagaactgtatcagagtattagccgatacatgctagatctatctgatcagctatgctgtaaacatatatagttcggttattaatatatatttcgatctaagtgatttatattgtctcggcatagcgaccgatctatcccaatcacttgatttaaatatatatcgatgtaaaaattatatattgttaatatctacagccgatcgaatagatttagtcctttattatctatttccagctgccgatcaaatcgactggtacgctagcatacccgaaggcgagttttggacctgcactggagttaaacagatctcccaggcctcgtgttttacgtcaacactcttttggcatgcccgatgggaccgataagaagtcagacaagcaattccttctca

SEQ ID NO: 39694 - DNA, 1501 bp, Oryza sativa
cgcctctctcccatcggagcacgttgatcttgacggttcctggcgcgaccaatgcgtgcgcgagaagttagacgccatgaattcgtttctcttctctgctttgtttttttttttggctcctgttttgcagttggtgtgttgcggaggtgtcagtttctgaatttgtataaaccaaatgccctcttcttattctttttgctgttcctgatgcaatctgcccgtcttccttacgtattgatcaagtagaacggcgcctcgttctcttctcgaattttaaggcgtttcggaatccgaaatttgctaagattttacctggccgtgatcatttttttcctcctgttcttggcttccctttcccgtgttgttgttgcttgatgcttttgaagttgggtgtgtgagtttcttggaggaggttgaagagcacggaagcttcatggtgatctcgttcgcctctcctcggaacatgttagtcttgatcttgccttccgtttctctatttggtcttgatcttgccttccgtttctctatttctaccagtgcaagctcgagaaattaaaccacatcaattcgtttctcttttcagtttgttctgttttggtatgctgcggaagtgccagtttctgaatttgtattagctagatgccttcttctgttcatttcgctgctcctgatgcaatatgcaggatgcttcttctctacacgtctctctgttttctgcctcgaaagaactctctgtcctattgtggctttgtttactcgatgctattttttcgttcaatgatttctgcatgtgtcgctccattgaattacttgtaaatcttctgattctttacctatcaaagaaacttccatctcttgaatcttgatttggcttccttctcccttaccgagatattgtgcattttttgtctgtaacctgtttttcacttctctgtgatggcgttcggtgccgtactgtactgttaggttgttcttgctttttttcttctgttcttcattctctgtttgcaattgtttaagttttgattcgccgaagcagtgccatatctaaaggaaatcgatcattcttgtacagtacactttatgcgctcgtttcctcttcttatctcactttgaaatttggtgttatgatatgtgtcagtaaagcttatatcgcgtttgtagaaaaccttgtgtgtattttgttcgcagtaataaaataagatttaggtgtaaaataatgcagcactgcaactgaagattgatacttccatgttatatatctcaaaaatgcatttaagcatttaagggccctgaatgaaagcaccaattacaccctgtgctttgagctagataagtagtgccatatcaagtttgatgattctacttcactttatttcatatgtaacctagctttctggcatttaattgatctgtattattgtttaagtgtctttccccgtttttgttaataatgttattttatatttgtattcatgttaaattttcagcaaagcaagtt

SEQ ID NO: 39695 - DNA, 768 bp, Oryza sativa
ccacgtgtgcaccacgtggtgcgccgctcctccccggtccatggacacggtccaccgtggaccgccctccccgagtcactgccatgtggggcccgcatgtcggcgccaccctctctctccccgggattttatttattacgcaataaatcaattaaggatttttctgtttatagtaaaagcacattgaatcttctaaaattcatatctaattcatccgagctccgtttaagcccattcaagtctcagtaaatcaagaagaatgtgaagaatccattaaaaatggttttgttctttgtttcagtagtcttatagcctgtttgtattgtttgctttgtatgtcgcttagattccggctctccggatgctccggtgtactttgaaatagtcgccgaggttcctccagcagtagagcaaagcaagtcatgcttgtcacttgaacatgttgatcctatattacaaatgctctaccgttttactttaaatgctgcatcgttttataatgtcaccatgggatgtttacctactgttacagccatactagttttgtatcatgctccgttgttagcttggggatataacatgacttgatattagactagggattgcttagccatgcttagttcaactagcacacagtggggaaaatacattaaagcatagatatctgattctagtaatgatgttggttaataccaccgctccggtgctggttaattaaaatatattaaacgatgggctgtgggtgcttggcttcgatggtcgcgccca

SEQ ID NO: 39696 - DNA, 1501 bp, Oryza sativa
tgtaaatcacatgcgagacccacacacacaaacaaacttaaaacaagcaagctgtcacgaccggaaatcacccaacaggcgttcccgacgtgcgtgtattattccttgtcccaggaggcaaggtacaccaaaagttgatacaatacagagtttaacaagcggaagcgtatataaaattattacatgggcaacgaaggcccagcacactcaaagacaacgaaaaacagcggaagactagggcgacgaccacaggcgcttgacggcaggcacgagctagacaccaaagccttcatcttccaggaactcctcatctgggcttgggaaaattaagcaagactgagtacaaccaccgtactcaacaagacacacccacaaatgcagaataaatgcaagggagtacaagggaattataatataaagggttagggttgcagtaaacagcatttaaagacatttagttgctcaaagctattttgtaaacgcgatcctagaactctacaaagttattaatcaaggccgtgaacccacacgaacctgccttaacccaaggcctatgatgattcagaccgaactggcaacccgaccctgggtcccagctcgtcccaagccaacccaggccaaccattccacattttagttgttaagcaagttttaagaattaaaacactaacttgggtacattgctcggcttgcccataaccgagggcgcggctattcgaatagattatactctgatcagaggtgtacatctttacccacaagacacatctttctcacgtgcaaccacgtgccacataccaccacggtatacaggcgaaagacgtgacatagtttccaacccatcctagccatagacaagagtaccgacccaatcccgcctacggccggaacccccgggacaggcagacggaactgagcccctcgcagcagggcaccaaccctgtgctttttgacatctcgactaccgggccgcagctcgtgtagccttcatttgccctggagaatgtccatcgacccccgacttcatccatctccaatccgtgtacttttgtttaagactagactgagccacaaactaagccttacccactagacatgtggaagtacggtagtgcgttgcaacagaggcccgaagaccggtccttatatggccgaggtgctaccatcaaaaccatgcaccccgagcccagcctaaaaccattttgggggcttttgaatagagggagcggtgtgaagccaattccacaataatccaacaattccaaagtgcccaggtgatatgaatattcccaaagtctaaagttgtaaaaccacctaatgttacctaattaaattgcgaagcatctacctaaaatcatactagtgataccacgagtagagtgtccactagttggggttttgtttaatctagggtgaacaaggtaataataacaatagcaataataataaggtcataacaaaggtaaataggcatggctaaataaaacagtgataacgcggg

SEQ ID NO: 39697 - DNA, 714 bp, Oryza sativa
aaaaaagctagaaaatagaggaattttgtcgactagtggatatttgtttgggcttcattgtcgcagaataataaccctctatgacttgggataacctacaatattagggatgtgcaatttttcatgccattgcattaatttttatgttagctcactgcatataatatctttaccccctttattttgtataagtgcatgttcaatgaatgaacatttccctcatatatcaccaccatagcatacatatatgggcctccacatgaagttggggatacaaatggaccgaattccattaatccagtgcctatgataggggatttttgtgatatgctattagataaagatcgaatatcagcatcagggggagaaaagcccatgtgttaaagatgccttatattttcaagaagaaaaagatctttataagtaagaataacgtacaagccaaactaaactagaaggtttagtttattctcgtgtaagccagaagcggaagcttgctagataattatgaattaaaggagtaatcagaagttatgtttacttgtagtaaactttctgctaacagtggtataccccgggttttgaatagtatatccacaaatgcagagtgacatgttagtcaatgttctaaaatctacgggaacacgtgcggattctaagatctaatgactattttcaatgtacccattaataactccttacaactcttgtaga

SEQ ID NO: 39698 - DNA, 1501 bp, Oryza sativa
agagcggagagaagagggaaagcgaacggcggtcctcggctcaccccgggacgacgagggcggcggaaacgacgaccgaagcggcgagaggcggcggcgcggttcgggatgacgaggacgacggtgctccggcggtcggcgggcgaaacggaggcgcggacggggtcgacggcaacgcggcgaagccgatggaggtgacgccgagtcgggaggaagtccggagcgacgacggcggcgaaccggagcacggcggcgacggcggagagaaagtgcgacggtgcgggctcgattccgacggggagagtgagcggcgagtggcggaaacggaggagcggagctcggggattgattttatagcgacgggagagagagagggcggccggagagaaaggaaaccggccgcggagttctcgggctccattgaagacgccggcgacgattgcgggattcaaatcggacgaatccgagggagagagagagggaaaagagggggaatcgggagagggaatcacggggagtaattcgcccctctttatggcgcgcggggaaggcgggatgcggcggaatcggcggcggcggcggcgctagggcacgggcggcggcgggcgcggcgcggggttggggatgacaggtgggccccacccgtcagcgagggtggcgggcgggcctgcctgtcagcggcgcgcgctcggggaggagccgatgggccggaggggaggagagagagagagggagggagagaagtgggccgagccggcccaagaaggaaaaggggggggaaagaagacttttagggatttttctttttataaaccttttcaactttgtttatttcttttcaattattatttgtgctctgaaaattccactaaaatttatttacgcattttaggcttttaggaaatatacaaaaatcctccaagcctcatttgacttttatctttgcacattttaattgttggaggctttcacatgaattttaattattctttgcacaatttcgaggatgtattttagagtcgatttgggacgtgacagtggcggaggaccgcccaccaacacctaggtgctgccgtgccgtcatgaccaagttggctacgtcgtccagccaacgttgggctggagactccgggtcagggacgacgggcgggtgacgtaggagcgcgcccgcagcttggagcgcgccctggggcgtgctaccgtcgccgtagacgaggaggcgacgctccccatctcggcgcccttctccatcacccgtggatgtcgaagtcgcggatccttcgaccctctcgagcgcctcctcccgcctaggactttggcgtggagggggcggtggagtacgagctcgacggcgtgggttcggctccccgtcgtcaccgctaacactcggagagagcttgtgcgcttttgcttgtttagccattgggctgaacaggaaaagcttggcgcacacgaaagagtatgagagcttagaaaaacacacgcagaaccccctacatgg

SEQ ID NO: 39699 - DNA, 1501 bp, Oryza sativa
aatcttataaaattaatagacgagatatagctacattggtgtacatctttaatgcatgccatccaattttagattaccatattactttcgaacgaatggagtaagaaatgctcatctggttggcatcaatattttaggcgactggtgatatggaagatgttctccggggttgattacagccgtagttcctcgttccatgtcgtagacacacagcgctttcccattgaaccccgagtagtagatacagttccctctcaagcctgttgtccgtgcatcaagtgacgctccaaaacagcctatctgaacgaagaacactctgccacctagcgaatccaccttcacccacgctgatctttgctcctgcgtcgtcgccatgctcagcctgtaaacgccaacaccagcgacaatccgatcacatccaatcgggtgagagaagagaatggagtgcagctccccgttcgattccacaaagatgctggtacgtttcatgtacaccgccggcctcctgtcgtcgtcgtctacggcggtcacggtgaacgccggctccagtgagaactcgaggacggcgacatggtcgatgagatcggtgtagaactcgccgtccatcgccgtgagctggcgtaacgccaggatgacgatgccgcggtgctcgtggtgaggcggcccaggctggaggtactggtgctgatgcctcttcacccagtggttgtcgccggggcggcaataccagagcaccgtgtcggcgtggtcgatgacgagcacgacgcagctggccgggtccatgggaccgcagcacgagaggaggcacctccggcgatggctgctgccttcggcggcgaggacggtgccgtcgtggtcggggggcagcccgacacggcggccggtgaaagggtcccacaggaaagtgcacggcgagccgcggcgcgccatgagcagccagccctgcgccgtggtccaccaccggtggcctctcatcatgtcgtcgacgccgccgtcgcccaccctccttggcagcagtgctctcgccggcacgctgtacagggacgtggcgtcgccgtggccgaacagaagcagaggagcaagcttgggatccagtactgctgcagatgcatcgcctgcctcctccatgattttgatggccgactgtcccacaggtaggatacggccggtcaattgaaaacgaacgaatttggcggtgctttataaacgaggagaggctttgagcagtgcaattactggcatataggaaagagaagcgaagaaatctgcacgcctacgacctacgattactagtaccaattaggacatgaattcctacacgacatcaaaattcaaacaaattatagtactagtactttgggccggtaaatcagtaaaaggaaacagtaatctgggccggggataaagagggatcaccacatatgcatctatggagattggatagcaaccaacaaaaaccaaccgtgccgggtatacaaactacaagcagaagcggaagccg

SEQ ID NO: 39700 - DNA, 1501 bp, Oryza sativa
ttaaacatatctcctccaactccaaagtacatcacaagaaagaacaacagtctcgatatcaaacacattcttccatttcctttttcatagatacaatatgcacactgtccaacaaatacaattttgagtaacttcttcacgatatgaatatttgaggatgctaggggttaaaagattactacctgtgggaaaggcttagcacagacaccagccttgagaaaatacatacatccattatcatgaggaataactaactctctccaagcatcggactgttgcaggttctcatccatgctgcagcaatcacacgaacaatgatatcccacatttccaagtgcagctataaacaaaattatgtaaagtaggccaaaataaccttaaaaacacattgtccagtgcattaatcagatcgttgtgatagtcttcatgattgcatagctcaatgtgaaattgttttgcgcaatacaatgctacttcagctcctgagatagaaaaaaacaattcagtatggcgtctcgctcaatacgatggatcaagattacttctattgcatagaagcttataaatcaaaacactgttgtgaacattagtagcagaacaacacttgaataggcatcattaaaaaaaaactaacctgttaatctgtaattatcctctaaattatcatcaccatttatattactagtaactcatattcatgcagtgttttatctctcatgaattaaaatttctttttatgtagttcatgttatccttgcaagcatgccacacgaatgtgattactgattagctaacttgttcattatccataactgtagcatcatatttatttgaaaattgacaggtaaatgtttcaacatataccacaaagttttcaaaacatgcgcagagataaacaaagtgatacacacagacaaacatagcatgacataacagttacgccaacaatttggagggtttgaaattaaaaaaaaaatgagaatgaaagcaaacctccatggccatcataaacaccaaagaaagacgtggacgtggcatcatcaagatttagaatagctgcatgctagagaatatagagggcatatgtcagtcacagtattttgcagaactgtccctttttttttcatacaaaaggctgcaagtttactcacagcatcttccattttctcaccccatccttgcatagacgacacaacatacttaattctgtcattctcttcttcaaaagtgaacttcgattctacaggaaggctgttacccatagcggaacttgctttgctgaaaatttaacatgaatacaaatataaaataacattattaacaaaaacggggaaagacacttaaacaataatacagatcaattaaatgccagaaagctaggttacatatgaaataaagtgaagtagaatcatcaaacttgatatggcactacttatctagctcaaagcacagggtgtaattggtgctttcattcagggcccttaaatgcttaaatgcattt

SEQ ID NO: 39701 - DNA, 1501 bp, Oryza sativa; identical to SEQ ID NO: 29789

SEQ ID NO: 39702 - DNA, 384 bp, Oryza sativa
ccctaagaccatcttcaagagttttgcctggtagcaaccaatatgccttgaagcctagactcttatcatacccaagcatttctaagaaaccatctaaactaacagcacaccaagtttttgcctcaacattatcaaaccaatccatgttctcatctatgtatgccctgttgctaccatagccaacaaagaaacccccatggtgtatctcagcagtgaatgtacccgaatccttagctgcattacaaaatttgtcttcctaattagcaaagattactgctatgatggctgtcaccaaaaccctaaataatcaacaaaattcgaccacagcttccacactcgaaatcatcaaataaatagaccacagctagcataactaccacccat

SEQ ID NO: 39703 - DNA, 1294 bp, Oryza sativa
attggttgcacaacctgttggattgggggtgtttgctaagctggttgcacaaactgctgccttggcggtgtttgctgaatcggctgctgctggactagaacaacaataggttgaggtggtaagaacatggccgcaacctgatcttgcgtagccgattcacatcctgccccctatgctgtggttgttctctcatcaacaaccgaggactaactagttggcctggtgccgacgtagacgcagcaagtgcgggagccgataccggtgccgtcggctgagctgatggcgcattgggaggaactgtttgaacagatggctgagtattggtgatcagaggccgataatctggaaagacacctccttgcaaataaactgggcctgtagcctgatattcagccattgaaccatcaaccattgatttcatcatgtttgacaaggtattgactaacaccccagactgattgatcaaagcattgtgcacggcatagtcaacccgatcttggaagttattgaaaagctcatgtgctgcattgccattctgactaagatttccaccttgtaatccttgggaattatcaccttgagaaccaagaccttgaacttcttgaaaaccatcgccttgatttccttgagaaccatttgcaacaccttgatcacctggctgagccataccatctggagcctgttttagttcaccatctttggaagaacctgtcccaggaacatccgcaaccaccattaatttatacttctgaaccaacgttcccttgcgggtctgtgtaaatgaactcaaaaattggttctttgcttgctgcatcattgcttcaagatccttatgctgttcaggtgtcaatttatccagagtgatgggcataatgttgctctcatcaacctcagacagacccaacttaaggatcttagctttgacagaatcaggttctctagccgaggacggtgacggtggcggtttctcggccatgaggaaaactgctgttgtgactctgacttctaatcagtcctatcaggcatgccaaaagcgtattgacagaaaacacgaggcctgggagatctgcttaactccagtgcaggtccaaaactcgccttcggatgtatgagcatgccagttgatttgatcctacaatcaacaagaaataaagacaaagaaaccgtggttaaatccataaatgatagtcgatcggctaagtgccgatgacatatcatttacctttgggccgatgtcatatgtacatcgatcgatagccataaatgaataaaaaggaactaaatctactcaatc

SEQ ID NO: 39704 - DNA, 910 bp, Oryza sativa
ccggtctgtgtccggtcacagacgggatattcgagcgcgatgcgttgcgttacatgcggcgtgacgcgctcgttcaaccctcaataaatgcggttaggtgagccccgccgtgctcacctaacctatacacgcggcgcaaaacccacaaggggtcggggcgcctcggccctcggggccgaaacgggagcggtccgatccctcggggagacaaagagaggggcggcctcatcaccttcgggcccgacccccccgagggggtcaggccacgtgggtgattgctcctgcccaaacctctagtcatgatactcccggtcccatgtcaccgacagtagcccccggcgttatgccagggcgatcaccctcctcgagggaagcggtcgggcgtgacgccacttacttaggcctggtgacaagtggggctggtctctacagttgggcagaaacccaacggtcgcaaatcacgcacatcggcaatggtaactcgactgtcaataatgagcggcctcttcaagactgccacattactcgagtagcacacgaatcgggacgagccggttcgttttgcctggagatatggtgatggcacttcggtcggcgagtgcaattaacgcgcgcacgatatgttccatctcgactgccacagccgcatattcacctcatgcgccgcaagcgggcgaatgggattagtggaagcgtgggcgcgagaaacgagggagcgagatagtgggcgcgagaagcgaggagccgggcacagcgttggcaagggtataaagacaccgaggaagagatttgcttccttcctctcgccattattccccttgtcttcgccgcttgcgccctaactccttgtttcctgtgccctaccctcgccacacgcgctcgctctcaaacatctcttcttccggcgtca

SEQ ID NO: 39705 - DNA, 1501 bp, Oryza sativa
ctcttcctaataggttcaaagttctagatttttcaaaattctcagggcaagatggtgtgtcaacttatgagcacattagccgatttttagctcaatgtggtgaagcatcggctgtggatgccttgagagttaggttgttccggttgtccttgtctggatcggcttttacttggttttcttctgtgccatatggatcaatcaacacttgggccgatttggagaagcaatttcacagctatttctacagtggggttcatgagatgaaattgtccgatttaacagcaatcaagcaaaggcatgatgaacctatgcatgagtatatccaaaggttcagagagatgaggaataagtgctatagtttgaatttgactgatgcccagttagccgttttggcttttcagggtatgattgctccgatcagggaaatattctcatctgaggactttgatagcttgtcacatcttatacaaaaggtaaccctgcacgagcagaggtctgcagaagccaggaagaaccctaaaagggttaatcatgtttgtccttacatatatggatcggataatgatgatgatgactgtgaaatagctgcagctgaatgggtaagaagtaaaaaggttataccatgctagggggtaaagaattctagaaaagaggagaggtatgactttgatataaccaaggctaacaagatttttgatctgttgctctgagagaagcagattcaactccccgctggtcatacgattccatcggccgaggaattaggcaaaagaaggtattgcaagtggcataactctgggtctcattctactaatgattacaagtcttcaggcaacaaattctagtagccattgaaggaggcaagatcaaatttgatgattccaagaggccgatgaaggttgatggtaatccttttcctgtaaacatggtgcacacagctggccgaacagctaatggaggacgtacaagaggttttcaggtgaattcggctaagattataaacaagtatcaaaggaagtacgacaagcaacaggagaggcgttatgaagaagataatggtggttttgatcctcattggggttgtgagttatttaggttctgctataatgagggtatgaggctgccatctatcgaggattgtcctgggtgcagtaatgttgcagggagatcaagccgatcgtatgatggaggcaatcggctgaagcaaacaagagttcctattcatcaaaggttgggcccggtgaaccaagactatagccaaaaggatgatggagacaggaagattcagtggtgtccttctggtatttttacaaaaaatcaaaagagaagggttcaaaggttgaggaatagagaatgcttttaggaggttgagcaggaaatcagtcatcggctgaagacaaagccgaggcaggagtggcgcgttaagaatcaagctcctgaagccgatgacgccacagccgacggggcgaagaattggcaaaagggaatagtgttgtaacgg

SEQ ID NO: 39706 - DNA, 196 bp, Oryza sativa
aaaggcgagccaagttttagtgaaaagaggatgggtccccaccaaaaagagaaataggtagaagtggtgcatgtggtatccccttgagatataaaaggaggaccttgcccacttagggaggggatccggaccagaggaccaggggaggagagattggagactcccggaggatccaggagaagatcccacgagaggc

SEQ ID NO: 39707 - DNA, 183 bp, Oryza sativa
cgaacctgtgaaggcggagattaagcgtttatatgatgctggttttattcgtccttgccgatatgctgagtgggtttctagcatagttcatgttatcaagaagaacggcaatgtgagggtgtgcattgattttagagatttgaataaagctaccccaaaggacgagtatccaatgccagtagc

SEQ ID NO: 39708 - DNA, 260 bp, Oryza sativa
attcctgcagcccgtcagtggctgagaaggcaaaagggaaggtgtttgaggtagtacgagagagtgatagtgatgatagggccagtgattctgattatgttgatagtgactatgatttgtctgattctgatgatgacttgtatgtggacaatattgatgtggaggtagaagacttaagctggaaagaagaaaacgaatagtaagaaagctagaggcagtgaactgaagggcaaagaaatagtagtttgtacaaattcaga

SEQ ID NO: 39709 - DNA, 204 bp, Oryza sativa
gtcatttgataatgcattcagaatacagaagatcatgtttcatgcttgagagataaattagtatggatattcaaagacacatgcttccttcaatatgattcagccaaatagccaattggagttccatccttttaggccatgatgtaacagggagaattattttctgtactttcagataattaatggcgtaagcctcagcaatga

SEQ ID NO: 39710 - DNA, 1501 bp, Oryza sativa
acgaaatcaagtagtagtaggcaaagaagaaacacaagtgatttgtaggggggtatttttcacatttaattccatttcaattgaaatatgaatgtctgattggaatgcgcgggatcaggaaaatgatatctcagaacagtcagatgtctgcctgctcaaccgaggattactgatccgccagatgtgctgatggtagttggcatggaaaagacccatatgtcatggtttatcacattggtgtgtagctccctacccatgataatttattggcgcaaactaatttcagttgtatgaatttttttttcatacagcgatgattcaatcacgaaataaaaggtcaccagtgatacaaccgaatctcatcagtattatttggctttgttgcaacattttactattatccacaaaacccggattatattcatgtattatttcgtagtacgcgcgcgctaattaacatgtcaagggttcatgaccataagatcttccaacataatatattctcatgactcatgagagggatttgatctagcaaggtggttctgatttgtactctttggttagtgtttatgataagcatttattatgaaaacatccaagcagatatttaagtaatctaattgtcaagtagtacataatatgcaccattccaaatttgcattttacagacttgcatacttcctctgttcttaattagtgtacagattgaaaccacagggggaaaaaaaacagaggatggactcaagaaaagagggaagctgattgccatcttcccagaaatgccaggttcaggccttcagggtcataacgtccggtgatttctattacacgagaaaacagtgaagctgagcaggggtgcagtggaaccggagggagtacgtacatacctagctatgtatagctattggggccaaaagtcttaattatgttttcatgaatcgtttgttgacatattagcttcattcatccacttcatctaaagaaagtaattctaacgaaaaaaagtaattcaatggtctttatgtggtttcttcacaagaaagtaattctaacgaaagataacctggctaaaagaagagtaaattgcactggcggtccttaaacttgtgaggaggtttcatccaggtccatgaacatacaaacacagggtcaaggtcactaatcttgttttattgtatcaatccggtccagagaacgctttgactcgtttcgtgcatacgtggacagcaacgtgtcgcgacacgtgtgatgccacactgcaccgtcccgcaccgtgcactttttcatctaagcccctcagttccctcgaattctccaaaccctagccctctcttttctgctctcttttcccctggacggcgagtgagggagtgggagggcggctgagagtcgacggtgagtgagggcgtgggagggcggctgagagtcgacggcgagggagggcttccggctgagagtcaacggcgagggagggcactcggccgaggtgtgttcatcgtcg

SEQ ID NO: 39711 - DNA, 236 bp, Oryza sativa
agctccttgaaatgtccaacatcgggttccttcttgaattcctgagcactgctcttcttcagctcatctccatccttcattttggcctctttcagcaactctgcacaggcagcttcataaatgaagccactcctcttcaggaatttgatgtaggcttcctcccaataccagaaattacaaccacttccatccttctatacatttcacagattgcaacatgtaaatttcaagcaaaa

SEQ ID NO: 39712 - DNA, 305 bp, Oryza sativa
caacctatcgaggtggcatgagtttctattgtcccatgacgctggaggcccatgcagcactagaaattgaaataactaggtgaaataattgacaatgggactttggggaagttaggacataaattaacttgttgggaggattttctgtataaaattgagttgtagggggaaatagaaaaactagtgagttgtagggggttatttggaatttcactggaattaaattatgagcaaagaatggcggatttcttttttgaatatttaaatgtcatgattcagctcctgttgtttttgcgtgctctagg

SEQ ID NO: 39713 - DNA, 806 bp, Oryza sativa
ttggtaagccctcacgcaccgagcacctcctagtgacctagaagccggcagccctcccaatttgggctatgtgccgccggagccataccacctccggccgccaccgcgcctccgtcgagctccccgtggagagggcgaattcaaatgcaacctaggctacatttttgattaaatggcaaccctactgattctagatggtgaaatcgtgctcggccgacgttcaactcttctacttttgtgccatcgccgtacacgcataaccggctgccaccgcgcgccgttgcgccgtgtgctgggaggccgccgcgcttcgccgtcccagccggggtcggccgccccaggcgggtgcgcgccgccgttcaccgaccgcgcgccgagccgtcccggctcgggtcggccgcactggccgcatgccgctcctctgctccgctgtgagcgtgaggaagaagaagggtatgaaagagatagagagggagagttggagagatgtaagccctactttctattagcgcatagtaattaccatgctaatgatggttagttgaaacaatgacatgtgggcccgagcaatcaggaatctaattaaaaaaacaatttatatggtacccctatggcatgtgggtcccaccgggattaataagaccggtttgacctcggtcaaaagaggcaggcccaccagtcagtgacacgccaaatttttccttagaggaataaagccagaaaaaggaaatagggatggcctcacatgtcagccactgagacttagggatagagttcgattaaaaaaataaatcaattaggaacaa

SEQ ID NO: 39714 - DNA, 1501 bp, Oryza sativa
agtttgatgttttgttcttaaatttttatgattttttctaatttagaagtgtcactgggtggtttaaaaatatttataagatggttaatttgctttaaggccgcatgggagtgcggagggagatttgggatgtttttttttaaaaaaaaagatagaactaataacctaaaatttcgattgtcgaatgttttattatttttctttaagatttcctctaatttaagagtgctatatacttcctccgtcctataaaaattcaaattagaatatgatgggatatatccaataacaacaaatctggacattgtttagaaatatttatttgatattgaatggactatttattaggagagaatatataaagagttggctagatataataggctaatgggctttttaggcccataaaaatatttaattttaattgttatggggattaaaaaaaagagaggaacggtggttggaacattggagggatcgtacatacgtgcgcatgaaggctgacgtccggactccgggcggagatttttttttcttgtaaaataaatctaacaatcaaaattaatagtcccaccaatttaaatgaaaattaatggtcagatttttactattttattagagtgacacatggcgactcgagagcgtttatagtatgccacatggtagcataggagcgtttgatcgaagtttaatggacttttgaatatataaagagttggctagatataataggctaatgggctttttaggcccataaaaatatttaattttaattgttatggggattaaaaaaaagagaggaacggtggttggaacattggagggatcgtacatacgtgcgcatgaaggctgacgtccggactccgggcggagatttttttttcttgtaaaataaatctaacaatcaaaattaatagacccaccaatttaaatgaaaatcaatggtcagatttttactattttagtttgtttgtttgtttgtttgttcttaagattaattaaaataaatgaaaatcaaatacatcaatattatagtttgtttgttcttaagattaatcaagatgtacacacaagaaagtctgttcgaaagaaaaagagaatcaatagcatctggaagactgaagaaataggaggcttgaccaacatttgcacgcgttgacgactggccgccgtggcctgcttctcacgtcgctatgagtcgccactgtcaattggtcttctagtgtttaatagtaacataagtgaggatcatgtcctagatccactaatacacgagaaaaatgactatatgggattccggaaaagtaagattgttgctgggaaaatctattaccaccagaccagatatcccttcgcatatttatcacctattggttttttttataaagtcagctcagtgcttcattgatacccaccttgcaaggaggcacgtaggtgacaatacgttgacaccggataacacatgtcaggtcggagctagatatcaggtcatggttgtgcc

SEQ ID NO: 39715 - DNA, 1376 bp, Oryza sativa
tctgccacgccgtcggcgagtacactgaggtaagtcccggtcggctagatcccctttcttagcatcagatcgattttctctcgccttatattgctttccctttctcgattactttggatttgtagcatctctccaacctagttgcaattcccagcctatcgcatgaaaactactactttctcggcccagtcggcaaccctgatcccacagagttctttattggtgaaaccaataggattccttttagattggccaacccagatctaggtcactggaaaaacaccttcaaatcctggccatccctcgagaaaactcgacccgagaaaagttggatcacatggttcaagagcatgtcggctagcaaaagagttcattgggacgagattggaatcggccaagcactcgatctcaccatagccaactcagctaaggatgagcccctaatggcaactgcctcttatttctggtccaacaccatcaacgccttcttgttcaaccaagggccgatgaccccaactctcatagatatcatcatgatcacgggtctggatgtcaccttatcggctaactctatgagcttgaacacgaagaaccaatacgacttcaagaccaagagcataggcggctggtcaggctatgtagcagcatacatgggccagggttccgtcacccctcgagaacatgtggctttcttgctaatgtggctagagaaattcctcttttgtggatcaagctgtggccctacaaccaattggcagtttgtagccgaagccttagaagcaaagaaacaatttcctttaagaaaaatacttctcggctacttgtaccaaatgctaaacaatgcatcggctaagttagctgtcggctcagtagtcggagcaggtggaccatgatggctattgcagtcctggctgaatttggtagtcatgaagtttgtcaattggccatctgtaacagaagctgaatttccaagactggagccgattgtagacaatgatggagaagaacgtactcatcggagatgcacatcttacggagaatatgcctccataccaaccgatgcagaagcaaagctatcggccgagctgcttaaagactggttctgcaatttttatgagggtttccaaaaacatactcaagtttggttcctctatgaagattcaacacttctagaaaatccattggacttcatattcgaagacatcaacaatgaaagatatcagaaacccagagaaatttcttcagctgcaatcagtccatgtatccttcctgtcggcattcatcaaggaagaaacatctaagtctcctatgaattttatcatccaataagttctgccaggcagtctggaatgggccaactcccaatcggcttattc

SEQ ID NO: 39716 - DNA, 1140 bp, Oryza sativa
atacaatttagaaataactgaaatttgaaaattaaaaagtgtaatatgaaaagaatagtcaatcgtagtacaaaatacgagattaattaaaattagaataataaataaataaatttcgaaattagaaaaatcaaaatatgagttcatgtatacaatttatcaacaactaaattcatcataaaaataaaaactattaaaacaacacaagattaatgaaaaaccgggataaaaattttataaattctgaaagttgacaaataaaaatgagagtttgagaatgaatattatttacaaataacttaaataggaaatagatgaaataacaattcatatagactacaatacggaattaactaaagttagaaataaaaataaattaaattatgtgattagaaaaactaaaatgagggttgagtaggaatataaattataaataacagataagatattttaatagaacatattacatctataacataacggtggtaagtgaccataaatgcaaaagggacatcagacaaaccataaagatagggttggtagaggttgatgggatattaaaaataaaaaccaaaactcctaatgattactagattcaatatttagaaaccaaaggatgattagaaggaaagattttgggtaggctgtaaattaaaagagaacggtggtgatggttgacaggacttcttggaagtaaaaagaaaacgaaaatccaactataatcatgttccatttcataaatcctaatgataataaagaggttgaaagttagtacaccgtagaggagtacaatgttgacgtttaaagggacttccaaaactacaaatcaaaattcgacaagacaatgaactagacaaactatccaatttttaaagtataataaaagctgtggcaggtcgggcaggagaaaaggattggcggctaacgtgacatttaaaaattataaaataaaaaacttgacaatgataaaatttgatcttttgaaatcctaatataactatatggctacttaacaaattttaaagaaaaatatatgtaaacaaaatattttatacggatgcttgccgcgcaattacacgggccacactcaactatgtaattatgaatcaatctaataatagcgtttgttaagacacatga

SEQ ID NO: 39717 - DNA, 496 bp, Oryza sativa
ttgatttacaactcgacaaacaaaaataattaaatcaagcggtggatatcacctgtacaacgaagataaattttggtttttcttttaacttgcacgattgtatagtggtttatactacataatctacaagcatacatataggtgacatgatatcatgggtagaaaatacttttccaaagcgaagcagctagctaacgcatatagcagtagtaatgcagctgcccactggcattggatgtactggtttacaaagcacactggtttgatgtttttttagcgaagttagaaaaaaaaatacatgagtgtttatagctaagttcataatagagtccaacaagtaattgtcaagtaattgtcgcgaagatatactatatcacatctatcttatggaacgacgtgacaagtacagtgcaactgattttttttataattaaatagtaaggcccacaaggtgtctatatgtacagtaacatttctaagtgtgctcttgacgtga

SEQ ID NO: 39718 - DNA, 371 bp, Oryza sativa
ctcgacgcgacctataactttgtagttgaaaagtttttgaactaaaattgtttaaggtcccaaaatattgttgcatgtttatagattttgaaattttaattttaaaattacattttgggacaaaaaatgacttaaaataaaaaaaaattcaactaaaaagttgtagatcgcgtcgaggactacaagtttgatataaagtttgtctttattagagttcacatgaaaaagttatgaactatttttaaatataaagtctttagaccgtcctatttaacccagatgatattcaaatccaagtttagggaccggggtgacacaactgaacaggttggaggacctaaacgagtgatctaaaagtttaaggatcggga

SEQ ID NO: 39719 - DNA, 1388 bp, Oryza sativa
tggagaagaattcttaggtggagtcctggcttataccccagttgagcgcctgtgaagatggagccgtaggcccgctagtccgctgctgtttatttttgattgtcaggccttaagtgcctttgtaataatgtaaatattatcgatataataaagatgtgtcttttatatcatgtttgtgtggtgtaccctggcttttactgggatggggattaatacactagcgttcgggaaaatgtatttttctcggtcgcgacaaatacaagtcaaggtgcgcctaattggttgccaccgattcagccgggcctgagagtttcgctgtggaatcagggaccgcagttcgacttcatcaacgctgctcaggcgccaaccgttcggcagcaagctccaactccaggcttcggaacaaaccaagcaccaatccaagctgccatgatgtggtcacagccaatttttgacccatccatggcggctcagcaagtacctccagttggagccgggcagccgaatgccatggcccaaccacacgcacaagctgcgatttcgcccttcgccacaccgtacccgcagtagggtgcggtaaacagggcgggaggcgaaaaagggctaccgctgtgtgggggaatcaagactcgtccaatcccaccccagtttaagttcccacccgtcccgcgctattcaggcgaaactgacccgaaggagttcctctccatctacgagtcagcgatcgaagcagctcatggtgacaaaaataccaaagcgaaggtaatacatctcgctctagacggcatcgcccgttcttggtatttcaatttaccagccaatagcatttactcatgggagcaattgcacgatgtttttgtccttaactttcgaggcaccaacgaggagccgaagacgcaacaacatctacttggcattcgccaaaggcagggggagtcgataagggagtacatgcgtcgcttcttgcaagcccggtgccaagttcaagacataaccgaggcgtcggttataaatgccacttcggccggtctgctcgaggacgaactcacaagaaaaatcaccaacaaggagcctcagacgctcgagcacctacttcgcatcattgacgggttcgcaaggggcgaggagaattccaagcgacagcaagctatacaagctgagtatgacaaagcctccatcgccgctgctcaagctcaagcacaagttcaagttgtcgaaccacctcccctcttcgttcgccagtctcagccggcgatccaaggacagccgccaaggcaaagccaagcccccataacttggagaaagttcagaacagaccatgcgagcaaagctgtgatggcggtcgaagaagtgcaagccctccgcaaggagttcgatgcccagcaagc

SEQ ID NO: 39720 - DNA, 1501 bp, Oryza sativa
  unsure (1)..(1501): unsure at all n locations
gacttggttagatcagcaacattttttatagcggattttagtcttgctttatgcttttcaacagattttgggagataggnnagcntcggcgtcatacattaaaatacggagggagtactaaactgatcctacttttttagtttgcttatttgaccctgcttttcaaaaatgaatactccgtctgaccctgtttccactacaccgttaaagtttcatttttttgaaaaaaaaagaaatttaattattattcgtattgaccaaactattctgaagaaaccccatccacatctaaccctatccattcactcccgtctctatcttgtctatcggcggcggcggcggcacacgattgagacgagcggtgatggaggggcgtggacctgtggtggcgcacgcggaggtagcagacctgtggcagcccgtgcgcggaggaggcggtgcgcgcggagaaaggacaggtgacagctacggcgagcagaaggaccagcagcaacgacgagcggaaggagcggcggcagcttgatgacgacgaggaggagcaacggtggcggagctcaagttgtggcggtggatccggcggaggctgggcgtacaagccgcagatctagcggcgcccctctcccgtgagctggcgagtttcggcgccaagctgtcactgctcgtcctcggtgcgccggcctcctcctttctccgtgcgcgtgatgccgccgcccgccctccgcacgccggcgagctccagcgcctcacagggcactgctccctctgtcgccgtgcgtgccggcctctgtcttcctcggttcctccacacacgtactgcccccgggtcggcaacgacgacgacgctgcggcgaagatcacagggagccgctccctccctccccgagcgcgccagcctctgtcttcctccacgcacaccgatgacgacaccgtggcaaagatcagggcaccgctccctccatccccgcgcgcgtcgttctccatcttcctccatgcgcgcgccgccgatggtcagcaatgacgatgacgatgccgtggcgaagagcatagggcgccgctcactccctccctccccgcgcgcggaggcctccgtcttcctccgtgggtgcgccgccgccgggtcggcgacgccgccgccgtggcaaagagattatattttttttggttgctatccaaaattttgatatattttatttataattctgataaaatagggtcaaatgaccaaaggtagaagagacattaaatagggtcaaatgaccaaaggtagaagagacattttttgctcaaattaacaccgttatataccctgaacagaatagggtaagattggatcttcaattttgaaaagaagggtaaaataaacaaaattgattaaagagggtcaaattagtagttaggcttcaaaacaagctcagatgcgtaattgccccattttttttatcttactatagactagtttttaggtttgcaactacataatttttcggggcgaacgggtgaa

SEQ ID NO: 39721 - DNA, 1501 bp, Oryza sativa
ttgcactgtttgtcccctcgccttattcaaataaaatgtgcaaatataaaaaatgaaaagttgtgcttaaagtactttggataataaagtaagtcacaaataaaataaataataatttcaaaattttttgaataagatgaatggtcaaacagtgcaagcaaaatgtcaaaatcccatatattacaagacggatggagtattttattaagagtgtatttttttaagttcattttgtcttaatatttatgttggccactttccattgagtaaatttcacggaacactacaattttcagggaatctgtatcactaccaaaccacattcaactatcggttacctgataagaaaggctcaccggtcagtgactagccgtatacccccccttgtgcgtctgatacgcaggcattcgctggagccgaagttagcgaatcagaaacgacaaaaaaaaaaaaaaaaccacgctaagcttttttcaggagtagcgtcaccagacccatgtgcacaacacgaagacaaccaactctttttgaagctcacgtttgcttgcctgcctacttcggtagttcggtcttttggttttcggcccaactcgagtttacgacgtatataagaagttccaaacctagtatttgcaatgatgctctgattttctgcatacatatacatgaatatattttttttatctaaagtgtgatttcaaatcttttattaaagaaattagttactataaattctattactagatataaattttatcttagggatgccaagtcttttataatattttcttattatggatgaaaacccacaatattttttaaaaattatttctatatgtattttatgtatgttaactttacatgtataaactttttatatgtaaactttatatgtacaaattttatgtatataaactttacatacacaaattattggtagaaaatagtttgcatacaaatcacaaagctgcatccgcccatgaacattttgcacttttgaaagatcatgggaaaaaaagaaaaacaaaaggtgcaaacaacgggagagggccaatgcaggaaaatgtccatccatttagccctaagaaaacttcaacgcatgcagaccatatgctgaaatccagaatgggagacggcccatgtgcttaaatgcagaaaatagaaatagcatgtttgcttgttagacttttcggaatcaaaccaagagaggaaacagaacgctatagttgaaagagaaagtgggacgttcgcgcgtgtgactaatcaggaatgcgcattagtcgttccgccgcttccttcctatatgccattcacccgttcgccccgaaaaattatgtagttgcaaacctaaaaactagtctatagtaagataaaaaaaatggggcaattacgcatctgagcttgttttgaagcctaactactaatttgaccctctttaatcaattttgtttattttacccttcttttcaaaattgaagatccaatcttaccctattctgtt

SEQ ID NO: 39722 - DNA, 237 bp, Oryza sativa
tacatctattctcttatttctatatctacactaatataaaatataccagtttcatctcgtagaaaaatgtacacagatgtttcctatccataggatctcttaatctaacattgttccatattacgagttggattcaacatctgcaattagggatccctcccctcgatgtccactacacaccgccaaaatagtggtcggttaaaaaataacacttctccactcctgactccttccaga

SEQ ID NO: 39723 - DNA, 1501 bp, Oryza sativa
ttttcacacaatggttagatgtacaaaaagcgaaagctctgcgacatgctctgtgcaggatttgggctctcctaggggaaagctcttttaatttttttggcgtgattgctggaaaggttgtctatccttcttatccttcttagctctgtaccaactaactcttgtcatatccttgtgctgttttggggagcttatagtatttacgtaatgatattgtccatggcaaaggtgaggagatggtggcaagatctgcaatgttcttacagagttaccatgactcttttgcacaagccgtggtacaagaacctggtaaaaaggtaaggcagttttgagtgcagtataaattaattccccaaacccgaagataaatagaactttgggcgtgggttgcagctcatgggaattgccagaactggttgggccaagattaatgttgatggtgcttttttgcaggctcatgcaatgtggtatagttctggttcagtcttgttatcatatttgaagtacattcgccacggggcagcggtggaaaaattagaattgttagcttgcagagatcaaggctggcctcaccaacgagcacagatcgcggctggcgagcaagccgaggatggctttccgtccctctcccagctgccaccaccttcacctccccttccggtgacgacctcgaggctggccatcgagcttcgacggggactagatcggggcgtcagcgcgctgcggccgtcctgtccacgtcgcgagcgtcctctgccgacagcctccagatcaaggcgacggtcgtcgagctcgatcaaggcgacggttgtcgagctctccggaggatcgagagatggcgacgaggtcggtggtgggcagcgggggatggcgacgagccccgcggaaacgcagagccgagggtcgtgaccttcttggcagtgtggagaaggggatgacagcaagctcctcggtgcggcgcggagctgggaagacgggggatgatgggctcccttttcggtcatcgagacgggctccatttcctcatcacccttctccctttccctacccaggcggtttctccctttcccttcctaggcggcacaggcaatggcaagccatgccctccacaacgcctctcctgccttctctccccatgccaccaaccctcgaacaggctgaagaacgagtgaccatctttggttccgcattcttcgtgggaccgcacgaggatgatgtggcagcgaatctttgatgtggatggccaaggccgaacgccaactatatgcattatgcattatgaatggacttaatagatggcaggcagtaccgcggtagaggcggccatgcgtaggtacctagatgagctaccgcgcgcgccgactgcatcgacgacctaccgtacgatcgagttcattgccctggaagtcgcacgtactcggactctcgaagcagcatgttagctcgttccttgacacactgcaggtggctctgtatatttatctgaagagctgccgttgat

SEQ ID NO: 39724 - DNA, 707 bp, Oryza sativa
tgctgttttcttttcttttgtaagtgtgtaacgttattattatgatggatttgtatattaaattgtcagtttgtgtacctcggctgattcctggacgaggattttatgcacaaataagttcggaaattactagtgaatttccgggcgtgacaagttggtatcagagccatctcgactgtaggataagcgaaatggtcaaaccttaaggactaattttctgaaaatatgatttgtgaaaatttctcctttcttccttatctagaattctttgcaaattgtttcattgtctactcccctctctctttcaacttcagtagttctgagacattgaaacttgaagacgccaatgaggtctacttacggaggttaagtaaagtggatcgaggaatatgaaggtgatgatcgatctgaagtgccaagtgttcaagatggaatgaagtttggatcctaccttagaacctatgccgccaaactatctttgaagaatagttagtagggtagaacgtttgttgcttgctttgtgtgtaggtatagttgcattcccatcattggagtagttcattgatgagtgtgtaactatactaggttgcttgcttaatcaacttgaacaatataatggtctacacacatcagatcagtgttaacctggttaaggtcttgtctttagtgtaacccctctccttctatcttctctaatatgcaataga

SEQ ID NO: 39725 - DNA, 1501 bp, Oryza sativa
caattcaaatttgaaacgttttcaatccatatttgaaaactttcatctcaaatttaaaaactttccactcaaaatttgaaactttcaatctagatttgaaaattttcaacccagatttaaaaacttttaactcaaaatttaaattttttaaagtcaaattttggaactttcaacttttcatcttaaatttgaaaaattttcaacccagatttgaaaactttcaactctgatttgaaaactttcaacttcgacttgaaaactttcaactctgatttgaaaactttcaactcagatttaaaagttttcaacttgagattaaaaactttcaactcagattcgaaaactttcaacttaagatttgataactttcaaatcaaaatttaaaattttcaagttaaagatttaaaaattttcaactcaaaacattttttgaaaaaatatgtgtgctaaagattaaaaaagtaataagacaaaagcgaaaaaaaagataaaagaaaaaggcaaaaaaatcgcaaaaaaatcttgcgaaaaaaaagaaaaaaagaagcctgatgggcttccgggccggggccaacaggcgggcgcgcgccaattagccacccccatgaaatccaagaaagtcattaaaagaataggtggttggattgaaatatgcctatcaaaagtaaattttttagatttggaatatgatggagagagtattataactcattttaattttttttcaaacctttttaagtttgattaagtttatgaaaaattttagcaacatttacaacaccaaattaatatcattaagattaacatttaatacattttgataatataatattttctttgtgctgaaaaagttactatatttttctataaattgaaagtttgactaggaaaaaaaatagaatgacttataatgagaaatagaggtaatataaatgaattcactcataaatccatttaaaacccgaaacaatttataatatgaaatagatgaagtaccgatatgtactcactccgttacacaatgtaagtcattctatcatttcccatattcatattgatgttaatgaatctagataggaaatgtatatatctagattcattaacattaatatgaatgtgagaaatgatagaatgacttacattattaaacggaggaagaaacaaaatataccctgacaaaacaatcatggaagatgagacggatgagggagccgcctatgccgcggtcctgtatgatagtgtggagattatgggtatcccatatctacacggcgatggtattcgaactgggtacaggatacctaatgtagatagaatatcttatctgtatctcgggtttgtttcttaacttgtgtatcaaggaaacacccagagacttagtcggttacgactgtattttatctgtatcttcatattccgttaggaatatagattatcttttgtaatccggactccttcccatatataaggggggtccgggcgcctctaggggcatatgctg

SEQ ID NO: 39726 - DNA, 1501 bp, Oryza sativa
agaatgatgatttaaatgataaattaaatttaaatagtgtatagaatgatgatttaaatgtaaaagtaaaggtgatatggctttatgagagaagaaaaggagagagatattttggaccatagattatctaagactaaaaataattgatgtgatatggcttaatgagagaagagagaaataacattaactaagtgagaatgaactatatatagaatattataaaaaaggatgaagagataaattgaaataatatttgaattatgtgggatgatgatttaacatgcttacattttaaaaactctaaaattcaataaatcataaaattacaaataatatagcatgcttcataatgtttaaatgtaataattattattgaatgatgatgtagcatattgttagaggatgatgatgttgcatctttttatttcaactactcccacattcctttatatatattgtaaaattaactggggcactatggtgtccaggcaccaagatttaaattgagtacatatattcaatttaaatgagtatgaatttttttaaaaaaatgtttagatatgatggttgtaaggtggttttcagtcggttcatctgtaaccgtgatcaccatctaatagggcgctgccatgtgcaaagggaaagctgggggacggtaagtctggttcggctcccaccgcctctagccatcgacttcatccagtgaatgacaggtaggcctctatggtgactgaggttggtttggccctactttagatcggtttcaactgtcatgtgagccctccaatctttttactcacgtatgattgaccggaggttcattttatggcatgacatatgtatttttattcataaatgacctgcataaatatatttatcaaaactagtgaaaatggttagcaataaactcctaccatcaagttttgatataatattttatattctttatacaggagttgacggttaaagtttacacttaatgaccgtcaacaataagcgataccgtggcagtttcgcgtagccgcgtgctaacctcggtataccggtattgcactcctaccccgcgataccgatggaatatttcttccaaacaaatttcaaccggtatatttctttcaaaaaaaatcaatatcagtattcatgcaatttttgttcaaagcactactttcgctacagtacaatctctaaggaacagcccctacatcaagtgccactgtactattgtcgtatactatttctttcttttccaccgttgacgttttagaacggagggagtatgtatatatcgtctgtacattagatttgctattttggtactttcagtgtcctttttctgagtactagctgaataattttgtgttcgctattggagggtacactaagttgaaaaaagaatttaaaatagttttgtaagatgatttaaaatataagtatttatatgattattaacaaaactaaggcagagtgaaaaaaatatcttttagtggttaaattttaaatt

SEQ ID NO: 39727 - DNA, 1501 bp, Oryza sativa
atgcagcggcatcgaggacatcgtcaggtcgcacgtcatcaaggctatctgtcgaaactagatttcggcaataataaaagggggtggctatcaagctaggaaagtgtatgggtttggaaacaaaggatttatacaggttcaggccttcttataaaagaagtaataccctactcctgtccggggatgaatccgccgagtgtattattgattgtatgattcgggaaaaaatcagcatatgcccctagaggcgcccggaccccccttatatatgggaaggagtccggattacaaaagataatctatattcctaacggaatatgaagatacagataaaatacagtcgtaaccgactaagtctctgggtgtttccttgatacacaagttaagaaacaaacccgagatacagataagatattctatctacattaggtatcctgtacccagttcgaataccatcgccgtgtagatatgggatacccataatctccacagtagcccccgagtcctttgcagtcgaccatcatagccttctcaaagatgataatccgagtacttcaaactcttcaagccaaaatctgccgagtggactgtaaagggcgaaaagataaagaatatggtgcatcgaatagatgcacctaattaggtgtagcccccaactatgtgattagttaacaaactaaacatatagttgaaagacaaaataataacacaattgtgcattatatgacaaaagcacacgcggcgcctaaataggcatgctagccgactgctttttagccacaataaaagaaatccgagtggtttacactctaaaaagttcacgaatgaacacacttgacaggcatccgaatataaaaactctaaagattacccatcaagtattataaagattatggtaataaataagtcaaatagcctaggccatgactatttaccatgaaaacaggcatataatacgccaaggaaatgactataataaaaacaagtcatccctagttaacccaaacagcttttgtagcctaaaaaagcttgcaaaaacagcataacgcctttctgtcgggcacctttttaatttgcattgcaataattccaaagaattatatgaccgcataaaaaggatttcatcagcattgggcaacactgttgtgcgcataatattgccaaagcaaaatatgcctaagtccctaaggaacacaatgggccacgctgttaaaagtattgggctgaagtactgttcaggcctaggcccattagcacctccgatacccttaactgaaaaatccgatatccaagcgacgcttcgtcttccccgccggaactctcgccattttccccactccctgctacagtgtaaagctgcgccggcgaactagggttcacagctccggccaaatccacctccgaaaagtgcatcaaaatccttcccgtgatccaccgcctcaatccctcacctctcccaagccatccctcgaatcaaatcagcacatttgagtgaaaccga

SEQ ID NO: 39728 - DNA, 1501 bp, Oryza sativa
cgagaccgtagacggtaagccacgattcggggttagtggtgccgtcatacttctctattccagtcggtttgaagccggctggccaatccactcgacgcaggtcgtcggtgaaggctgcaactccgtcaaggtcgtcgtcgcggcgatccggcgagtgatgatagcctcgagctgctcggcgctgcgtgattgtgtcgcgaagatcgatggggcggcgacgaggtggtgagcgaggccgttccactcggcgctccctatgaagttcgggaggcgagtgaacagaccgctcgtcgtggcccctgctcctgcgattggatcctgctccagtaatgctgaggcttggatgacggtagtcatgagatcggaagtgggggacccggctgccagtcggcgtgtggacgctttcggagttaactgggaccgtcgccgcaatcatggtcttcgtctggttcaagatgttgacgacgtggtcggattgattgagctcgttttggttgaggagggtgtcgagaagggtgatcgcggcaaccgcattctgttgaggggtgcggaaaaccggtgtcccttcgacatcttgctggccgatgagatcacgcgctcggcgccctgcttccaaagctcgttgacgtcgatcctcagcctccttcgcggtccgctcacggtcctgctgctcacgccgtagccgttcttgttcttgcgcttgatgctcctcctccagtcggcgacgttcttcgttctccctggcttggcgttgctcctccgtctcattattggccatgaaaacgccaaagtagagaggggtgtagttgtcatctaggcttccgtcgaagtcgtcgaagtcgtcgaagtcgttgtagcgagaactaaattcgtcgtactccacgatgtcagtaggacgtgagtcgacggtgggagagctgttgtagtcatccagctgatccgtcgaaaccgtgccgagtggttggaggatgacgccgacttccctgaagctaggcgaaatcggtgttgaagccgacttccgcctaggcctacgggatgaaggcgctgtcgtggtgaagacggccgctaaatcgtcggggagcttcatcaggaccggtgggtaagccccatcatcctgatctggtatcgttggagaagatgcgatctcggccgagtggtttgaagccgactcggttgaggtggtcttgaaatagctttcagccgcgttcgggaatccaaacgggaccgaaagccggttctctcccgactggtctgattccgagtcgaggagagaaatcttgccgaagttgttggtgatgaagtcgaggctgccgaaccgaaacgtctgcccgggtgggaagacgaggtcgtcgatgccggagatggaacccattgcactgatcggcgaaaaagcttgacgctacccctacctggcgcgccaactgtcgaaactagatttcggcaataataaaagggggtggctatcaagctaggaaagtgtatgggtttggaaacaaaggat

SEQ ID NO: 39729 - DNA, 1501 bp, Oryza sativa
acacaagttaagaaacaaacccgagatacagataagatattctatctacattaggtatcctgtacccagttcgaataccatcgccgtgtagatatgggatacccataatctccacactatcatacaggaccgcggcataggcggctccctcatccgtctcatcttccatgattgttttgtcagggtatattttgtttcttcctccgtttaataatgtaagtcattctatcatttctcacattcatattaatgttaatgaatctagatatatacatttcctatctagattcattaacatcaatatgaatatgggaaatgatagaatgacttacattgtgtaacggagtgagtacatatcggtacttcatctatttcatattataaattgtttcgggttttaaatggatttatgagtgaattcatttatattacctctatttctcattataagtcattctattttttttcctagtcaaactttcaatttatagaaaaatatagtaactttttcagcacaaagaaaatattatattatcaaaatgtattaaatgttaatcttaatgatattaatttggtgttgtaaatgttgctaaaatttttcataaacttaatcaaacttaaaaaggtttgaaaaaaaattaaaatgagttataatactctctccatcatattccaaatctaaaaaatttacttttgataggcatatttcaatccaaccacctattcttttaatgactttcttggatttcatgggggtggctaattggcgcgcgcccgcctgttggccccggcccggaagcccatcaggcttctttttttcttttttttcgcaagatttttttgcgatttttttgcctttttcttttatcttttttttcgcttttgtcttattacttttttaatctttagcacacatattttttcaaaaaatgttttgagttgaaaatttttaaatctttaacttgaaaattttaaattttgatttgaaagttatcaaatcttaagttgaaagttttcgaatctgagttgaaagtttttaatctcaagttgaaaacttttaaatctgagttgaaagttttcaaatcagagttgaaagttttcaagtcgaagttgaaagttttcaaatcagagttgaaagttttcaaatctgggttgaaaatttttcaaatttaagatgaaaagttgaaagttccaaaatttgactttaaaaaatttaaattttgagttaaaagtttttaaatctgggttgaaaattttcaaatctagattgaaagtttcaaattttgagtggaaagtttttaaatttgagatgaaagttttcaaatatggattgaaaacgtttcaaatttgaattgaaagtattcaaatatcagttaaaagtttaaaattttgagttcaaagtaataacacaaaaatagaaaataactaaaaaaacaaaacgtgaaaaaaaagggaaaaagatgtgggcctaacagaaaaaacacaaacgacgagtcctttc

SEQ ID NO: 39730 - DNA, 488 bp, Oryza sativa
tataatatcatctgacgtaaacttgacaaaataattagatgatattacagccgatgaggcatttttatggtttgcacgtaatttatatatcaatgcattaccgatctggtctaactatatcggctgggatcactaacgatatgtcatcggcctattggccgatcggctattggctaactcactctgtttgatgtttccttgctggttacaggatcaaaccagctggcatgcccttagcacactagaggcaagccttggacatgcactggagttaagcagatctctcaggccaccgtgtttttcgtcaacacctgagtcgtcattccccgcatcgcgcagccagtctcgcatttaatgtgaaggatatgaatctgtcggctacgtgtggggagtgaccatgggataagccatcatcagtcctaaaaagtcggggtcgtgggctgtcaggcaacatggttgactgtcacgtcgcttagctaggaccgcca

SEQ ID NO: 39731 - DNA, 1501 bp, Oryza sativa
attcgagggatgaatgccgaatccaagttactctccttgaggcagaagattgaggatagtggttgtcaggtctgttgtattcaggaaactaaaaaagaccactttgatttatctgatatcaggaaatttgctccaaagaatctagatagttttgcttttgctccttccaatggagcttcaggaggtatcctgattgtttggtcgtctcgagtttttgtgggcacagtggtagaggttaacctcttttcagtcaccattgacttcatctcaaggcactctgcccagaattggaccctggcatgtgtctatggcccttgtagtggccctaaaacagcaaattttgtttcttgattcagaaatgtccaaattgcttatcagcaaaattggcttttcttgggtgttttcaatttttatatatctgtgcaagatagaaataaagatggggcagatatgaatgacattttcatcttcaatgatatcattagcactcttggccttctggaaatccctcttaaaggcagaaaattcacctagagcaatatgcatcatatccacttcttgagagattggactgggcattcacatcagcctcatggacaatggactatccaaatacattagtgctgcctctaaccagaaacatctctgatcatgtgccatgtgtagttaagattgacacaaaaatccccaaatcccctattttcatatttgaaatttattgggtagagatggatgggttttttgatattgtttaggcagtttggtctttagatcctagttttgatgatcatgccaagtgcatttctttcaaattgaaagtgctcaagtaaaagctccttgcctggagtaagaatctaagttgatgggacttctaaaaaactgtaacaaagtggtggattttctggatttagtcgaagaaaacagaatgctttcagtctatgagtggaatttcagagaaacagttaaggtacatattttgaaattattggaatttaggaagatctattggaaaaaaggtgcaccaatagatggatgatgttgggggaggagaatacaaaattcttctagttattagccactgaaaggttcataatcaacactgtctcacaagtgctagatcatgatggacagattatacatcttcatgagcagaaagtttccctgtttcatcacagttttaagaacaagatgggtgtttctaattccccacatatggcttttgacctggagtctctttttgacagacatataaatttgagcagcttggttgacatgttttccactcaggaaatagatagtctcatctccattatttcagctgacaaagcaccaggaccagatggtttcaatggctatttcatgaaaaaaatgttggcatattatagctcaggactattacagattggcagctcattttcatgctggaaatgttgttttggaaatccttaatagctctttcataaccctggttccaaagaaaacctcccagagactgttaatg

SEQ ID NO: 39732 - DNA, 1501 bp, Oryza sativa
tcttgaacatacttggacacccaaagtatttaacaatattaaaaccagaccatttaatgattaatttaatatgtgggtaattactgaaatgctctttgtatgattaaaaattaggaattgagctccgaaaaatccgagaatattccagagagtataattaaccatggagaatttaataaaaaattaaatccatccatgctttatatttaggaaattttatttcccacatttaacttcacttgtaaattaatgaacatttaatataaattctaataataatttattaaataatttataaatcctgaaacaaaaatcaggatgtgacattccactacagaacggtcatcgaccatcttgtagtcatagaacttctccatgacatatagctcgctgctggcgtcagaaactccgaacttggcctcaagtgcatcccacatgtcgttccctgaagccattgtgcatatacatgtccactatgttgtcagcgagtacattgatcaatgctccacggaacaggcaatccgaagcctcgaacttaacctcctcctcaggagagagaggtggttcacttcggttaccccatgaaacatagaaacattgcatcgctgtcaaccacagtagtgcacgtgctttccatcttttataattagaaccatcaaaagtatgtggttttagtgcagcaacaaagacaactaccgaaaatgatatatcaggtttttggattgttggaaatatagtcatatatcggcatattttaatccaaaatattaagacaataatcatgacatgaacaatgtgaggtgatctagtgataaaattaaacataaccaggagcatgcttaagatagaataagcatcatcatcatgtagagaacgcaataacattgcaactaacagaagtaacaaaaacagagatagcgacaaaatgttataccctgtgaaagtcccttcgctggattgtgaggtagaactgtctctgttggtgttgtcgatcggtgcgccagctccagctccaggtgcgccagctttgcctccgggtgcgccatctccagaagacatggtgatgcagacgaatggacgatgaacagaagaagaggagcagtcaggtgatgcagacgaacggacaacgaacagaagaagaggagcagtcgtgcggaagcactccccaaaagccttgctcgttccgatctctcgtgcgcgcaagcgatcagaaccggggaaacagaaatgggaaggaaagcgtggagatctaatcgggatcagaaccggggaaacagaaatgggagagaaagcatggagatctgatcgggggtctctgtttcctaatagcgcaagagaggaatccgcccgttgccatagtaacgacgcgatcaatgcgtattgaatcgcctgcccgttacagaggcaatctcgcggggttggattccggtccattgcaaaaggatcgagagagagacgcaacgcaacccaacccaatgcaacgcacgccacgcctcgccca

SEQ ID NO: 39733 - DNA, 199 bp, Oryza sativa
acaagttgggatctactcacgacttgatcaagtttttgaagctcctcctgctgtgaaagatgttttaattagtcaggctaatttggaccgttcggtataactgtttatgtcgacttcattaatctataccaagctgaactgaccagaatcctcaatcgtgtttcctcttctgtttccccctctattatgcctatatagt

SEQ ID NO: 39734 - DNA, 168 bp, Oryza sativa
ttgagatctcccctagcccccggccgaactggcaaaggggggcctgcgcggtctcccggtgaggagccccgagctccgtcatctggcgcgccaggtagggggctcagcgtgtgttttctgagctctcatactcttccgtgtgggccaagtttcccttgttcagcctaa

SEQ ID NO: 39735 - DNA, 1213 bp, Oryza sativa
ttctttcaaatcgggacagtatctcagaaatctgtagaaagaggaggaaaaagcggatatgaacaacatccatcatacagtattcccgtaggaaattattagcaggcatatggagacaataaacagtagagtacaatttagtgtttggttgcatgattgaaattggttacatgtcggcctgccactagccaggatgttagtagtagtactggggaccattgatttgacaaacctgagagaagaggagatgagaggagaggaccccaagtgtgcagtgcagagttgaggagcccaattggagaaaagaaatgaaaagagagcagaatgacagatctgccatcacatctcaaagtttgtctcatgtgaatgtgattactactcagtattattagtcatatgtagaactgagatgagatggtactatgcattatatagttgttactagtggtatatcgaagtatatgtactccagtatgttagtaatagagatgtactagtaatcggaggaagtacatggtaccaacatgagcatgtaatgggattccgtaattttatatcgtagtatgatgtatgcactagtaatttgctggtgttaatgctacggtgatacttaatagaacccatgttagtattattaaattaaaaaaaatcatgttggtgatgcaatacaagtagtagttaccaggcccctttggacgccgtcaggcttgatgacagggacctgtaagttgacatgtactgcaccatcaacatactacatgcttgtagtcgtagatgtacccaaaaaaaaacaaaaaaacaagagagaggcatagcactacttgcaaatgcatccatatatactcacttttaattacttgccagccacactccacacacacactttgttattgcctcgcgcactgcttcctctcttctgcaatcttcccctcccctccccattgagagaggctacacttttctctactcaaattccctaggagtactttttttttctcgtcactctccttgccttaatttggagggaaaagaatatctacttactgctgtcgactcatgtagacaaaacaaaacaaagcacagtcattaatctgaccttaatatcttttggccttctctactttttttcccatagtaaaaataaattatgttttcactcctgaaacaaaaagtaaaatctactgaccagaaaatagaatgcttgttagtaaca

SEQ ID NO: 39736 - DNA, 1501 bp, Oryza sativa
caatgccacttagattcatgcacatccatgtttatcaaatgctatggtggtgtttggatccagggacttatcggatgtttagacattaatttggagtattaaacatagactacttacaaaactaattacaaaaatgagatctaattcacatgacaaattttttaagtctaattaatccataattagcacaagtttactgtcatggattaattaggctcaatagattcgtttcacgaattagtctagggttatggaataggttttgtcaataatctacatttaatacttctaattagtatccaagcatccgatatgataggaactaaatttttagtcccatccaaacagcccctaaatgcttgggcatctactttggggaagctagttgatatacggcatgtggagacatgagcgccactttgatataacatgaacaaaatggtttgtgaaaggaaatctaaactaaacaaatgtttttagactagtggctggatgacttgggtggtgtccggtaaaggctagtgccgtccttggtctgttaaggaccgtgccttgaagctaagcatgaaatgaccctagtacaaccatacttctcgtatgggtatagacctagcggagtaaatagccgagcagaggtggtacccaagtgcactggttttcatctaggtgtgtgaataggcggggagcctacggtgggtaaccatctgtgggcaaccaaattaaaacctaacttaactataacttaacgcatgtgtgagtttttccctcctcgggaacgccagaactcctctcactactagaaaccatgtatgcctagagtgcatgagggctcaagttcatggagcgggtactgccaaagtgaggttattgaaaggctttgccatgacgcatctcattcgttcggactttggctcatgtgttgggcaagtcacggcgtacaggtggagtgtatatccactacagtgtgagtaaaccaacatattcgaatagctgtgcgcgtggatattgagcaccgggacatgtgttacacttgcctagaatctaaattcttaaaatgatgggtgggatatgcatgatgattttgtactggtggatgaacttctcgaaaagcgagaaagggtagaccctagaaaaccatgatggtccagtggccggaagctatccttgggatcacaacggatggtggacagaagcgttactgtttaatgaataatggtattaaaacctgatcagtctatgctaggtcttaggcttatgaaaagaattacaaaatgagctttacacaaaaagaacctttaaccattccttgaatatcctctatgatatgcatcgttgagtgtaattaataatggataatttaatacaaattaaatccagccatgctttatatttaggaaattttattttcccacatttaacttcatttgtaaattaataaacatttaatataaattctaaaaataatttataaattctgaaacgaaaatcaggatgtaagagt

SEQ ID NO: 39737 - DNA, 252 bp, Oryza sativa
gcttattaatatgcattttacccatgagacttgttgcataactgttgtacacatggcacgatacttgttcgaagtttcggagagcatatgcatgcgacgtccaaatttaggaagtagaaccagagaatgtgcctacttttttgcaaataatcaagggggctgacttaatttgtaccacccatttttgggcggtggctaggtccatgtatgccaatatataaatcgatcagagaagaggatcgacgaggagac

SEQ ID NO: 39738 - DNA, 1501 bp, Oryza sativa
cttgcgcgcacgagagatcggaacgagcaaggcttttggggagtgcttccgcacgactgctcctcttcttctgttcgttgtccgttcgtctgcatcacctgactgctcctcttcttctgttcatcgtccattcgtctgcatcaccatgtcttctggagatggcgcacccggaggcaaagctggcgcacctggagctggagctggcgcaccgatcgacaacaccaacagagacagttctacctcacaatccagcgaagggactttcacagggtataacattttgtcgctatctctgtttttgttacttctgttagttgcaatgttattgcgttctctacatgatgatgatgcttattctatcttaagcatgctcctggttatgtttaattttatcactagatcacctcacattgttcatgtcatgattattgtcttaatattttggattaaaatatgccgatatatgactatatttccaacaatccaaaaacctgatatatcattttcggtagttgtctttgttgctgcactaaaaccacatacttttgatggttctaattataaaagatggaaagcacgtgcactactgtggttgacagcgatgcaatgtttctatgtttcatggggtaaccgaagtgaaccacctctctctcctgaggaggaggttaagttcgaggcttcggattgcctgttccgtggagcattgatcaatgtactcgctgacaacatagtggacatgtatatgcacaatggcttcagggaacgacatgtgggatgcacttgaggccaagttcggagtttctgacgccagcagcgagctatatgtcatggagaagttctatgactacaagatggtcgatgaccgttctgtagtggaatgtcacatcctgatttttgtttcaggatttataaattatttaataaattattattagaatttatattaaatgttcattaatttacaagtgaagttaaatgtgggaaataaaatttcctaaatataaagcatggatggatttaattttttattaaattctccatggttaattatactctctggaatattctcggatttttcggagctcaattcctaatttttaatcatacaaagagcatttcagtaattacccacatattaaattaatcattaaatggtctggttttaatattgttaaatactttgggtgtccaagtatgttcaagatttttcttggaattatttgagcattggaagtatttttaacaattcaaagatcatttcattgattaatttaattggaaaagtaataataatcctcttcctagtcttgggccctttccggcccatctccctcttttgtgtgcacggccgtgcagccctagtcggcccagccgagcttcccccttctctttctttcttttctttgttttcagccagcccaagacgaaaagtctaatttgcgtccccttctctcttccttcctctcagcccgcatagaagtctgtttttcgtccctgtcgc

SEQ ID NO: 39739 - DNA, 858 bp, Oryza sativa
tggatcataatcacccctttataaacaaggcatggactccccagcgacccccgtggacttctcgccacttctcagtctggcgcactataatgaatcacgctatacaaaagataaagccgttgcccatgctggcttgtggttggcacggtaaaggtttcacaacagtagctcgcgaaccggtccttaattgtcatgagcacaaccatcaaaaccatatgctcacaacccaccttaaccaggttttaattatcaattaattaacatcacacgattaaccatcgtgagctaccatttaatataaccatcattaataatgtagtatataagattcatcccattagtgagctaatgtttctaagcattgctaagcaattatatatatatatatataacatttagctgaaccaaaccaatacataaggttcaagctaatcaatttattacccaaggtatcaaggaatagggcattcaatgcaaattggccataacaaaggaataggttcacaccacccggtgacattcgaaaataaatgcacagttgaaataaatagagaatttaaatataggatcaacatgctcaaaggatcgtgtttaggatctgtgtgacttgccttgcaataatcggttttcaattaatcttcttgaatacttccggcggcactcacgaaccttcgcaacgacggaaacgacaagctaacacgcaaaacgaagaaaaagactaataaaaaccaaataaacaatacataaaaagtaaacaaacatgtagatcatgattttagatgaatttagcaacttgaaccactcaaaaccgagttacgatgatttagttatgaatttctgaagatttaatctattaga

SEQ ID NO: 39740 - DNA, 202 bp, Oryza sativa
cgttttcccctctctctctccccgacaggtgggacccgaggccccacctgtcatcttcttccccaacctcccgtcgccccaactgccgccatggccgccggtttcgccccacgacgccgcggctcccgcgctccaccccgtcccacgagcgcgtgaaatcgatcccctccacatcctccacctttctccccactctcccagc

SEQ ID NO: 39741 - DNA, 1501 bp, Oryza sativa
tggaattcctatttgaaatattgttaacaaaagtttttctttcagtttgtatggaaggtgttcacaccttacccctaagaagttatggttttgctatttcacacgcgtcagatttttgggcttctatctttattttttcgtccgcaagatcttgcattaagatttctgttcttgtatatccaacttgcagttacactcgattacatagcacttacactcagttatagtgcacttgcacttaattacatagcacttatactcagttctagtgcatcaaaattatattttagatcagttttttctagatttttgattgtttatatgcttgtcttttttgtttattatttcatttaaaatgggctatagccattggttgaaatttctgcaagattcgaagttataaatctatcgcaatatcaaaaggtagtcctattaagctatttcttcggtgtctaggaccctaaatacctttctttcttctcccgcacttcatgaacgctctccatcttttccatttttttctccctctgtgctagggaaggcaccgcggagcacctggccgtgagatttcaatggcggcaccatgaatacaatgagataatagaggaaagatctctcatatggtctattaatgtgaccaaacatgggacatatataatcattccattcacttagcacggatggcacacctcttctcatcgatcccaggaatgctaattcacgcatacgcgctagctggcaaacttccgcacgtggccccaactctatctcacgacaagcgccaggttggagttagggtttctagagtgggtaggggaaggttaacactggagagggaaagttaggggattggccttagagcgtttgtcttgaacaaacaaaggctggtttccatcaagaaatcgggttaatgaaggaaggggggaagaaaagcgtgtcaaagtggaggcgaggactttggaggtgattactatcaaagtggggtctcatgatatgccaataccttctaaagatggagccaaggcgattccaagcgacgaaccgaagccgggaccatctctgccggtctaaccaccggccacacgctagtctgaccgggccgactggccagtctgaccggtggtttacaaccggtcctgactggtctccagcgccgatttgacagtagatttgctagaggtggttcgggtgcttcatcgtcttcaagcaaaatcaatagggggcataatattcctcatggaacatagccgaaatcaaggcggatgcctaggaatttaacggctactcaaaagaggaggttgcaacatcttcggactcaagagttaaaagagagagaagccgaagagtggagggatagaagatttaatgagttgtgactgccgccaatgaaggagtggaggcctaaatccatagagattagagattgatgagccggttgttgagcaagtaggaaaagatgaccaactggttgttaaagatgaattgccgccaaaggaagaca

SEQ ID NO: 39742 - DNA, 254 bp, Oryza sativa
ttaaattggtttaacttttatttaatttttagaaaatgcattattaaatgatttttaatcccgaacgaaaatcggggcgttacaagggttgccacaagtcttcactcatttatgagggaatgacagggctgtcctccgtgtcaggcgggggatggcattgggacccactcaaggaccggttgctgcttagcttccgggggaaggcacggatcaatgcccggtcaaagtggagtgggtccccccccatggagggt

SEQ ID NO: 39743 - DNA, 196 bp, Oryza sativa
taaactcattggaaaaatactcgccactcctatcagaactcaaccgtttgattttcctttcaacttggttttctacctcagctttataggtcttaaagtaatgcaatgcttcatcctttgttttcaatagatacacataacaaaatctagtgcaatcatctatcagtgtcataaaatatttctttccccctttagt

SEQ ID NO: 39744 - DNA, 1501 bp, Oryza sativa
aggtagcgatcactacacatatattcattcggtttcaggcgtttctttgctgtctcctagtgaacaaccttgtcagaattcagaatgttcagcagggggatgaagctaattctcatggtagccttccaggctatgagcctcatctccatatcaactgcaagtctgcagtacaatttctacggctcgtcgtgcccaaatgccgagcagacgatcagcaatgtcgtctacggcttgatcgatgctgacccttccatggccccggcgctgctgcgtttgcatttccatgattgctttgtcatggtaatgtaattgctaaccacaagttaatttagtttttcaactatgaattgatagcagttttaatttctcacaagatatattactgcaagcaaagcttagatattgatggttaattacttcattttgtccccaaaaaaaatgtaaacgaagtttttttttttttgttttttgatcatgcagggttgtgatgcgtccatccttcttgatcccacgaaggcaaacggctcgccggagaagacagcgatcccgctccgcgggtacgacgccgtgaacaagatcaaggcggccgtcgaggccgtctgccccggcaaggtctcctgcgccgacatcctcgccttcgccgcccgcgactcggtggccaagtccggcggcttcgtctacccggtccccgccggcagccgcgacggcaacgtgtcgtccgccttctccgtcttctccagcatcccgtcgccgttcttggacgccggggagctcgtccagagcttcgccgccaaggggctcaccgtcgacgacctggtggcgctctcgggtgcgcactccatcggcaccgcgcactgctccgggttcaagaaccggctgtacccgacggtggacgcgtccctggacgcgagctacgcggcggcgctgagggcggcgtgccctgacggcagcgccgccgacgacggcgtggtgaacaacagccccgtgtcgccggcgacgctgggcaaccagtacttcaagaacgcgctcgccgggcgggtgctgttcacgtcggacgcggcgctgctgaccggccagaacgacacggcggagaaggtcagggagaacgccggcgacctgaccgcgtggatggcgcggtttgcggcgtcgatggtgaagatgggcggcatcgaggtgctcaccggggcgcggggggaggtcaggaggttctgcaacgtcaccaacagctaaaaagctatactggctggctcgagtgaagaacgcacttgtgccattggtgtgcgtgccgtttttgcttagtggcaagtttgcaccttgtgctaattaaacgtttttgttctccaatctacaccatgcacacacaccattcatgttgcaattttttattgccaccttgttctataagaggaggaaaattaaccaccttaatttgttattcactctggttatagtattttggttgtatggctcatgtaaaagatttggggcttttttttttaga

SEQ ID NO: 39745 - DNA, 513 bp, Oryza sativa
gagtagagtgtccactagttgggggtttgtttaatctagggtggaccagggaattattaccattaccattattagggtcttaccaagggtaataggccttggttaattaaaccatgattaccccggaatttaaattaagcgataatgcaataatttaaatcaacataattttataaactgggattcaatatgttcaaagatgatgtgacttgccttgctcgctttcccaaacgtcggcttcaacctccacgaagagcggatcttccgaagctgcagcgtctacacgaccaacggaaaagaaaaggcttttactctaataaactccatataacaagcagaaacaaagcacaaaaatgggttcttgacttcttaaggaaaaattagagacttgaacggtccaattccgagttcaaatggccaagttatggccatttgaaggttatatgctctttaaatgaatatttgcaaatttcttcatttaaattttaatttaaaatttggatttattgcgtc

SEQ ID NO: 39746 - DNA, 1501 bp, Oryza sativa
cattcttctcaaggtgcattacgtcgatggcatgacgaacctccaggtctttccagtaattcagatacctgaaaaatattgagtgcttcttaaaaggtaagttactttcctctacaggtgcatcagtattttcctgatccgtccgtttcttcctcttgatgggcttcttctttggcttgccgaacacaaccttaatatcttttgtcagctcgaagacagagccaccagttcgtgtgtccggagctagatcgttctctactgtattgtcgaataatctggccttcacatggcacctatgcctctgaggtaagaaccgacgatgacgcatgtacacacccttggttgacgaggtgaggtacttgtacgacatcttgtcgatacatatgagacatctgaacttttccttaaactggcccgagagcgaaaagtttgccggtaagtcgttgatcgtaacgaatatgatggcatgcagagtaaaatgttccctacggtacttgtcccacattcataacccttcctcccacagttcttgcatgtcctccatcaatggttccagaaacacatctatgttaatcccaggctgtcttggaccttgtataaggatagacaaaagaatatactttcgcttctggcaaatccatgtaggcaagttgtacacggttagcagcactggccaggtgctgtgtgtgctgcttaagtcaccgaacgggttcattccgtccgtgctcaatgcaaaccttacatttctcgggtcctttgcaaattccaggtgtagtgcttcaaagtttttccacagtcgagcatcggcagggtgtcgaatcttaccgtcatttttcttaccctcctagtgccatcccatcaacttggcatcatcacggttggaatatagccgctttaggcgatctttcactggtaggtaccacaccaccatcctaggaatcttttttttctcatccaccggtgcatcatctttgtcgaccacctctccatcggaggctccgttacccgtcttgtaccgactcgtcccacatgttgggcaagagtctaaatccgcgaatttcttgctgtacagtatgcaataattttcacatgaatggatcttctgaacacctaaagaaaatggacatatcaatttctacacttgatatgtgttcgttggtagcaggttcggcttaagaagcataactctcaaaagatccatcaaatcattgaagctagtgtccgacaattcatttctggccttcaatctgagaagttcaagcaccgagcgcagcatcgaatagtccttgtcgcatcctttcgcttcgtcatacagaaggtccttcgctgctttctccaacgcttcccaattgtccaaccctcatcttctaccagttaggacctctggttcaacgtgccacaacatatcttccagatcaaattcaatgccttcattctctatatgtcacgaccggaaataacccaacgggcgttccttatgtgcatgtattattccttgtcc

SEQ ID NO: 39747 - DNA, 879 bp, Oryza sativa
cgcgcactgcgccgcattaaatgcggcgtgacgcgctcgtcaatccgctataagtgcggttaggtgagcgccgctgtgctcacctaacccacacacgtggtgccaaaaccacagggggtcggggcgccccagccctcggggccgaagcgggagcggcccgacccctcggggagacagagggaggtgtggccacgtcaccctcgggcctgacccccccgagggggtcaggccacgtgggtgaccgcggctacccaagcctctagtcacgataccctcggccccatgtcaccgacagtagcccccggcgttacgccagggcgattgcccccttcgagggaagcgctcggacgtgacgccactccttaggcccggtgacaggtggggcaggtccctacaggcgggcaggaacccagcggtcgcaagttgcgcgcatcggcaagggaaaaccgaccgacaataatgagcggcctctttaagaccgctacattactcgagcagtgcgcgaatcgggacgagccggttcgtttcgcctggagacgtgatgatggcgcttttcgcgtctggcgagcatggttaatgcgcgcttgatctgtcccatctcaactgctacggccgcacatccgtctcgtgtgccgcaaacgggcgagttgggttagtggaggcgtgggcgcgagaaaccagggggcgaggtagtgggcgcgggaaacgaggagccgggaatagcgttggcaagggtataaagacgccgaggaagagatttgcttccttcctctcgccattcttccccttgccttcgccacttgagcactaactcttcgtttcctgtgccctacccttgccgcactcactcgctctcaagctcctcctccgccggcatca

SEQ ID NO: 39748 - DNA, 480 bp, Oryza sativa
acaaaatttcactaagcaatacaattgttctttacttttaatcactgttgagagaaccactcctttcggcgtgacgcagttgtccattcgataatagagatagttggtaacttcgttaacaccacaaatctttaggcgagtctcgtgttagttggaaaagggggccaacacgaggtttgcattttgttagggattgttttttttcactgtgttgagaaatgacatgtttattttttgagaagtttcatggcaatagtaaaacttgtcttatttttttgaattttttatagacatgtgctttgcattgctttgaaaaatgaattgttttgtgaaaggttgcatatttttttagggaaaatactgtaggagtgcataaatatatttaatagaaacaatatttaccctgtacaataaagatatgttacaaactttgcagccattgttgcatttggggtattgaacaatcttttactctataga

SEQ ID NO: 39749 - DNA, 1501 bp, Oryza sativa
  unsure (1)..(1501): unsure at all n locations
caccacaaatctttaggcgagtctcgtgttagttggaaaagggggccaacacgaggtttgcattttgttagggattgttttttttcactgtgttgagaaatgacatgtttattttttgagaagtttcatggcaatagtaaaacttgtcttatttttttgaattttttatagacatgtgctttgcattgctttgaaaaatgaattgttttgtgaaaggttgcatatttttttagggaaaatactgtaggagtgcataaatatatttaatagaaacaatatttaccctgtacaataaagatatgttacaaactttgcagccattgttgcatttggggtattgaacaatcttttactctatagataaccttgctagattcctttttgaaaagatccaagcaaacttggaagtaaggagagttgtttctgaaaatcttattgtttcttgtgttccaaacgctcctagccataattttgactgtgagaaccataattgcgaaaaaatcatggagccgccaatgactctgagagcagtaacgttgaccaagaccaaagcaaacaaccaatgttaaggctgtgttcggaatcggacgttcccgcgtacatagtaagaacggaaaacggaacggtccattagcgcgtgattaattaagtattagctaatttttttttaaaaagagatagatcaatatgatttttttaagcaactttcgtatagaaactttttacaaaaaacacaccgtttagtagtttaaaaagcgtgcgtgcggaatacgatggacaaggattgggaaccttgagttccaaacacaaccttagacgtgtagtagctgtatcataatttaccaattttagtatcaaagccatgcttcctagaataacctggatagaaaaatctacaaccccctagcaaaaatatcttaagtattgaaaggttaagaaaaaaacttgatcgaggcatatattggctaaaggtacaaataaaaaaaagggagaaatatcaaaccaaaaacagagaatgttagctcttgtaccgattggcagatctanattattatttatttttgtaggtccaacccacagggaggcgacagggacttaactgcaataggacgaacagatcattgcacatgcagaaacgaaaacaaaataatacaggtcaacaatacatgatcactgtgttgtgcacgtcagtctgacgcctcaatccttcccgtgcacacaaaatttcttatcctcccctctccatctctccctgcctccctcctgctcagctactactactagtagctatgctgccatggaatcgagctgctccgtacagctaattcttcaccatcaacctactccatcctctctgctcactctgaattctcaaggtatagttctcatcaggtagatggccatggaagcagcagatgaggagagggcgcctctgcttcaacctcaacctcaaccttcacgggtatctaacctacctaccattgcttcttgacttctgcat

SEQ ID NO: 39750 - DNA, 1501 bp, Oryza sativa
tcgctgcttttcctctttttttttcttttctttttcagtggggatgggggatcgatcgaccggatcgggggtgatggtttagaggcggatcgctgacgtggggttaattgcaattacaaatttgcccaagcctagctactaatttaaccctaaccttactcatttgacctcgttttttcacttcaccgttagcacttcatttaggaaaaagaaaaaaaattgctagcacgaagtgaccaaaatacccctattacaaatcaaccctatccccatcctcacctcgtcgcctactgagctgcagctgggcgacgacgacacgcggaggcagggagcggcagcggcgcacggaggcagggggcggcggcgcacgcgggaaaggagggagcgttggcgtttgcaatgacaattatgttaaaaaaacatgcacgcagaacacaacatgacattgattaaaatttgaaataaaagtaagataaatttcaaaattatataaaaaatgagagttcaagggaaataatgtaatatagaacgcaatgatggtaaatgctaaaagagggatagggtaacgagctagcaagtagtgtgatagcggttgatgaaacaataaaaactatgaataaacctctcttacgatgacatttaggtttgatatttagaatcccaataaagattgagaggaaaggcgactaacaatccgtgaagcagcaaggtcatggtggtttatgagacctctacaaagtacaaaaatgaaacccagctcacattacttattggtgaatgaacaatccaacactttggcgatttttgcacgagggataggttacagcccacctgcaacctattggggccttgtccgcaaaaatcgattatgtactattccctccattccataatataagacacaaccataatataagacataatataaaactctacaccatcaagaacttagtactagacactactctttcaatacaaacaccacttttccatacttaaatttaatgctacttatctcacacgatatcttgaatgttgtgtagaaagcatgtctcatgtaagacctagtttccttctctttcctcatttatttacttgttacatcaattttcatcgtttttatttaatgctatggacaccatccccgttattgggttgggaatggccagtcgaattgcgatggagtgcgccctcagttggatataaaaatgaattagtggccgagatcagtaacagctattaatggtagttgccaataatggaggtttaatttggaaacaaaggaaagaacggccattcgctcacctctcgatcgatcgacctgccaacatcaacatgcaatcggcctcctgtcctgctcctgctcttgctcttgccaccggccgtccggctgaaaggaaaacgaagcagcgattgataagagcaagaactaccaccttgcaatcgtccggcctccatcatctctttatcaatttgcttccgcacgacgtcgcgtacgtct

SEQ ID NO: 39751 - DNA, 216 bp, Oryza sativa
ccgggtccgcgcttttgaggcggcgcggaggaggaagctttcttgggcggtcgtcctcgtccccgtcctcgagcggcggtggcggaggtggagagaaggtacgagtgtccagacatgaggagaaggccctgtgacctgaggcggcggaggtgaacggtgaggagcgcgtcgtgtgagaagggaggccggagaagttgtcggagatgtacttggcga

SEQ ID NO: 39752 - DNA, 1501 bp, Oryza sativa
tattttcaaaaataattgtaatcacaaattgatatttgctagctagagaaccaagcaagctactttgactattttacctagcccaagcaaggtttgaaacactgtttagctctgaagtctttctctaccgagattttttggatataaaaatggtgtacaagcttaggatgtgtttagatccggggtaaattttttttgctgtgtcacattggatatagacacacatttaaagtattaaacgtaatctaataataaaataaattacataatccacctgtaaattgcgagacgagtttattaagcctaattaaccgtcattagcaaatatttactgtagcaccacattgtcaaacgttcgatatgatagggtgtaaaacttttgtgtggaacaaaagttttcaacatatcgatgttcaacatatcccctggggcggatcccaacttcccaccatttatacgttacagcgtagcatctatttttagagaacagtaacgataaaaaagatatttagttgccggatatactgtccacatcagcagctagagcaatccgtttctctatcacaaatcgttacaaattaccctgtctaccaaatcgggtctcatgaaagatgccattggtgtcccaagtgattaccacgtgattgtgggcgcagcagtcaattgattttgtgaactcggtacagttcacatgcatacctaaattaggccgagtttagttacaaaatttctcttcaaacttttaacttttctatcacattaaaatttttctacacacataaacttccaactttttcattatatcgtttcaatttcaaccaaacttctaattttgacgcgaactaaacacacctttggagtaagttctaggacgtttaaacaaatttttaggtaggaatctgtctgctgccactctatatacctacgtacaagtcaaagcagtattcttgagataatattctggacaagtagatcccttttgctttaacttttgatttgtcgaaagttaaatattattgatgttactcttttatcagacaatagggaattagttagccttttgcaggttcaagtctattattctcagtatcatcattagagcttaaatcctttactttcagaacttatttccagaacacaggctctcaacatcaaatggattttaagacaggttaataagatggctgactttcttgccaaaaaaaccagggataaatctagacaaaatctgaatcaaatagtttgtcaaaatatttctcacttatgctctcattctgactgtccgactaagacagctttgaaatcctctccttttaagttctgaattcttaaaaaaaagggcgtgttttcaacatatagatgccaggcttgcaagcttagacaattcttcgcatgttgcaccatgtggcacattgtggtctcgaccttgtcttgttcttttgttttgtgcagtccttttcacatttagtttttcaatcctagatcctatctactttctccg

SEQ ID NO: 39753 - DNA, 1501 bp, Oryza sativa
aagcaaattgataaagagatgatggaggccggacgattgcaaggtggtagttcttgctcttatcaatcgctgcttcgttttcctttcagccggacggccggtggcaagagcaagagcaggagcaggacaggaggccgattgcatgttgatgttggcaggtcgatcgatcgagaggtgagcgaatggccgttctttcctttgtttccaaattaaacctccattattggcaactaccattaatagctgttactgatctcggccactaattcatttttatatccaactgagggcgcactccatcgcaattcgactggccattcccaacccaataacggggatggtgtccatagcattaaataaaaacgatgaaaattgatgtaacaagtaaataaatgaggaaagagaaggaaactaggtcttacatgagacatgctttctacacaacattcaagatatcgtgtgagataagtagcattaaatttaagtatggaaaagtggtgtttgtattgaaagagtagtgtctagtactaagttcttgatggtgtagagttttatattatgtcttatattatggttgtgtcttatattatggaatggagggaatagtacataatcgatttttgcggacaaggccccaataggttgcaggtgggctgtaacctatccctcgtgcaaaaatcgccaaagtgttggattgttcattcaccaataagtaatgtgagctgggtttcatttttgtactttgtagaggtctcataaaccaccatgaccttgctgcttcacggattgttagtcgcctttcctctcaatctttattgggattctaaatatcaaacctaaatgtcatcgtaagagaggtttattcatagtttttattgtttcatcaaccgctatcacactacttgctagctcgttaccctatccctcttttagcatttaccatcattgcgttctatattacattatttcccttgaactctcattttttatataattttgaaatttatcttacttttatttcaaattttaatcaatgtcatgttgtgttctgcgtgcatgtttttttaacataattgtcattgcaaacgccaacgctccctcctttcccgcgtgcgccgccgccccctgcctccgtgcgccgctgccgctccctgcctccgcgtgtcgtcgtcgcccagctgcagctcagtaggcgacgaggtgaggatggggatagggttgatttgtaataggggtattttggtcacttcgtgctagcaattttttttctttttcctaaatgaagtgctaacggtgaagtgaaaaaacgaggtcaaatgagtaaggttagggttaaattagtagctaggcttgggcaaatttgtaattgcaattaaccccacgtcagcgatccgcctctaaaccatcacccccgatccggtcgatcgatcccccatccccactgaaaaagaaaagaaaaaaaaagaggaaaagcagcgagcgagagaccgggggacggaaa

SEQ ID NO: 39754 - DNA, 373 bp, Oryza sativa
cccttcagctctatttgacagtctgtccaggcttgacttcaagacctgcacaactttgactaatcagggaaagacacatgtatagagtagtccttcccttccaagaaggcatgaatgaaacagtatactacagttcatatttgcctttagctagtaaagttgaaaagcaactagcatagtaaattaacgaggatggcccatagaaacaagcgaccttatctttccgcttatgcttatcagccaaaatttgaattttcaatcttaaatttggagttgattttggaggttttcagaagtttatttttcagccttttcttttagatcgctaagttttattcacaaattatttttcgttcgtaaatatgccaaacga

SEQ ID NO: 39755 - DNA, 1501 bp, Oryza sativa
ctacacgaacttgtaaaagacttgtttcggtacatgaatttgttcgatgcatgtgaaacaaggtcaaaatgacacatcataatcaattttactaagttatacactgattaggacgagatgtgcatatggaggtggacatgagacatgcatttgtgctttattattctttgttctaccccttgcactatttctcagtatttttgtgtctttctccatacaatctttaggccttattaacccctttttattgaacaaatgtatatgtacttagcatttttctcacacatgtgtttatgtagtatcctaattaacactaaaataagattagctttgttttttcttttggccttgattcacatgcacctaacaagttcgtgtatcaaaatgagcgttttataagtttatgtactagattgcttccacctagcaagttcgtgtaccgccaatgcaatttactcatgctagtatttggagaaagcatataaccaaatgacggtttgtgcttgaatcaaggatagcttttctgggctcaaaaggccagagctgcttaggttccaatgaagatgtttctttcgtgctttttgggaggatcactgcgatggcactcctccgatgttgctacttgcatatccttctatactttatttaacttggctacaacttgaaaatgaacgcaaccaatcaccacggctgtccgatccaacagcattttcagtacaggaaaactacaatacattagatttagggtgcaatcttttcagcttatgaacttcgggatatgcataccacggttctcaaactagaaattttctacatcagcattgcctggctcgctttaagctatttattcggtttataataatttaggagtgtaatatttaattcattactataaacaattgtcaataacctatccaaatcatgcatgaagaatggaacaagtaatacaatgctacgaaaacagttcaataacatcacaagaccaaacattgctacgaaaacagtttcactaacgccacaagaccaaacattagtatcgaccttctaagataacaatcacaagaccaaggcctatctttcaattcacctccatccatagtattccataccttccatctcgttacgaagatattgaacaaaacatagtatagttaaccatatacgaaattcgatctgaaaaacggaagttcatcagactagcctctcagggattcatgtcacaggaattcgtttacgtgggtcgctctaggattgcaaactcgggtaagataacgaaaaacagacactgaggacttagggagataaaactgccataagacaaaagtcacaattgcagtgccatctaaagacatgcatcacattggattcgacgagcattaagcaagaaaacttgattcagcagaaagccaatccttgctagagtaaatgtcagacgatgatacttgaatacatgatatggtctgcttaaattaagttcctaataacattgaagtatgaagca

SEQ ID NO: 39756 - DNA, 1501 bp, Oryza sativa
tggaggccggatctgccgccgcgacgacgggggaggctagatccgtcgccgcgatcgccgcagggccactagtctctaaagactaaactatatatttaaaaaaacattaccaatataactttatgaaagagagtttctcataaaaaaaaatataccaatataacttttcatattttaaatatttttacgtctattaaatttttaaggtttcaagatttgactgcacttacaggagatactactatacaagaatcaacgagaaacgaatttttaagttgcgataaactggtagtagtaagattttgtgaacaaggataatgcatatctgtgtaaaaaaaatatatagtgcaaatcacatatacattgaaaatctagaaactattgtcacgagtaaaatttttaccaaccaaacggccacaatgtcgcgcagggcttatccggggcactactgcccatgggctgaaagtgcggccacaagcccacaatatcttgcggggcttagccggggcaccacggcccatgggctctatctccctcaccagtaaagccctagcctccaagaccgcacccgtataaagctgcagacctctctctccttctcctcccccgccaccgccgctcgcctccgaaaccctagccgccccctccccgcggccgcgaaaatggtacgcttctccctcctcctcctcctcctcctctcccctccgccgcacgacgggaagatcgcacgcgtgcttgtcctcgtgccagtccacggctccgcgcgccgtctttctcatggtgtttcacaatttgtaggatgcgttctttattcatgttgatctgccgtagatggggggatcttgagccggaggagaggagtagctagtttctttgattatgcgttttggggtctagcggattttaacatgagatggtttctctttagcgacatttttttttgttcatgttgatgtccacggtgattgttctagttatgtcatttttatcttcaagacttcaatgctttgaatcgtgggtatagaccagattattgtcgtgaagatcgacgtattttccgagctgaccctctgcatgctgaaaattttgtagtgggttatatctagattatatgtgtattgttgtcatttaattagcacttaaacttctgtagtatgaacattttcatcattttcctgtgaggacatgggatgagttcctttttttttctcttgttctaaaattgttcggtaatcttgtctggctttgactaatgggctccgatgatggcatgaaatctttgagacctgacattcttgtgatgacaaacataagcatatttcctgagacccaattgaggttttaaccattggtttgctgaatgtgtcttcactgttgaaaaatttgtacacacatttgcttcaaattatgcacatttgattattgtttataggcctgcgatgtccattccacattcagtatttgttaagctgagtgcttttgtttcaaatttgttttgtat

SEQ ID NO: 39757 - DNA, 1311 bp, Oryza sativa
gttatgtagattccatcttctcaccgctgttgctgcaaataatctttgttaactaatggtacccagattgcttactttggacctatgcttctcctttatgttccttcctgcaacaaactgcgacatactatttatactaggtttgctgttagtgcagtgaaatttggatatatctatatgtctagagatttcctatccatgtgacctgattgtacaatgctgtttctttggtggaatttagtatttgcatattaacttctttagtttgctccctgtatgcccatatggttaagttgattatcagctccgttttttgccaattgataatctgacaggtacattagttctgaagcttccgagttctggagacatgcaattgatgtcaattgttctcaggcatctctatcttttaacttggagtatatctataatacatacaaaattatccatgtttctaaattggctgcaacagctaacctcagcaatcacattgattagctaccttctatatatctagtttgtagtacctaaagactaaactctctaatggtccacctagattgttcccagatagcacctaatatctatgagctgtggcataaaatattccagttactgctggaccctgcattttgctgataggtacaaaaagctattttccgctgcattttttttaatgattttgcaatttaggacatacttgatagtattattattccgtgctatcctatgaactggcttgccattaacttcatacatctctctggttttattctaagatcatacttagtatgtgtcaacccccatagtattaatattcccagcatagaaatgctgctaagtttctgtcttgtattgaacagcatattctttcttatattgaattatctgcactgaatatttggagccttttcttgctgttgactagttggagtaatagttgcatttccaatgatttttgtcccaaagacaggctagcatgaagctgtagctggagtttttcctgcgctttgcctgccaccactgagcttaaaacatggacaacatcattaatcaaatccttagaatctccaaggaagcgaggattagtagcaccagctgagatccacatttcccactatttactaggataatgataagtactagtactatataacacattacaattcacattcgtccattttctgtacagcctgttagtcttctcaaaggatttttgttccctaattacccttacatttgttcttgcacatacaatatttctgttttcttgattcatgtacctctgaacattttcatctttatttcagg

SEQ ID NO: 39758 - DNA, 1501 bp, Oryza sativa
tgccgatgcgcgcaacttgcgaccgctgggttcctgcccgcctgtagggacctgccccacctgtcaccgggcctaaggagtggcgtcacgtccgagcgcttccctcgaagggggcaatcgccctggcgtaacgccgggggctactgtcggtgacatggggccgagggtatcgtgactagaggcttgggtagccgcggtcacccacgtggcctgaccccctcgggggggtcaggcccgagggtgacgtggccacacctccctctgtctccccgaggggtcgggccgctcccgcttcggccccgagggctggggcgccccgaccccctgtggttttggcaccacgtgtgtgggttaggtgagcacagcggcgctcacctaaccgcacttatagcggattgacgagcgcgtcacgccgcatttaatgcggcgcagtgcgcgcttatccggtccgtgaccagttgcagtgtgtaaccggtcacagaccggtcagatcgcgggttaggtggcaacaggcggcctgtcacacgcctcgccccgtcccgtcgaaatgatgagagcctccaggcactcgtctctagccggagctggcgtgctagctcctggagtgggtatgtcagtcccggccagattcataccaggcttcatcgcaaccattacaaggaagtaattgtatgaagaagggcagacgtgtggcatgctaaactgacacgtggtagacaagaatgaccggtttgtgactggtctgacgccggtcacgtcatcggcagacaaccgtgctcccacattgcatctgcttccggcggagtggaggtaggtatgacccatcccatcggagggtcattcggacagcggccattgcaaatctccacccattaatgaaggaatgacagggctatcccctgtgtcaggcgagtgacggcgcaaggcctcactcaaggacaagctgtgatttagcttccaggcgaaggcgcgagccaagttttggtcaagatagggtgggtccccatccaaaagaagagtaggtaaaaatggtgcatgtggtatccccttgagatataaaaggaggaccttgcccaccgaagcaaggggacgagaaaaaaaagggagagactctcagacgactctgagaatacctgagctcgtagaggagagaaagaagaagagtggttctagagcctgaactctcttgctctccggctctctgtaactctttcacacacagatccaccagaacacaggagtagggtattacgcttctcagcggcccgaacctatctacatcgcccgtgtcttgtgcatttgctctctcacgaacattccacagatcgagggtgaagaacctcacttagcgcccccggccgaaccggcaaaggggggcatgcgcggtctcccggtgaggagccccacgctccgtcatctggcgcgccaggtagggggcgcgtgtgtctttctaagccctcgtcctctttcgtgtgcgccaagcttccctcgctcagcccaa

SEQ ID NO: 39759 - DNA, 1501 bp, Oryza sativa
ggcgcacacgaaagaggacgagggcttagaaagacacacgcgccccctacctggcgcgccagatgacggagcgtggggctcctcaccgggagaccgcgcatgcccccctttgccggttcggccgggggcgctaagtgaggttcttcaccctcgatctgtggaatgttcgtgagagagcaaatgcacaagacacgggcgatgtagataggttcgggccgctgagaagcgtaataccctactcctgtgttctggtggatctgtgtgtgaaagagttacagagagccggagagcaagagagttcaggctctagaaccactcttcttctttctctcctctacgagctcaggtattctcagagtcgtctgagagtctctcccttttttttctcgtccccttgcttcggtgggcaaggtcctccttttatatctcaaggggataccacatgcaccatttttacctactcttcttttggatggggacccaccctatcttgaccaaaacttggctcgcgccttcgcctggaagctaaatcacagcttgtccttgagtgaggccttgcgccgtcactcgcctgacacaggggatagccctgtcattccttcattaatgggtggagatttgcaatggccgctgtccgaatgaccctccgatgggatgggtcatacctacctccactccgccggaagcagatgcaatgtgggagcacggttgtctgccgatgacgtgaccggcgtcagaccagtcacaaaccggtcattcttgtctaccacgtgtcagtttagcatgccacacgtctgcccttcttcatacaattacttccttgtaatggttgcgatgaagcctggtatgaatctggccgggactgacatacccactccaggagctagcacgccagctccggctagagacgagtgcctggaggctctcatcatttcgacgggacggggcgaggcgtgtgacaggccgcctgttgccacctaacccgcgatctgaccggtctgtgaccggttacacactgcaactggtcacggaccggataagcgcgcactgcgccgcattaaatgcggcgtgacgcgctcgtcaatccgctataagtgcggttaggtgagcgccgctgtgctcacctaacccacacacgtggtgccaaaaccacagggggtcggggcgccccagccctcggggccgaagcgggagcggcccgacccctcggggagacagagggaggtgtggccacgtcaccctcgggcctgacccccccgagggggtcaggccacgtgggtgaccgcggctacccaagcctctagtcacgataccctcggccccatgtcaccgacagtagcccccggcgttacgccagggcgattgcccccttcgagggaagcgctcggacgtgacgccactccttaggcccggtgacaggtggggcaggtccctacaggcgggcaggaacccagcggtcgcaagttgcgcgcatcggcaagggaaaaccgaccgacaataa

SEQ ID NO: 39760 - DNA, 1501 bp, Oryza sativa
atagggttccatttgcaaaagcagcatttagcaaacatttgagaatttaataaaactgttaagtaataattaaacaatattaatccaacactatacaacgtaccctgttgtataggcccaaccattctgaacaaccaccccggctgcacagttctatctccaaaccaggaatataccattccaaaccaggagctaatcaaattattaccaattatagcatcatttactatggtgaaaagtgtgagactaatcacgaaagacattgttagacccgcccataaccgcgggcacggctattcgaatagttttactctgatcagaggtgtaccactgtacccacaagacacagccccacatcatgtcaccatgtgcctcaataccaccacggtacctcggaaaggagctgtgacaatacccctcgcacaacacaatccattacagcgcacctttcctggatcataatcacccccttataaacaaggcatggactccccagcgacccccgtgggcttatctccgccacttctcagtctggtgccccgcaatgaaccatgctatacaaaagataaagccgttacccacgctggcttgtggttggcacagttaatgtttcacaaccgaaactcgtgaaccggtccttaattgtcatgagcacgactctcaaaaccatgtgctcacaacccaccattatcaggttttagttggcacattaattaattaaccaatcacgattgaccatcgtgaactatcattaagccatctttaaataatagtgagtcataagttatcccaatagtgtgctaatgtttctaagcagggctaagcaattatatctaatacgtctagttgaaccaatataaacaaagctcaactagtcaaattataataacccaaggtatcaaggaataaagtaatcaagaacaaaaaggctataacaaacaataggttaattccacccaatgacattcgaaaataaatgcaatatttgaatagaaacaatagctttaaataggatcaacatgctcaaagggttgtttgggatctgtgtgacttgccttgctggccttggaactcttcaaactcttctccggcgaaaacggactcttcggaaacgacggaatctaagcaaaaaagagcaaaatcaccaaaacagcacaaaacaagcatgaacagtacatgtggatatttttaatatgtatatctcaattttagaaaaatttagagacttgaaccaactaaatcggagctaagatgaattagttatgaatttttgaagattaaatcggattaaaacacttaaattgattttaattgaattatgacgcaataatgaattatttttgaaaaggaaaagggatttattgcgtcagcgggctagggtttcgcggtggaccgggcgcacggcggcggttcacgggaacggacggccgagatcgacttgatccaaaacggacggccgagatcgatcgggtccacggcggctcacgggaaacggggacga

SEQ ID NO: 39761 - DNA, 1501 bp, Oryza sativa
gtgctttagatttcggtggaagttgggataagaatctaccttatgcagaattttcgtacaacaacagttatcaagctagtcttcagatggctccttacgaagcactgtatggtcggaagtgccgcactccgcttttgtgggatcaaacgggagaacgtcaggttttcgggactgatatcctgagggaagcagaagaaaaggtaaaggtcattcaagaaagattgcgagtggcccagtcccgacataagagttatgccgacaatcaccgcagagatttgagttttgaagaaggagattatgtgtatcttcgtgtcacgcctcttcgaggggttcatcgttttcacaccaaaggaaaattggcaccgcgttttgtgggaccttataagatcgtcagtagaagaggagaggttgcttatcagttggagttacctcaatctttggcaggagtccataatgtgttccatgtgtcgcaattgaaaaagtgtttaagggtacctaccgaagaagctaatcttgaacagatagaagtccaagaggatctgacctatgttgagaaaccaatccgtatcttggaaacagatgagagaagaaccaggaatcgagttatccatttttgtaaagttcaatggagtaatcactcggaagaagaatcaacttgggaacgagaagatgaattgaagttagctcatccgcatctgttcgccagttcttccgaatctcgaggacgagattctgtttaaggggggtaggtttgtcacaccctgaaaatcataaatatataaattgttgtttaaatggaattttttttgaaataattttaaaagccttgaagagaagatctaattttaattaataaattccaatataaaatggggccagataaaattttattaaatactttgcttaattctataattcctagatttttctgggattcatttgagctaaggaagtatttttaataaatggaattgcatttaagaaataatttaaattgaaaaaggttttaaaaagtcttcttttggctttgggccgaaagtcggcccaaaacctctcttctctctctcctcggcccagtccggcccagtccgccgccgcgcgcgcgcgccctcgctcgctgacaggtggggttcgtcttccccgagccgccgtcgcccggccgaaaccctagcgcgccgccgccgccgttcacttccaaatccggccgttcctttccttctccggccgaatcaaaagaggggaaatgatctccgggatctcctctaccttttctccgttggaatcatcggctaaaacgttttggaagttcgtggaatcgagttcgattcggatcggcctctttccttcaagccacgaagtttccttctcgtcaccggccgccgtgggccttcgccgccgcctcctagcccctttaaaaggctccccggtgtctcctctacccgccgccaccctcgccttcgcctctcgtcgcccgtagagctctagcgccgtgtgccctagc

SEQ ID NO: 39762 - DNA, 800 bp, Oryza sativa
tttatttcaatatttcctaagatgattcaggagcaaatttgttgtttgtcaccctctggccatacgggcaatatttcataagctcaaaacatggtgattgttcctcagatgtcaagtcttacgtacagtttttttttttttttttttttggggtgggggggggggataattgaagtacctgaattgattggtgggctgaattttatgacttgcttcagttgttgaagatgaattggatggctcatataaaagtgacttattttctggcaattgcagatggcacttcctaacagctgcaacaatcacctgacagaggctcttgagggggctaaatcccaggttcctaaacctgtaaactcttgagccggcaatgaatacagggaaactgatgatcatgaacacagtcgggattgcgcaacccaccccccatccaacattgtcttgcaaccaaacaagcactgtgcttgacagcaaggtgctgacagtagtcatgtagaaggaccaactgaagaaggaggccttcttcggtaactcctccagatcagtgctatcaaactggtcggccccaaaggatgaagtgcatggtttcattgcaccactcccaagggcagcaagatagagccctagatacactacggaacgatgaacattgccatgttcagaagatgtcaagaacattggaagtgatgctgaaactgtcacgatgagcattccctgacaaaatggaaatattcagagtctgcagaaggtactagctgatagtgcagaccatatctgtgagctgcatttgcgcttacagt

SEQ ID NO: 39763 - DNA, 1501 bp, Oryza sativa
attgatgatcatgtctcatgaattatggtatagagataacaaattaataatggggacacatgttggggaacatattgttgaatagacccaatatgagatattgtaagagccatatgtgttgtgtcatcaatgatcccatttagtcttgatgttggatccttagacctaagattatcatgattcctagggaccgctaaatgctactccgtaattgggtagttataaaagtagttttcgggtatgctatgaaacatgtagtgggatatgaataatcaaaataggatttgcccctcctatggagaggtatctctggtcccctcgatgttatagattatggaagtgcatggccataccaaaggtgattgaggagtctatcacaagttatataatatatcacaggctcgagtgaatgattaagctattagaggatggcacatatctagccttgagcttcatcgatatcgtgaggcaaaggggttcatacaagtatacactagaggtttagccgatatgatctttatgtatgcccagtggatcaatatgttctactagggaccgctggtgacacgtggaccgaaaaagagttttcgggttatagccgagtgtgtatgaacctacagggtcgcacgcttaatgggccagaataaggggattggatggagatccaatatgagcttaatttggatagagatccgaatggaagttctacgggcctaagtcatggatcctatatattcgtgaggggtgtgaccggcagaggtaatgcatcacgtgagaaaccctagctgccactcccttccctgagcaaaatcctagccgcacgcgggtactagcatatctgcgcgtagtattctgtccctgtacgtgtggatactggtagaggtgccgctgctttgcggtgctgatcggcgtgggattacagcgaggagaacgcacgaggaggagaagatcgagccggtacgatcgactacttcctctacatcgacgtgcgctactttgcgagggttcctttgccttcttagcgctttcttccgctgcgcagcgcgtcgagtggtaacgatttatgatctaatacttgcatggttcctagtttatgcgctagaaaattttgatttatactatcatagcctgtgcgtaacccaacagagagagatgtcgagaccatactgttaagacataaaattccctaacaaaaatgcaaccttttggaatggtaacttttggacaaaagtgacaggcttttcaaactactaaacggtgcgtttcgtgtgaaaactttctatatgaaagttgttctaaaatataagattaatccatttttcaagtttgtaataattaaaactcaattaatcgcacgttattacctcctcgttttgcgtaaaatacttaatcttttatcttcatcttcattttcaaacaccatcttcttatcgcacttataattatgtaaaggaaaaagtacgaattacgcccctgaactatcacggtcggtcgaattacc

SEQ ID NO: 39764 - DNA, 175 bp, Oryza sativa
agctgaataatagtttgaaggagtaaaatggacgaatttccttaatccgtttgttctttggttaattaacgatgagtgtatttgtagttgagtgtaggcatcataggtgatggaaatattatttagtgcacgctcgctacttctgattctaaagcaccacttcttttaattcagg

SEQ ID NO: 39765 - DNA, 1501 bp, Oryza sativa
acaacgcgaatcattaatacatgattaattgagtattaattattataaacttgaaaaatatgtttatttgattttttttttaaaaaaataaaattgcacgttttagcagtttgggaagcgtgatcatgacaaacaagggagaatcaacatccaaactcattttgtctcagccttaaactaaacttggcctttggctatacatctaacatagatgtacaagctaagagaaactgtatatatcttgtagagaatttttactccttgaggttttgaggtaccatgcggtaccaaatctgaaccgtcgatccggcctcatcggacggatgagattgcagcgtaccgcctagtaccgcacgggctgatatacgcggtaccgcaggtggggggtaggaaagtaatttcgccttatgccgcaatagcgagagagaggccgatgattctgctcggctctttccttctctcgtccctctttcgttctttcgtctctcaaagaaacgaagctggccttcttcttcctccgcacatctcgaatccggccttggcacacatagaggtatttccttctcttgtttttctgtccgatttcatgggcgcacgcagagggaagacctctctttgattctctcagctctctttcttgatctcgtatttctcttcgatttacatgtgggcgaaggcagttggagcagcgcagatgatgggggatggcagatccctagataggtccatccgctcgtggcccccttcgagcaatggaggtgatcttgccgcatgtagggtggggctggtgtttagaactacgcaacagcgggtagattggccgcgtgcatcttcattcagtcgtgccctagtaatcgttaagactaaatgaagatgtgcttagtcttaatgttccttctattatgtactgtgatgcctttctatgatgtaattaagttaatggatgaaccatctacatatgtttaatcctaaatggatgcttcagtattgaaaatctggctgtttcggttctgcctatgattttttgctgctgctgtttctgaactgactagtgtctactagttgcccatgtggaagctaatgaaatctgatgtttgtttcactgatgaaagctggtgtttatttcactgatgaaagctggtgtttctgcttctgccgtataacatatttggcactaatacacttgctagcatggatatttgggatttaaacacaagtacaaatccaggaacacaacatgtgagctttgcattcactgattaatagatgcaatttaactgaaacagccagatttaaacacaagtacaaatccaggcacacaacatgtgagctttgcattcaataccgatgcagtttaacaacaagctgggcaaaatacacccttaatccataagaaagtttgcaaatataaaatgcagtacttcttgtgcaatacaggtttggaacaagtctgcaaataataagaagctggacaaaatcaacccctaatccataagaatga

SEQ ID NO: 39766 - DNA, 681 bp, Oryza sativa
gaaggtctttggctaaatatagcttttgttatatacgccactttgactatagccggctttgtgtactacatcatttcacgtacgttacatattgactacatcgatttttagcttctataaaagggtgcatattgtatatttttggtaatggatttaggctgagtttcaaaaatgaagttttccttaatttttagtggcacacgaaacaacgcgaatcattaatacatgattaattgagtattaattattataaacttgaaaaatatgtttatttgattttttttttaaaaaaataaaattgcacgttttagcagtttgggaagcgtgatcatgacaaacaagggagaatcaacatccaaactcattttgtctcagccttaaactaaacttggcctttggctatacatctaacatagatgtacaagctaagagaaactgtatatatcttgtagagaatttttactccttgaggttttgaggtaccatgcggtaccaaatctgaaccgtcgatccggcctcatcggacggatgagattgcagcgtaccgcctagtaccgcacgggctgatatacgcggtaccgcaggtggggggtaggaaagtaatttcgccttatgccgcaatagcgagagagaggccgatgattctgctcggctctttccttctctcgtccctctttcgtt

SEQ ID NO: 39767 - DNA, 427 bp, Oryza sativa
atgtcaaactttgactaagtttataaaaaaaacgtagcaacatctacaacagcaaattggtttcattaaatccaccaccgaatatacttttgtaatatatttgttttgtgtcagaaacgtagatacatttttctatgaacttggtcaaactttgacaaacttaaaacatattacaatatggaaccgagggagcatttaacatctactcaagattagaatggcgttaccgattattttatcattaaaggtgctatttggatggtcctgtaacccgtcttttgttgcctgtttctagccatgttcatcccgcagtgtttaattccatagttcagcctgcttctactgtagcctgtagtttaagggtttccacaaggtttctgttggccttattttgtggtttttaatcaaattgtggcattattttcct

SEQ ID NO: 39768 - DNA, 236 bp, Oryza sativa
attatggatgcggatataggctacgagcataaatgcatgcatatgcggaaccgggtatagcgagtttttttaagtggatcaacaaatactttttgaatagaaagtcaatgtatctaaccaattattttacaggagtatctagttggcgaaggcgatttcagaatcaaaaaaagtaaagtcaaaatcatttagcttattctctcaatttcaatcgaccgctgttagtatatctaata

SEQ ID NO: 39769 - DNA, 514 bp, Oryza sativa
ctggaccattttctttgacaacatatctcccatacatgggtcccttagcaacaatactatcaacccgtatcacggtgttttcatttactctgagtcctaccttacccaaggcagttcttctctcacttccttaaaaaaacaaacccttttccttcgcacaaaaccaactaccctttcccataaaaaaaataactatctttccttcacttcgagaaaccctacctccccgagaaggtagtctccctcaataaaacactagaaattttgctaccaaaaaaagaatggtatattgttgccttgtatgcgaaggaagccttgactttggtaccgagttgcccccggtccaacaatgagattggggggttactgtcgaagaagtaggaaccgagattcccacccctgactgctcaggacatcaaaggtctgcagaataggccccgtggcgccacatcccgccaagcacaagcaagaccaagacctcagtctcttagttcagcaggccatgccctaagca

SEQ ID NO: 39770 - DNA, 1501 bp, Oryza sativa
agaaagatgatattttgaaaatgacactttacccctttgccatgttgcagcaaggagttctatatttcgacgagtaatttctgaaaattcgggtcttgttccccctctccctctagatcgatcacgctaggatatcattccccagaaaaaaaaattaagtatttttaattcagccaatatttttttctttttttgaaattccagaaatttttattgcatcggtctaccaaattaaatttggcatgagttttgttttttagaaaagaaataaattcagtgaaaatatattcaaatttgaaattttccataatttttgtttcacctttcagagatttccattctatcccctgccttgaaatacttttgatatctgcaattttggatgaaaatataaccggctgcgcgtgcaacttggcatagggataaatgcatcatttctaaagtttcctctctcttcaattaagcgaaaaaagataaaacaataatcttttggcaaattaagacaaaaccagagtgtcatatggtatagacatgattttggagtgttcggtagcaaatgacacaaaacatcaacgtcataaggataatttaagctagatacacctgtgctagtccttctctaaataggtactccttatcctagaaatctcagtcctaatagaaatccttatcctacatgatacaaagagctaagtgaggaatttctcgctctcatttccattaggattagagtcacaaattacaacattgagggtcagctcccgcgagctagattcgctcgtgtagtagttgaacccaaaaacttaccctgttttcaccctaaaattggacttccaataatacccacgctagaaaatttacagttctctagcaaaaatctgtgacctatcaagtatcaaccatacctgaagattgcaactctagcccagctcaagccatattaacaaaaaaaaaagcaatataaataaaataaaataaatatagcaaatggggaatgtttgctcttttagattccaaggtcgatcgtgcttttctattcaagtacagatatgtccatgcaacaaggagacgacgacattgattgaccaacactgcaaggaactgatcatggccaagaaaacaaaggaaaaatacaaatacaagtcatgaataatcgatgccctcatgatctgcacgttactgtgacgcctcaatcctctgcatacaaacaagttatttttatctccactggaccctcccatctttctagctccttgcaataacccaataatgtaatgctgatagctcaactatttcttttgcaaataatgtagtaatagtagtctattttcatcagcaacaacattaattctccatgtctcctgatcaggccacttatatacatattttcatctcaggtaggttaccatggaaacagctgatgatcaggagagagcacccctgctttatcctcaacctcatgcacaggtaaatatcattatattagaacaaattaacatcc

SEQ ID NO: 39771 - DNA, 1501 bp, Oryza sativa
ccgggtgtacatatttatacccatggggagttactagttcttgtagaacaagaaagaaactttcctaaagataaatggaaaacataaagtccttataggacactaaacacacatccctaaagataaaaggaaactaacaaactattcctaattaatatataactcgtcatgccgcatcctccttgaacttggtcacttctggataagttttctttagtagattaatttccttaaccgaatatagtaagaatccgacaactagagacttgataactctcatcggccgatcccaggactctgaagccgacactgactttagaccgatggtgacttcgggcttaccaaattttaacaggtccctcactattatagctcgagcttcgacatttgcttacaataccggcatggacaatcccccacgcctcccccctaaccccctcttgctgaaaagtcaagtgtcgtgatttcaaaacgagcacttatggcctttccgaattggcgttgatgacgtttttctgtgcaatggtagatattagatttttcttacataaaaagtaaaacttttggcctttttgtcgattaagaatacacataattacatgtatgaacttcaggatttaaatcctgatgggaaaattatgcacccatggattaatccaccacataaacgttctttatcatacacagatattactactgacctataagctacttaatttcatcgatgccaatatattcatgggtgcaagttgatcgatgcaagtataattaaaaagaacacttttgagttttgactaataccctagctaagtagctagcatatgaatggccaagtcagaatcgtcatcgaatctgctagtatttgacatcactaagacactaaccactccgatatgaaagatagtactagtatactagtactagatacatgtacaatcgagttggcaaggccccagtggataaagaattaatgcatgccgcgcagcattttttcttgatgaatggacatatttataattaattagttaaactagatcatgcgcatgttcggttgtggctgctgcctgcttgataaaataagcaaataaatatactagtgctatgaatctacatatatttctatctaaatttatagtagtatatgtctaatccagccatttgattgttatattttaaaacggaagaagtaatggttggtcaatgatccccctctctctctctaattaattcattgggaataaactccgctggggaataaactccccatcaaatatatatatatagagagagagatatactatatgtagtattgtttctttccatctgctggagaaggcttctctcagccagccgagcggtggtagcacgtgtactagctctgtgtgtgcgttctttgtggataacaaagagggagaataatggaaagggttttattttttgaaacgaataataatagaaaggataagatagaaggagaaatgaaggagtgatccagtattga

SEQ ID NO: 39772 - DNA, 1022 bp, Oryza sativa
tgatatattatatgtataaataagatatatctacaaccggactccctatatactctctccgtctcataatataagggattttgagtttttgcttgtactatttgaccactcgtcttattcaaaaagttttggaattattatttatttttttggtgacttactatattatccaaatccaaagtactttaagcacaactttttattttttatatttacataatttttttaataaaataatacaaacaaaaactcaaatctcttatattatgagacgggacgggaggagtagatggtaacctcgcacgaatccgcaaaaagatggattaaattctgttgccaaaatatttctccactacacagaacggttgcacccaagccgactgctctcaattgcatccaaacaggccggcccctgcatgcagttcgacacaacctgaccacatcctgcacacgttgcagaaatttgtcttccacgttgctgctctcactcaaaaaacctgacaatacaactcacacgttattagtttaacagccctgctacacagcttttttttttaataatgtattaagaaacccgacctctacatccatgataaaatgtacacagccaacacagcttgaatttgcctggttatagtagaccttgtggttatgtttgtttggcctcttcactcagcagggcttctcttcatcctgcctctttgttgactgataaacctgtagtgtagtgcatactccatactagatgtgaggcttcaatctggtcggtcagaccgaactatcgtaactttggtggtaataacaacttgggtttcctaatcctgtttctgaagagagaccgaagttttttttggaggatttttatgctacactatactacaaaagtatatacttatagtataaattaaggtgtagattcatccaatcttcctttcgattagttttgcagtataaatcgaaaagaatatatttgtcttttcatctttttgcgtgagggtatttttgtattttcgcgtttcaga

SEQ ID NO: 39773 - DNA, 161 bp, Oryza sativa
gccaaaatccaaacatatttggtaaagctgctaacgtgctttcggctatccctaccaaaaacgaatgccaaaatctccccaacgaccaaacgaaatatgtgattaccaaatgtaggtacttaaagaaaacgtggactcgaaataaaactaggatgcaatca

SEQ ID NO: 39774 - DNA, 1501 bp, Oryza sativa
aaactagtggacactctactcatggtaccactagtatgattttaggtagatgcttcgctggttaattaggcaacattaggtggttttacaactctagactttgggaatattcatatcacctggatactatggaatggttggattattggggaattagattcacaccgccccctctattcaaaatccccaaaagggttttaggctgtgcttggggtgcatggtttgaatagtagcacctcggccatataaggaccggtcttcgggcctgtgttgcaaagcactaccgtacttccacatgtctaatgggtaagggttagtttgtggctcaatctggttataaacaaaagtacacggatggagatggacaagttcgggggtcgatggacatctccagggcaaatgaaggctacacgagctgcggcccggtagtcgaagatgtcatggcacagggccggtgttctgctgctaggggctcaatcatgcatacctgtcctggaggttccggctgtaggtgggattgggtcggtactcttgtttatggataggatgggttgggaactatgtcacgtcttctgtccgtatacagtggtggtatgtggcacgtggttacacgtgaggaagatgtgtcttgtgggtaaagatgtacacctctgatcagggtataatctattcgaatagccgcgccctcggttatgggcaagccgagcaatgtacccaagttagtgttttaattcttaaaatttgctcaacaacgaaaatgtggaatggttggcctgggttggcttgggacgagctgggacccagggtcgggttgccagttcggtctgaatcatcgtaggccttgggttaaggcaggttcatgtgggttcacggccttgattaataatcttgtatagctctaggaccgtgtttacaaagtagctttgagcaactaagtgacttttaatgctgtttactgcaaaccctaaccctttatattatgacccccttgtactcccttgcatttattctgcacttatgcgtgtgtcttgttgactacggtggttgtattcagtcttgctcaatttttcccaaacccagaagaggagttcctggaagatgtaggctttggcgtctagctcgtgcctgccgtcaagcgcctgtggtcgtcgccctagtcttccgctgtttcccgtttgtctttgtgtgtgctgggccttcgccgcccatgtaataaagtaactatttacgcttccgcttgataaactctgaaatgtatcaacttttggtgttccttgcctcctgggacaaggaataatacatgcacataaggaacgcccgttgggttatttccggtcgtgacatatagagaatgaaggcattgaatttgatctggaagatatgttgtggcacgttgaaccagaggtcctaactggtagaagatgagggttggacaattgggaagcgttggagaaagcagcgaaggaccttctgtatgacgaagcgaaaggatgcgacaagg

SEQ ID NO: 39775 - DNA, 1501 bp, Oryza sativa
aattgatcaaaatttttcagagatgtggaaggagattcatacgcacccttgaccgcagtcgggcctagggttgtgttcatccccagtacccttccccggtgttcatgagcatgcagtcagccaccggccactttgcttccaccttccgccgtggcagcttgagatgaagttggcggcgtaggcagcggcggcgccttcctttcctcgtccatcaacggaactcgaggggaagacatcaccggagaagcctgcttcattttgccgacgagatccagttgctgacgaagatcgccgacttcctcatgtagctcctgaactgctgcttctacttgaggtctccaactgcttactccgtgatctagcttgacgagcgctgcttgagtttcgccttgagcacgattcagcgtcaccaaggactcctggatctccatcaacaccttgccgaaatcaatgttctgctcctccatcgcttcgacttgaagttgcaaacgggaagtatatcgtggcttctccaggatcgaaattgctctggataccaaattgtcacggtctcgaattcataggagagattcggtcgagtagagaaggaaagagattgagagagatggcttgaggaagaagaagaaggagaagaacagaacagaattgaacaggagagagatggaattgaatttgagtttgttcgattacatgatttgatccccttcctctcaatcctgccggcttatatagcatcgcactacacagcctctctcactcactgacagtggcccagccaattactatttggtccacacacttgcagggaaatgggagttgggctgcttctcccgtctaggccgattcataggctgggtcactggcttctgctttgaactccctgctacagatgttgctgccgtgacagtttcccatcaacaaagtgtgatggaattaatatctagtgctaccagtatcatgttcatctccggcatggtccttcgcttcagctggattttgacatcgtgagaataaccgggtttgttgtttcaatacatatttgttagattgatctttaatcacacatattgatcttcgtcatatttttgtttgacacgcatatatcgacggcaattgagatcaagctagctgcctcctgggatgccgagtccttcaacaacgcttcgtgcattacagggacaacatggatgcatctgatctgacgtccaagcctctatgagatcaatatagagatcaattaacatgcatgatttctctaatcagactgtaaggcatatatcttttttattactaataaattgaccatcctggtattttttgtgtttgcatatatcggacggattgaggtcaagccatgccgtgccagccgatggcacgcacgggaacggagatcaccagcacctttgtttatcaaatgctgtggtgacagccgatgacattaatcaagctgcaggctccgcctaccataccgtgtattggatttatccaaacatgttgtctt

SEQ ID NO: 39776 - DNA, 1501 bp, Oryza sativa
tggtgtagtgaggcagcggaaaaaaatatcaaataaagaagaaaaataaatggtgacttagctttttagtgttcccccggtaatagcagatgtagccgatgtgtggagaaagtcgtccatcaatcccaataaaaacaccagtcggcggcgatggcagccgccggaagtgaagacatggtcgccatcaacaacggcagcggattacaccaaccgtggaggcgaagaaaccggtcggcagtgatgacggcggccagcgatgaaggtgtagatgcccaacaacggtggtgtgaccaaccaaccgtgtaggcgaggacactagttgacagtggacgaggcggccggtcagtgaagacgatgatgtccatcagcagcggcgcaatatgccagccgtgaaggcgaagaggcttgtcgacggaagatgaggcagctggcagtgtagaatatgtcattatcagccatggcgataaagacaacatgtttggataaatccaatacacggtatggtaggcggagcctgcagcttgattaatgtcatcggctgtcaccacagcatttgataaacaaaggtgctggtgatctccgttcccgtgcgtgccatcggctggcacggcatggcttgacctcaatccgtccgatatatgcaaacacaaaaaataccaggatggtcaatttattagtaataaaaaagatatatgccttacagtctgattagagaaatcatgcatgttaattgatctctatattgatctcatagaggcttggacgtcagatcagatgcatccatgttgtccctgtaatgcacgaagcgttgttgaaggactcggcatcccaggaggcagctagcttgatctcaattgccgtcgatatatgcgtgtcaaacaaaaatatgacgaagatcaatatgtgtgattaaagatcaatctaacaaatatgtattgaaacaacaaacccggttattctcacgatgtcaaaatccagctgaagcgaaggaccatgccggagatgaacatgatactggtagcactagatattaattccatcacactttgttgatgggaaactgtcacggcagcaacatctgtagcagggagttcaaagcagaagccagtgacccagcctatgaatcggcctagacgggagaagcagcccaactcccatttccctgcaagtgtgtggaccaaatagtaattggctgggccactgtcagtgagtgagagaggctgtgtagtgcgatgctatataagccggcaggattgagaggaaggggatcaaatcatgtaatcgaacaaactcaaattcaattccatctctctcctgttcaattctgttctgttcttctccttcttcttcttcctcaagccatctctctcaatctctttccttctctactcgaccgaatctctcctatgaattcgagaccgtgacaatttggtatccagagcaatttcgatcctggagaagccacgatatacttcccgtttgcaacttcaagtcgaagcga

SEQ ID NO: 39777 - DNA, 1501 bp, Oryza sativa
tcccattatccaatacaaggatgaaagagaagggtgtggacagttccgtaaaggataaggattaggtttaccagagacgtgatgacagccatatgagctgtattgcagactctctaaggaaaatagctgtaggatatttgcccaaatcgatccattaattttttttctctgtcaaactcttgaaaagtatacataggtcaaacagtactcacacatatacaacattatttggtaattggaggtgcgcatatatatgttaatatgcttccggtaaaatttcagctaagcgtgtgattaaattctaaggacttaactcacacgttaatcttgatttagacatgaactttacttttatgttttcttcaaattgagaatgatatatgctactatagaataaaatgacctttgctaagtatgcatgactttgcagttgtaacatccgataaacataatgacagctgagcacaccgaagaaaaggttgatggctgactgcccaaggaagatgtgctttctctctttcacacattcaaatgttgggttccaaagaaaaaaaaattgcgttttcactaatattattttcacatatggaagtcctaatttttaataattaattaatggtttaagagttcgatgtttggcaccacatgttttaggagatctagatgttattctttgaagaccacataagtactcgctccgtcctaaaataagtacagttttacactgttcatgtctaatgtttgaccgtttatcttatttgaaatttttatgattaatatttttattgttattagatgataaaacatgaatagtactttacgtgtgactatttttttttcaattttttcataatttttttaaataatacggacggttaaacgttgtatacagatacctacaactgtaattattttgggacggaggtagtaatcacttttacgtactcaatgaactcaatgattgtccggaagatagttttcatgattaggctccaatctatcacatctggataacttgcgatcgtaggtgcagttcatatgagaaagttatgacattcgtagttcaaccttttctcagaagcccggaataagttatacaatacttgtctttctttacttctagttccacttgaacagcatgtgacaaaggtgaccactttgcatacatcatgatggcccttcttttacaataacgcaaaatttgctacagggcatcgaaaaaatgtgtaattagctcgtggacaccgcaaaatcgagaatttgctgtcgggcataaaaaaacgtgtaattagctcctggacactcgggaccttattttattatttcctgtaaatttggagagagaaacactaaataaagacaagtttgcccttgggtctcgacctggacagtgagacaacacattgggttggccggaggcggcgacggagctgaacacgtgcagcacttgtgttctgtccttgtgatgggtccgagcggtggagcgcggccatcgccggga

SEQ ID NO: 39778 - DNA, 378 bp, Oryza sativa
ccgtgctcccacattgcatctgcttccggcggagtggaggtaggtatgacccatcccatcggagggtcattcggacagcggccattgcaaatctccacccattaatgaaggaatgacagggctatcccctgtgtcaggcgagtgacggcgcaaggcctcactcaaggacaagctgtgatttagcttccaggcgaaggcgcgagccaagttttggtcaagatagggtgggttcccatccaaaagaagagtaggtaaaaatggtgcatgtggtatccccttgagatataaaaggaggaccttgcccaccgaagcaaggggacgagaaaaaaaagggagagactctcagacgactctgagaatacctgagctcgtagagga

SEQ ID NO: 39779 - DNA, 1501 bp, Oryza sativa
gcggcagccgcgggctgatgccggtggagctgctccggcctgtggtcgccgccgtcgcatcgctggctcgctgcgtgcgtgcatgtgctgaggaatcgaatcgaatcgagggaggaagtggctggtgcgtggcggcgatggacggggacgccagggtgaggagtggctatggcgcgagggcgggtcctggtgctactactagtgctacgacgtcgtcgtcgccgtcgtacatgagcattgacggcgacgacaatggtggtgccggcggggcgaaggtgtgggtgctcgtgctgctcttcttgctgatcgtgctcatgttcttgccgtcggtggtgcggcgaggcaggccatggggaggagggggaggagagcaccatcgaggagggggcgggcttagcctcaagagcggccgggatgttgtcaacctctgcctcgtggcgttcgccatcctgtgcgggctgcttggccgcgccagacgacttgctgcctcgccgccgagccggctggaaagaactagctcggcgccatacacgaaagggaattcactgtatgtgcatgtgctctcgccctcccgatcaaaatttcccctcattttttttgtgatctctccatctctatattcaaattgttgtttgatccccatttctctcccttgcaattgcgaagtagctgccattgacacggcgggagaacgggatgctggcgtcgaggctggcgaggagcagctccgcgatgttgttgttggcgtcggtgtcgtcgatcaacacgtccgttagctccacgccaagggggtcggcggcggcgacgagcacacgtatgccggccaaagcgcggagcatcccggcgatggccgcgctccaccgctcggacccatcacaaggacagaacacaagtgctgcacgtgttcagctccgtcgccgcctccggccaacccaatgtgttgtctcactgtccaggtcgagacccaagggcaaacttgtctttatttagtgtttctctctccaaatttacaggaaataataaaataaggtcccgagtgtccaggagctaattacacgtttttttatgcccgacagcaaattctcgattttgcggtgtccacgagctaattacacattttttcgatgccctgtagcaaattttgcgttattgtaaaagaagggccatcatgatgtatgcaaagtggtcacctttgtcacatgctgttcaagtggaactagaagtaaagaaagacaagtattgtataacttattccgggcttctgagaaaaggttgaactacgaatgtcataactttctcatatgaactgcacctacgatcgcaagttatccagatgtgatagattggagcctaatcatgaaaactatcttccggacaatcattgagttcattgagtacgtaaaagtgattactacctccgtcccaaaataattacagttgtaggtatctgtatacaacgtttaaccgtccgtattatttaaaaaaattatgaaaaaattga

SEQ ID NO: 39780 - DNA, 160 bp, Oryza sativa
cagatatgaataagtgcgctcattatgcaaagttataacagaactctcaactctgaatattaaccaagctaaggcaggtaaaataatcacaacaaaggccttcaaaattttactcatgtaatcatatggagttctccaaaaaaataaaaagatcaacaca

SEQ ID NO: 39781 - DNA, 1501 bp, Oryza sativa
gttaacaacagaagctagcagtacattaatgatcaaattgctctccaaaaatacaaatttgccatgatcacttctataccataaatgtcaacaaaaattatagcttttgtgtaccatgaactagctcttggcataaattaaaacaactgatagtccttctcgtttgcaatacctaataaatcgacaataagaggaagaaatctccataaaaattggaattgagaaagacaatctcatttttgaccatgataaactaaagtactcactgtatacaggagatcgtgcaccttcacttcgcagccctggcaccatgttgcctcagcgccggcggcaacgtactgccaccgctgccctaaacgtggccggcgtgttttctcccagcaaagtcctaccgcctggatccaattcgcggccttccaccttgatccaaatatcaatctcctgatttatctccttttgttgctaactcaattggcggtaggctatcgtaaaactgatctctagcatgggcatcatcgtgggctacaacacaaaagaagatttggaggaatcggaagatgtatgaggggttatttgcaaatatgtgtagccaactcacgcccccataacgtgtgtatgcgccaatgtggcatcctaatcacaagccaactcaataagattggtgatgaagtcatgtcttgcccttggttcgcacgcactacgcaagtttgtgtaccgaaacgagagtttttcaagtttttacactaaattgcacccaccttacaagtttgtgcacccaccttacactaaattgcacccaccttacactaaattatgagaatttaaaatgacatgaaaagctatctttctgaaaaacatgcatgacgtggaataactagttccctaattaattcccgccgtgcatgattaatttggcatgcatgttacgtgtaatgctcctctcctttcaagctattaattttttaattgaaccatgaaaatacatattttaaattagaaaaagaattacgtattaatggttaggggtaagatggggctcctttaaaaggggatcatagctcataccgtctcggcattgctccactccctcgtcaggcaacagcagctggttcgtaactgaagtgaggcaagagtcaactactgtctactggtacgatgattttgttcatataattttttttaaatagagtacaaatctatacgtccacaatgtgcatacacttctctctattaacacacacaatcacactctatccttacgagcaatttcaaaaatctataccgacatatataaagattgacaaagtaactaagacgtctcgttaattcttatggacggatacgccgcctaccactgaaaaaattagtcataaatacgaacacttatattaagtctagaacttaaactctagtagattggttgcaccacaataaacgtaacaagttgatgcttttgtttatatttttgcttacgagatgctgacttattgttagagctaga

SEQ ID NO: 39782 - DNA, 1501 bp, Oryza sativa
cgatttccccctttgcagtatcatggtgatatttcggggcatggtgacatgtgtggaatcgtgtcttgtgggtacagttgtacacctctgatcagagtaaaactattcgaatagccgtgcccgcggttatgggcgatcaaccagattcaccgtgattagtctcacccctagtttagcttaatgaactggtgtagttcaggtggttggttgggcctgttgcaacgtggtgtagcgttggacagtgtttggttaatattgattaattactacaactgttttactgctttcaactactgtttttaaatgcctgctttgtgcaaaagaacctttagcctccttcggttatatcctgcatcatacctcctcttccgatatgacttgctgagtacagtgggtagtactcagtcttgctctcttttccccataccagagctgaagatcttcctagtgggagctgtcttgtcgaagttggtttcgtcgctgccgtcaaggattgcctgtggagtggagtcgccccgctgcagaagtcaagtttccaagtctagctcgttttattttttccgctgcatttgtaatcttttctatttttgtaaaacatggatctgtatgtcaacaattgtcgtttgtgtaccctggctggtcctggacagggatttcatgcacattcagcttagaaattctggttcgtgaatttctgggcgtgacaagttggtatcagagccaggttgaccgtaggacaagccaactggaaaacctaagagctctctgaacccctttttcatctgcatatgcatttttgcacccggatttgtttcgggaaaatttggggttttgcctcgttggtttgtgggaaaaatcttggtcgttcattcggatcggatctttaaaattagctcagtctagggttttagtaaaattttatttggagtttattcgactgtcagtcgggaatctatcaggtgatatgcattaggtcgtatctatgttcgatggggcaattttatgcgcattattttctatgcatctattttatgcattaatttattggttagcctgttgcattagtatttttgtctaggttcatgaaaaatgttctatgcataaaaatcagccatgcttagttatttatttgagtcttttgttgctttgttcaatttggaatttagcatgaattggttcttatcccttgtctactttagatgtcagtcctatccctcgattgcaagcgccgctccgagcttcagagtcgccgcccttagctttatcgtcttcttagtttgttgtttgctagtttccgtgtttaggtctgctgcttgtgggttagtcggcggtcgatatcatgtgtcagtggtatggctgcctttattaggagttgcgtgcctcttttcagtgttttaatcaagattaagataattgcacttaaatttataagaaagattagtttctaagccctctatttttctctcttttctcatatttctacctatcccccttcagatgg

SEQ ID NO: 39783 - DNA, 1501 bp, Oryza sativa
  unsure (1)..(1501): unsure at all n locations
caggagattgatatttggatcaaggtggaaggccgcgaattggatccaggcggtaggactttgctgggagaaaacacgccggccacgtttagggcagcggtggcagtacgttgccgccggcgctgaggcaacatggtgccagggctgcgaagtgaaggtgcacgatctcctgtatacagtgagtactttagtttatcatggtcaaaaatgagattgtctttctcaattccaatttttatggagatttcttcctcttattgtcgatttattaggtattgcaaacgagaaggactatcagttgttttaatttatgccaagagctagttcatggtacacaaaagctataatttttgttgacatttatggtatagaagtgatcatggcaaatttgtatttttggagagcaatttgatcattaatgtactgctagcttctgttgttaactatgctttcttcctggatatacccttaaacatctgaacctaaagtaaactattctgaagatgaataattatctgtacacaatatatgtagattccaaagatgaagaattcagcattgagatgcaccacggaggcttttttatgggaaatggtgtaaaccgggcttatgttgatggtagagtaagctggtttgaccattgtgagtcagattcttggtcactgttgtgggttgatgatttcattgaagaattaggatatgagaaatctgataacaccaaaatttactggttgcttcctggcaaacaattaaatgatgggttgaggagggttaagtgtgatgcagacactaatagtatggtcgctcttgtacctagggtccgatcatttgttttgtatgcagatcatcaagacatagtcgacgctattgacttagatgatgtggcaattattggttcagatcctttgcgtactgctgtgaaaccaagtaaaataattagggctaagagtgatggtggggagttgattgtagataaacgtgctaccgacgctaaaattgatgatgaagaggagtcaagaactgaagatctagattttgttgatagtgattatgagattgatcatggggatgatgacttgtttgataattgtgttgaagggcaaattgagttagcacataataaagaggagggttcagactatggttcatctgaagatgaaaggttgatgatgccagatatttctgaagaagaagaagaagaagaagaaatcaagttcagttttaagagttttagggctgatgtagacatggagacacctgagttcaaggttagcatgatgtttgcagatgctgtagagcttaggaaagcaatagatcaatatactataaagaaccgagttgctattaagaagacacggaataccaaaacaagaattgaagctaagtgtgctgaaggttgtccatggatgttgtctgcatctatggataatagagtcaaatgcttagtggtaagggaatatatanataancnngccctgcttggttctttnggagatcaagg

SEQ ID NO: 39784 - DNA, 335 bp, Oryza sativa
tttgtggcatggcaaaaattaatgaggcagcaaactggaacaggatgggatcactcaagaggcgtgattgtaatggatgatgagtggtggagaaaggcaaaaaaggtgaattagctttatacctgccccttaattattaactagaattagcttgcttctaacacattgtttcatggttgaaattgaataggatattcctggatgcggcaagtttaggaagaaacccttgcagaatgtagatgaccttaacattatgttttctgacattattaatgatgcatccgatcattggaatcctatgagtgagaaccccatcatacctgagcacatgactg

SEQ ID NO: 39785 - DNA, 1501 bp, Oryza sativa
tccattaagatgtaaaataaatattacgataaaaaattagctactcggaggtgcaattccctactacagtagcagcattgccatgcgtgttgctttgcactatgactgtgcgctctccagtctactgtgtagctcgatcgtggccattttggcgttttgctgcaacattacctctcgcagcaggattgaaataggtgcttgcatcgtcttgaaaaaagtctattttataattttttttattttttattataaaaaaattagctattcgagctaattttgtaccgttcttgaaatagctacttgcatcgtcttgcaacaagtctattttgtaatatattttattttttattattgttatggctgtgagaaatattaaacatcactatatattagtaatcaacatccatacaagatccatgggcaaaacagtcctttcactcctcctcctaccaaatctggagctggaccatatgtattattacccaaacaggtgctagctccaggagctccacggtggagaagatttcctggagaggagctcatttttttgtagagtcagtttggtagacttgtagtgccgccatcgctgctgccggcgaatagctggagctcgtctttcgctacgcgctgccaccgccgccgtcttgagcttcatatggaagctttgccattccatcttcctactaggactggatgtatcaatcggtagtgatgcagcatgcttgctgcccggaatttggattttggaacattattacaatgagcagagcagagcatgcattcgattcaactagtcagcaagtaaagcatgcattccatcagacaattcataggtttcaaacaacaccattcattactaactacaacagagaataagccacatcgtaaatcaaaagagatagagaatagaataagccacatcgtaaatcaaaagagatagagaatagagatcgtaaatcaaaagggattgaaaagaacaaaagcaacgcactagaaactacaatctccatagctaaaatatgtcttcagtaccatcaacagttgaacaaatgaagaacaacaaaaaatgaagaactaaaatatgtctttggtactttggccccgaaaaatgaagaacaacaaagaaaaagttgggcccaggcgatggctggtgacggcgcacgcttacaagcagacgagctccgagctagctagtcaccgccatcgtcggcatcgacagtggcggcggcggcagcagcgacgagaggcctcatcggattaactcatcagtgtgtcttgtcgggctgccatggactgatttcaatagcagttaagtatgcatgacacgtgagccgttggattgcatggacggtggataagtgatgactgcacgaccgtgccttcacagggtgaaggaaagcagatccaaatccgatcggtaggaaaaataaaatcttccttctcgaaatcgccggccgcaccgtctcctctctccccggccgtcgctgcgcctcctctctcg

SEQ ID NO: 39786 - DNA, 366 bp, Oryza sativa
cttattcaaaaaatttaagtaattatttattcttttcatatcatttgattcattgttaaatatactttcatgtacacatatagttttatatatttcacaattttttttaataagacgaacggtgaaacatgtgctaaaaagtcaacggtatcaaacattttgaaacggagggagtattagcagtactgtaaatgtacccagtaaccaattatatcaaaaaatttaagccgataaagaaatatgagcaggctataatttctatttaattatttcaagacttttgactcaaatccatcacacgttgatgctcaaataaatcatattttgaccaataataaaacaaaggaatacctgaattgatcagta

SEQ ID NO: 39787 - DNA, 291 bp, Oryza sativa
tatgaacctaaaaattccataacaggagctatctatagaatcagtcatgcaaggcagaactgaaaaatctcaaccttaacttacattggaatcactaggaaggttttaaattttaacaaaatttatcgtgttttgggcaaccgcagataccgtgtgacataaggcttttcatttactgctttcagtgcactgttaagttgctttgagtttgcacaattaaatgaaactgattttgcatcatttgggtgaattcatttgcactagtttagtctgcacacttccgtcaaaaaa

SEQ ID NO: 39788 - DNA, 1138 bp, Oryza sativa
cttcgaatgaaccggccaatgaatagtttatatgcacccatgtatgcagatatcaacgagtgcgatccatccaacaaggacaagtacccctgctatggggtttgcaagaacattgtaggagattacgaatgcagctgtcatactggttaccagccaagtggtggtggtccaaagaaacaggagtgcaatccaaagtttccagttgcagcacagcttgcccttggtatgcgactatttatgtacctccgtgtatactattttgagtaaattgaattaattttacactgatttattttcatgcatactttgactttacgttgagtgcaatcactaaacacctagtacctagtgtaaaatagaagaaggtacacagcgtacactcaactactttgtttcaagtttggatttccagcttctcaaaaaagaagtttggatttctagttttaaggagccaaaattagggtaggaaagtgcatgcagatgctattatgttgttatagattaaaataattctaatataacatgtccaatgtacatatataatattaatacaacaatagttgatagttatgttcatgaaagtgagaattcgcctctctttctattgtcacaaaatcaactccctccatctcaaaccataaggcacaacccaatttcttcatatctcgtaatataaggcgtgtatacatgcatatattaactagaacctctttctcctctaaattcactttgttttaaatcctctaccctcaacacccatctcccctccccccccccccaataatcacattacttgcatgcattgaggtggtccaaccaagggagtaattaaattatttattagtctttgtgttagtgtaccttatagtttgggatggagggagtaatacaaaatcatgaatttattatattagctcacatgaatttgtgatccttctaggtgtcagtttgggattttccttcctggttgttgttgttcttttcacactaatgatgcttcaaaggagaaaaatgaacgaatatttcaaaaagaatggtggttcaatactacagaatgtggacaatattgtgattttctccaaagatgagatgaagaaaatcctaaaaaacaattcagaagttattggtcaaggaggct

SEQ ID NO: 39789 - DNA, 367 bp, Oryza sativa
caagtcattaacacgtcttctctatcagaaaggacaattgagagctacactggaggacatagaagatctgaaaagacaagaaagatcccgtcagcaaaggatcttgaaggctaaggaagcccttgctgctgctgagagggaacttgatgatctacaaccatatgaagcacctaaagctgaaatggttggtttattcaccttattttccctagtttttgctgtcatttattttagataacgagcttttgctgtcatacatctttttttttgtttgcaattttgcatatgtagcatacaagtattgtgtacggtttatctgctctagtaattatttaagcccgttaataattttatgtttcttcacaga

SEQ ID NO: 39790 - DNA, 1501 bp, Oryza sativa
tgtttaatgcaggcttcaaggaaaggctgttgttttcgcaatttattttatttaaactcttttctaaaaacaactaagtgagtgcttctcaaacgacacggatgagacagtgcgtctcgtccggtcggagtatgtgcaatgtatcagtctttagatcttgaaacagggttggcacccggccaacagcttttcaaacggccacccgggccaacaacttttcaaacggccacccgggcctagctgatcccgtcagctgctgattttccaaacatcgaacccagtttcacaacagcaatttcacaagcagtagtcaaacaaaactacgctaggaatcacctcacatccgcccatgaccgtgggcacggctgttcgaacagtttaatgacctctgcagagggggtacactttacccacacgacattactaacccgggtcacccagcccgtggggatcagccacgtcgggagacctccaagctttcatgacaaggcatttcgaaagccgacacaggtttaccatatgccgacgagaggggtcccagaccaacaacaggttaggtcccagaccatactgtgccaggaagcccaggggtcctccccgacaccaccccggcgaatccacatgtctctcagcatcaaggctcccctgataagctagttactcagccaggggtgtcccattccacccatgtggtcgtacttgtcttatgttcggatgaaattccaaggaaacggtccttaagtgcaagagcgggaaactgtacacccggtacgtttcccggtccgcggttttggaaattcatttagttcgcaagcaccgacccaagtgttgggttttccaagtcttttgtaaaactccagttttacccaagttgttactcagattttaagtttgaaggcgaccgtcgatactcgcacagagtgcacgagtatcgaggcgcaactgggtggttacaaggggacatggtatagcaattaacaatggaaggatcaaatgcgacaaattaggtaagtccgccaatctgcctcgcagacgggacaacagattaagtgtgatcctatcaatgcataatattttgcaagtaacataattaaatttcaaatataggctcaagatgttcaaaggtggcttgccttgctcgagatctggagcttgatcctcgaaatcctcgcactgcgggtcttcgggctccggaactacacgcgaaacgggacaactcaacaaacggcgaaaataaagccctattaatgacctctaagcgtgccattagatagatctcgagatttggggaattttggaagtcgaacggagtcaaacggatttacggttgggaagatattgaatttctaagattattgaatttttggtctaaaggaaaaggatttaattaaatcctttttgaaaaagaaaagaaaagaaagaaaagagggatggaaattagacttttctcgggcggctagggtgcggcccaagagatttggggcggctcggcctagcttaa

SEQ ID NO: 39791 - DNA, 1501 bp, Oryza sativa
gggtgcgtgtcatgccgcctttgctcctccgttccttttcatgaagtgccctgatgaacatgtgcagcaaatctgttattcacttttctatggtagtttttttttagccatcctttgactacggagaaagttattattttactgctaatttgattctgcatttgcaagtgtgtccagtatggctattaagctcacttttcagattgccactgaaagttttagatgaattcactcattggcagagcaacacagatttatgccttattatgatttataagtgtcatctcaacaaaatgctgaacctttttttttatttgcagacaaattgtatccatgtttttctgacaaatcattgaagcctctagggaagtaaacatcttgttttaaaatgtctagtcgggtttactcaaatgaatcttgatattgtataaggtttagttgatgcttgttgctggttgtaactgatcttgtttccttggtcgtaaatggaaaattgttatgccttggtttgggacgaaaaatcttgttatagttttaatagctgctcttcgtctataattgaagtgatatgatattttatatatcttgttttctttctttgaattttatctgtcaaaattgattgactgcttcttttattactcaggatatctccaaatacacggaattctggttttctgcagcagcatgcacttgcatagctgagtgtccaagtcgcctaaatctcctaattgttgcgtagaattcagatgaagatgatgctgggtgggttttattattgaattgactggtaaatgattcctgttcgcttgagtcattatgtcaatatctactttttagacaattcatgatgtgccaatatatctctgcttattatgaatgaaaatgacaaaaccatgatataggacagataatattttttatataattagcatattgctgaatagcagtgccatcgtattcagtgctgttcacacaacatacgacttgaacaccagcttaataaaaacccttatttgtccttcaaagttcaaagtatctttttttttgttgacgttggttttgagatttgggaaggtggttggttggttatctttgggtagtctagcacttagctgtaccttattaacacatcaattgcaagcaactggctgcacacatcatgcgacgcaaaaaaaatgtattctactggtggaaagattactttacaagtggcaattcaactccttttaaccaatcataggcaagctatatctgaataatcagatttatagcacatgtggagagtaaattattgtgaattactatttgcttattacctgaagagggagacctgcacgaggttggacggccaccacatcgccgccggctccaccagataccgccggaatattcccgcccacccgaatcccagcacctacaaaatgaagctcaagttcatgaacatgagtgtacatgacaccttgtactgttattactgcagcacgttgatgtcacctct

SEQ ID NO: 39792 - DNA, 286 bp, Oryza sativa
ggatcccccttttttagtattttccgaaaactactgatattttgaccaaactattgtaaaactacatatttacgacggagtataaaaaaactacagatttaatgccgagtttaccacgaaactacagatttaaggtataatgtgtaaaactacatattgttaatcaaatcaaatcttaaattttcattcgaatggaatcatgtttggatcattttcaggtgataaacatgcataccagccagcatcaggatcttggttggaattgcagaaaccaagaccaccaagc

SEQ ID NO: 39793 - DNA, 1501 bp, Oryza sativa
aaactattgtaaaactacatatttacgacggagtataaaaaaactacagatttaatgccgagtttaccacgaaactacagatttaaggtataatgtgtaaaactacatattgttaatcaaatcaaatcttaaattttcattcgaatggaatcatgtttggatcattttcaggtgataaacatgcataccagccagcatcaggatcttggttggaattgcagaaaccaagaccaccaagctcatttctgctagccttgcagctgacatggttgatttgtttctgccaaacagcaatgtcacccatctgctgcaccttggtccagcaaaggctcttggcaatggcctcaatggccgattgctcggagctcaagtcctccggcgtcctcttccaccccttgaaatgtctctcccagttcaccggcggccctgacaggacccagtacccgccgggccggagaacccggtccacctcaatcatgtagagcccgtctgaaatgcaacaaccattgttgatattgccatgatcaatcaaagctacccctccgatcataaatattcgatgtttagaacaagatttaatcaaacttcgaaattcccgaccaaaaatctattatattattaaaggaatagaatttctacgttcgctctcatggcctagaaattctcacattaatcggagaaaaagaaaaaacagagtccatatagaaatacaatttagaaatacctaaaattcggaattaaaaaataaggaatattagaagaggagactagagtccatatagaaatacaattaggaaatagttgaaattcggaattaaaaataaggaatattagaagaggagactagagtccatatagaaatacaattaggaaataactgaaattcggaattaaaaataaggaatattaaaagtagagtatagagtccatatagaaatacaattaggaaataacagaaattcggaatattaaaagtatagtatagagtccatataagaatacaattaggaaataatataaatttggaattaaaaataaggaatattagaagtagagtatagagtccatatagaaatacaattaagaaaaaaaagaaattcggaattaaaaaaaggaatattagaagtagagtatagagtccatatagggattttaaactaaataaaatttggaataaacataagaaaattaaaagtaaagtttagagttcgtataaaaatataatttgcaaataactaaaattcgaaattaagaaaaacatgggaagaagagtttaaggtcaatatagaaatacaatttagaagtaactgaaattcaaaactaaaaattaaagaatattgaaagatgagtttagagtccacatagaaatacaattagaaataataaaaattcagaaataaaaataaataatattggaagaagagcgtagagtctatatagaaatacaatttatggaaaattcagaattaaaaaaagaaatattaaaagacgagtctagagt

SEQ ID NO: 39794 - DNA, 345 bp, Oryza sativa
cacttatgatgcttgtttttgtattctaattactgtgattcctaataggtagctgttagatcttgtttgtaaaaaggaatagctgttccatgatcatgtcaggcatctattgcctattttttgtagcatgatcaaagtaatcctgtcagtggccatctaaaacttttcaaggtcatgtacgaaaatagagtaattcgcacctgcaatgagttagttctctgtggtgtcttgggagtgagaaattacatggtagttgactggtcattgaaccgttcgtttgattgcttaatttccatgttttaaatcatgaaaattcatggttaattttgcaggctacaaattcga

SEQ ID NO: 39795 - DNA, 1501 bp, Oryza sativa
tatgcgttgccctagcttctactcctaaatggcaacattagtattgcctatctatgaaccactcgtacatatacgcctgtaatggttgatttgcatgatattttgctgtctaaatgttaacattagacgtcggggacgtaaattcaattaccaggttaactacatgtaatatttcacactgtagttcgcgctataaacaaacgttggtttgcttattaacagagtagtttatttcaagtttttttttcaaacaatgtatgtgaaccggcaagaaaacatgagattaaatccacaactgcagttcatagggtccacgtctaactactggagttactcataaattcatatccaaagagccatttgtatttcatacacacagcacctctctaacaggacgtatagtagcagtaccatccaggaacattatggtaacaataaatgaagtttcaatcggatgttattcctggcgcgagcttgaaatcttcaaatcgaaatcttaaaggcacatttcctaaatgtgtgttttatactaataagaatttaacttctcctctctcgtttcatatgtacgcatttcctcaattattgaacgatatgtttttataaaggttttctatagaaaaatattaaaaaacaaaattaatttagttttaagttttttatataatacttaatttattatgcattaatgaatggttctgtttgacatgcgcagcgagaagtttccaaccattttaccgagcacaccctaatttgctttacctaggccgtgtttagttccaatttttttttcaaacttccaacttttctatcctatcaaaatttttctacacacacaaatttttaacattttcgtcacatcgttccaattttaaccagactttcaattttggcgtgaactaaacacacccctagctaaccggagaaagtgtgaggtccaaagcaatagccgttattccgttacaggctttattacaggtcttcttatcgccggtcgtacgttggcccacaatcccggcccgctcaaatcttagctctaaccacgcggcccaacctggaatttgggcccactacacaactggatgttgggcctgatctgcgacaggtgccggcccatatagagtggatcgcggcgcatttaacctccttttccccaattcacggggcggctggcttgacgcgtcatcttccccgcgaaaatttcaaagcagccgaggagaaatccaaaatttccccccaaatctttcccggcacggcgccctcctgctccttccctcgcaagccacccccgccgccgccgccaccaaggcgcgaaatccaaaattcgcgcgcgcccgccgctataaaggcgaggaggggatgcctcctcctccacacccactcgccgagccaactccaatccccaaaccaccagatcgaatcgcggttgccgcggcggaggcgaggaggaagacgaggatgccggcggcggcggcggcgaagacgctggtgccagcccgcg

SEQ ID NO: 39796 - DNA, 1501 bp, Oryza sativa
tgaatatttgactactggagatcattaaaaaatgatgttttcgcctcttcttttaatcctaacatgattgagtctatatcacaatttaatttttcctagatgatccctaaatagttttcaaaaatcacagtgacctaaatttgcaatggcccccttcaaaagtcaccaactctggattttcatactaaaagcttctttggaaatcagccttttgttccttacctgaaacatggacttctcacttagtgatcactgcattgtggaaagactagttcgaaagaactggggaatttcccagattattctgtatgtctgcatgtctttcggcttttgtatatgtagtaccactctaaatctggaactgtcccctttcaggtcatgatcttgaaaggcttgctgcagatactgaaggtagttttatttttctggtatattgccattctgataagacgacatatgtgttacttggtgctgaaataaatatgttataggatattccgggagtgatctgagagcattgtgtgaggaagctgccatgatgccaatcagagagcttggtccacaaaatattctcactataaaagcaaatcaggtatttcgagttacatcttcatacagtgtgagctttctgaagtgtcctaatcatatccctccttttcttacttcattgtagttgcggcccctgaaatacgaagatttcaagaaagccatgactgtgattaggccaagcctgcagaagagcaagtgggacgagctagagaaatggaacgaagaatttggttcaagttgacactagacaatggtgcgccctatgcatcagcagttttaatttggccagtattaccatctcctcaacataactattggtttgcaagtggtcgcgcgcccattcaggcattgatatcccttgccatctgtaacatgtacatgtacaagaaaaccctatatttcatgagccatttgagaggggaagctaaagatgaactcacggtgtaaataaacgcccatagcttcaacccgtaccaaaacagtcatgtaaacaaacactgctaaaaatttacatataccactgttccgttactttctttgtaccgtgtgcagatactttcgaattccatgccatatactggtatttcagttatcgtcacttaaaccgaactctttctgccctcttgcaggcctatctgaaagcctgaaaagatcaaattcttgagatgccatcacaactgaaactgaacacacgagcgaaccatcagttgatgcccaggtctattaaaacctttggctttagttctttttgaattatttattggattgttgaaacgaattatttgcgctccacgctttaaaaatgcattttctcaaaaaaaaactttcttatattatatattgtatttcttagatcacttattttaggtcatttgttaagtttatttatcaaaatattttgtccatccatataatcaaaatataatcaagtagataatctgcagcaacaata

SEQ ID NO: 39797 - DNA, 601 bp, Oryza sativa
attacctttaatccttttctagaccttcctttagggattaacggaacaaaattaaccttagttagagcaggtttaataatatcgtcaatttgctagctataaaacaaccacatcgtctatagcccgttactataggctgctcatataacaatggtctttattactatcatttgtggtaacagctaatatatattttaattgatatgggtcctactaattactacattatttactattgttccaagcacgaaccaatctccatcaggcttatttctctttcttcattgcaccgcgtgctacagccggtgataattctatcgtcgactcgtggtctctctctaccattcccaacgctatcgccagtccagctaggttggcctattagacatgctcttaggtcaacgttgcaacatatgatacacatccaagatatcagattcatctcgtgtgctttagttttgatgactgaccgacaatatatgtttcaaccactgtacaacattgatgtcggagattatttcattacactcgaaggttgacgtcacaaactatgcaccacaagttcggccgggtcgtgcattctgttctgatattttcgata

SEQ ID NO: 39798 - DNA, 170 bp, Oryza sativa
caaaggccagatatgtgctttgtagacatcgaggttggcgccacctaagagatttcttttctcatcactgagccaacctagcaaagactcaccttcgctggctcttctccattccaccttgagaactggcaatccccttgaccaagctcaccatgtccctccgcactagc

SEQ ID NO: 39799 - DNA, 1501 bp, Oryza sativa
ttgctgtgatattctgtctccctgtgataccagcactgcttcctgggactggtatcgattaacaggttaaattggagcgtcacgggccagttccggtcgggactagttcggggcgtgacaatcacgctaacttgctgactcgccaccaggaaagaaggaagatggccgacgtagcgaaccggctggcgacgtcgtcgcccacgcgccatgcagccacgccttgcccttgtggccttgccttaccttcacgaggcatctgattagcagaaaagactagggcaaggtgaggtcttctgatcttatttgcatctatgtagttcgaaaattaggttatagttttgttttgctctttttgtttaatgaatttagtttatgatttcaggtgttagaaattagaatattgcctcagaagcatctttcaggcctcaccttctggtatacaccaagtagccagcgtgcgggtcttgccttctcgttggctccctagcgtaacccctgcaagccgcttaccacatcgaatccgtagttcccggtctctacaatatcgccctatgcctccgcgctgccctactccttgggggtgggaggaggatgaagattagggtactaacttgtggggtttacgagggttccacgcttactctactgatttgattttattatactaaacttgtcacatcagtaaaacctggacataataccgtcttaagacctcgggtgctctggttttacaagttaagagacatgttatgtctggtattacgggcttgtttggcacagccaaatagtttcagctccacctaaagtgggagtggagttgggtggagctctctcacaaaatgaactagagaggtggagctgggtttaggcagctccacaactccactccaaacccaactcctgaagctaaatttaagagttggagctctactaaacatgccctacaattaaaaaatgtgattaaaacttgacatatctaaagtgaactcattcggaaagacaacaacaaacactcattctgcagtgcagctaggaggaatgtggcatcaccatcagcttctgcattggagtggattttcatccctggaggggatatcctctcgttatttgcgtatcactcaaatggttatgaaaaaattttaaaaaaaaagagagaagatgtattaacatgtatatcacttcacaaacatgcaagttcaaattcaacttctatatctcgcaacgaaaaaaacaaattaaactacaactagttaacagttaacgtatatccacaatcaagtttgtttttttcgttacgaaatatagaagctgaatttgaacttacatatttgtagagcgatatatcacatcttaatacatcttctcaaattttttaattttttttcataatcatttaagtgacatgcatacaacgagggaatatcccctccagggatgaaaatagtttccggcttctgcataccttgtgatgtccctctcttgtctagtactggcatgaatc

SEQ ID NO: 39800 - DNA, 1501 bp, Oryza sativa
ctctacctcctctcttgatggagccatggaggcatagcggaatcaaaagggagctcgctaaacgccacaaggaggaggaggttgagctcgaggctgaggtggtgctcggtactataaaaaactcgaggctcaaccaaggatcacattctcattttttacaaaatatcatccctatttgagatttttgttgcaaaattaaccccgtcttggtggccacccttgcaggttccattgtcgtgcctctcggtaaccccaagatcatctctgtatcgacccagcccatgtcgctacccctacaccatcaccgaacatagtcttgtacttgtcaaaccggtcgtccgagagctgctcacatcttgtcaaccagccactgccactgcacgctcgtgtctcgctcgccatttgccaactcgatgggtggtgaagatcagtagtggcggacggcggcaaagcctagattgtgcgagtggccatcttcactaacatcgcttacacccaccacccaaaagatttctccccgatgaccacgagcttctacccacctcttcttccctctttccagatctggcactatggtcgagctcgtgttggtggcccatccgtcgagtacatgagtctgccaccatcgtcacgttgctccttggcaatggcttgcttctagagccatgcacctcactccgactaatctcgtcatggccttgctcctcggcacctgtcaactcgtcttcctccaccgtggcttgggtagtagcgtcaaaggctcgtgtcttgctcctagtactctcgtcgtcatctttgccaccagacctcgggtccctcaggacgctggccactacctctatttcaacgctgaggtgttgctggatggccatggataacacccgtctgatctcctcctccactgacattgagttttttttgttctctaagagcatcgaacccaaggtggacacttgccctgtgctaactcaaaccgcggtaaacttgctacgtcagtgtagtcacttctcaaacaattgaagtagtctatctgtaccggtttttgaagatggaggatgcgttatacccgttttttcagttgagacattaatggcccgggcctatcaatccccgttggaggggagattgaggccctcttacctgctcggctgggctgggtttgccccactttgcctaggactacatgcatatcaagccgctttctcagtctccgcatattgaaacttttttagatacgacccaacatcataccatctcgatcaaaagaggtacttccccatttcatattgaaagtgcatctaggacccctcatttattttggtgttaatgacaacacaattagagggtaactaatgctttttgttgagatgtatgcaaggatgaaaaaggagtggatgtcaacacaataagtattgcggcatcttttgtggtaattgtcttctaatccatgtatatcttgtgttcttgagtattaggatgccgtactattaagagggatacc

SEQ ID NO: 39801 - DNA, 314 bp, Oryza sativa
ttctttactcaaattaaaggccatcaaagctatgacactgattttactatttctgcccaaagtaggccttttccttgtggttttaattttctttcaagatacttttacatgcaagctcctgcatacaaagttggtttctaagagactacctaggtgccaaagcgtacgtgtatatcctatggttttttgtttttatatactgtattattttagaaaggccgtgagattgttcgagtaaacatttgcagaccctgctaggttgttgaagaattgtacttacgatgctagttgtctttccaacagaatcttggagc

SEQ ID NO: 39802 - DNA, 1501 bp, Oryza sativa
gccgcaaatattttgtaatattctctgagccctattatactctccagatttttccatgaattttcggagctcgagaaataattataaaaaaaatataaactcccccttcctccctttcaggccaccggcccaatctccatccccccctccccccattcctgggccgtcggcccactctgcttccatcccccctcccaaagtctgcttgaggccccctagcccaatctcttctctcctcccactaacatggagggtcggggcccacatgtcaggtccttaccctacctttggcctcccacgccccaactgccgccattgccgctccacgtcgccggtttcccgcgcgcccaatgcccctccgccccactccgtccgctcgcccgcaaccgccatccacctcctccaacccgcgcccacgttccccccctccctcgcaaatcggcgccggttggggccgatttaaacccattgccgacacaccacttccctttcaaattcatcactccccggtctccccgtcacttcatcgagctataaaatccatccctgtgccgcccccgcgctctccccacgccgagccgtgcaccgccgcgtgccgtcgagctccaaccggccgacacagccgctcccgtcgccgccgcatcccgccacttgcgccgctagcttcaccacgccacgctccaccccggcgtcccctccgctcctccattccgccactggaaccaccaccccaccaccaacccgagccaccaccgcctacagccgcctcccgctggcgagcgttgccttgcccagccatgcagccgccatgccccactgcaccccgtccacttctcctcttccccaatccattgccgaaacgccgttgccacattcaccatctctctccgccaccgtcgcccactacaccgcgtcgcctctccggccgaccccgcactgcgtcgtcgcctccatcggttccgcaaggacaatgagaaccccggccgccgctcggttcgcgtcctccaccactggaatctgtttcccctcatgcaccggtgagctcccccttttccaatcccctccgatcggcgcttcacgctgcctcgagccaccctatcctcccctaacccctcctcatggttctacaggtcgaggaggtgctcggccgcccttcctcacctaatggtcatcgtcagtgcttcgcccgcgccgtttgcccgcgcagcgccgccgcctctcctcaccatcggccgccctcccttgtcgcctcctcctcttttaatattccacttcctccgccaccgcccgtgcctgccgcagctccccgcgccgtctgcaggtggccgcgcgccgccaccgtgccatggccggccgggccggtctcggccgcgcccatgccccagcggctcgccctctaccgcccgatcggcttggctgatctaggctgtccttcccgtggaccagcggtggaccgccctttggtcccggtccacggtggaccggtggctccctgtgccgc

SEQ ID NO: 39803 - DNA, 1501 bp, Oryza sativa
ggcgaagatcgattcaggaacagaatgagaatcggctggagtccaaatcggatacgatcgggatcggctgaatccgagtcagactgggtgagccgatacagccgattccgacaatacgacttggtgtacgacatcaggttgagttcatatgcttcaagatgattgccacgcatggatagagtcctgagaaggcaattgtatctattaattaggatattttatgtaatttccttagagatatgtttgggcaaaagtctgccgtaaagacttacggtatcttagggtttgttagagataagagtcttgtccgatatggtggacatagtttgtatttttcgggtataaatagaccccgaaccccatgtaatcatttaacacacatgttcaatacaatctcggcgcattgccacccttttgctttagttttatttcgacgagttcttgttttcgggttgtgctgcatcggtttcgatcttcaacaagaggtaaaacttgtcatgacgacttgcgttctcgggattagtgcttccatctttatgatactctaatcttgtatatgtaattcgtcgagttatcatatatcttgcaaaatctccggcaatatcgctatttaatctattatcggctaacatctgtaggtagagggcagccgattaggttaaacatcgatgttgacttagattacgtaggatatccaccactctatgaaacatccagcagcttgattgtctagatattgttcttcttttcatacttaatgctgcatcagttgagtttgatctattaagtcgggcttagaatatcaatctatagcctgccttctggttgccgattagggtagtatcggggtttcagccgatcttatctgatttaactatatttgctctatatgcttcatagatatgttaaatctaccgtttatgttaagatcttgttgcatttaagtatattacacttttgtttgatatattctacttgttttaatatcttagtatagagtggtatcggagtattagccggtacatgctagatctatctgatctgctatgctatgaacatatataatcccactattaatatatatttcgatctaagtgatttatactgtctcggcatggcgaccgatctatcgcaatcacttgatttaagtatatatcaatataaggagtatatattgttaatatctacagccgatcgagtagatctagttctttcttatttatttatgactgccgatcgatacatatatgacatcggctcaaagataaatgatatgtcatcggcacttagccgatcggctatcgtttataggtttaaccgcaatttctttgtctttatttcttgttgattgcaggatcgaatcaactggcacgctagcatacctgaaggcgagttttggacctgcactagagttaagcagatctcccaggcctcgtgttttccgtcaacacgcttttggcacgcccggtggaaccgattagaagtcagaagttttctctca

SEQ ID NO: 39804 - DNA, 1411 bp, Oryza sativa
ttcaacctaatcggttcaaagttctagatttttcaaaattctcagggcaagatagcacatcaacttatgagcatattagccgatttttagctcagtgtggtaaagcatcggctgtggatgccttgagggcttggttattccggttgtctttgtctggatcggctttcacttggctttcttctttgccatatgggtcgattaacagttgggctgatttggataagcattttcacagctatttctatagtggggtacatgagatgaaattgtccgatttgatagcaattaagcaaagacatgatgagcctgtgtatgagtatattcagaggttcagagaaatgaggaataagtgctacaacttaagtttgactgatgcccagttagccgatttggctttttagggtatgattgctctaatcagggagaaattctcatatgaagactttgaaagcttgtcgcatcttacacagaaggtaaccttgcatgaacagaggtttgcagaggctaggaagaattctagaaaggttaatcatgtctgtccttatatatatgggtcggatgatgaggatgatgactctgagatagctgcagccgaatgggtaaggagcaaaaaggttattccatcccaatgggtgaagaactcagggaaagaggagaggtatgactttgatatcaccaaggctgacaaaagttttgacttgctactccgagagaagcaaattcaacttgctgccggtcacacaattccatcggctgaagaattgggcaagaaaaggtattgcaagtggcataattctaggtctcatactactaatgattgcaaggtcttcaggcagcagatccaagcggctattgaaggaagcaaaatcaagtttgatgattctatgcggccgatgaaggttgatggcaatccttttcctgtcaatatggtgcatacagctggccgaacagccgatgggggtcgtgcaagaggttttcaggtaaattcagctaagattatcaacaaatatcagaggaagtatgataaacagcaggagaagcattatgaagaatatgatgatggctttgatcctcattggggttgcgagttctttagattttgttggaatgaaggtttgagactatcatctattgaggactgtcctgggtgcagtgatattgcggagagctcaagccgatcgtatagtaggggcaatcggctaaggcatacaagggttccctgttcatcaaagattgggtccagtaaacaaagatcgtggccaggaggactatgaaaacaggaaaactcaatggtgtccttctggtatctttacaaagaatcagaatagaagggttaatcaagttcctgtagccgatgaagccacagccgatgaagcaagaagattggataaggggaaaagtgttgtaactg

SEQ ID NO: 39805 - DNA, 1501 bp, Oryza sativa
ttccatgtttatcttataaaaataatagaagatgttgttgttattattatcaaaaaagataatagcgactttgaataagacccctcgaaatgaagtcagtgcctccaatggacgtagaggataccaatcaattaatgttataatatctcaaattttgttcaagagcaatggactctcaatctctgattggtttcaaggaattaggtaatcgttaggaaagtagtccaatgcaaaggacatgtcatctcattacaattaatatatatatataacatcatactaataccaaaccccatgcatatatctatacactgatgaatttgcaggcaacagaataaaaggtaatgataacagcatacaacgaaaaaatatatgttgttaaggaaaagcatttcaaatgaacaattgtaatttaacaatcaagtagtaatattactattggatcagaagattgagtcttctatacgatatgtagtttgcattatataaggtatagctgcattttggaatggagcaagtatatagctgtgccgtgaagcagcaatattcgatctcttgtcagaaataggatgtgagaatgagatggactgagttcaaaataaattgttccatccaggacacctacgtaaaaaaaaagcatgaacttgtcatcgtcacaacatacttcctttgctaaaaaaacaacctaagataagaatttggcactacttagaatgatgaatctggataatcttatgtccagattcattgtctttttttaactgatggagtaattattatcgattaaacacctaataaatattttttgtctggggatatatatatctatcgttgatggaatctacatccgtaagctgaaagtaacagaatctagtaggaatctggaagcgtggccacagcaaactcatctctctgaggtgttcgattcttgcaagaaaacaagaaatgctgaaaaattgcttcatccacgccaagtcatcagccttgtcaattttagagaggcatgtgttatccacaagatgaaaccgtttcaattgccctctaaaccctttgcataaaattgtcatttcaacttgattacttgcaaagagctacataattattagtaaggatgtacatatgctaatttggagacaccaacatgttattttggaccggatgattgactaacttatgataattattcgagggtataaatgattaaattttataaagttaaaactagatttaaaatagtcctaaaatttatatacacaaagttttttaaaaagaaaaaaaagtgtcgctttgaaactcgagaagcgtgcgcactcatcgcttaaaaagaaatatttaatattaaactacacttaaaaattcctagcaaaaccactagttaccaaccacatagactttgccaaaaagaaaatcactgtttagagaacctacagaaatcattaatatttaatacaagcttttcccctaacaatgtttcaacttgttagataactaaaagacaaca

SEQ ID NO: 39806 - DNA, 1501 bp, Oryza sativa
cccgcgctcctcctcctcctccgccttccccccaatccgcgctccctcgcggcggatctccgatcttctgctgcgctgttgggctgaagagagaggtaatggcgagatcgcctccggctgcaagcgaattcgcgcttcgattttacttgtttacgcgaggagggttagcgcggggtggttcggggataggctgggaatgccggaagaggagcagctgcgagtcgtcggtggcggaggcggtggagcggaggagggagccgaggaggctgcggtgcggagcccccgcgcgcggaggaaggagaagtcggccttggcgtcgcgcagcgccagcgtcacctcccggtatagccgccgccgccgtctcccgccgaggaagatccctccgctcccgattccgcacccgcgccccctccagccgccgccgccacctccttccggctcatccccgccggttcgctcgattttggcgtaggtgttgcacctgtggtaactgctaacttggggttggggttggggttggggttgggagcagagtcgctccgctccgatttgtgatctgttacaggttttgggaataggttgacaagttaggatttacttagcttctactacatgtctgtctagggttgtatgattttcgtatttgttggtttattatgcttggaatttgtaaggctggaattgtagaatttatgctattagattcataccttcactttgcgatctacatgcacggcccagttggaaaaaaaaacaagttacctttacactgaatttcgccagtcttcgaaaagctgtctgtagccattccctcggatgtatttacgaattataggttcagttctagttgcctgcatgggattctggtgctaaactgttacagttagttgcatagtttgctttttgtgccttcattttccatgaatcatttttgtgttgtccaagttcatccatgtttttttttcttaatcattggtccaatatgttaggtcaactgaaaaggaccggggaatcgttgtcaatataagttcatgcatgtctcattggttactgagaacagagtagtgtgtgactgcctaaataaaattaagagtattgaaagggcgtcggttacgcgcacaaaactacaacatgattttggttttatgcatagtaaaccttgcacttgaatgacatcacaacaaagcgaccttattgcaaaccagtcatatgaagtgtatttctggtgcacttattttgatctccgctactaagtttgtcgttttgttccgcttaaaacagcttgcacagtttgtctgcacaaaggcactgagatacattgagcagtgctcatttgttcagaagcagattactttcctaactttgtaaattgccagtcctgttccattttgatggcacgcatctcatcaattgtattaaatatgttcataattccagctgtgctgctgacaagtattgacatacataagttcctttgcagtttaatatctccaagtcaaga

SEQ ID NO: 39807 - DNA, 941 bp, Oryza sativa
caagatttcgaagggctatttaatagctcagaggatccaaacaaggccaatatagctgttgcctttagccttgtgaccttgtcaactgcagagataagattcagtgagtataaagtagagaagtgagcttactcaaatcagcaagcaacatcagtatagcagctatggttacccagctcacctacctagctgcatcagcaggagtgtgcttggcttcagctctagccatcgccttgctgtccatcgccctctacatcatcggcgtcgtcgcctccttcgccgtcctctgcgccaaggagttcgccgagagagcccacgaccggccgccgctcgtcggaacagttttccggcagctcaagaacttcgacagaatgttcgatgaacatgtcaactatgcaaccgcgcatcgcaccagcaggattgtgtatcccggtcactgcgaggtctttacttctgatccggccgtcgttgagcatgtcctcaagaacagcttcagtaaatacagcaaggttttttacttcaatctttcttaccaaaattttccgcctgtgattctgtatgtcaggcgtttattacctgcaagatttgtacaaacgatgatcaaaagcttgcatgctgtacaatacggcatatgctatgatatgttctattataaaaaaaaatatagcttagtgcaatacacatgactatattcatttctgaaataaaagctaaaatgaccgagtaacattaccatatatggctcggttaaaaaaaaacacatttccatataaataattaacttaagagaacagtatatttatataaagttagttagcatgtccatatgagttaaactcataagcaagttactagtaactatggaaagtatatatagttgagcctatgagatcttacagtgtttgagcctgattcacagggggacttcctcactacagcca

SEQ ID NO: 39808 - DNA, 1501 bp, Oryza sativa
ccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacagggccggtgtcctgctgctaggggctcagtcctgcctacctgtcccgggggttccggccgtaggtggggttgggttggtactcttgtctatggctaggatgggttggaaactatgtcacgtcttccgtccgtataccgtggtggtatgtggcacgtggttacatgttaggaagatgtgtcttgtgggtaaagatgtacacctctgatcagagtataatctattcgaatacccgcgcccttggttatggccaagccgagcaatgtacccaagttagtgtttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccttgattaataatattgtatagctctaggactgtatttacaaaatagctttgagcaactaagtgtcttttaatgctgtttactgcaaaccctaaccctttatattttaacccccttgtactcccttgcattgattctgcacttatgggtgtgtcttgttgagtacggtggttgtactcagtcttgctcaattttgcccaaacccaaaagaggagcccctggaagatgaaggctttggtgtctagctcatgcctgccgtcaagcgcctgtggtcgtcgccctagtcttccgctgtttttcgtttgtcttcttgtgtgctgggtcttcgctgcccatgtaataaattaattaattacgcttccgcttgttaaactctgaattgtatcaacttttggtgtaccttgcctcttgggacaaggaataatgcacgcacgtaaggaacgcccgttgggttatttccggtcgtgacaatggtcaatgaaaaattgtagtctattagcttcaattgtagaaaatatatcaacatcaatttgatcacttaatcgaccataacatgtcaaaggatttggttcatttagtctatagtgcatcatatatctataatattctggcattgtgacgtattttcttccaactccgtcataattattatatttaatgccaagatggaatccgcgttcaccatatgggaataataaagggtactgcaaggccatataagatgggtgcaatggagaaatctggtgcagtccatggtttttatcatacacaagcatatcaaatttgtattcttttgcagaaaattcacctactattattccacgatttcaccacttgttggtaggttatactgaacatcgtcttttgcgttgcaacctaaacggcgaagggttatttgctgatcaccatgttcagaaag

SEQ ID NO: 39809 - DNA, 176 bp, Oryza sativa
aaggtattacctacttattaggttcaccgaaggacacgaagctatggtgggaaaagggtagagaggatttcctagtgagaaacagtgtctagggtatgcgtaattttaatgctaacgcgatacttcatgtactggcaacctgctgttccccgatgtcgctctactatgtacctaga

SEQ ID NO: 39810 - DNA, 423 bp, Oryza sativa
ttttattctagatatttttctttacttattctagatgattactccgtgcaagagaggagcgattagagggagagacgagcgatcagagaggagggggagggtgtgtgtcaggtgtcaggttttcacctgtgtcaatccgtgtgagagaggagacgggttatcattaactaggaggaatcatttcttgttacaaggtgtcagagagagagagagagagagagagagagctagagagagataactaggaggaatcatttcttgttacaagaggtgtcagagagagagaggagacggctaaaccacgcaagtaaccagctcgagtatataaacgcgggttacataaggagtctcacgcctctcaccccaccccacccactcctccgacgagagtagacgagcagagcaaaagccggccgccgggca

SEQ ID NO: 39811 - DNA, 348 bp, Oryza sativa
aaactgtaaaccaaacccgatacacaaaaaagggccgctctcacggattcgttcaatcgatgttgacgaaatttgaaggacggatacctggaatggtcggaatcgatttgcaccggctggatgggatcgggactgaaatcggttcagaggcatcagagccaagaggattaggtgccaagaggatgcatgcatcctctgaatgcaggaaggaaacgtgaccgtgccgccgccgttcgtccgttcctcgcctcgcagcctccgcctctccccgtcggccatcggacgccgagccgtcgtcgttgtctgcccgggtcaatccgcggaggatggaggcgtagaccaccgcga

SEQ ID NO: 39812 - DNA, 1501 bp, Oryza sativa
ccatctcctctgtcaacccgagccgccaccacctcgccgccgccgcgagcgacctccgacctcacgctctccttcgtctgcttcgcaacaacgatagggaacccgacatcccctcatccaagctcttcgtcgccggaaatccattccccgctgtgagtggtgagctccttcccttgtcgccagcttccggccgagttttcccgccgtcttgcgcctcctccctattcatgcgcctcctccctattccctaactttccctccttgttccctagatccttccggccgccgtccgccggttcccgctcacggaacaccgccggaccgccgttgccgtgccaccccgaggagcgtcgccgccatctcgcctccctttggtgccgtgccgcttggtgagcatcccctctcctccgctctttccgccgctctccgcgtgccgacccgcgccaccggtgtcgtcgccggtggtcgccgtctggccgcgcgccgccgctgtcgttcgccgccgctcggccgcgcctgtactttggccgcccgtggaccactcccatggtctgggtccacggtgccgccaggccgcggtggaccgagtccaccttgcgcccttccccttgtgccgctgacgggtggggcccgcctgttggcgccggccctcttttgatgacgtcagcggctatgccttttcctttggaaaataattaatagttgcgcaataattcgttaataattctagaaattcatttaaatggctcaaaacttctaaaattcatatctaattcattcaaactccaaattgggccattcaacttgcaaaattcatctaaaattgagatctacatgtttgtttagtttttatgtattgtttcattggtttttattagagtttttcctccatttgcgtgccagcgtgtagaatccgttgtttcagaagtccgcggtcgcgaggaaaagagttcggaagatcaaagtgaagaagcaaggcaagtcacacattccccttgagcatgttgatcccaagttataaatgttttaccgtttgcaaataaacatgcatgtcttgctaattacatgggatccgggtattacctatctgcttgcttgtgccatgtttacttgatatctatcctttgtcaacattgggtaataaatcgactagctcatgttacttatgtgacctagctagaactatatgcttagccatgcttaattaccactagctcagttgatgggataatggcagtattagacctttttagcatcagaacgagctgcgtgctcgagacacccggccatgtttcagtggccgtaattatccaactaaaatgcgactgaagggtgggctgtgggtgcatggttttgctagtcacacccatggcaattaaggaccggttcgcgggatgccctagaagaacttatcgtacttatcacaagccagcgtgggcaatggctggtcttgtagtgtagctttcctctagctgacgcatccaggcaagggtgggcgtga

SEQ ID NO: 39813 - DNA, 1501 bp, Oryza sativa
aaaactacgctaaggaatcaccttacatccgtccatgactgtgggcacggctgttcgaacagtttaataacctctgcagagggggcacactttactcacacgacattactaacccggatcacccagcccgtgcagaacagccacgtctggtgaccttgaggttttcatgacaaggcatttcgagagccgacacaggtttactatatgccagaccaacaacaggttaggtcccagataatactgtgccaggaagcccaggggtcctccccgacactatcctggcgaatccacttgtctcccggcatcaaggctcccctgattagctaattactcagccatgggtgtcccattccacccatgtggtcgtacttgttatatgtacggatgaaattccaaaggaatcggtccttaagtgcaagagcgggaaaccgtgctcccggcacgtcccccggtctgtgatttttggaaattcatttagttcgcaagcaccgacccaggtgtcgggttttccaagtcttttgtaaaaccccaagttttacccatcgttggatattttaagtttgaggggaggtgctcccatgcacttgctcgaaggcccgtgcatcgaagcacaacagttgacaaaggagttttaattgttcaataattcaaggagggtaattgcagcaattaggattggggccggtaggctatctcgcaagccgcggccgaattacttgtgttaaacctattcacgcaatatttgcggaagagaaatacttagatttaaattataggtgcaagatgatcaaatgtgacttgccttgctcgagatcttgagcttgatcctcgaaatccttgcactgcgggtcttcgggctccgaaactacacgcgaaacgggacaactcaacaaacggcaaaaataaagccctattattgacctctaagcgtgccattagatagatctcgagatttgaggaattttggaagttgaacggagtcaaacggatgtacggttgagaagatttggaattttctaagactaaaggatttactgggctaaaagaaaaggatttagtaacctcctttttggattagaaacgagatagggaggagatgtagacttcgcgggcggcttgagcgcggcccgagaggagttggcgcggctcgaccaattaattgggcggacgcggcctcaggaggcggtccaacagagggaggcggggagagagagagggagacccggatccatcgtgcagggtcccggggcgagcccacgagtcagtgactcggtgcacgggagagagggtttacgcggcacgggggagctagggtttgcggacgcggttcacagatggtgcaccgggtggactaggaggcggcgggcccacgcgcagccggctgactctcagtggaccacgcgcgcacgagagaacggatcgaaggaacggctaaccgggttcaaaccgtcctggcccgcggccgagctggcgccgacgtggcgccttcgtggctgccaca

SEQ ID NO: 39814 - DNA, 1501 bp, Oryza sativa
tagaagtagttgccgcccagacttcgtttacttttctcggtaacatatgtaaaaattattaattgctacagtatgctctttatcactcaggcttggaactccacaactgaagtagccagtcataggcgataatctgcttctagtagagacaagagagttagtagtacaccttgtgctttaataacatatctccgatatatatcttacaagaaggagcatatttttttttccattctgacaaaatcaaacgtaccttggacttggagatcaatatgaaccggcaggggctaaactcctaaacaaaacactatctaaattacttcgagttaaagacagtcgcagggcaactctcctttggcaggccgttttggtgaattcaatcgctacatggcgatcgatcaaagctagtagcagctggtatatacatacatgcacataaccaaccgatatatgatggtctatcaaaggccaccatgtatatatatacacaatgcaatcacatatggatgattgcaatgtagcaccatggccggactgtatataccttggatgcatatacaattacaaaatcacctagaatgcacctgccagaggagagctgcctactactgtcttcaactagttcttgcacctctctcacatccacgctcacactcacacacctacgaatgcatcacaaagacttagaagacttgcctcttgtcttcctacaaacacatggatgcatcagaaaacttaaaatttttatctgtttggttgttggtgacctgagtagtgtgcctcttgtgcctttctgttggcagaattctagctcctcttatagctagggcgacaggaagaagatgaagcagcagcgaaacggcatatgccattgtggtggtgagatgagacagtgagatatatgcattctgactttttagggagggtttgtaccatggatatcctccccagctattccttcgaccctgcaactttatcctattctctctcgatatggagaataatcgatcgaaatcgccccaatggtccacgctgatccatagatgatggtatatagcatctctccttgatattgtcttgcattgtgtgtgtcccgtctttccatggtcgctgtctcgccaaattgccttcatttcccttgtgaattcgccgctgtgtttgtgtcaaatagaactactcaaatgtcctggagaaccgttcagaagaaaaagaagtcctggagaggaaaggtccattccattttcaacctaccaaactttgaaagttcactttatggcaatgtttaggttctttaacaagacaacacaaatccacaagactgacatggcaacaagtttctcaatcagcagctttgccggccttcaaaatctgaacttcagatagaaagcacgttttgatcttaaccaaaatcttcgtcttctcgttgcatacaacacgagagaacagagatgcatccatctaacgaagtgtccaatgtgaccagcacatcatagagaagatg

SEQ ID NO: 39815 - DNA, 1501 bp, Oryza sativa
ccaacgctccttgttgctccaacagaaataggacaatcttctcaatctgatgccacaggaaaacagaacatcagtaatgtaaaacacaaattttagtatggtcaattagataaatttgttgcatcaaaatctcgcacaagggatggaaccaggtgaaaacagggctcacatgtgagcaccagaaagaaaaaaaataaagaacagtaagtcgtcaactagaactgttggcttgtaacattttgatagtattactcagtttctacaagaaaattggtgacaaaactccgctacagtttatttaaaataaaactattgaaattcctttgcttagaaaggccatgcatggataatttgatatatgagcatatgtgggtaaacactgacatacagattacacatgctcaccatgttgatgctacactcagcaagctaaatatccacagagaagctaaagtctgcaattaaagcagatcagggagaatgaagtaatggcttttcatagcatctatctcttggcattacctgatcatcaagcatcttcgagaaatccttaagaacccggcgacgatctttctcaccctgttgaacctgctgcccgtactgttttactttcttcttcatcaacttgtagtttatgtagtacctggaaacatcggtataaaaaagaggcaaagctaaatttcggtaactaagtatcaactatttcaatgtatcattagactatcaggtttgttaagaaaaaaataataagtttccatagaaaaaattatctggtgaggggtggaagactgatgatatttacagaactggtaagcgtagaatggtccataaaaattaaagtaataaaagccctgaatcataccctttccattccggaatttgatcagccatcaatttcttcccaaagttaaccatcttgacttggagatattaaactgcaaaggaacttatgtatgtcaatacttgtcagcagcacagctggaattatgaacatatttaatacaattgatgagatgcgtgccatcaaaatggaacaggactggcaatttacaaagttaggaaagtaatctgcttctgaacaaatgagcactgctcaatgtatctcagtgcctttgtgcagacaaactgtgcaagctgttttaagcggaacaaaacgacaaacttagtagcggagatcaaaataagtgcaccagaaatacacttcatatgactggtttgcaataaggtcgctttgttgtgatgtcattcaagtgcaaggtttactatgcataaaaccaaaatcatgttgtagttttgtgcgcgtaaccgacgccctttcaatactcttaattttatttaggcagtcacacactactctgttctcagtaaccaatgagacatgcatgaacttatattgacaacgattccccggtccttttcagttgacctaacatattggaccaatgattaagaaaaaaaaacatggatgaacttggacaacacaaaaatgattcatggaaaa

SEQ ID NO: 39816 - DNA, 1501 bp, Oryza sativa
attaatccaggatgctcatatactcattgttttgctttttttttatttccttggatatattggtgtcttgcattttttttaataatatatgcctagcctatgcttaagagcagacaaggaacattggacattccccaatgggaacattattctatgtcatctgctaggtgcctcctatgaccttcgtactcgtagcatgtgacagccagatgtattgtgattagctagtactgtgctacttaatttacacaacacaatagtattaatttagacatcttaacacggcatgattttcgtatatggtatttatgttttaccagccgatattgtggttttcaatagtacaaattgttgccatctatcgaaggtaaaaaggaaccaagaaaagcggggaaaacatatactccgacctacgttaattataaatcatcaaaacttgaaacgaaagtgattgatgagtgccatcaccagatctaccaaccaaatggacctttccccgggtcagcttcagcttcggtagttccagacaagcaataccaccggatgaggctgagaaacccaacctgcccgtgctgcactgtatgcctgtgtcgaccctccgctgccggtttcttttcataattttttttattgtgaacctttattgtcttaaaatttttaaaacaaatcatccataatattatttttcatagaataaattttttgaccacaccatttgagttaacatgttaggacaatatcatatcagatagcagtatgatgtttagtttatctactaccttgtgtttttaggttgctagtagcatttcttcaccaaccatagctaaggttagactatgaatctaacgcaacgctttgactagaaagctatgatcttaccgcactttacaagacaaataacatatgagatcaagatgagagagaaaaaaaatcgtggttatgtgtaacaatgaaccgaatacatagctaacttaattaaagctaacttgatgtgtagcaaagtatggcaacatgtagtcacgaatcaaacaaccccttaaactgtatttgattgttgattttagaaactaatccctcgcgcatgcaaaatagaatgaatcattaatgcatgattaattaagtattagctttttcaaaaatagattaataagatattttaaaacaaatttagtacatttagttttgcaaaaaaaatacaatgtttagcaaattgaaaaagtatgcgcgtaaaacaaacgaactcaaactaagtgccattgttcgtggcatggcaacaattatttatcttatactccacgatattttatgagcgtgaaaatgtcatctgatcacacctattaaaatgatgcgacaaaatatttagttcaaaattttcatagagctccttttgaaattaaaacttaaaagaaagttaaaaaaaaacaacaataacaataataataataataaattgcctaccagcaacactgcaagtctgcaacagcaagcaaagcagagatca

SEQ ID NO: 39817 - DNA, 1501 bp, Oryza sativa
attttagccttaaaaagctttagattcagcgttgtctgactagcattaccatgctttagcaattgagcaagtggctgttttttattgttcctatgcaagcccttgtatgaagttaacatgtcatggtgatggtgtgccaaatggtcagagtgaaccctgctaaatctgaattatttcacactgttaacaaacactaattttgcaaaagatgagtttactgcattcctccctttgcttattttttttgttatctaatttataccagattgtgtgatgaagctacaagcgctcttgatagcaccaccgaagcgtcaattttaaattctctgaagactttgtccgttgaccgtacctctatctttattgcacatcgactgacaactgcaatgcaatgtgatgaggtatgcatgttcatgcaaatacattagaacaaaaaaacctgcaacttcattttgtgaaagtaatatgatttattgaactaaaaatagggattcagagtaatgtatcagttaacagcaacagattttcttttgcatcgattcaagaaatcgatagttaccatcatgggctagatctcaattatagctgatttatcatttgttcatatgtttgagctacagagctttccattatactcgatactgatgaatacttgtttgatgacacttcaatgattcttttataaatcttgtttcaaaatttgtattttcagattattgttttggagaatggggaggtagtggaacaaggaccacatgattttctgctgtcaaagggtggccgatatgctgaattgtggtcacagcagaataacagtgatgccatcgatgctgccgcggttagcttagaggtttcatagactatatacataattcccttttgcaagggaaaatgcaaaccatatttgaatgaaagaaggcttccccatatctgcattgtaaattgaatggttaggtttttagatatcggggaacagaaatttatagcttaggagcaaataactccgtttgaaagaaagccaggaggcaaaattttcctctttgaggaaacacccaacagttcgacatgtttccatgatgtaagcattttttttactaatccaagtaaatattttttcccactaaatcctatgaccgtgatctgatcgaggactgttgtcaaagccttgtggctgtggtggtgactggtgaggtatcatctcatgctacgtttgatatttgaggactgaggtgactactacaaatactgctgatgtgtgaatgtttatatgcttaactttttgtttaccgcaggtatgtgagatcaaaacttattttatgtaaatattttggtcgttgccaaggtaagaatgaatttatgaatgctgcctcctttttggatgaaaattagaagatgttgatgttccctccagcagattgtgttagtctttgagctttagctttaacattgttactacctgcagatataaagaaacggcaaggttttgtgagatactaataaa

SEQ ID NO: 39818 - DNA, 1501 bp, Oryza sativa
aagtctcagtaaatcaagaaaaatgtgtagaatccattaaaaatggttttgttctctgtttcagtagtcttatagcctgtttgcaatgtttgccttgtatgtcgctagattccggttcttccgacgctccggtgtacttcgaaatagtcaccgaggttcctccagcagcagagcaagacaagtcatgcttgtcacttgatcatgttgatcctatattgcaaatgttctaatgttttctttcaaatactgcatttgttttgcaatatcactatgggatgtttacctattgttacagccatgctattttggtaccctgctcctttgttagctcgagttataacatgaatagacgttggactagcagttgcttagccatgcttagttcaactagcacataatggggaaatctcatttaaaatatagactgtaggttcatatgataatgttggtttagtaccaccgctttggtgttggttaattaaaatgaatcacatggcgggctgtgggtgcatggttttgcttgtcgcacccatagcaattaaggaccggttcgcgggaaaccctggaagaatttatcgtgcttaccacaagccagcgtgggcaacggctgggcttgtagtgtagctttgctctagctgacgcatccaggcaagggtgggcgtgatggagtttggatgggccctgcgacggcctatgcagcttccggattcacctaggcacgagtggggactgcccgtcacccgctggggacgggggtgaaacctgaggtgtggtgtgcttggctagagggggttatgcaaagggtcctgtcacagcctctttccagtatgtcgtggtggcatgtcggcgcacgaaaacgtgtcgtggggctgtgtcttgtgggtacagttgtacacctctgatcagagtaaaactattcgaatagccgtgcccgcgattatgggcgatcaaccagattcaccgtgattagactcaccctggtttagtctaatgaaattggatagtataggtggatggttgggccagtcgcaacgtggtatagcgttggacagtggatgaataatatgattaattataacaactgtttacttctttcaacttctgtttataaatgctcgctttatgcaaatgaaccactctagctctcctttgataattccctgcatcatacccccattccggtatgacttgctgagtacaatgggtagtactcagtcttgctctattttccccaaccccagagtttgagtatgtgtccgatggtggtttcttcgaggagtaggcttcgtccgtgtcgtcgaggatgcctgtggagtggtgttcccgctgcagttcaagtcaaggcttagctcctgttatcttttgttttccgctgcatttttgtaagacttttatgatgtttgtaagacgtggatctgaatgtcaacattgtcgtttgtgtaccccggccggtcctggacggggattttaatgcacattctgcttggaattctattcggga

SEQ ID NO: 39819 - DNA, 225 bp, Oryza sativa
taaataaaagaaaacaaactaaattgagaattaaaagaatttaaactttaaaaaataataaataagaattattcggtggaatattttataatttttgtatgaataatgatatgtcattattgtatgactgttgaaagagtttgtgattattttatcattattgtatgactgtcattattatacgaatgattatttgtgtacgatttttttttcatttcatgtaga

SEQ ID NO: 39820 - DNA, 251 bp, Oryza sativa
cacttagtcctcacaccgaaacgaaagcagcagcagcggaaagaggcaatcctagcggggcttaattcttccccggtgcgcacgagtgaggacaaagtgtgcagaaaagacttgtgttgttccaaacgtaaataaaagcgtaaatacttacagaagaggcacttagtcctcacaccgaaacgaaagcagcagcagcggaaagaggcaatcctagcggggcttaattcttccccggtgcgcacgagtgacca

SEQ ID NO: 39821 - DNA, 787 bp, Oryza sativa
tcctccaagaatctggcttttctcaaacttgtttgttgcttgctctagttctgcttgagtgaacaccttaaatgcaagtccctggtctgatttcatcttctcaaataatagcagccctccatgttcctggatgtattttttcttgacatctgtaagctttcttctctcaaaaattatacgcacgaagaaaatgataatcactagaacaatggagccaatgctgacacctgcttcaaagagtataaaaaggcttgttacattatcatcatgtatttgcatgtaatacaataaaagcatgtcaaactgactcactgtggtggactgaaaggtgatgttagtatactacaacataatgattctacctataatcacttatgtcttctttggatttaatttaatttcttttgtcgattatattggtttgatagtttctcatatttttctaaattattcctaaaaaggagaggacacgaatataaacaaaagctaagacgatcataaaaattgagggatattttatgactaaggatcaagtagaggaagacgtcattctttcgatgtagatgatccttacaccagtcacatgcccatgctgctatatgctttccagctctattcattcaccgatttatttgtcaattctatgatactgtgcaaatggaaaatatgtacatgttaaataaggggccctttacataatgctgaaattctgacagctaaacttatgcattatagcttcctgtaatagaatagagttgggtgtagggttgcagcttatctagtttta

SEQ ID NO: 39822 - DNA, 401 bp, Oryza sativa
caaatggtccagcaagagtgagcgacgatccaaggcgatagggccagcagcgtaggagcacacgcgttgtgccatcccttcttccgctagcggcaggatggcaggacgatgctaccatggcgcaaccgattagagaggaaaattttgacggcaaatggcagaaaaactaacgatagtgctaaaatggggaactgagataactttcattgctactaaagtgaactgatatctttcggtgctatagaaacaagaatgtgaacttccgatgctctaaaaccaatgttgatattatagtccacataactatactcacaaactcttcgagcgctatccacgaatacaacctataacacactcaaaacgatgaagatattttgctccacataactatactcacgagc

SEQ ID NO: 39823 - DNA, 476 bp, Oryza sativa
gtagctcttgtttattgaggcataaggttttataatctgtaatgactgtctttctttacaatcagatgggggggacaaggacaatatgaaaaaaaaaagaagtcagcccttaaaaaaacttaatttattcctttttatttattgtttttatcacttgtaaagttcaatcaattaattcttgtgatattatttgcatccttagtgactttttttactttctgtttcctgttataaatgtgcctaatcaattaagttaatttgccaaccaccttaattatgacaattacttttggacagtagtgtcattttgtaccacctaccttaattcttgtactgaatccaaatggacttatatttgaaattgaagggattttgtttgggcatcgaagttttccacccgtttctttaaaatccttcatattatgtttacattctattctgtggataattgtttaccacttggtctttcttcaagc

SEQ ID NO: 39824 - DNA, 291 bp, Oryza sativa
actgccattatttttgatacactttgccaaatcaaacagatttcaaataaaacatttattgctaatcaatatgttatccaccaaaataatagctcgagatataattcttaatcatacatgatcctaaatcaaataaaattcaaagaaaatatccctctgatctgtgcaatcccacctccaacaccactaaagtactataagaatcaccccccagagcacaagcctgtaccacaatacctttgttcttcctaaaaattcttctacacacaataattccatcatcagcacaaa

SEQ ID NO: 39825 - DNA, 180 bp, Oryza sativa
ttagcaaaatgcatggcatcattgtgccatactactgttcttactggatgacacttgtgtaacttaaaaccagctaatggttatgattaatgttttcatctttgtttatatcatcatctgttgtctcactcgatacagtacatgctgatattgctaaaaagaaattaaactcaatttgta

SEQ ID NO: 39826 - DNA, 1501 bp, Oryza sativa
taaagttatcacaaactatagctttagagtttaaatccttagcatagttgttatgttggagctatattttttttgactgggataatttagttattactaaatatgtagttttataacactttattttaaatatatagtttgtgataatttaatgttaaatatgtagttttgtgatacaccgagttaaatctgtagttttgtgatagtttgatcataatatttgtagttttgtgaaatttactcaaaataaattttgcaaaattatcaagaaagaaggaaacatgagaagggaaaaaaacccaccctcatcctacacatacaggtcttgttacaagaaaatacaaccaaaagcaatctcatccagtcaccctacacatctttattgaaagggtcaccctacacatttggctacttattcttgaaaattaggttattgggttgtgttttagtgggttctctagcctgtgtgtactggttatttaatagttggattagcctttttttaccgatatttataacatttatgtgtgtattataatcttgtaattatatcatactaatatatcacaacaacatagtataaaaccatataatcctaatataacattacaccctctccaatgctaatataacattagaaccaactctaatttttttttctaatgtagaagtatagtcagtgtcaaatgcttttctatgaagatgtgccaacttagcggcggcacatggccccaaaccggagagagaaaaacccattagcacaactttattataacattttttttagctatttatgtgcaaaagtaagttgacaaaaattcgatgatcggtatcatgtgtcaggtatgtgctttgatgattcatcttgttagtgcgtcgcatgcctcatgcccacgcacataaaaaaaaaagaagtatgcccaattcatgttcccttgattttttattcgacatagaatgaagtaaggattatacatgtagtttttaaaatttaaccctaaattacatttactctagactctaaatttctaaagacgaaactaagacaagtccttattgcttaactttagaaacaacttgttttcccaccgggaaaaacttgaaaagagtttgtttgaaaaaaaaaggttgtttttcttttatctgtttttttttgaaataacaggaaaaatcgtttttcgtgaggtggatggagtatccgggatccctgaacaaattgctgcttcacaaaaaaacaaaaaacaaaaaacgtagcaccagtagccgccttttccccatctccactggccgccgccggcgacatcgccggcgccgccgagctccaccgctccgatcccactccgaacagccgagctgcggtttccaaggaaccgcgggcgagccgagcccgacccgttatcagccccgtttttttaacggggcagtgtccaagtccaactccgcctcttccacgcttcggcttccatccaatcatctgcatcgtcgtcgccggcgagcgcca

SEQ ID NO: 39827 - DNA, 1021 bp, Oryza sativa
tggggcggtgggcagcgtgggctaggctggcagtggaggcattgccaacgacgaaggagacgagacggccggtttggttgggttggcttgggaaatttggggggttttggccctccaggctccagtcctgggaggacgtgatctctgctttgcttgctgttgcagacttgcagtgttgctggtaggcaatttattattattattattgttattgttgtttttttttaactttcttttaagttttaatttcaaaaggagctctatgaaaattttgaactaaatattttgtcgcatcattttaataggtgtgatcagatgacattttcacgctcataaaatatcgtggagtataagataaataattgttgccatgccacgaacaatggcacttagtttgagttcgtttgttttacgcgcatactttttcaatttgctaaacattgtattttttttgcaaaactaaatgtactaaatttgttttaaaatatcttattaatctatttttgaaaaagctaatacttaattaatcatgcattaatgattcattctattttgcatgcgcgagggattagtttctaaaatcaacaatcaaatacagtttaaggggttgtttgattcgtgactacatgttgccatactttgctacacatcaagttagctttaattaagttagctatgtattcggttcattgttacacataaccacgattttttttctctctcatcttgatctcatatgttatttgtcttgtaaagtgcggtaagatcatagctttctagtcaaagcgttgcgttagattcatagtctaaccttagctatggttggtgaagaaatgctactagcaacctaaaaacacaaggtagtagataaactaaacatcatactgctatctgatatgatattgtcctaacatgttaactcaaatggtgtggtcaaaaaatttattctatgaaaaataatattatggatgatttgttttaaaaattttaagacaataaaggttcacaataaaaaaaatta

SEQ ID NO: 39828 - DNA, 1501 bp, Oryza sativa
ggatgaccagtcgagtccaattgcaccaatgccaaggccatggagacctgatccaagctgttgtgcgagcacagatttgggaaagatccaacaaatccaggagagggaagtgagcatctggaataggtagcctgggaaaatgtagtaggcaaagctgcacacaaatgctaccaagaagaactgggtgcgtgtcatgccgcctttgctcctccgttccttttcatgaagtgccctgatgaacatgtgcagcaaatctgttattcacttttctatggtagtttttttttagccatcctttgactacggagaaagttattattttactgctaatttgattctgcatttgcaagtgtgtccagtatggctattaagctcacttttcagattgccactgaaagttttagatgaattcactcattggcagagcaacacagatttatgccttattatgatttataagtgtcatctcaacaaaatgctgaacctttttttttatttgcagacaaattgtatccatgtttttctgacaaatcattgaagcctctagggaagtaaacatcttgttttaaaatgtctagtcgggtttactcaaatgaatcttgatattgtataaggtttagttgatgcttgttgctggttgtaactgatcttgtttccttggtcgtaaatggaaaattgttatgccttggtttgggacgaaaaatcttgttatagttttaatagctgctcttcgtctataattgaagtgatatgatattttatatatcttgttttctttctttgaattttatctgtcaaaattgattgactgcttcttttattactcaggatatctccaaatacacggaattctggttttctgcagcagcatgcacttgcatagctgagtgtccaagtcgcctaaatctcctaattgttgcgtagaattcagatgaagatgatgctgggtgggttttattattgaattgactggtaaatgattcctgttcgcttgagtcattatgtcaatatctactttttagacaattcatgatgtgccaatatatctctgcttattatgaatgaaaatgacaaaaccatgatataggacagataatattttttatataattagcatattgctgaatagcagtgccatcgtattcagtgctgttcacacaacatacgacttgaacaccagcttaataaaaacccttatttgtccttcaaagttcaaagtatctttttttttgttgacgttggttttgagatttgggaaggtggttggttggttatctttgggtagtctagcacttagctgtaccttattaacacatcaattgcaagcaactggctgcacacatcatgcgacgcaaaaaaaatgtattctactggtggaaagattactttacaagtggcaattcaactccttttaaccaatcataggcaagctatatctgaataatcagatttatagcacatgtggagagtaaattattgtgaattactatttgcttattac

SEQ ID NO: 39829 - DNA, 1501 bp, Oryza sativa
cagcttttgcttattatgcgcaagcaactgcagctcaggagatctttggccacacactgcaatctctccgtggaattaagtatctctacaagtatgtatctagcatgcaaatccatagtcagtttacagttgtttgctcgaataagctggatatatccatgtggtggatattggagcatcaaacttttgaaaatgttctgattttaacatctgaatatgcaggtacaatgttttccagtatggctttgtggctcttgcgatactcacactcttttactatgcaatatttgtaagtgcattcttccaaagtattcagtcaattcgtatgaaaatctggaaaaatgttggcttgcttatttgtcctgaactgtttgttcagggatggcgaaagaggaaaccgacaggaagattccagctctcaaattgatttgtggtttgttctgtaaggaagcctgacgaattgaactacaaacatatttgttcacgagtgatagattggttagcaatgtatatgatctttgaaaccgctttctcaaagagctggagagtttatccatgtaaattagcaaccatgaagtataaggagaaaactgagatttcagtagggcacggacatggttgttaaaagcagaacccagctgcctttgtaatgtacacatttctcatcgcggctcttcttttccttgtgtattattattttacacttggctgatgttattcttgacaatactgggtccttcgaggcagagatgtttgatgtgatcgggtgccactttgggacccccttgttcttttgttgggtttgtatcgagttaggtcagttgatttctttcatatgtaccatactgtgattaccatacgaacttctagattgtattaaggatgtcttgatcatctgtcctctgtcaatctgcatttgcttctcatcttcagactgctcaaccaatcgagcttttggggacaaacttggctgtcctgttccaaatttcactctatttgttatggtcccttgtttagcggcatgtttaattttaccagatgaaagtcaattctggttaaccgcattctaaaccgtaaagaagctgaacgtaataaatgtatactccgtatcatgttaatccgaaatccagtgactgttcacaccttaacaaaaatggtgcctatttctttaatatccgtttacgtcagataaattgacagataaaataataagaaaagacatatatggaaggaaagagaaaggagaaaacgaaaatgtaaataaaaaaaagctactccatatggcatgaaatggaaaggataaaactaaaacaatatgagagaattttaagaaaataaagaacctatatatggaaagaagacaggagaaaactgaaactatctgtactagaagaggggggacaactgaaactatctgtttctataaatctgcctccaatgttccaatctatagctcaaaatgatcatcagcatgatgaatgccatttttgcgaacccttag

SEQ ID NO: 39830 - DNA, 1501 bp, Oryza sativa; identical to SEQ ID NO: 39795

SEQ ID NO: 39831 - DNA, 638 bp, Oryza sativa
aactacactaacaaaacatatgtacttaagcgtcaagtgtcaaagtgtgtggttttctgtaacttggaccacagaacgtgtaattttgtgaaatttactcatatctgtttacttttctcaacgaggagattggtagctccacggataatatgcttttttttttaattttgttgtaaaagtcacaaatgatataaatttagaagttttactcccaagttatttttgattgcttcattcctacctctcaaatcaaccgatcagcgcgtgagaccttgtgtactgagtttcaaaagttcacaagctggatgatcaaattttattcgtaaagttgactgcaatagttttgtatagatcttaactaaaattctttcagatcaatgtgattcacgcagtattattttggcccatacctaatccgtaaaattaacggcagggattgtccgtggtttacagtcggaagaactgatatgtggacgtaggctatgcacgtctcgaatttcaaccattcagtgggagctagcatatcattttggtagactttaaaatcccctccggtgaattaggcttgggaaaagtccaccacctcaatccctaaccaagatcgccagatcggccaccgccgcccgcgactcccccgc

SEQ ID NO: 39832 - DNA, 1501 bp, Oryza sativa
ggggtggccccggccgccgcgccccgtcgcgaccgcgctgacgctggcgctcgtcatgtccacggggttctggctcttcttcccgccgatcacgagggccggcgccgacaaggtggtgatcgccgagagcgaggcggtcgtcgcgttcgtgcgggacaccggcatctgggcggccgcctccgtccactcggctttgagtcttctttgaccggccgctcgcgcgtactgtagtagtagtttgatatgatgggtccatctccccatcaaaatccaactctacgaatactccagcaagagagtggatcagacaactggtgtctgtcatggggtcccctattcatcctatgttgtcctgattctctgacatgtttgtattggatccattttaaggaagggatcccagtgcatgtttgtctgttcgcttgttaataagatcacgcgtgcaacccggaaaagctaacgcgggcgtgcccgttggcggcgagtgtttccaataatttagcctaattaactaagtggttagtagataataacggtaattaagatatgattttcttttttccggaagattttttctactaaccgattgaaaactttcaagttagatttgaaaacttttgaagtcaaattttaaaaactttcaaaactcaatttgaaaattttcaactcgaaatttaaatgtgtaagacaaattttgaaaactttcaactcatatttaaaaactttcaactcagatttgaaaactttcaactcgagatctgaaaactttcaagttcaaatttgaaaaattttaaaattaagatttgaaaaaaatgaaaactttcgactcagatttaaaaactttcaacttgagatttgaaaacttttgactccgattcgaaaattttcaactcaaatttgaaaattttcgactcagattcgaaaactttccactcaaattcgaaaactttcaactcgagattcgaaaactttcaaatcagatttaaaaattttcaagttaaaatttaaaaacttcccaactcaaaacatttttgaaaaaaataagtgtgctaaagattaaaaaaaagtaatcagaaaaaaacgaaaaaaacgcaaaagaaaaggaaaaaacaaatcgcgaaaaaaaaagaaaaaatggctgatgggccgggaggcccgggagcagctggcgcgcgcgccaactagcaatcccctgtgcaaccagggccatatgggagaattgtttggaggctctgtgccaaacgtaaaattttaggcccttagatttcagaattgtaattctaatttgagtcattatttaacttttacaagagtttgcctacatctaaggcttccgtatctacatccaaccattttcagaccaagacgtgggagtattgtttttctcccatatctccatacagagctaatgagttttacagttgtgctctcctcttggtctcggtgcatagaccaaatatgctgatcaaacttgaatggattgagtatatgttggtggtta

SEQ ID NO: 39833 - DNA, 1501 bp, Oryza sativa
ggaataaatccagttttggggttgatgcggtacgttgacggggcttgttttggggatctgggggcaggatctgatccgtgccatcttcaagctggtgtgaagccgccggggcaaaagggccgccgccggcggcaatgccggcgacgaggtcatcgaggtcgaggtgattccttgatctggtcccagatccttgcctccaaatgattgttttctgtggccgttcttctttcagctactcctaatctgtttcagattactcttctttctgttgtgtatgtactctggtctgaatgtttccttctctaattgacagcctgccccggagacatcaaggaggaatcgtagtgccactggtaaatcaccttctgctacagtaaaacatgcgatttatgcgttttgctttgttacatctgattagtctccttagccactggtaggaactaggaataagcttgaccatgcacatctgttggtagtattcggtgctgttaaatggcagcaggttatcaacactagtggcagcatcagaagtttttacatttcttgcaattgccttttggagctgaatctcatcagtatcaactttgctaaattctcttattactagtaactattactttggagtttgggtaactttacagtgatgtttacctccgtttcacgggccctgtgggtggcaccttattttactttacaagcgaatcctgacaacaatttaagttgtgcaatacagagggcaacaagaagtctatctgatttcagcatgacaatcaatcggtccaggcgtccagccacttatgatgtaacaggatcttgttggcatactagtttagacattcatcagttagtctgtcctcttttatagttgcatatgctgcagcagtggacatttgttgatcatcttggttgtacaattcagtttttgttattgttttatattgtagcagatgggctctagacctctagtcctttcagggtttggtatatccttacaacagcaactaatgccagcaccaagtgtgccaaccaggctataacaatttgaccctgttggcctgttggataagaaattgaaaatagacctaacaagtaacaataacttgtctcaaatgtttaaggcatcctagcgaaaaaaacaatattatcagattttgtctctagtatttgttaaaagaatagctgtgagttgtgaaaaaccaagtcttgttaaattcaattctgtgcgcccaatcacctaatactgaaaaaagaatctccacccttagatttctgttggggtagtttaaatcttgaacttgaaattaactccctatcatcctatgagagccttcttgtgtggtgttgacaatctgttcaccttcacagccaacgccagtgcgcttaaagtgagctgtgaacttctacggatatttgtcacaggtatgtacctcttaaattgttctattgcctcatggtgttaagtgacatgaagtcaatactccatagctacagtgtaactaga

SEQ ID NO: 39834 - DNA, 1501 bp, Oryza sativa
catggttttgataaactgatatgcctcatcgatcagtccagcccgcactaacagatcaaccatacagccatagtgctcgatccttggctggcgccataatcccgggtcattgctaacaaaatgcctgcgatcctactcatctaagcagctgtgaactgcaagacaggagaacaccagtgaatgccacgtccgtgggctttaacattggcctcacacatggatgagaagagccccggtgttcctctgagttcctcacaggcagccaccaactttgaatgcttatctgcattgtcactgcatccacacttcgcatataagtccaccagtgcactgccaagtccaagaacaatggtaagaggaagacccttcctccttatgtactactgacttacagtagcctcatttgggttcagcaacagcacggtagtctgcatctcaatgaaaagagtaagtgcctccagacataggcccgtatgtgcgtaactgtgtatccagagatcattgcaatccaaacagagcaaatgcaaccacatcacaccactgcatacctgtattccatcgaacaacctcggcgccttgtcaagaaaactcaagatcaccatacgtccgccattgcattcttgaagtgtccccgcaaccattgtatttcacgtgaccgcaccgttgtcctccatggcgtcgaactgcaccaagtgatgccgtgacatccccacagccagcaaacgatcaaacatgagcccatgcttgatggtggtgtaagcctggacgccgcgcctaaatccagagcgcacatcctcgaggtgggctcgagaggtgcaagcgacagtgtgctgtgctggtgcagaatggggccagtggcgtcgagcatttccacgaacaggtggagggcgtcctccggctccgagtgaccagcgccgacgagggagggatgctgtacaaccgtgcggagagaggcgagcaggggcagaggaggaacaggcggagcgcgtgggcggtgaaggtgccatgggccgggagtgcggtggcgtcagctcgaggagagcatcgacggattcgggcgaggtggcgagcgcgcccgacttgaggagggcaccccagcgtgacgctcgcacgttgcagagaaccacgccgcgaggaatgcacaactccggcgccgtcgccagcgcggtgggggggcggggagagccgccgccgctgggaagtcggcggcgcccgccattggagtccgcttgggcagttgggctttgggccccaaccgcttaaccgcacgagccgcggctgtcacgtttcgctaattatcagagcggaagaccgcacgtgacactgcagctgggacccaccatttccccggccccatctgtcataggcacatctcttccttttaaacccccctcagatccgccaccgttggccacacttgttaccatggcttcttcctctccacttctcctgctgctactgctgctcccgctcgccgccgccaccgccaccgcgtcgctcc

SEQ ID NO: 39835 - DNA, 1501 bp, Oryza sativa
cattttttgtgttcctaaacattgttgccattgcactaaggcctttcaaccattcttctgggccaaagtacttgtcaccaaaaaagccattaccgtcgttttcgctgcagcaccatcctggagttgtcatttggttatcaagtataaccattatattgttcttggccaaagctgacaccacttcctatggttattaatttaacagaaggagtaaataatcagaattcaacacttgatagcaaaaatctcgtttactttatttcatttaatgtttagtacgggtaaactctcccagaatatactcctgagtatgtgaacacatgttttggtagattactaggtcaactaactagatacatcattgtaaaatgagagataactaatacatccctggtttggatttttttttttaaaaaaaggaagcagaccacctaatgaccccagttgccatctatcgtcagaacatattttacaaagaaagaatttatctagctagagactttcaaggcacccttatcttggaccatcaatttggtgactattaggaataatgtcatcttcacataaactggtttggaagagaaacaaaaggaaaaagggaaagctactcaaacaattaccattggtttttcctgaaatagaaaaggacgatcagattgttgattatgcttaaaccttcaacttgaaattgattgttcttattaaataagcaaaaaaaaaagaggataccctaggtttctttggcaagtcttgtgaaaagattgtgacgagatcatctgatttcaaaatcaataatctgcaaaattttgacttcttagcaagttgtttttgttaaattaaaccacatgacctgcagttggtttagctataagtcaattgattcattgcatactgttgcttccacaattaagccttatgcatcataatagctatttcttcagaaaaatgtaaaatttacatggactctgacttaaatgtttaaatgagcccatagctttcaacaacaaaaaatgtaaatgttcttctaggtacaacgttatctactccctccgtccacaaatataagcatttctagtgtttaaatttagtccacgaatattttctataaacatttctagagtatatttccacattccaagttttcaaccatccctcatagttatattccccatcccggtgaatcggatggtggcatggggattcaaccagggtacatgaaagtggtttcaccttaacctttacttaatttctcctacaactcttggacggagggagtattttcttgcactctatcagcgaaaatactgcttcctccgtttcatattataagactttctagcattgtccacattcatatatatgttaatgaatatagacatatacgtgtgcttagattcattaatatctatataaatgtgggtaatgctagaaagtcttataatctgaaacggaggtagtagcatctagcggtaagacacggtaaaatttggcgccatctcga

SEQ ID NO: 39836 - DNA, 1501 bp, Oryza sativa
aataattttttaaaataagatatacggtcactgcatttaaaatggttcggggagtactagtagtactacaatacagatggctctgctcccatgtggacgtacgcctcgcgcccccatgtggtgtcttggatttggttcggatttaggcgtaccgagtccatgccaatcacattgtttttccacgccaaattgcgtctcccagaacaccaaacatatggtggccaagaaaatgattgatacgcacggtggatggatggatggattggtggcgatcgatcgattggtttgatgatgaaaagaaaaacaaatccgaggagcacctggaatcggggacatgcgctgaaccgggacaaggaaacagccccttgttttgcgaacttgtagttgtagagttcgtgtggagttgctgtttgctgttgccgtgttggggtatttttctgccgtttcttggagtctttgggcagtaggttcaacagctaaaggagacaaacctctctccggccgtgttgcgaattcgcaatgcaaaatgcaaccgacggtctggtctggtggtgttgctagtcttccatttcaggtgccattgtcaaaaaactcaaaagggcatcacaggcacagcacagggatttctgtccctcggaaactcattgataaatttattacaaagacctagctttgttttgttcttgtgtcttttaatcgtgtcaaatgaggtgtttaaatctatgggtgtaaagttttgacgtgtcacatcgaatatacatacacacatttgaagtattaaatatagattaataagaaaacaaattaagattccgtctgtaaactgtgagacgaatttattaagtctaattaatctgtcatcagcaaatatttactgtagcactacattgtcaaatcattaagcaattaggcttaaaagattcgtctcgcaatttacacgtaatctatgtatttttttaatatttaatactctatatatgtgtccaaacattcaatatgacataatgaaaaattttgtcatgggatctaaacaaaccctaattttagccagacgtgtcacgtatatgatatttccttggctaattaaatttaagcatttgaaacaatctgtcaaaaacataaacatgcgcatatttgaatcaatcacataaagaaaaaaatgagtaaaattaagtgaaaaatatgatgctatatttttaccaaataaactcatatggccatatatcacttaataaccaattaaccatgatgccatcagtcaaaaaaagaaaaaaaaaccatcctaactaaaacccaaactaaaccactgtcacggccaaatcctcttttcaaccatgcagcacattaatcaaacccccataaactccaagcctctccaatccaaccataaagcaacaagagagaaaagaaaaagaaaggaaaaaaaaaaccaagcctcagctcagctccccagttgcttcccctgctgcatttattaatccaaagcagcttccttttactc

SEQ ID NO: 39837 - DNA, 1501 bp, Oryza sativa
ccgctctaacattttcatcaattacacctttgtaaacaacaccaaacccaccctctccaagaatttggtcaggccggaagttttttgtggctgctcttagttcattatatgtgaaaatattaacatttccgtatccttcgatttgcaggtcctccacatcttttggaggggcaaggacacttgctgtagctttagaatcagatttgcatttccttaacccatctggcccaccagcttctgcttatagaattaatagaaaagaaaaaacatcagggaataatcaattacatacgaacattaagagctacaatgtggcgtgattattttgccttagtactttagttttttaattcatataacaccccccatacagctcctgctgtgcagtctctgtaatgttgttgtgcattatgtcaaaatgataatctgataagcataacatcttagtttgtaaataccactaacctacccaaaatggtgttcatcttctaacttaagaaacatgtgttccattgtgtcaagctacaatgtcattttgcaatagctctacagcaacaaaagtattcattgatcatcctccacgttcaagtggcaggttaatgtgcagctaaaggccatgacatgacaaaggaaggtcccaatttaatttggtatctcaataaaattctagaatagctccaaacacgcatttgctgctcatggtcctatatgcaggacaacatttgtcatctcttccagtctctgaacaagaatcttctatgcagaacagaccatttgcatctaagttatagggttactcgatacttccatccaaccaacttaaaatcttctagcagctttgccaatgtagttcaaaccaagttatgagctaaatttgacttgctgcagtttgacttttcaggaaccgtgactgcaaatttcatagacaacataccagtacatcataatatcgtgtcctctaccagccatcaaagagcaaagtttgtaccatgcaagtttcgtctttgtcaaagaaaaaagagaaactaagctacagatagaggcctgaatgtaacgatgtccaataagataaaacttttagcacttagagaatggcattcctcacactcgacactcagtcacagaagaatcaaacatcaaccacgcgatgcctaaaaaacccgaatttgcaacacgagttactacatgatatagccccagagacaaaattgatcctgtcggaactctgacataaacgagacagcaattctcgctcaaaaaccaaatcttctgaagctgaatatacgctgaaaatccatagcccccaatacgcccaaaaacccaaccgcacgactaaattcacaaccaaattacaacaaaaacttcacttccatgcaacatgcacacagctactactactactacaagcaaaaacacacatcagagactaagtaagatatatatagctcgaggcaagaaagaacacggacgaacctgtcttgccctggagccggtgctcctc

SEQ ID NO: 39838 - DNA, 273 bp, Oryza sativa
agaatgacttacattgtgaaacggaggaagtatttaatttaccggccgtatcatcaagttggccagttgattttgtctgagttgaactgtttagttgattctacaatctgcatgcacatgctaactacgctactagtgaaaaaagaagaaacgattttcttgctgcatggcttgctcacctttgattgatctattgagagaacatgtatttttccatgctaaaggacacttttgttgatttatcttcttgctcgtatgataattgataacagg

SEQ ID NO: 39839 - DNA, 1501 bp, Oryza sativa
ttccttcctgtttgatttgcttgtcgatataacgtcccaaccatcgcctaatagattttttaaatactatatattttagcaccgagtacttgtaatcaaaacaaaaaaaaattaacgatgtaactacccgctttaaaaacagttacaaagtagctagcgtagtagattagcagtgctggtacagttcagcagctgatcatcagtggagaatacgcagcacatgcagatgaaataatcgcgggagcattattcgcgccaaggtgcgaaaataatttgtttgtgattagttagctagatccaactaccggaaaaaaattgctcttgattaatttgaactgtccaacataacaggatatttttttccaagtttttatttaaaaaacaactaaaaataaacttgcctatatgatcaaaaccttttggcaaggccattgaggttggcattggcatggtcttatttggaacagaggaattttgtggaaatcttgaaggaaatgaattgtttcctatgaaaatcttgtgaaattctaggtcagcaggcagcatgacaatgccaaataataatgttgaaaaatgtaagagtttgtttttttaatttatttagaggtgtttaaaatctagtaatacaatagtagtggtcataggaaggctttgtgtgccaggagggagaggaataataaataaagagatcacatgatcctagaaaaaagaaaaggcacaagttaagggacatgaatcatgcttgtggaattcatcttctatgattcaaaagtgaagtgcaatggttcagatatcagaatttatcacagctagatttgctgttgcaggtttgcaggacagctacagtagtgctggcaatcagcttttcgatgcatgaattgaagtggctcttgaattatggttttagaaacaagctactccctcagttttaaactactcgtcattctagtaagtcaattttttttcttaataaatttgtatggtttaacataataaatttcaagtatatttttagattcagcatgagactttcataacatatatataattcatatgttattagactatacgaacctattaaaaattaatggttaaagatagacgtgtttgacttaaaagaaagctaaaatgttcagtaatttcaaatgtagagagtactatctcttttggttaatagttcaaaaacaaaagaaactataaaactatagttccaaattgagatgcacttcatagtacaatgacaaggggtatgtagttttaaccccaaggtctcgtgttcaattcccgatacactcataattttttcttaaaaaaatatttggagggacgtcactccctctaaatgtcgtttttggtttatagttcaaaaactacagaagagttattgtaacctggtgtacatttgttaccaaccagctgagtaaactgctgctgtctgtatgagattcatacacaaacacagctgacagtatcagccagtatgcagtctctgtctggatgt

SEQ ID NO: 39840 - DNA, 1501 bp, Oryza sativa
aatttttgttaggctggccaaatagttattttgagagtcaaaaatggtcgctctgtgttgaagatgttctaagtgactcatcaatatgcccaacagctcaagttctgtagtagtgagtacggctattttcactttaggcatgatctctccctcttgctcgcctctcaccatctgaattctgatgatcaataagaagagatttgagaaacaaacaaagcaagagaagatcctggtatgttcttcctacagtttcaaggcattatcagtacttactcttgtgtcatcctcaccagtgatgacagttttaactttttcaccacacggtacaactggaatgagattgaagaatctaatctagccatactaaaaggcaggcagcatatataacagtatcatggtcagggcaagtgctgtctgaaacctgaggaggtacccgtcgtacgccaataattctatggcactgtcagatctgtggattcagcatcaaacaagcacatatacagtttcagccattctcgatcttcacctgatgatcagaacgagacacgcacttatgcatcgcattgtctgcagatcgatcgatcagcatcttctggtccccgagaacactttcgatctctacataactaagatacgcacagccgaactcgcacaccggcaaaattcagaagaagaaagaatacagcaaatatcaagcaccagcatctgaaactcgtggtctcagcaattcagcatctttggtcgatgcaaagagagcagctgctcctgtgtctgtagctatgtgagcactgttcagcttgtgctctgtccccctgctccgatccctgcaggctgcagcttgcttgtcactggatcatttggcaattgggcatggccttcttgatcgcgctagctatcatatcgtggtatgtaatgtacagtacatatgcttgatcgatctgtcattggatttgtgatgcttcgcctttgttcatcaatccgagcggccgggaatctttgcttcatactccggattattagatagacatgattagcttgtgcaatcagtaccgggacttgtcactgttgctgtatcattattagtcggtgataatgtaaggcataaatttggtactttggttcagcatggacagatagatgaatcgatggggtaatggatctgtgtgaagaaatcaaactttattttcatcgttttaatgtttgcttggttggttaatttttccatcatgggctgaattaaggtttgaaatccgagagttaaattaaacgtggagacatattaattagccgagaagacgagaattaagaccccaagatctaattgagcatagctacttctcgtttccgttaacatgtttttcaaaccgctaaatggtatgttttgtatgaaatttttttagttaatactaaaaagccaaactaaatttatttttcatgtttctaataattattcccttcgttccaaaatatagggtattttggttgcatagaatacattcta

SEQ ID NO: 39841 - DNA, 1501 bp, Oryza sativa
gcgagacgcctctcgttgcacttctgcagtttcatctggtattgctcgttctgccaataccatcacacgccattatgtcatcaaaagcaagatgtgaaaattgtggttacattgagctatgatcatataagacggtacctttaacagctcctggtgtttaagctccttctctagtttcttcatcgacttggatagccgctgaagctcggctacctataatgaaatactagtcagatggtattctcttgattgtaataatatcaggggcaggattaaatagattctacagtctgaagtctcatacctcaataatactagtacatgtgttagaacccaggaagcaataaaatgctatcttgctgaggaattctgctcgctccttgttctgtacaaacaattagattacctaccattaatttctactgtcaacatctaggtatgataaaaccatatgctgtatggtgcttatgtatatcagtaatgatgtgaagagaaaatcaaaccttgtatattcctgtccttccagcccatacaatttggtccagaaagaggaaagttgatagcagtgcattcttcgactgtggatggcacaaagcaaaaagatacaatgagaagtgaaaaaacgtatctttaggttctcagagttcctacaaggcaatacaagcttcaacatacctttccaagtaagatcaggggtagtggagttcctttggcaggaggactaatcaaagcatgcagatcattaacaaactgcaaaataatgtggtgccacagatcatgtcaaggtatgaaaaaatagcttctcatttgcaatatctactgcggacaaggattaaaactttaccttaaaaagtcggaaaactttacgagctagactagtcgacttgtcaacattctgtgcaggccctggttgtccattactcacaaatttcgagccatattgtatagctctacagatcttatctcttgcttcagccttgtttaggtataaaataagcagagcaagatctgctcttgcactctccagtgaactcatactgtatagctggtgactgcatcggtgataagatgttgggtcacaattatagcagtgaatagatgagcattaccgtgacagaatcagggacacaattgaagcaggaaaagaaacaaattaattccaaaaataatataggctcagtcgtgatctctgttgcatagtgataacgaagaaattgccaaaaccgaaagcaatgtaacagggctaacagctaaaggtttaaagaatctcggaaaaattggcagtagcagaataaggtttgtcatcactcatcaggctacctataagactataatttaaacagcaggctctgctaaaaaaaaaggagctcatataacctttagcacatattcacaatttcataaactcggtaaaatttacagtggcctgtaaagtagcataaaggttaactcaatgacatgtgatttaaatttgattgcatggatacagtttaagaggcgt

SEQ ID NO: 39842 - DNA, 1501 bp, Oryza sativa
tggcatagtagggtttcatttgcaaaagcagcatttagcaaacatttgagaatttaataaaacagttaagtattaaacaatattaatccaacgctatacaacataccttgttgtataggcccaaccattctgaacaaccatcccggctgcacagttctatctccaaaccaggaatgtaccattccaaaccaggagttaatcaaattattaccaattatagcatcatttactatggtgagaagtgtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtacctcggaaaggagttgtgacaataccccttacataacacaatccaccgcagcgcaccttcctgaatcataatcacccccttataaacaatgcatggactccccagcgacccccgtgggcttatctccgccacttctcagtctggtgccccgcaatgaaccatgctatacaaaagataaagccgttgcccacgctggcttgtggttggcacggttaatgtttcacaaccgaaactcgtgaaccggtccttaattgtcatgagcacgaccatcaaaaccatgtgctcacaacccaccattaccaggttttagttggcacattaattaattaaccaatcacgattgaccatcgtgaactatcattaagccatcattaagtaatagtgagtcataagttatcccgaaagtgtgctaatgtttctaagcatggctaagcaatcatacctaatatctagttgaaccaatatatataaagctcaactagtccaattataataacccaaggtatcaaggaataaagtaatcaagaacaaaagggctataacaaacaataggttaattccacccaatgacattcgaaaataaatgcaatagttgaatagaaaccatagctttaaatgggatcaacatgctcaaagggttgtttgggatctgtgtgacttgccttgctggccttggaactcttcaaactcttctccggtgaaaacggactctccggaaacgacggaatctaaacagaaaagagcaaaatcaccaaaacagcacataaacaagcatgaacagtacatgtggatatttttaacatgtagatctcaattttagaaaaatttagagacttgaaccaactaaatccgagctaagatgaattagttatgaatttttgaagattaaatcggattaaaacacttaaattgattttaattgaattatgacgcaataataaattatttttgaaaaggaaaaagggatttattgcgtcagcgggctagggtttcggtggaccgggcgcacggcgacggttcacgcgaacggacggccgagatcgacttgatccaaaacggatggccgagatcgaacggtccacgaccggttcacgggagagggcgatga

SEQ ID NO: 39843 - DNA, 1501 bp, Oryza sativa
ccattcctttagttgtgctggttcattctgtcatccttcgtggaatcttttgtttggttgtcattgcatcattcccggaccttactgtacagatcagctgctaatgattcctttccccatttttttgtaatgcttgccatgtggagtaatctaaacaactgttgttacacagagcattcctggatacaagatcatgccgaccaatcccaagattcttgtggacattgccatgagatcaatctcagaggagaggacgccggctcatgttcgttctcgacgccgctggcgtcatgcagccgcgatgtgagcttcaacaccggtggcccggtcgcctgccaaagcatgtctgaagaagcgtgctcccccacattcgcctgcagatcatcgttctctgcatttgtcgctgagaatgctccgtcgtgcgcgctctcggggttctccttcggtggcgtctgcgaaccctgcaacgccgtgttcccgtccccggtcgcttccatgccgagcttctccttcttctgcggccaagaacccggcgagcctgagtcgtcgcctgatggtgacgccttgggcgagaaagctcactgcgacgcgacggtggtggccctcgtctcgtcctcggctccgaggacagcggaggtcctgagggccgccgtaagggcgaacccgtcgcgcgccatcggcatgaacagcaggaggaaccacaccatcggcgccggcgagcgcgagcacctggatgtggcggtcgccgagtcggtgatacggtgggcgtcctgcaccaacctgtcgacgacgcactcgctccgggcttcgctggtgtgctagcattttgtttatctgtgcaattcaccatgtgtcctgtggctgtgagagtgcttcgctagtctcttgccttcctccttgcacctgcgatgcaagctgaaagataagagtgagatgagtgatgagatgagatgagagtgtgagtggtagaatgtaacgtggacctgatgatatataatgctatagtagattaccgagtagtgtgcttgctttctgtttgttgaatgtgttccttatttttggtctcctttgtgcacttgtcactacttatcactaataccatccatcaacatcagcttggtgccatgctctctcttgaatgcttgcagacaaacttaaaccgaagttgacccccatgtaattagctcaagaaacatttcaaatacctcattatgaaaagatgatcgaataatatagtgattattggatagagatgacgtatttgctactataaagcaaagaaaaaatatggctcaagagatgatatatttggatcaagtgattaccaatttatgatcaagtcccctcttccagtcttccagtatctacaaatttgtgatcctatgggcctttgggcctggtcgctgacccagcccacggcccagccaagtcgtcgtcttcctcgatgccgctccaccgcttcttccacttcgcccgcgccggcgccgcccgtcgaacacca

SEQ ID NO: 39844 - DNA, 1501 bp, Oryza sativa
cactaggttagtcccacttacctcttaaaatggggcaccttcttctttatataaaatatcagcaacgggtctgaccgttaaaaaaaatcttaattggttaagcatgattagcaacaaaaataatttatgcgtaaatctttaagatatgtgtacttagcaacttttaagaatcaactcaaatttaagtttcaaattttaatttttggctacggctagctggtctgactagggaatgtgctaattcatttttccacctccgaaatggacgcaagcaaacgaacccgttgaaaccagaaggaagcaaattaaatgcagtgcatctctctttcgccctcctgtcgctttcccactctggtaggccagccaaccacacaacattgcattagatctttctttcccctgatcaatcacttgcaaaacagaaagaacaaggacaaaaaataataagcaaaaaaaaaaataaaggcatgcaaatggcattgcttaagaacaattatttgtagccccactagaggcacaacttgtagtgctccttaaaccaatccagcaaagagggcaaccatcacacatcggcatgatcaccacattaactaaacaacaaatttttaggagattgggccctttttgtgtttactttctttctggtttttcttttgcttctgtcctactttgcatttgcagttttttgggactccttttgcgacatataattgggtcgacattggaaaaaacagaaggaattttttataaacataagattattttttttatagaatgaataactttgagtgatttgtaccaggatgcgctagctgcttgcatatccttactgatttgtgaaggttcacctatgtttttgcgtgagttgtagaaagagtgtcactacacttgagtgtatctcaaactaccgggtcaaattgcacatctcattttcttcagtctttaacaactttacatgcattgacatactagtaccttatactactcctatgtgctaatacggtcgcagggaaaaaaaatactcgaagtacagactgcatctgtattggtgtctaacggtctgtacccccccccccccaaaaaaaaaaaaaacaaatcccgaaacgcataatttgtacttcgaaaaaaagacaagaccttaccacaactgctgcacctaattcaaaccaaccaaacacattagaacaattcaaagtctcatacatcatcgttcatacctcttcctaactaaccagtctggcgaaaatcatttttttcttctagagtcaacaacaaatactattcactctgttagaacaatcatttaaccaaccaacataaaattgatgttattatatctacatttaaaagtatttgcttatgatcgtaatttgttactatataaacaaccaacatattagtagaacaattgtttatcaaaatcttatcctaataaatcgtcttactccatcctaagattattatgtccagattcgtagtctacaatttttatgcggaggga

SEQ ID NO: 39845 - DNA, 1501 bp, Oryza sativa
aaaaaactacaacaggagcatcagtctgagatcaatattatttcagttcctcagcaatttactgaataatgcagctaggaaatctgcacttcccttcttaatacattggtacacaactctcctacgtgttcgagaaaataaaattgtattctgaatctgaaatatgcaaacagcaatcgtggcgccagagaaaggcctttccctatattttcagtacactcaacttctttccctctttgttcatttcaatgtcgcctttctcctttccttttagttgaagggcaaaatcctcattcatcctagttcatattcagcacggcatttcttaactgatctgatgtgagacagatacggaatcgcaagcagtttacatgcatgatctggaatacaactagcaacattcttagagtaaaagcaaaacctcttaacctgtctttgtagctgaattgttgacaacggcgtgaggctttggacgagctcctcataaacaggatgcaaataaatcccagttgtgtgtgcaccaatgctacactactgaatattgattgcttcacgaaaaaattatactaaccaaccacgattagatctggtattaattgcaaatgaggtactactaataatcgatgcaagtaaccaacatcaatactccagtatcactataagaagtccaaaccgaagctgtaactgcaagggtttggtggccatttttactccaaccacccaccgaccgacgtgcagagattctttgttttctctggttctgatttctgaaataggccaggttggtttggctcatcagtcggattatcaaccggattattagtaccacgattccaaaagtacgtcttcgaaaaatttctttatcagcattgcttctttaattcataagtacgccatacattgcccataataagctatcatccgcttcttattaaaacggattatttactccatatttcaaaaatatttattttctttactataagcaatgttgcctaggctatttattttatattattcattaagtttatttctttaaatatttaatttatctttataattaaattgatagttcacgataataatgtgcaaataaacgcgctatgcactgcattgtcacagacgtacagtgatgtcgcttagcttgtcctgccttgaaggataaaacagtatttggttgcattcttgaaacatcagcaatgcgatttgctcactcaccctcattcatggcctctccacttcacacatgtcaaggaccagcagcatagcttaggagagatcgtcgtcttccgcccatggcaatcccgtgaagcctcgccattccccatgccgaagcaaccccgccgccgtagtactcgctataaatccacctcgccgctgcttcttctcggtgtctcgcattgccggacggccggcgtcgacatgaggctcgtggtggtgtggctcgccgcggtggcggttcttggtctggccagccatgggcgccccgcggcggcggcgg

SEQ ID NO: 39846 - DNA, 1501 bp, Oryza sativa
gggtgccgagggagaacacgtggcggctggacggggcgggcgccgtggcgccaaggaacgcggcgccccccggggaggcgacgaccgcggggcggcggagggccacgctgggaggggcccgctccaggagctcccgcccgccgaccaccagcgacccgcgctccagccgcgccatctcctcgctccgcgggcacgcgacggcggcggaactgaggctgggacgcggccacggccggcattgcgccgggacgaggccgcgggggcgcgaattattcccgcgcgagggagtaggaggaggggcccgaagcggcgacctccagggcgccgtccccgtcatcgccatgtcagcttcgagctgggatagactaagatatccggtagtacttccgctgccatgatcgggacccccgcgtgtggatgggggcgctcgccgcgacgcgagagagacggcgacgctcggctcgcgtgcgcgactacgcgggggggacgagggcgacagctacgaaatcggggtttttatggactatttggcccccttccttctcgaagagcactgctaaatgtacttagtccttccgtatcataatatagcaatataaaatcgaacgagacatttcatagtacaatgaatttggacatacttcctgtccagattagttgtattataaaggatatgtttagttctcactaaaattagaagtttggttgaaatatgaacgatgtgatggaaaagttgaaagtttatgtgtgtagaaaagttttgatgtgatggaaaaattgaaagtttgaagaaaaactttaaaactaaacacggcgaaaatgtcacatctttatagcacaactaatatggacagggagcatgtccaaattcactatactatgaagtgtctcatccgatactagattgctataatatgggacggagggagtaacttctttctatttttacaaaactctcataaacaataatatcatgcgtttaatttaagaagataaaaatcatagatatctacgtatactcacagcatgatacatagtctagtcttagtaaaactttaggaaaagaaaatttaatactaataaacttttccattctcaaataccactatcccctcttggatgacttcgtttttttactagaaagagacgattttttttctctcgtgtcaatttttagccagcgaaatgccacgtcatcatttatgagggcaagactatcatttttccctcagatatggcgacatgacgcctcgcgggctaaaaatagcacacgggctaaaatttgaatttcagtttaaattattttaaagtttaacctgtttattgaggaatgaggatgatatttgaagccacataaaacgatggcctgaaaagagggagttttgatctgcactggactgtgccacggtcactacacagtgcacactgcgacgccaaccactcgaactccccgacgagataaagcgccacgtccagcgacgagccagtgagcctccgttct

SEQ ID NO: 39847 - DNA, 1501 bp, Oryza sativa
gcggtccggccgcgcgtccagcttcgcccggccctccggcgtcagcaccagccgccggatgccgccggccgacggcggcggcgacgcgcctgcggcaggggagcaccgcggcggaggcggccgtcgcgaggcccgcggcgcctgaggcggagcgcggagcatggctgcgatttgctgccgtcgccctggagaacggaggctcactggctcgtcgctggacgtggcgctttatctcgtcggggagttcgagtggttggcgtcgcagtgtgcactgtgtagtgaccgtggcacagtccagtgcagatcaaaactccctcttttcaggccatcgttttatgtggcttcaaatatcatcctcattcctcaataaacaggttaaactttaaaataatttaaactgaaattcaaattttagcccgtgtgctatttttagcccgcgaggcgtcatgtcgccatatctgagggaaaaatgatagtcttgccctcataaatgatgacgtggcatttcgctggctaaaaattgacacgagagaaaaaaaatcgtctctttctagtaaaaaaacgaagtcatccaagaggggatagtggtatttgagaatggaaaagtttattagtattaaattttcttttcctaaagttttactaagactagactatgtatcatgctgtgagtatacgtagatatctatgatttttatcttcttaaattaaacgcatgatattattgtttatgagagttttgtaaaaatagaaagaagttactccctccgtcccatattatagcaatctagtatcggatgagacacttcatagtatagtgaatttggacatgctccctgtccatattagttgtgctataaagatgtgacattttcgccgtgtttagttttaaagtttttcttcaaactttcaatttttccatcacatcaaaacttttctacacacataaactttcaacttttccatcacatcgttcatatttcaaccaaacttctaattttagtgagaactaaacatatcctttataatacaactaatctggacaggaagtatgtccaaattcattgtactatgaaatgtctcgttcgattttatattgctatattatgatacggaaggactaagtacatttagcagtgctcttcgagaaggaagggggccaaatagtccataaaaaccccgatttcgtagctgtcgccctcgtcccccccgcgtagtcgcgcacgcgagccgagcgtcgccgtctctctcgcgtcgcggcgagcgcccccatccacacgcgggggtcccgatcatggcagcggaagtactaccggatatcttagtctatcccagctcgaagctgacatggcgatgacggggacggcgccctggaggtcgccgcttcgggcccctcctcctactccctcgcgcgggaataattcgcgcccccgcggcctcgtcccggcgcaatgccggccgtggccgcgtcccagcctcagttccgccgccgtcgcgtgcc

SEQ ID NO: 39848 - DNA, 627 bp, Oryza sativa
tagtgtttcgagataccatccctggttgccgagttccttacgacaacccgtcatggccatccaaccggggctaaatacggaggagtacccttcccaggaaattgtacttaggactatatgctaatgtggaggaataaccgtactgagctgtcaccatcagcggcccacctctgctgtcccgtagcatataatcccaaataatgatatccagcggcctaagcacctcgcttatgctaccaaatactactctaatatcatcgtcatgacacagagcaatcatatacatgaacattatacccacaccattgcatttcccgagtaagctagctagacaattatatatcaaataacatattggaaagctagtactcagatgatcagaatgaagcaaagtactgtatatatatttagaagaatattctaaaaatagtacaagtcttacaaaagaaggaaaagctactagagcaatacccgaacttttcccgaagtctccgaggactgaagactctattctatttctattccactatactctagacactaaactaaactttgagaaagatgattgagctcttgcttgagtatgtcctggagtggaggatgagagctccttttataacctcccaa

SEQ ID NO: 39849 - DNA, 517 bp, Oryza sativa
agtttagggaccgttgatgaactttactcaataccacccattcaaagggtatggctatttgaatttcatccaaaagtatataatgaccataatgacctaaagttgtattttgtgggttaaactaatggagctaaagttctttgtgaatattggctaaaattagtttctgaaagttcaagtgccattaatttggttttgatggttaatgacaaatccaattacatgagactaacattgttataagcatttctttgtctactagtctcatatggatatgaaagtggaatatgtgagaggtgatttctggacttcatatgtgttgagagagaaacgttcattgatggtgtacctaaatcacaaggatgaaatgcatggagatcaagctatatgtatcattctttctatccgtgcacatattgatatattcatttataatattttcatgtgattacataagcatgtcagactaatgttttgtttgagccatatcttgtttagtctctttacattgagaaca

SEQ ID NO: 39850 - DNA, 1501 bp, Oryza sativa; identical to SEQ ID NO: 38358

SEQ ID NO: 39851 - DNA, 627 bp, Oryza sativa
aagaatgaccggtctggcactggtcgcgtcagcaacgggcagccacgatcccacgttgcgcctgtctccgccgggagtggaggtaggtgtgggctgtcccatcggagtgtcattcggacagcaaccataccaatctccgtccataaagagaagaaaagtccagtttggaaagggaagggtgcatgtggtatccccttgaagtataaaaggaggaccttgcccatagagaggggggggattcttttcgagatttagagcttagaacgggggatttttggtcctttcggaaggctgagaggaaaggaagtcgatcctttgtaacttgtccatacacaaatccacaaaaacacaggagtagggtattacgcttcgcagcggcccgaacctgtatacatcgtcgtgtctcgtgtgtcttgcgggcagacgatctttccagatacagagggagagcgagagcttgagatttcaccctaagcccccggccgaaccggcaaaggggggcctgcgcggtctcccggtgaggagccacgagctccgtcatctggcgcgccaggtagggggctcagcgtgtgttttctgagctctcagactcttccgtgtgcgccaagtttttcttgttcagcctaa

SEQ ID NO: 39852 - DNA, 1501 bp, Oryza sativa
tacgaaaagttgagattcctatcatttgtttgcaggctgccacacaggatgataacgatgatccagacaacatgacatacgaggttagtgttatattcacttgtatcacatttcttctgtaaaagaggtttacaccatctatgaaaaagttgctgattcttattctttctgtaatccagcaaaggcaggcacttgtggaatctgtaggaaatgagaacagaggtttatctgatctgcttatctcctacttggagacatggaagtacaaatcaggctttttcccaaggaaggcaaaccatgataagtatgtctaccatttcagttttcaatcaatcacatactgatttcttgcagaagataatccaagcatgtaactgatgacactctgattaaaatcttcatcatggcatgcaactgatgatttcctcctcttttttctcccaaaattgcagctgtcctatatgtctatccgctttcagacgccgagaaacactcattacattggcttgcaagcatagttaccatgaaggttgtattgctagatggctcaagattgacaaggtaaacaccttcttgggacactagatttgctatctgaattgtgtacctatcttagattataccatttgtcaaagtttacatgagcactgatatgcactgtccatttcatataacaagatggtctttgtctttcagtttccttgagcttcttccaaattaaaagaacttcatgggcttgtgcagtggaattcctgacatttttgtttatgaaacaggcctgcccagtttgcaaatatgaagtgtttggaccttcctagcgtgtgaggaggcgatcaacaaggctgaccaactatgactcgatgagacggcatatagtggttgcagcatctgctctgcagtattaattaaaaagggaaaccttaactcccaaaaaaaacagagaagggaagaaaaagaaagcaaaaaggaaaaaggaaaaagaaaaagaaaagacaaggagaaaagaaatttgaaaacagagatgcttcgtcaagattgtgcatttttttcatgtttttttttggctgtgtacaagcgtaattttgacctgatcgactcaaggcagtcgctcgaggcctttaatttcgtaaagcttcatatgcatgagtgtgcaattgtgtgcctatagtagtatagtacatgttttctgtttgaaacggagtcaaagatctctctcctgccgaccacccatctaaaagaaggccatgtgtacatcaatacatgtactgatatatactccctctgtccaaaataaatcaacttttgtacatgtcaaaatcttcttgttcaacttgtacaaaccagaacatattactccaaaatcacaaaaaagaacatattactctaggagtactcgtcctaaataatttgtgctttgcttggcttggtaccagcaaggcagcaacaagtatgctatgccacttcacttactacctgacaggcagtccagctatgatatctc

SEQ ID NO: 39853 - DNA, 1501 bp, Oryza sativa
tcgcaccttggcgcgaataatgctcccgcgattatttcatctgcatgtgctgcgtattctccactgatgatcagctgctgaactgtaccagcactgctaatctactacgctagctactttgtaactgtttttaaagcgggtagttacatcgttaatttttttttgttttgattacaagtactcggtgctaaaatatatagtatttaaaaaatctattaggcgatggttgggacgttatatcgacaagcaaatcaaacaggaaggaaaaggtttgcagcagcatcagccgacacaatacgaatcaccatctaaccaaacgaaaacgaatcaaaacttggactagcttgctgcaaatttcctggttttaaaagccaagaaaataataatttctcaggcatgtggaatactagtagagacgacaaggaggaaacaccaaaaaattcagcaaataaacaaataaatgaagtgtattcatttctgatggcgccatgatcaagcatctagcacaatgtggagcatccacccttcctttctctcacattccacagtagaatcaaatcaattttgtcatgaaccaacgcaactctgaccctgatcttttcagtttatttaccagattattgaaacatattatttatcgtacactttaaaaactatattttctttataaataatttacactcctctattgcatttcttatcgctagtgttattttctcattaatataaagattttacttcgattttcgtaagcacgcttttaaaactactaaactgtatgcgaaaactctaaatatgaaagttgatttaaaatatcaaatatattcatttgttaagtttataaatattaaaatttaactaataatgtgctaatagctttatcgtttaaccgtgcgtcaacttaatcttaatcttatgagtttcaaacactattattaagtttattcatcaaaacatgtactcctactttatatttatatctgagtgcatagtccgccaataatctaaatcgaacaggaatatatatattatcatgttaattaaatatagttttccagaaacatttatttatataaatctctttggaatttgataatggaaaatgtcatgtggccagtggcaagtaatctaattggcgtatatattccccttgtccatggcgttgcggtttgttccctcatcaacctcaccaccattattttcttctctcctcttctcttcttcctcctctcctctcctctcctcgctctccatccatctcgtcttcttcttcctcctcctcagcttcgagatttcagcttctccaaacccccattcttcccgccacaagctctgctctgtgctttgctcgctcgcctttcccgccattggtgtgcttcgctttcttggcttcaaagatccgacgagctctgtgatagctggggagaagaagaggaggagaggaggatgctgggagcgagccctaaggccaagaaaggcgcgacggtgaagttcgggtcga

SEQ ID NO: 39854 - DNA, 1501 bp, Oryza sativa
agacactcacactgtttgctagataagttcaaaggggaggtcccaacatagatgacggccgcgacttctccttcgattcggcagcccttgctccaatttgaccgcgcgcccccttaggagagagagagagagaagctagagagaagaggggaggacagtgatgatgacatgcgggggccacttttggttttgccacataaattcctagttagcacgagtggaacagatcaacttgccaattgccatgtcaacaaaatctcagacctcagattattggttgtggattactcgtgccatgctccaaaaaaattcgatttctacaaaatcttttcgaaacatacatacgcatttgctcacaatacgtgtactctcactcctatgaatgcacacacgcacaccctaccgctatgacctttcggaagactatgtcgacatatctcgagattgacgaagtcaccatgttgtctcgctgtcggcaggtacagcacctaccactgaaagaataattagccgtgaatgtgagtacatgtgtcaaatctagaacttgtacccaggtaggctggttccaccacgaagaatctaaacaattgagcaacgcttacttcacgatttctccgtaaactttaaacgttagaactgttcattgtttagactgctttgtgtttaaatttatttttaaggtttgtaatatataatatttgactaattcacataaacaaatccatcatctttaatccaaattacatggttctttgaaacgtagtattgaaaaaaaatggaataatggaaaaagagcaaaggatttaaacgtgaacataaatgcaaaatagagtacaacaaaacataagaaaaatatagaaatagtggtttgtgtagaccgcggaaaaaacacatgaatcgaattagataaatagactcgcatgaaatttttcaagggtttagagttcttgtaattttcctctaaattttttttgtagaattgtccattttatatgattttaaaacaaaagtataggattaaatctttgtttcgaagactttcctacgattttcctataatatagaaattctccaaatttatctccgtttcaggttataagactttctagcattacccacattcacatatatgttaataaatctagacatctatatgaatgtgtatctagattcattaacatttatatgaatatgaacaatgctagaaagtcttataaactgaaacggaggaactatatgtttttttttagaaggaagtatatgtttttggtacggttcaggaggccctcatggggaaaaactaccagacgctctccaaaaggatgaaaaagaacattactttgggcgcgttggatccaatacagatggtcgagattgacccacgtcgtccaaggattcgtccacgattcagaagacgttgaaccttatccgtttctgcaacgctacgctgtgtttctctggtttggggagctttggaatgaactgaggcagcagcagagga

SEQ ID NO: 39855 - DNA, 1501 bp, Oryza sativa
ccattacctacatggtgaccaacgcatttgagcgctagcttattcagttgatggcaaagcattaatgcaatgcacgacatatataccaggatacagcttcctctgtcccaaagaccattatggataatcaattttttaggagaggacacaatatggtcctagaaaaaccacaattacaacacgcccagcactaatactgtcttggtaccattagcacatggcttcctagtgataggaaaattaaataaataggcctcatttttaaggcatcacccaaaccaaacggctccttaaattgccttcgtactgtactgatacccccttcacacgtcaacaccaaagaaaaaattagctctcctgatggcatcaaaagaaaattcagaaaaaaaattaaatcgagggaaattagctggcaccaaatttaaagaaaaattaagatgtcaagagatgacgccaaagaaatcgaggacaaaaaaaaagaagcttgagtttttttttaggaaaatatattgctagcaagtttcctgagctgctaaacagtgtgttttgtgcaacaatttctatatagaagttttgcaaaaaaattcagcatatctatttttaaaatttaaagtaattaataattaattaatcatatattaacgatatactccctccgtttcaaaatatttgacatcgttgactttttagtacgtgtttgaccattcgtcttattcaaaaaatttaagtaatcatttattctttttatatcattttatttattggtaaatatactttcatgtacacatataattttatatatttcacaaattttttttgaataagatgaacggtcaaacacatgctaaaaagtcaacggtgtcaaacattttgcaatggagggagtatctgttttgtgtttgactgaagagttccagtcattcgcttaaacgaacgcaccttaaataatgtgtggtggaagaatgtctttttttagaaaacttatgtttctaagcatgtaataaataatatgttttaataattcggtgaataagtcgaaaagagcaaatcaagggaaactagcagcctagcaagctccaaaataaaattaagatgtcaagagatgacgccagtgagatccaggaccataaaaagaaagcttgagattgaagtggtttggtgtacttggtagtgtcgcaacagcagccggtcaaaatacagttgagcaggcctgccgtctgcactgcactgcacttttgtccctgaaagactttttttgggtgcttcagtggataaggatagtatagctttggtgcatctggattaagtcaccttccgctaattaatcactggattttgacatgacatacacaatgctgctttgctgatcactaagctaaaaattggttgtgtggatgctcctgtcatggtttctgaaacatggagttggagggctttggcatatgcaggagaagagcagatgatctgagcttctgacttcatgtctgtgtgtgtggttagc

SEQ ID NO: 39856 - DNA, 1043 bp, Oryza sativa
tggaaatagacttgagtagttaggtttgtacttgattcgtcctgattatatgattttgtaagagactactaagtacttccaaacatatggttacacaatctttaaatgcatcaaacaagatataaaggttcccaagacttctagcgggttctttattgggccccttttccctgatagggacaaatgggctttgagttaagcatgggttaatgttctacttcgtaagcaacataaccttgtcacaaatggttttattatgcttcatgtggtattgatgcattctttatgtagttaggtgcctggatgaagtgcaattgtaatttgtggattaacaaactaaggataatgttacgcaagtagtggcatttggacataatatttaaattgtaaatgaatgtagcacttaactgtcatgtaatatcttgttcttttattgctgtgtcgaggagcgatttgctcgctgaagttataagtgattctcaaattaataaattaatagctatctgacatggttctggagttttgcttcaaaggcttatgcctcaattttgttcctagatagttatattccagaatagcacactgcatatagaaagaaccaccattaacatctgttaccccctcagttttgcatggttaacttgaatgttttgatagtgctgatctctatagctctgttgaatgtttttgacttgcagttttccagaggatagaatgtaacatatagattttttttcagaatcctgtggtatctcattgttaaggaagttaattcttatgtaacaggtcacatgtttgatttccactttggtggcttgagagcatactctagttgtctgaatcaagttctctgaaagagagaccggagatgagagaggagggaggaattgcttctccggtacaatcattaaatctcttactttttctgtagactatttaaaatttgaaattatttgtaagtgcttgcggaaaatactctcattttttctgtgtctggcaaaaccagggcgaaaagcctattccgaatggtgcttccccaaatc

SEQ ID NO: 39857 - DNA, 1501 bp, Oryza sativa
agatatggaacatgcgttaccccaaatcactttatatgagaagctattcttcatatcatactttggggtgcaatccccatgtatcgcagaaccccagtacagaagtgtatactaaaatgtaaaagaaactatgcatgtgtgcttgatacagaaatatagtgataaagttgcagcagcgctggaaaatgatgcgaaatcagtacaaaccttcctgattcatcgacgtttaagagctccccaaccagacctttaaccttattatcgaataaggtttgcaatgacttcctctgaaacaaaattgcagcatgttcgtttaaacgaatttgctcttggctccccaaaatatccccaaggaactgaaagaaaaggtttgcactactgatgaacctgcatcacggttgcccggtgaagtgtggtcccttccaactcagcaagctcatcttcggtgaaccaaatggagcttccgaaggtgcttggaagcatatccaaatacctagagaaattaccaaaattcaatcactgatcaagttgtttaacatggagagatgtggattgcgaccatacggcttccagagggagctagggcggagtcgctcgaccatgaggaagagcatgacgaggaggcggtcgtcgacgccaccttcctcgaagagcgcgcggcaccgcggcccgacgagcgggtcctgcagcacccgcatcggagtgatggcgagatcgagcggcaccaccatcaccacctctgcaacgagacacagccaacgcgcgagtcagcgcggaggacgagctcctaaaacctccgagagaagaggtggaatagcaaatgttaccgtcggtggcgccggcctcggcggcggtggagaagacgccgtagccctcgcggccgcagcggcggatcgtgcagccgcggaggtcggcgccgttggcctgcggagaggagccaggggtttagggatttggcgtgcacgcgagtagaaggggatgtgcaggagggacgaggagcaacctggagccattggaggaaggagtctagcttggcgtcgccgggtactgctgctgcggcggcggcggcagccatggtgttcgacgggcggcgccggcgcgggcgaagtggaagaagcggtggagcggcatcgaggaagacgacgacttggctgggccgtgggctgggtcagcgaccaggcccaaaggcccataggatcacaaatttgtagatactggaagactggaagaggggacttgatcataaattggtaatcacttgatccaaatatatcatctcttgagccatattttttctttgctttatagtagcaaatacgtcatctctatccaataatcactatattattcgatcatcttttcataatgaggtatttgaaatgtttcttgagctaattacatgggggtcaacttcggtttaagtttgtctgcaagcattcaagagagagcatggcaccaagctgatgttgatggatggtattagtgataagtagtgacaagt

SEQ ID NO: 39858 - DNA, 1501 bp, Oryza sativa
gatcccggtgctgccttgtcgccccgccacccctgcctgcttcgcctgccacacgctcgctcgtcgtgctcgcccgctgcccctgcttgcttcgcccgtcgtgcgcttgcccgccgccgccgccatatacatgtgggccccgcatactttattttttttttatttttctgactgggatgccacgtcagcgaaatcaggtgtctatactcttatagacctaaattggacgcttttatacagtctagggatgaagatttttgatattgaggataagggatgtaaaaaaaaaaactcggtgtaaagttgagggacggacttattccccgtaaaatatgaacatgttaggctcgatttaatctcagcccagcccatgtaagttttacagattggccgtctgatttgacgtgattttcgatgcaggcatcatcggcgggcggtggctcaagtactggacggaggccggcgcggtgctctcctccgtcgggttgttcgaagcgcagctgagcagcggcgcgttccagctcctcggcatggcggagctgggcctcctcccctccgtcttcgcccgccgcggccccggacgatccgccaccccgtgggtcgccgtcgccgcctccgccgccgtctcggtcgccgtctccttcctcggcttcgacgacgtcgtcgccaccgccaacctgctctacagcctcggcgcgctgctcgagttcgccgccttcctccggctccgcgcgagggaggagagcccctcctcgctcaagcgcccctaccgcgtcccgctgccgctccccgcgctcgccgccatgtgcctcgtgccgtcggcgttcctggcgtacgtggtcgccgtcgccgggtggagggtctccgccgtcgccgccgcgctcacggccctcggcgtcggctggcacggcgccatgagggtgtgcaggtccaggaagtggctcaggttcaacaccgcggttgccgccgaccatcgtctgcaactacaagatgctcctcctcctcctgctggtagagtctgaactctgaacccgttttggcagatttcgtcttgcgaaaagatgaaacacggtaagaaactcgaaatatttgctagtagaagactaattacaagctatactagtacaagactaattacatggttggatgaagctctaaagttggcgttttcatatttgttcctctaattaatcaccgtgtacgattgtggttcattatcagagacgcggtttaaattgaacggtctgtctctctcaaatctgaaatggtcacatttgtagtgaagtggacatccatgaaatggcgacaaggaggcggacatgatcatattcatatccacgtactaacccagctcctcttttgtggcacacgcggctccacactacaaacctccgttccgcgccacaaactgcaaccaccacacatgctccatcgcccgtagtcatcctacaaaccaatagacaccgcgcgcgcggaacgccatcgctgccacatctcatgg

SEQ ID NO: 39859 - DNA, 270 bp, Oryza sativa
gcgcataataatcttgttggtgagcaccttaaaagatggaagggtgtccatatagttggtagttgcttagaggaccaaaaggatggaaattttggagaaaactaggtctcaagttttagggataacttgtgggaaattgggtagaatggggagttttggacatcactatttgttgcttacttgtttggcttaacaaaaggctccacttagtatctagggaactgaatggatcaatatgttgttcatctcacttgtgcctcctttcgtagg

SEQ ID NO: 39860 - DNA, 492 bp, Oryza sativa
gccattactcaaaaaagcatactggatgggttgcgaataaggcatagggtataacaaatatatatataagtcttcaagtctattgataaatattatataaagctcacttggtgttaaacaaaatgtatatgtaattcattggaaattgttccttttatcttttggtacagctaaaccagcaaaggcaaggtgataaacttgaaaactatcccctggttcagttgaaaatgttagagcacgcagttacacacttacactagatgggcttgagtcattcaatataaaaaaaaaggaaaatgccaaacgggacaaagaaattcaggacaacacgattctttgaagaagctcccaatttccagaagaatttaattccaagcatcgacttttgacagaggagtgaagcaggaagtgaagtactaaaagattggcgttgcgcgaatagcaatgcagtggtcagtgtcgacctacaccatcctatgatcctatcctagc

SEQ ID NO: 39861 - DNA, 403 bp, Oryza sativa
aattcgagctcggtaccccctgaaaaagctgcacatgtcttttttattgtcttttgcacaattagttggtttcacttgtagggatgctaatgcctggaatgctatttcagtgtgatttaaacattattttacaaaggttgtgggtaaaacaagcgtttgtatgctattagttgctacagttcttaaaaaaaatacattccactcctttgaccttaatcttccgcatgctttcttatttgcttcagtgaacctaacggccctcttgaaatgtgaagtctggttgtgttggcaactctgactaactagcttattaatcagcaactattcttttttaatgttcataaatatatttgttccatctccccaactattcttttctgatgtatctctctacttctgcagt

SEQ ID NO: 39862 - DNA, 325 bp, Oryza sativa
gtgcatcttgaccttttgcttctgcattaaagtcgcggaaacaaagcatactgaaattcttgatatttagccaatctgaaattctgatttctttcgctttcatgtgccgttgaaaacttacaataactagcgaagacaccttgcgccattgagaatctagtaatgtgtcattttttttgataattggaaggactgtactacaatatctatttgctacgagtattaaagtgtagatagtagctaaattatcgaatcaccacataatgagttgctaatgctgtgtttgaggagaatgagatagacgagattggaaatatacgcaaaa

SEQ ID NO: 39863 - DNA, 1501 bp, Oryza sativa
gggtcccacctgtaagtttttgttttcctttttctgttaaaaatctcccccagagtcctctttcatacatactccgatttcgtccatcttctttctaaatccatttaaaatgaagtcggtaagcactaagcactgtagtatctagtattaggttggacacctgggctcactttggtcggttctttggtttttgtagattgtgtgtagctgtgtatgactgaccatgtctgtcagtagcacgagcagtacatgcgtgtgaaagacttttctagagctgactttctttcatttgttcttattaaatctaataatgttcatggtcaattcgaaagacagttactattattatcattacttttgctgttatgtgcagaacaggttgagatgaacgtattgaaaagctgcatggctgacataccaaatgattaattatgtgctttcttttgtttctagccccttttttcttgaaaactcgtcttttgcatcaagaaaccaagaaacctcgttctactgtaatagactttgtgcaacatgtgaacaagcaacagtgacatttattgtttattttttaacaggcccccgaatcccaatcaaatctccccttatccaaacatgtccacactgatgagtatattctaataaaaaggtagcaaggcaagaaaacgtgtaaaaaaaattcaaacaacctaagaaacaaggtcatctggtaaagtcaaaatccatcagagatcatacatgcactttatcttgaggaacatacggcaattgggacagtataccaactcaactgcttgagcaaagttttaccaattccgaagttactgatgatgtcaagtttaacgcctaccatgtttgtctatttaagtacctccagcgatcctctagtgttacattaaatgtacacctgtaccttcctgagaaggtctgaggtgttggttgctgcctggctgggtttatggtgagaaatctctctgtacttttacctgatattgatccctgtgatgtttttggtgatacattgatctatgctgtgtgatcgtggattcagatatattatcttgttttcatgatgaatgtttagttattgtttcttctttgtattgagtgttctgttctatttagtttattttgccagtaatctttgtttagacttattccttgactttaagccaatatctttttaaacttaagtaccctcccttcttattttgttaacttccatttattttttaaaaaaatcttgtgttgaaccagtggactaggtgatggacgggtcacacaacttactgtccaaacaaaattgtcctcagtttaatggttaacgaatgcttttgctaccttaagaacaacataaatcagtcactgaaaatttgtttttttgatggaggtctctgcaaatttcagtttcactatgtttttttgtttcttcttaacggctctcagctttcaatggttttatatttgtacctttcgttcccagctagcatgcaaagtttcacgt

SEQ ID NO: 39864 - DNA, 709 bp, Oryza sativa
acttgtattttttagatctgtttgaaccaccctactctacttaaagagaaaattccctgtgtacccctgaaagttcacctaatcccttctataccccctgagatttgctcattctctcccatgcccctaaatttcagtttggatcacttctataccccttccgtcaattgaccgttagttgaccgttaaattcacatcataaagtctattttaccctctagtatcaagaaaatataaatttataaagtatattgatggagtgtataaatttattgtatgcgactattatatttatgagtttatttcgtgaggtattatttgcgacggagcggcggcggcaggcgtcagaggggcggcggagcggcacggcggtgtggtcgtggcggcggtgcagggcgtttttagctggtgcgggagcgggcatgagaaggggaggcgcgagtgcggtcgtgagagggggaggcgcgggtgtggtgtctatacgtatgtttacgttggcttcaccatcaccactacgaattttttaagtagtaaagagtaaagatagtgaggaaaaaaataatctatactatatagtatgcatgttagcttagtcaatactcaatagttagcgatgctattaaacttgctctaacccgatgagtgttaatgagtaatgaccggcacaacacgctagcacgtgcggacgaattgcgacgggaaatcacca

SEQ ID NO: 39865 - DNA, 292 bp, Oryza sativa
tcctgcagccctgcgtgttgtcgtaggttcgagtcccctagagggctacatttttttgtttcttgtttttttacaaggcgcagggtggcctgcggctagcctgtcttggctgcccatgtggaaaatgggccgctggcccagctgaaggggcagagcgcgagagggaggctggcccgagcccaagaggagagagtgagccagaaatggtccaagagagagtgtagcttttcatttttttaaattcatttgaacctcaaattcaaatccttttcaagcaaaacaagttttgaaa

SEQ ID NO: 39866 - DNA, 1330 bp, Oryza sativa
gggacatctaactattggtatgtagttttgtggtccctagacacattctatagtgacatgtaaccgaatggatctagtactggtcaatgatctaagcacacccaaaggatttacatacctgtattttagtttgtgcctaaggtccaatcagacctgtcagttgagaagtttctattaacaattcatcttctgtaacaggataaagagctctccagtgctgctggaaaactcgtggagtgccagaagacgattgcgaacctcggtcgtcagctaaaatcgctgaccgatctcgacagtgtaacagccgagcctgaaaagctagagtctggggatgcacttctggactttagagaacccgatgttgaggtgccaccagcaggctttgcaaatggcctgtacgatttggatcttccaaagagcaatgggagctgcctgtcacccattcctcgtgttcagtcgtcttccacacattcgcaaacgtcagtgttctctggcggtttatcgtcgcttggtagctacaggaacaaaacaagaaagtgaaatctgatgaaaaagatttgtgcataaacttatttaacagttcgtggatgtttgtcagttgtcacctgatgcttagatcagtgtacatttacaggaaaatgatggttacttgtgcttgttccgcctgatgattttactgctatgagctcagcctcattttctttacttttcagcgttcaccagtttctgatgcaagtcttgttgaaagttgagactgatgtttgtcatatagtaccattctcacaagctagtcagttcgagctgaagatgtgctgaacatataagtaggcaattcactgaatgcaagatgaataatctgtcactgaagaaatgcagcttgaaacttgtatagtgctttgctcgagtttataagcctggaaactaaatgcttgagatatatagctcgaatgtctgaaagtgatgagagctggttttcagtaactgtaggttccgtacgattgaatttacctctgtaagatgcaaccacctccacactaccgtccaaaactgcgacatggagtactacataagctgtggcatggttgcactctatcgcacactcgaatcgtctcccattgttgagcaagcaaaggtctttgttcttcttgagctcagctcagctcatcagcttccatccatgggtgtcttcagctcggctcccaaggtgtacaagccggcgtcggaggtcaatctcggcgccgacagcaacgagttctacatcagccccaacgtcaaaggttacaagctcttgctgaattttctgtccattttcatgtcaaagagcttttgc

SEQ ID NO: 39867 - DNA, 1501 bp, Oryza sativa
agattcagagagatatagcaaagatctaaataaactagacaaaactctaaccctttttatatatatgtatgacaaaaagttttagtgagatctttataagagctctcataattctggtaccagtagtggagactcgagcccttgccgtccttatattagatcatcccctggagccatgcatgcagagataatatatacactaaactccgatcttttcatacatgaatatattagtagaaaatcatagctcgtagtactaagaacatgtaatattccatattatgtttatttattttggagcacaatgaacaatcagaatatttatatatacaatagatctctcctacgtatctaaacctaattggtacttgctaaaaactggtcgtacgtacgttaaaaaatatctgaccattttagatggatcatattaacatgatctatatgcatttaacttttcaggtcatgttaaaaacttatctattctacatctacatattgtgggagtttatacttcatgatgaatgtttttttttataatgggaatttataaaacccggcttcaaactggatacaacggggtttttattgattccaaattctagactaagcaaaatgtcggtaagctacaactaagattacaaactgagtacaactcaatatttattaattcagaattatgaaaccattcagttttgctatataattgtcgataaattttcttctagaaatttaacatatataattatagtactatcatgatataattacattgtaatttacatataactataatataacttgtacgcaactttcacaaaaaatttgaattgttagatttgtttcaagattcttaccggcaaggaaggaaaaaaaatcaaattgtgcgtacatgtgagaggattcggttgacctccatttcacgaaaatagcatgctacgaagagatttttaaaagttacatacaagtgacattgtagttacaatgtaattacaactcgattgtaccataattacatctgtcaaatttctagaagaaaagttgtcgacaaatgtatatgtgacctcaaaaaattaaaaaaaaaaatatttcaaatgtcaataacaatagctgtgcgacacacggttttacgactatgaaatacaagaaagaagagatcgggaataacaaataagctcagatatatgtgtagttgttatcacttgtttatatcagtggcatggccgctcgtgtgctgctagctgcatgccccatccatatattgcatacatacacacatgctagctactctcatcactctaaattctaaaatacacacgacaagacagtacaaatcgacgagcgtcttctttataaatcaatagccagcctgcaccacagcctgtgcccatccaattaactacaagaccccagttcatccagtggatcgatcgatcagagctagctagatcgagagatcacaattcagaagcaaatcaatcaagcatcgatcgatcgatcgaca

SEQ ID NO: 39868 - DNA, 1501 bp, Oryza sativa
ccgagtggcagtggaggtagcagccggagagcttcctgatctgcatcgccctgaacgagccgccgatggatgacagcggcgaggacagcgccgacggcggcgaggttgccgacgagctggtggtggtggtggtggtggtcgcggtggcggatgtcgccgccgtcatcacagagttgaacgacgacgacgcggagacagccgccgcggagtcgccgtggtacccgggacccatcagcgacctgctcgacgtgctccctccgccgccgccatcgccgccgccgccgccgccgctccggcggcgccggcctctccccctgctcgacaccgaactctccttggtgctgcagatcgatccggcacacgtgatgctcctgctgatgctgctcctcctcttctccttcttgccaccattcttgccttctgctgcagacactggttggcttctggaggaagaagacgaggagtagaacgccatggatccccagcttccaaccctgctcatcttcttgccatccttgtctttctccttggctgcactagcttccattggagaagaagaagaagaagaaggtgtttgatgaaatgaggggagtgagtgtgttgtcactatgcctagctaagctaaaaacttgttgtttttgagcaagacagcttaagctttaggctccattaccccatgattagtttaacactaatgaccttaatgaagcttttggttgtaatgtaatgtaaatgtggtgtggtggtgttgggtggtgtgggaatgaatgaaaagacacacaaatgcaacacaaatgccaaggagaaaaaaggggatctttatgtgcggttgcagcatgggcgattgggcatgcagaagctatgccatcatgctcccaatcctgaccttctgatgagaccatgtgatgtgatcacctgtttctttccttctctgcattttattagccatggattagaggagagtagaaagatcacctgttaattgaatacttctacatttgtggcaagaatgcactaaaatactatttctgaatatttctctccctctctctcttaagttttgtttgactgaatttctgcaatgtcattgtttgcttttcagcttataagccattgtcagaatttgaattttgaaattgactttgtggctttctcattgtagtttctttctagcattttcttttaaaccacgaatagcacagatattgaagttttgcccacaaactattttgtggttgcttatacgctgttctatggtttaacgatcaaacttctgaacatcattctgaatgtgacagttccgaaattcagcaggaagaatgcttgcaatgcaagatgctgttgtgatctcgatggcatgattggtgcaggttgatgtggattagtttggattaatcccagcatccgttcttagcggttactgtgcagtcaaaagagtgcaaattaaagatgtatattagagagagtcaagtaataatgcagtgtagataagatcttcagt

SEQ ID NO: 39869 - DNA, 1501 bp, Oryza sativa
tcaaatatgcagttggaggcttggagcaggttaatagtgctcccccaaggcagcttgtgagctgtgacagtttggatagaattattctgcatctttgacagttgtcatatgtaacttttttttttttgcataaccatggatctgaatttctgctcacaactgaacttctggtgttgttgatctgttacataagtttccaaagttgcatcctttacatacagcaggtcgttctactactcccacagtatcatgtcatccacaattaaaaaaaattggcaaaggcaactgaatattctcatgttctaggtaacctgcaatcctgcatgtttcttgagagcaaaagcatgggatagttcatgaatgttttgcagtacacaccggccaggaaacaaactggcaaagcattatgcttctctcgtaacctttgatttaggccctctttgtttagacttaggcttattggactagacttttaagtcagcttattggcttatatgatttataagccagtggatttaatgtcctaagtttagtggtggagtcatacatctatctcatataagccaaaaaagcttttccaacctagcttttggcttaatagtgttagagtggtttatggcttcaaaaaagccaaatgaaaaagctgcttgtttgttttggcttagactttttgatttataagttggcttataagcctaaacaaagaggaccttagtataacagcagacatggaagttatctgctactagtttctactcgaaaatatgcattgttgaacctgaaatagtattattttcccataagtaagcagctcaaatctctttattgtttttatctaaaaaaaactctatattgcttggagttgtttaattggaaccatacaacgtttgctttcaagcttaatctcagaataaacagtgcagacagcacacgtggttcggtgggaatgtgattgtggacttcaataactcgcagatgatttagatgggctgggcccattatgctaccagcgaaatgtatgcaggtcaagcgctgtcgattagtaccacctcgccagttttggtggagcgggagctacttataaactggagcttggaggcttggggcacgaccttacttgaacaggatctgttctataggctcgtaccgttgcatcctttaccaataaggaggcaagcactctagtctggttgatgggtccatgacctctgggccagagcgtgattaacggcttggatggatctctggaaggaaccatctgacggctgtagaggatcgttcctgactggtggtaccagtgcagggtggcgcagaggtggtctgacagacccccaatttttttttttgtctttctttctgtattctactttcgataatttttcatcttttgcattcttactttcaagaatttgtttatcaccaattcacatacagactcctaccttttcttttgctggacaaaaacacaaactttctatgcttacttaggccgtgtttagtt

SEQ ID NO: 39870 - DNA, 468 bp, Oryza sativa
ctcaagaaaaaaactataaatggtgcaaattgcctataacattgtttttttatatcctttatcacaacatactacataatgagcagctctgtaaacatgaacatatatcaccaacacacaaatcatatggatcgctattgctaaggcagccacgtttggctataacctatggcaggagcgttcatttggttttacggttgtttaaagaaaaccgcccgcgtccattgcttatcaacggaggagagtcgatcatccttggtgggcaaggattttgaggcggttatgtgcggcttgccttaaaagctctgtttttttccatttgtaccaaatgcctctcgtgccttagcaaagtaggagtagaatttttcttacttaagatttaaacgtgtccttaagaaaccatgtggagaggaaaccatcgatatgagaatttatagttcaaactggattagacgtgtatcgataaaa

SEQ ID NO: 39871 - DNA, 1501 bp, Oryza sativa
atccgtttaaaaatatataacgacctaatataaaatgagacatattctagtaatataaatctgaatagggatttcttagtatcgagatgtatcccatcctgtattacgttgctatattttggaacggagtgaagaataatcaatcaactgagcttacttgcttggtagcttccaactctgtgtgatctcatgattacctttggagctgcagttagctgttggttactaaagaaactaaaggtgcaatataatataatggtacccttaagcttaatctctctcatcatggccgccctcgatctcatggtggcctagctacctttatttctgagactttttcatctctgaatctgccgggaccatgcatatgcatatgcatagaggtgccccaatttctctatctttcggaccatctcatcaaaaggacgttcacagatgatagatcaactgttgtgtaataggtatatttgcaagtttcctttaatttcaattttggcatgatcattacacatgttgagatcgatctagagagagagatggcaggagtctttcagctggcttgagtacgtgaaggcagagctggctggctagctagcttatgttgaattcatcacttttgggctaaccagcattatgcattatgcatatggccatatgggcctgattgatgaaagggccattgcaccttgactgaccgtgagatcgccttttaaatgattatgtgtatatcgatcggccttatattaatatggctatactatagtaatatggtgctactacctctgtaaaaaaaaacttcattattttcctatctcacacataccaatataaagtcaaaagactaaaatgctctccatttttttcgaactccaatacatttgttcctcgcttttttaaatctctaatgtatttgtgtttcacttttccaaactttgatgtattaactgtcttaaaaatgaaggcattatgggacaaatgaaaaaggtaacaataaagtctttgtgtgatggagggactactacatatgttttaaaatacaaattgttgacttttgactattcatcttattaaaaagttaatataaatatgaataagtcatatttgaagtatatttaatgataaaataagtgatatttacatactcccttcatcttaaaatatagcaattctagctatatatacggacatacttttatgcaaatacatatagctaagttatattatatatttcaggatggatatagtagtatttttaataagatgaataatcaaattaatttattatcatcaggagtcaaacacatcatatatttaagagtcctgctccggtgctttctacttggagtagaaagcaatctgagccgttcattatatttaattgtagggttgtgatctatttctactcccaccagagttagtggtagtagaaatgtacaagggtatattcgttcagggataataattcgtgcaggggtattatcataatttatcaatatctaac

SEQ ID NO: 39872 - DNA, 1501 bp, Oryza sativa
gaagtgctaatgattgtgagcagtgcagcagcagggctttttaggcgaaactgaagatcttatctacactgcattattacttgactctctctaatatacatctttaatttgcactcttttgactgcacagtaaccgctaagaacggatgctgggattaatccaaactaatccacatcaacctgcaccaatcatgccatcgagatcacaacagcatcttgcattgcaagcattcttcctgctgaatttcggaactgtcacattcagaatgatgttcagaagtttgatcgttaaaccatagaacagcgtataagcaaccacaaaatagtttgtgggcaaaacttcaatatctgtgctattcgtggtttaaaagaaaatgctagaaagaaactacaatgagaaagccacaaagtcaatttcaaaattcaaattctgacaatggcttataagctgaaaagcaaacaatgacattgcagaaattcagtcaaacaaaacttaagagagagagggagagaaatattcagaaatagtattttagtgcattcttgccacaaatgtagaagtattcaattaacaggtgatctttctactctcctctaatccatggctaataaaatgcagagaaggaaagaaacaggtgatcacatcacatggtctcatcagaaggtcaggattgggagcatgatggcatagcttctgcatgcccaatcgcccatgctgcaaccgcacataaagatccccttttttctccttggcatttgtgttgcatttgtgtgtcttttcattcattcccacaccacccaacaccaccacaccacatttacattacattacaaccaaaagcttcattaaggtcattagtgttaaactaatcatggggtaatggagcctaaagcttaagctgtcttgctcaaaaacaacaagtttttagcttagctaggcatagtgacaacacactcactcccctcatttcatcaaacaccttcttcttcttcttcttctccaatggaagctagtgcagccaaggagaaagacaaggatggcaagaagatgagcagggttggaagctggggatccatggcgttctactcctcgtcttcttcctccagaagccaaccagtgtctgcagcagaaggcaagaatggtggcaagaaggagaagaggaggagcagcatcagcaggagcatcacgtgtgccggatcgatctgcagcaccaaggagagttcggtgtcgagcagggggagaggccggcgccgccggagcggcggcggcggcggcggcgatggcggcggcggagggagcacgtcgagcaggtcgctgatgggtcccgggtaccacggcgactccgcggcggctgtctccgcgtcgtcgtcgttcaactctgtgatgacggcggcgacatccgccaccgcgaccaccaccaccaccaccaccagctcgtcggcaacctcgccgccgtcggcgctgtcctcgccgctgtcatccatcggcggctcgttcagg

SEQ ID NO: 39873 - DNA, 1501 bp, Oryza sativa
ggctggatgaggctatcattcgccaatcttcgctaattttaatcattagtaattaattagtgataattaatatatggtgcaaacaagacgtcatgatcatacgtacaacatccgtccaaaaaagacaacttctagaaatgaatctggacatatgtttattcagattcatccccagaagttagtattttataggacagaaggagtaggtggttttcctctaaaacaatatttttacgcagctcttttaagggtgtgtttagatcccaaaaaattttggtcaaaaatgtcatatcaaatgtttagacacatctatgaagcattaaatgtagacggaaaaaaccaattacacagtttacatgcaaattacgagacgaatcttttgagactaattgcgccatgatctgacaatatgatactatagtaaacatttgctaatgacgaattatttagacttaataaatgtctcgcagtttacaggtaaaatctgtaatttgctttgttattagtgtacgtttaatagaaagaactaaacacggcctaagtaagcatagaaagtttgtgtttttgtccagcaaaagaaaaggtaggagtctgtatgtgaattggtgataaacaaattcttgaaagtaagaatgcaaaagatgaaaaattatcgaaagtagaatacagaaagaaagacaaaaaaaaaaattgggggtctgtcagaccacctctgcgccaccctgcactggtaccaccagtcaggaacgatcctctacagccgtcagatggttccttccagagatccatccaagccgttaatcacgctctggcccagaggtcatggacccatcaaccagactagagtgcttgcctccttattggtaaaggatgcaacggtacgagcctatagaacagatcctgttcaagtaaggtcgtgccccaagcctccaagctccagtttataagtagctcccgctccaccaaaactggcgaggtggtactaatcgacagcgcttgacctgcatacatttcgctggtagcataatgggcccagcccatctaaatcatctgcgagttattgaagtccacaatcacattcccaccgaaccacgtgtgctgtctgcactgtttattctgagattaagcttgaaagcaaacgttgtatggttccaattaaacaactccaagcaatatagagttttttttagataaaaacaataaagagatttgagctgcttacttatgggaaaataatactatttcaggttcaacaatgcatattttcgagtagaaactagtagcagataacttccatgtctgctgttatactaaggtcctctttgtttaggcttataagccaacttataaatcaaaaagtctaagccaaaacaaacaagcagctttttcatttggcttttttgaagccataaaccactctaacactattaagccaaaagctaggttggaaaagcttttttggcttatatgagatagatgtatgactccaccactaaactta

SEQ ID NO: 39874 - DNA, 1501 bp, Oryza sativa
gagaatctcttgtgtgtcactaactttttcgctcgtctagcaattttgaatttattatgctagcaaattaagtgcatgtgcgttgctaaggaaataaatttatggttgcaaacaaaactgaatgctccaataaattcaagtaaacaacatgattattacattgctaaaacatgtaaatgatatttacaaattacatatatactagctgggtgtccgtgcgttgcaacgtgaaataatatatatcaatttcaaattatatgaggtgaaaagatgttaaataatcattgagtgaaaatttgttgaacacggttaaaaatctggcaaatcgaagagactacaaatcaaaattgttctgtagtttaattcaaattaatttcaatacaaaaaatctattaccactacacaatccgagtgtaagctttctggcatataaaacaatctcatggtgtttaatatttagaacatagtagtagatagaagaatgctatggaaatttaatatctagaacatcaagcatacctagatatagtatttgtcatggatgagctgcagatctccctataacatacctcccgtacaaatacattggcattgccataaactatcaccaattcaccccaaacaacatgacatttccctttttttctattcacatgtaccagtcttctgaacatcataaaaaatcatgatctatgtgcatataacaaactattatatatattacaaaatgaaaattatctccagagattacagatgaatgctatatttttaaatcaaatgatagggactgaattgaaataatcaaatacagtccattaaagacatgtatcaaacaccacaaaaatcaagagaattatgccacgagttcacttgtaatgaacgtactaatctctatccacgtctccagcattacacaatatgctatctatcatgagagattgttgatctcagagcatacaaagtaataaagtgaagtagcacatcagtccactgctctttcaaattcaatcttcggatgacccttaagagttctgcgagaataattccagatcagtgataataacagtgcaaaacatggactaaccaatttagcatcatagatcctgaagaattaattatgtttttctccttttgcaataccacctgatgcataaagaactacactatatctggacaagttcaattatggagaatgccatgacaaaccatgtcttacatttcttagtgaagggagcataaatacagtacaggaacaacacaaaaaagaagtgtattgtctcatcaccctgaattgtgcaacacattttggtcctgttcttttctccaacatgagttggataaagattaggattttcgtggcacgcttttcaaactgctaaacggtgcgtttcgtgcgaaaaatttctacacgaaagttgctctaaaatataatattaatctatttttcaagtttgtaataattaaaactcaatcaatcgtacattaataccacctcgttttg

SEQ ID NO: 39875 - DNA, 1501 bp, Oryza sativa
cttcgcgggtggaggaggaggagcgaagtattcggcgtattcggcgtggatggatggatcgtgtggtggtgaaatcactcgcgcagatggacggtagggatcaatccgaatgattttgtatgtaggattggaggtggacaactcctcctttttatattatagatatagatatagatatagatatagatatatatggcatgatttgtcttgatgatctacagtgaaaggaaacaatttttatccaaaggaggattaccatcataaattcgcaggaaccaggaaatccttgtgttagtagcgccagccaatagcagtgcggcgtgcatcgacaccgatccgtgccaccacgtaaacaaaccatatcagccgtcgattaattaaatgcaacggtaatcaatcgagctctggttaaataaaaactaattaataagtcggtttatggaacggtaaattagcccgcccgatcgcctataaattagccctcttctccggtcagatctgcacaccaaaacatacctgagggggattttcggaggcacacacagcaatagcagttgctgcactcgtcgaactgtgagaggtataaaataagttatcatttttttaatctaatgaaattccttgtcctactaattaacgtgttcttcaatcgatctccacactagttagtttcctgtaaattgtactaataataagcatctctctgtctgtaacatcccggttttcctctttttttttagtttgtacgggtcttttaaaatttgaattggtgtttattttcttagtttaacttaatcgagatatttaaacaagattagatttattgcgactaattaattataaagccataattgctcggccatttgttttttttttctcaattttgacgaaaaatgtcttactttcatgcatatctaaagactttttaggcttgctctctacacttttcgaaccatgtttcagagttccaaatttattccaagaatttattggcaaatatccgcattgtcctttttgacccttcttcttccccttctccttttctattttcttcccaattcttcgcaacttgtaacctcccttcctgatccggactcttctcctctactccaaagacccgaaacactgttgtcaccggtttgtttccagaattgttagccgttgaatcatcgcccctccacctcttctaccctcttcaaatctgttgggccaatcaagcgccaccattattcatctacgacgctaattaaggtgttcttttttttttctggattagaattttttttttgttcttggcgctaattaaggtcttaagtctaatcttaattaacattattattatttcgtgaacgttgtaattaagtttttggatctgcgtgaggtttgtaaaccgcagagctcccgccgttcttgttcatattatagggtcttcaaaattgttgtcttagcgttatagccaatgtggataatgtgcatattcttgtctatatggattgcagga

SEQ ID NO: 39876 - DNA, 1501 bp, Oryza sativa
tttagaattgaaatagtatttctgatctttaatacagctcctgtgatttgtttcagaccatcttgtgcaacaaggttcaagatatgattgaaacatctcacatgaaagaagatgccatcgcaaattaaaggagagattttacggagttttaaaataacacccttaacacaaacatcattagacgatgcattgtccaaagtaagtccaacaagccttctatcaagattccaatcaactatgttgtcataaaactctttgcacatattacttcctgaatgatgtccttctacatgcataaacttaatgatcctcttttgcatgttccaagtgtcctctatccaatgaactgtgatgcacatataacttttattttggttagatgtccacatgtccatggttgtgctaaaacggcatgagagtgtaagcaaatgctgccacaatttcttcttttcctcttcatatatgtttagaatatcctttctcacagtaatgcgactcttaattggaaaagtagggcgtaaagacttaataaaatccacaaagtaatcatgctcaacaatgttaaagggatactcatgcatgatgattgccatatagaactttttcaggctaaccgtctcatcatacctgtatgtctcaacagctcctgtatgtctcaacagctctttcagtaccatcttcactctttttcatctgtagttgttgttgacctgacttaatgttgtgcttgttattcaagtgattccagaaaacagaagtgccacaattactctcacaccgacgtttatatgagcacttgttgcatttagcatactcctctacaatcacagtgtcatctgaccctttcttgcttaccttatatttagtgtagtgctgccaaacttcagaactacacttcttttgcttcttaccaggaggaggtaaaacctcagaatcatcattggttgtcaaatcaattgcatcattgtgtgccaaggcaccagcagtaggagaagtgtcctgcgtagctgccgtagcatggcttggaggtgctgggagttgcaaaactggagatgatgcagtggtacttgcagctgcacttgcactacttgcactaccagactccatcaccaatctagacacaaagtaaaaaaaagcacatccaagatctacatcagtttatcgatctcatgaaaggcacaaaacaaaggttacaggagaagaacaaatcaatggattacctaagagattagtgcatgcaagaggccttgccgccggcggtggtaacggctcctagcctcccactgtcccacgatttagggagataggaagcagaaacaagcactagggggattgaaggccaatgcccagcaactccagcaaggagccaaggagatctaagacagccgccgccactgtcgccggcttgccgctgctgtcgtcaccgccgccgccgccgtcgcccatctggcagctagggtttagatagccgagagaaaactatgtgctgaaattgaaggga

SEQ ID NO: 39877 - DNA, 1501 bp, Oryza sativa
tgtggaaaatggaataaaagtctcggattaaagaagcaattgccgtttcagacgagggtggcagccatataatttgcttgcgccaaaaccaaacatagagcagcaatagagaggaggagagggagatgatggcccatctccttctcctccatccacctgccagctcgaagatttctgtctgaatcgatcggatcaagatcaaatcaaggagggaggaggttgagcaattcctgacagggacagatcgggaaagctctcacagctttttctttgtttttgtttgatttgttcctgcttttcgattggaaaattgggaggggaggaaggtgatagccattgaggtggtggcatttgctgtcaccacctttagctatcgccttcctcttcctcgtctcgctcgccccccggtctagcttctttctgcaggtattcaatcgatcgagcaatcagttattttcgtttttgttcttgttttttcttttttatcatggaagctctctgttcatctgattttggtagtgaatctttaatttgtttgtatggcacgattcacccataaatcaatcgataattttgatacgattcagagagtgattgatttactgcactggtttcatccagggaagaggggaataaaattactctttttgcaaaaaaaaaatctgaaaatagggaaaataatccagcaaaatcgcatgtaattttgatgtttgttcatcgtttcaaactatacgtattaggagaaaccaatctctactgctcctggctgattttgtgatgaaaaatggccagtttcctctaaaacaatgaccaaatttgacaccctcttgttcttgaagggccggacggaaaaaacaaaacaaaagaaggcaccagccagccatggcgatggtgctggactccttcgtcacccggtgcacggcgtcgctggaggacttcgccgggcaggaggcgtgcggcgccctcggcatcggggacgacgtgcggtgcctcctggccacgctccggcgcgtccaggccgtcgtctcccacgaggagcgccgcggcagggtgctgagcgccaaggtggacgcctgggtggcgcaggtgaaggacgcgatgtacgagaccgacgacgtcctcgacgtctccatggtcgagggcggcaagatgctcgccgagggggacagcccgccgacgcccaaggcgcgctgctccctcatgttctcctgcttcaagcctgcatccgcccccaagttccaccacgagatcggcttcaccttcagggagatcgacgccaagctgagggagatcgaggaggaaatgcccaggctccccgcaggatctttgcactctgaatcaagaagggattggttcagtagaggcatctgcagtaacttctctgacgccattaggccactcgcggttgggacacaggttcagaaatctctggatggccttgtgcctaggatgattagagagggcaagaagaaggtggatgtcttggccatcgtcggcgcag

SEQ ID NO: 39878 - DNA, 1501 bp, Oryza sativa
gatcgattaattgtaaagatgcatcgttcacaagtgaaacaaaattaattagtattgtagtaatcatttttggcaaagcatttgtacatacagcacggagtggctttctaggggcctttcctcccgtggatttccgagctgtctgcttagtacgagccatcctgcaatccatatagacaagaatatgcacattatccacattggctataacgctaagacaacaattttgaagaccctataatatgaacaagaacggcgggagctctgcggtttacaaacctcacgcagatccaaaaacttaattacaacgttcacgaaataataataatgttaattaagattagacttaagaccttaattagcgccaagaacaaaaaaaaaattctaatccagaaaaaaaaaagaacaccttaattagcgtcgtagatgaataatggtggcgcttgattggcccaacagatttgaagagggtagaagaggtggaggggcgatgattcaacggctaacaattctggaaacaaaccggtgacaacagtgtttcgggtctttggagtagaggagaagagtccggatcaggaagggaggttacaagttgcgaagaattgggaagaaaatagaaaaggagaaggggaagaagaagggtcaaaaaggacaatgcggatatttgccaataaattcttggaataaatttggaactctgaaacatggttcgaaaagtgtagagagcaagcctaaaaagtctttagatatgcatgaaagtaagacatttttcgtcaaaattgagaaaaaaaaaacaaatggccgagcaattatggctttataattaattagtcgcaataaatctaatcttgtttaaatatctcgattaagttaaactaagaaaataaacaccaattcaaattttaaaagacccgtacaaactaaaaaaaaagaggaaaaccgggatgttacagacagagagatgcttattattagtacaatttacaggaaactaactagtgtggagatcgattgaagaacacgttaattagtaggacaaggaatttcattagattaaaaaaatgataacttattttatacctctcacagttcgacgagtgcagcaactgctattgctgtgtgtgcctccgaaaatccccctcaggtatgttttggtgtgcagatctgaccggagaagagggctaatttataggcgatcgggcgggctaatttaccgttccataaaccgacttattaattagtttttatttaaccagagctcgattgattaccgttgcatttaattaatcgacggctgatatggtttgtttacgtggtggcacggatcggtgtcgatgcacgccgcactgctattggctggcgctactaacacaaggatttcctggttcctgcgaatttatgatggtaatcctcctttggataaaaattgtttcctttcactgtagatcatcaagacaaatcatgccatatatatctatatctatatctatatctatatcta

SEQ ID NO: 39879 - DNA, 1501 bp, Oryza sativa
ccattactgttgtttggattatcttggagaaagtttttcttagttcaattggctttatgtctgaatggatggttttgttgtatatattttatcttttctggcaatgtactgcggatgatatttcccttcagctctgtctgtagtactcttaattataaatcaattaatgtgtttgcaaaaaaaaaaaaaaaaagctgaagcgagaacaggtcacaacgacagaaagcttgagcaggcaatgaggcatgagcagagtaaagctttgcagtttttactgcatgaactcagcactaactttagttttgtagtagtatttagattacttgcatattacctatacgttgggatgagattttaattaaaaaattattatatagcccattgttatcattattttctatgtatatagcataccttgatttcagcatatatttgttaatgtctcgcattatttttttttcttctcacaaagttgggagttggtggtggaagtagttgatatgtggatccatgtcattttaacttcttttttttaagaaaaataaggagttggtagtggggactaatatagatatgtaaagattttcaacggtctatgttcataaaattgaagtactaaaaggattagaaaataaaattaccaaaattaattattccatgagtgccatcgctctgagataaatacaggtattggttttttttttttgcttattttgtgagcaacttctctattatttgctcatggtcgatttaatgcatccaaagtggttgccagccagcctgtcactagcaggctcctagtcagcatggcttcaggcaggcctaccagatttgctatttaaacactagcataatctccgtgatttgcaacggtttttttctcaaatatattatcattataataaatttatcattattttgtaaagatgaaaacttttataatattctattaccaaattttatttttgatggggtctataacatgtggggctaagaaatcaacaaagttttatacgatagttcgtcgttcccgcatggctcaccaccgtcaccaggtatgcaagactaggagcataagagattaaggagtaattaaagctggttgacaatgttgccatcccatcatcattaagtcgtgacatattctaaatatagttgaaactaactcatgttaatagtacatccatctcaaaataagtttttttccatccatcccacatactccctccgtactcgtaaaaaaagtcatttaaaacagcgacacgatctctaaaacacaactttgatttcttatttctataaaaatatttattgaaaagtgatacatgtatacttttatgaaagtacttttcaagacaaatctattaatataatttttatattttcaaactcaacaacttaagagttattattgatttatattcctaaggtttgacttaaacattgtctaaaataacttcctttataagtacggaggaagtataccaatactcatacttta

SEQ ID NO: 39880 - DNA, 1501 bp, Oryza sativa
taaatcaaaggttacgagagaagcataatgctttgccagtttgtttcctggccggtgtgtactgcaaaacattcatgaactatcccatgcttttgctctcaagaaacatgcaggattgcaggttacctagaacatgagaatattcagttgcctttgccaattttttttaattgtggatgacatgatactgtgggagtagtagaacgacctgctgtatgtaaaggatgcaactttggaaacttatgtaacagatcaacaacaccagaagttcagttgtgagcagaaattcagatccatggttatgcaaaaaaaaaaaagttacatatgacaactgtcaaagatgcagaataattctatccaaactgtcacagctcacaagctgccttgggggagcactattaacctgctccaagcctccaactgcatatttgaattcagtgtgaactatgaaatggcaatcatgcagataactatatttcatcagtgttgttacccataccctgagactaggagaggaaaaaagagcacaccttcatacaaaagatataatcaacggtggaaaatgaggccaaatgaattgttcaaatactttgttgttggaatcaaaccaaacaacagtcataccatatagtattattagttagtgaactatatgcaacaagtaactctaccgaacatgttcaggtttctgcatattgagcaccagagacgcaaattggcatgcctgcatccaagcccaacaatccaaatgctcatgacacaacaaacataaaagagtacatgcttagtcagcgccagcaatcataatgttaatattataccatattccatttcctaagctcaaatacagatgtcaagaatatttcggtgaactgaacatcgcatcctaacgcatttcacttgtattacttgagcttaagtctaagaatcagtaacatcgtttgcacatctcaaattactaactgggaactcctcttaaaaacagagagatattgaagggggtaaaccctttctacaactctacagcaatatcacctagtgagagagaacagatcaacagcaatgccctgcgcctggaatgcattagcagtttagcactagcccgactactaatgaactccatacatacagcaaaaaccaaataaatagccgctgttattatagtaaagaaataaacttattgcagttcatatgatcaaaggctcaaagcaaacaggcaattagtaggtctttgatgctttccattgtcaatattgcttctttctattcatttcctttctttcccctttttcggtagaacattaagacaaacaatgacagggacgatcacaagtgactctttaatcgcttttcattctaaccatatttggttaaataaacatcaacttaggtatgtgactatatgaaatatcaattaatggactctttcaaaaccaagggacacatcaagacacaaatcattgcaatttatgctgctgagaattccataagatagtagttg

SEQ ID NO: 39881 - DNA, 1501 bp, Oryza sativa
aattcaagtctcttgtaaccagattctgaaataaaaccgtttcaccttgtatcatggctatggcctaaaatatttctggtttcctccaaactgggtaatacggggaaactattttaaactctcgaggggatgtctccttgttgtttgtatgttactcaaatggttatgaaaaaatttgagaaaatatattaatatgtgatatatcacttcacaaacatacaaagtcaaatttaacttctacatatcgtaacgaaaaaataaatttgactatgaatatactttaattatctgtagtttgtttttttacaacttataaaagttgatttaacttgcatgtttgtggagtaatatatcacatgttaatacatcttctcaaaaaaatttcataaccatttgagtgacatgtaaacaacgatgggtcattcactcgagagttcaaaatccactctccgacgatatattactgtattgcttaaattggtactaattggtaggtagactggtaaggcatgatttttttcccttaatataggtagaaagtttatatagattctttcagcaagacataacgataatcttctccaacacaaacacaagcaaattgagagggaccaactatgcaagtgtggacacttcgggctcagtgctagtgcatcatcgaaagactcggcttcctgccgctacagtatgcgcattacgcatggttgaaggcattgtctagaattcgaagaatttggtctctagtatgaaaacctatgatttgggttttgttgatcggatcatggcaatgacaatgcaatttttattttggaggtgttgtttttaaggttttctaagtgatgcgtgtatagagtataaagcttgtggttgtagctcactatggcatgatatttgttatcatgtcgttcttctttctaaaaaataattataggttgtggacaacctactatgctggtgccaagagtgatcttagattaattgtatcactttattataattgtttacatccatcaagaaagtttcctttatcttaaaaaaataaaacctctaaatttacttccaaggacacctaaatagtactcacttttggtggaaaaaatatcgtttcaacatcgatatagtcttcaattgaagcttttttttcataaaagataactaaatatccaacaaatcaaaatatatgatttttcatacatgcaattcatatgttaaaaatattgtgacttaaaatatgttcaaacaatgtgtttttgtcctaagaggggttagttttcaagcgggggctgctatataacggaatctcgttttcgaacgggatgataccggttaggtatcaggtcttgatacataacctgtatcatgcgtttctatcacatacgtatcaggtgatacttgagaagtatcagatgatatctatcatgtatcatgcgattcttatcacatagagggtgatacttacgaggtatcatgtcctaatacctaaccggtatcaggtgatacc

SEQ ID NO: 39882 - DNA, 1501 bp, Oryza sativa
cgtaccgggtgtacggttttcccactcccgcacttaaggaccgattccttggaatttcatccgaacaaaagacaagtacgaccacatgggtggaatgggacacccctggctgagtaactagcttatcaggggagccatgatgccgagagacatgtggattcgccggggtggtgtcggagaggaccccccctgggcttcctagcacagtatggtctggaacctaacctgttgttggtctgggacccctctcgtcggcatatggtaagcctgtgtcggctttggaaatgccttgtcatgaaagcttggaggtctcccgacgtggctgatccccacgggctgggtgatccgggttagtaatgtcgtgtgggtaaagtgtaccccctctgcagagattaacaaactgttcgaacagccgtgcccacggtcatgggcggatgtgaggtgattcctagcgtagttttgtttgacaactgcttgtgaaattactgttgtgaaaaggggttcgatgtttgaaaaatcagcagctgacgggatcagctaggcccgggtggccgtttgaaaagttgttggcccgggtggccgtttgaaaagctgttggccgggtgccaaccttgttttaagatctaaagattgatacattgcacatactccgaccggacgggacgcactgtctcaaccgtgtcgtttgagaagcactcacctagatgtttttagaaaagagttcaaataaaatcaattacgaaaacaacagcctttccttgaagcctgcattaaacacttatttcccatggcttgctgagtactcccgtactcacccttgctctatataaatattccccccctagttgctgatgaagatgaagcggatcctgctgatgaggagttcttccaggagcaagccggttacgatgagttttagggtttcggcctagttcccaagtcgcgcctgtgttgtttggtccaagtcccggcttccgtttcccttttctaatgcagttgtgagctcgggatctgtccgcagcccaacatgactgtactcctactctataataaagagacctctgttgctgtgatattctatcttcctgtgataccagcactgtttcctgggactggtatcgattaacaggttaatttggagcgtcacgggctaattccagtcgggactagctcggggcgtgacaagagatggtatcagagcacaggcttggccctagggcgaaacccgacgcttaggacgaccctaaggatactaagttcaaaactacttgcgaaaagctaaggtctcttttgttttctttattttcaatagtttgtttctaaaatggttactgatccttctccctctttcaaaattgtagatggcagtgaacgccagcttcagttcccacggttttggtgagggtcaccacgtcgctcagcttcgtgacctcacccgtttccttggcttctcgtgtcccgagtacacggggtactccgtggaccgtgttccccctcactg

SEQ ID NO: 39883 - DNA, 1501 bp, Oryza sativa
gcaagccatgggaaataagtgtttaatgcaggcttcaaggaaaggctgttgttttcgtaattgattttatttgaactcttttctaaaaacatctaggtgagtgcttctcaaacgacacggttgagacagtgcgtcccgtccggtcggagtatgtgcaatgtatcaatctttagatcttaaaacaaggttggcacccggccaacagcttttcaaacggccacccgggccaacaacttttcaaacggccacccgggcctagctgatcccgtcagctgctgatttttcaaacatcgaaccccttttcacaacagtaatttcacaagcagttgtcaaacaaaactacgctaggaatcacctcacatccgcccatgaccgtgggcacggctgttcgaacagtttgttaatctctgcagagggggtacactttacccacacgacattactaacccggatcacccagcccgtggggatcagccacgtcgggagacctccaagctttcatgacaaggcatttccaaagccgacacaggcttaccatatgccgacgagaggggtcccagaccaacaacaggttaggttccagaccatactgtgctaggaagcccagggggggtcctctccgacaccaccccggcgaatccacatgtctctcggcatcatggctcccctgataagctagttactcagccaggggtgtcccattccacccatgtggtcgtacttgtcttttgttcggatgaaattccaaggaatcggtccttaagtgcgggagtgggaaaaccgtacacccggtacgttccccggtccgcggttttataaattcatttagttcgcaagcaccgacccaggtgtcgggttttccaagtcttttgtaaaacccaagttttacccaagttgtttttcagattttaagtttgaaggcgaccgtcgatactcgcacagagtgcacgaatatcgaggcgcaactgggtggttacaaggggacatggtataacaattaacaaaggaaggatcaaatgcaacaaattaggcaggtccgccaatctgccttgcagacgggacaacagattaagtgcgatcctatcaatgcataatattttgcaagcaatataattaaatttcaaatataggctcaagatgttcaaaggtggcttgccttgctcgagatctggagcttaatcctcgaaatcctcgcactgcgggtctacgggctccgaaactacacgcgaaacgggacaactcaacaaacggcgaaaataaagccttattaatgacctctaagcgtgccattaggtagaactcgagatttggggaattttggaagttgaacggagtcaaacggatttacggtggggaagatattgaatttctaagattattggatttttagtctaaaggaaaaggatttaattaaatcctttttggaaaggataaagagaagaaaaagggagagggagggaatatagacttccctcggacggctagggcgcggcccgagaga

SEQ ID NO: 39884 - DNA, 1501 bp, Oryza sativa
ccatcattagcaagactggagaatcaaccaagcaaaagaagactgagtaaccggtgtttttgctacattgggtgagcttctaagacggtttgaatcttttttactagttcatggtatactctaaatccaacaaaccactaatagcttttgtgtttcacatatttagtatgctacacatttcgttaacatgatagcatggacaacatttttgtttaactcttgcaatctcaagtttacataatgttgcaatagttcaaaaaacctttaagatgctataacggcaatgccagtggatctttgttactcgaaaagtcccacaaaaacctaagggctaagggcagcaaagatgagataaattctcgttgaacaaatggatagagttacttctcaccgtattctgtatttctgttgtatttttctaaggcaaaaatggtctttcttagaaaggcgaggcagtgatgtcctccctttgttaataaaaagagaaaccaccagcccaggaatggcattcaaggcactctaaatacaaccaagtaatcactttcagaagtttgtttttctggagttgaactgttaccacacatgaaatttacaaatgttctgagaccatcttctgttgttcctgagaaatgatacttctctataatgatcatcttttgtcttatcaggaacctcttttgtcatatgtggttggtcatgaacctcgtcagttactctccatacctgtgaaccaccactggaaatattcttggatatcgaagatgtcatgtttgactgctgatgtagtttacatgcactctgttcaatttgagaaatggaatgctttgtatattttttcaagtaacatgacacatgctgaggtttatcatgggcacatatcttgtggataatgatatatacttttcccctgaaatcattttctgtagccggcatatacaaatatgttggttgctggtgcactaaaccgtttttttagtgttcttgattctcattgttaaatagttccctaataaactttagtgagctcattcgatgccaaactgcacacatgcatacctgaatctttggtaatcgtctagggccagccatttttctctactacttatgaaccgttgtgttcagtttttactattctggtgtattaatttgctgcaaaacttatgtatcatgtaagtattttgtgttggtgtaaaatcgctatgctagaaattaagaaaaattaacaagacaagtcagagcaaccacatgcatatttggaaattctgtgcagttcattgtagaaacaaattatgcatgagccagccttgataacatattttcaaacttaagttgtctgctcaggctccagtatgcaacacctctctttagaggggctaaggccattacgggcaccagtggacaaattggcttaggcatatccgaaaggggacgcctattggcaattcaatatgtgtgagcattatggtacaagactaccagtgcagagcctttttgggacact

SEQ ID NO: 39885 - DNA, 1501 bp, Oryza sativa
ttccacgaactatgtgagttggtatgggctgtgtttggatccaaacttcaatcattttccatcacatccacctccacctgttatacacacgtaacttttcagtcacatcatcttcaatttcagccaaaatccaaactttgcgctgaactaaacacagccaaggtagcatcggaccgattactcggttggcgttggaacgggtactcatgttccacgctgttgttttcaacaaataggaagaatatgtccatgtttggacccataattcggcttgatttaaacatgtcgtcgtcaaatgctagcatccactaatctgttggtttggatacttgttttcttcgaaatgacatcgtatctaaacaaagcagcatgaaagtgccagtcctccaaattgaacggcatgaaactagtagcttgcatgaccaaacgtatttatggccatgatatatttaagagaaaaaaatcattctaaacagtatatatttactgaatgtactagaaggtccaagcacataattactccatcaattttaaaatataaggattgttacaataaataatttatttttttcacttcagttgttagcatttgaatttcgaattacttgtatttcttttgggaaattttgtaaaaatacactcgttatgatcaaaattacacaaaactacaaggattttgacacatagcacatgacccataggtactatggatataaagttccacaaaaccacattgtaaccaatttgacatactcatatatcaaatttttaaaaggccatggatgtaacatttatatgatggataaataactcataaattcgagatgcgattgtataacttaaaattatggtaattcaaagttagaatgataaatattgtgttttttgaaatgaccataatacatatgtttatgtgctaaaaaatcgtatgtttttttaatttactcaatttgttctaaaatttagtactagataggacacatcatagtactataaatctcgacagaaattcgttgggtattatatgctctatgttcaaattcgtagtactataatgtatcccatctagttataggttattattatttgtgattaagaggtagatcataatacgggtggttaaatgaaatttacttattctctctttccaagcatttgattagctttaaaattattgaaatgatgggaatcacaaaaatcagtgaaaaataagaatattatggtgtaaaatttaaatcttaaaagtatagaaatggaaggagttattccaacaccatcgggcatcacttgcccgcaaaattgcaataactcaccataatatttcaaaataattcgacggaattcattcgctcgcgccgtctccgaaaccgaatccatttcctgatccagcaaaggacacagagagagatcccatctcgtcctcgtcgcctccgcctcgtgagctccactcacctaccccacttcctctcctcgcttcggccgcggccccaaaccctaaccc

SEQ ID NO: 39886 - DNA, 1501 bp, Oryza sativa
gagatattctgaatttagttttccattggtcatctggacattttggtccactgccactgtaccaatgtgccattaccacgtgagccaagaaacagaggtctccaagaaccctagctttggtgttggtagtggggcacccccctcttttcctgcccaattccaccctattttaatccccgtgtcggcgtgatctttctgcccctgcgggtgtagtatggccaccatggcggcatatggccccctttcacacgcacatcctcctctcctttatttatgaaaggggggttgggttagctgggaagaggaaggaagccgctgctgacatgtgacaccgtgtttggcatcacaccacttcactccactggctcagtggctgcctcactcactcaccaattcaccattgctagtgcaagagctcgcataaataggcagagctgctgctcctctcctctccctctcagcctctggaggaggaagagaagaggaggggtctctgcttcatctttcttcctgagctggcttctttactacaggtccgtagttttttcagcttggtttcttgctcgtattgtttcttggattggagtggtgtcggtgtgtgtggatccattggggaatggaggtgctagctaccgctgggtggtgtggcattcatgtgggttgcccctgccatttctgtgagattttctggatctctgtggcctgtggtgcttagctgccaccatcttgctgcttccgctttgccttttgcctagaatatttatcttctttagcctctttgccctttatcctagtagcaactttctttgccttcagctggaagcataaatcttgcttgtactgattttggtgaagcataagccttcagcaagaagcatgagcctatgcttctgtgtagtttcctcctcttgagtgaagcatagtgttttttttttcttcctaagaatcatttcatgatctacagttattagtggtattttgcgtcccctcctgctttcttgaatgctatctgttcgtctgttttcatagtcttgaattgtttcaactgctgcagcttaataaatttaagacaaacagtcaggtgtatgtttcctggtgttgtcagtagtcagattaaacaattttgctcggtagatcccagagttttacaatgatctgttgtatttgactccatattcaaatttgtaatccgaaatttattgccatgtgatcttcactagtagtactaaggttggtgccacaattagtgtgctgcagtacatgccatggggaatttttaagatagtgttaaatttgtaccatactccagtaatacaactccaattcatccattaggcaactttagagccttgcatatcaattcagcttttcgttttcagctcagatcaggcaattgtagctcaagttcttcaatttcatgcctttttctgcatccaacaaagcttagatttcagctaaattaagctcctagctgacgagttcttgaaacttgcagcagcca

SEQ ID NO: 39887 - DNA, 1492 bp, Oryza sativa
atcaaaagtccgggtcttcgcataatgacaaccattagcttttttactttgccaccgtaataaaaaccctcaattaggaagccgaggctttgcgttgaagtggaaatgaagatgaaagatgcaactattccactcagaaatattccctcgttttttaatagataatgttgttgatttttaaacacatgctcggctatttattttattaaaaaaatatgcaaatgtataagatataagtcatgtttaaaacattttaaataataaaataactcgcaacaaaataaattataattatgtaatgtttttaataaaataaattatcagacatgtgataaaaaaagttaacgggctcatcaattagaaacggaggtactagtatttaaaaaagaaaagacgaactgacattagggcattaggcttaatcaagtggagtacatgcatctatatgcgccgaaagcctgggagcagaacaaagctgctttccaacgacgtttcctctgttgctgtcacactggaatatcattctacttatcaactgtgctctgctaaaattgcttctagaagagtaggaaaagttgcttaactgtactttagttgccatgctttgcataaagtttatagtatgggttatctattttgataattaaaattagcaaaatgagtactatctggtctaagaaatacgatatttttaaaaaaggaaaaatatttttagagacatgatcaaataatccgtggcaataatacaatgagctattccccttattttaaatttagctgtctaagtcaatcatgtctatattaatttgaccatcattttttaaaaatacatatagttttaaaaaatataaattatataatttcttaggtgattaaaacataaatcttactatcaccttccccaaatgtttggcgttggttagttaagttttgaacaaaccaatgtcaaataaaaaaaaagaaagagtatgatgctaaactatataagtttttacaaatcgatgatcaaatattaaaatatttgacttagagaaaaactgaaaacacaagtaatttaaaaagagtagctaaggacatccacaatgtagtaaaaaactacagcaagcattaaatattctcttgttacctagcaacaagtattgtgagagtgatgaataactactacttggttatatggctactaccgacaacaagtaataaaatgttatttgtacagtgttgatgagtattaatgaattcttttcttggaagagtcacgacagctgaggattggtgagtttttatggtgggctcatgttataccctaccatcaaacaaaaacaatgtggagttcatctcctactactagggtttaatatttcggaccgaaatttcggtcatatcggaccccccccttacgatatcattttgacagaaattttaaatatttaattttttatgaatgttagcaatatttgttcaaatttaactaaattttgtttaaaattttaga

SEQ ID NO: 39888 - DNA, 1501 bp, Oryza sativa
tttaccttcagaatgcagagatcctagatcctccctgtgacctcagcaattgcgctctgccgacctcacagccaaattgtgaatttctatcattaatctgggcagctttgcccggccatgatggtggttgtttgcagtagaagcaggggggtaaaaaacccaaaaaagcgcaactttttagctattccctttttttatctcctcacaccaacttcctgacgcttttaccctttggctgccttgcaaaatctgcatgcttggagtggacaggatttggtcaatggcgaaacgacaacgcacacagtggttttttttggagagagattgtcggccctccatttgcttccctgcattttcatcgtttttcagctttttcttttgaacttaaaaatgaatcttgacagtggatggaaaaaaggatgcttgtttcatgatgcagtatgatgcaggaggtgatggagtagtgtcggtgcaatgaaatgcatggaccacaagcaacataatacggaatctctatgcctttgtcacacttgttctgcatgatgatattttgcatttgatttttttttaggataaagagatatttctgcaagtgattttactaccaaatactaacagtttctagttcatgtctccgctataccaacagtttcattacagaagattaaattaaagttaaaaactaaaaaagacgtgaacattaaggaagaacttaatatcaaataataagaaaggggtgagacttcgaacccagttcgtctaacctaccacattgtggagctagccggaagacccctgggtgtttcttaattaaagttaaaaactatgccaaacacatcagtttttttacggatttgagaggatttttaagaaataattgaaaggggtcaaggaatttacgatcatccagatatggcttgaaaatattgagaagaaaagactacttcgtactatatgatgatcttgcagctggaccaaaagcatttgtggacgatacaaatttttggatcaaaaggacaacgaaacaaacaaaaaataatagtaaaacagaagatttgcacgcaaccggaagaatctcaacaaaaggaatgacatcttcctcctttctaccgaatcccgcatcgaggtacctagggtttcatcaaatccatcaactagaccctctccctccccttcgtgcgatcgccacaaagaaaaaacgcaagcgaaattgctagtgattccagccatggatccactcacctcgaggatcaaagtagagctcgaagtcaatccgcgcaaccagggaggggggagagagagagagagagagactcgcctccgatgatctcccagttcgttgcaactcgaacgcttttgaattttggagaagcagatgagaagagaaaagctcggtgccgccattaatgggctctccgtacaaaaagaaatccaaatccgaattctccaagcccattaggcccagtagtagtaagcccacgaagcgagggcttctcgcggc

SEQ ID NO: 39889 - DNA, 1501 bp, Oryza sativa
aaaaatcacctcacttgtatcaacatctcaggtgattaaaattgtgcatcgatccttgtttagatgggagggactaatttcactaaaatacaagcctatatagtagtgactaaaatttatgtgagagggattaaaattagtatggacttatatttctgtgagagggattagtcctcccatccaaacaaggccttaggaatagggcacatagggataggtgacaattagcatatactccaatgtataatcacatcttaactattttctgcatccttcaactgagccttccaaacctattgaagtggcctacttgggggcaaatcctcatttcagtttgatttttacccagcctttgccttgacaaacacacatgtctcaaatagtgtgcatcacataattgtactttaatcctctcttcactgtactaatttcatatagtacataagcaccaactaaactaaaccatcgatttaaggactctctaggaatctatttaggaaaacataagattatgagaaccaacgggttggtagccagattttaagaatctgaaacaaaaaatctgacttctagttcatataactaacaacttctttgaatctgaataaaaagggcctctttgatgcgcaggatagaaaaaacacaggaattaaagtagtaggtttctcaaatcctacaggaatcagcaaacacaagaaaggcaatataagtcctttgatagtgttctgtgaaaaacaaaggaaagttcacaaagaggtcacaccgcttgctaaatgtgaagaatagaaatacaatcctatgaaaaattttctttctttcctatgaatcaaagggacatataggaaaaaatccataggaatttaaatcctatgaaaatccttcgccaatcctataaatcaaagggagccttagattctcagagaacctgcagttgtcagaaactacacgaaacagaccttaagaacaaagtacaagtcagcttgtatctgcccaaaggatggtcgaatcccatattgtggaatactccctccttcccaaattaatcatcatatcgtgaaacctaaatttttttaaattgatcatcatataaccgcatgagaatgtggcatgctaaagagtgtaattgtgcattattttttaatcgactacaattaatgtttaattgatgcgatttaaattatccctgatcttggtacataaatattataggacaattaatttgggatggagggaatacttaggatttgaactttcagtccaccacaaactcaaaatgttggccttacctccaactccaattcctccgctctgcagaatttcagaagaaaaaaaaatgtcttcatccggcacttcacatgtcaacagtgtcggtaggtgattaaaaaaaaacttagatttcacttcagaaaatccaacttatcaattatgcataaagccccatatgccatccaggcattggactcggaatcatccctctgcagccagagatgggattcagctg

SEQ ID NO: 39890 - DNA, 395 bp, Oryza sativa
taatagtaaaccacctcaatagtatgtctacataggtatctatagctctctcatgcattgcttcgtttttctctatagactatctctaagctagtagatagctttgctctctctcttcatttaatatcttccaagtagaaaaatatgctgacatggatctcttgtagatagcttatagataaccattgtgggtgccctaaagtttaagtccctaaatccaaataccacccgacaaagcccacctcacgggcacccctaaacagaagtaaataatttcaaaatagtccctcaagccgtcgccttcctcacgctctctcccactccgccactgctccagctccccctccccgcaaggcggcggagatcccaaggtcgtcgggggatggcggcggtgg

SEQ ID NO: 39891 - DNA, 1501 bp, Oryza sativa
gaaatgacaaggggaatcgttcaatcgatcccccattttagcaagttgatagagtcagaacctgcaagctgcaaccactcgcttctcggtaagctggttactgatcaccttttttttgtctcttatgcagcatgtgtatgtttatgtccaagttgatggacaatggacactcaactggtcatcatcagttcacccaacaagtgtgcaccgtctgctcgataaaattctgggtgaaaccaggggctcacatgcatgtgaaactggcaggagtagtacccactagtacatgctggagcagtagaacagccgttggccacgtgtactgtggtctatggtccacaagccatgcacaagagttaaaccgttgcttttctttttctcgcgcgcgttcaccgcgaaaagagcccgtacgaccgggagaatccttcaccaacttgcaagcatcaagcatcgccaattcgccatgcgtgggcgtgggcgtgggccagggccggtcggtcgcgtgtgatcgtcacttaatcgtggccgttcaaacccgacgttgcacgcggatctcgagatcaactttttgttgactccgtaagcgagggacgcctccaagtccaacggactaaattttccgtccaaggacggtgattcatcattttttttctctaacatattgatgtccacttcttttgcgagttaggccttattcgacatcaagatgcgcacaagcagattaaaaaaatcacatccacacttggggcatggatcgaacccacgatctcacggtgcatatgttaaccaactaagcaacaacgtgattctgagcgtttttgtgccagttacattgtaactatagtctagttacaatgtaactacgttgtaattatagtggagttacatttgaaagtttttcatctaaaaagttatcgacagttatatagctaatctcttccaaaaacatcacatcaaatttttggacacttgcatggagcattaaatatagataaaaagaactaattgcacagtttgcatggaaatcacgagacaaatctttggagcttaattagtctatgattagccataaagtgttacagtaactcatatgtactaatgatagattaattaggcttaataaattcatctcgcagtttccaggcgagttattttttatttgtgttcgaaaaccccttccatcatcagtcaaacatccgatgtgacacccacgaactaaacacaccagattcaccagattttttgttcactctctttttggccacgaaatacggggaatattactacactacgtacattttgaggcgctcatcatgcaggaaagaacaccggtaaattctgaaaacaacatattcaaatggatattgtttttgtaatactaatcaactaatatcagaaagcgttggttccatggcatgtgtagacatatggactgatggacatacgcatgttttcttccttgaggagaagctagctagccaggagaagaaatggaatagtc

SEQ ID NO: 39892 - DNA, 1501 bp, Oryza sativa
ctttccggtatgtcgtggtggcatgtcggcgcatggaaacatgtcgtggggctgtgtcttgttggtacagttgtacacctctgatcggagtaaaactattcgaatagccgtgcccgcggttatgggcggtcaaccagattcaccgtgattagactcaccctagactagtcttttggaattgaatagtataggtggatggttgggcctgttgcaacgtggtatagcgttggacagtggatgattaatattgattaattattacaactgtttactactttcaacttctggttataaatgaccgctttatgcaaatgaaccattatagctatcccttgataattccctgcatcatacccctattccggtatgacttgctgagtacagtgggtagtactcaatcttgctctattttccccaaaaccccaaagtttaagtatgcgtcagatggtggcttctccgagtaggcttcgtccgtgccgtcgaggatgcctgtggagtggtgttcccgctgcggtgcaagtcaaggcttagctccagttatctttttattttccgctgcatttatgtaagacttttataatgtttgtaagacatggatctgtatgtcaactttgtcgtttgtgtaccccggccggtcctggacggggattttaatgcacattttacttgaaattctattcggaaatttctgggcgtgacactaccaagcataagtcttctcagatagtaaaacagttgaactagacatgaagacatatacacgaatagggcgcgtgttatgggtgcaccctgcgccgcgtgggcctgcttcttcaacaagagacgccgctcccactcgcgctctttcacgactcgccgcttcagcttcctaaaccgagcgggcatgcgacggtggaaaagcttctgcagacctgcctcagcggcctccaactcctcccgccgcgccgagtactgagcccacgttaacaagccgtgctgcttgatccactcctggagcttccgtctcaccttggacatcgccgaaccgagcgcgacgaacttgaaataccgcgtcttcctgatgtacttttggtttcgccgtgaccacacgccgaaccggttgcgcacgacgatgtcgcaagcgtgggcgtgggtccccaatcctgcgtacatgtgccgcttcatcgcaaacgcccgtctccctttgggcaccggtgagcagcggtggacgggctgtactccggctgcttgtttcacctggccgatctccatgcttagattgccctagctggaccggatgcagacgaaattaataacccctctcacttctttcctccttgcgtactcttttgcttatccattgcggatggatagctaattaaccaacgagacaaagttgtagtcagtatgcacatgtagatcaacaccgactatctagatcgatgtaggtgactaaccgctgttaacttcgattcggataatttcacacaaattttgacaatttgaccctttccaaaaacta

SEQ ID NO: 39893 - DNA, 1501 bp, Oryza sativa
gagagccttcccaccttggtggtaagagtcttgaacatatcacgatgttcagctttcacaaataatcttgtagccatgaaatgctccgcacttccttctgctgccccgcaatccaccaccaaatccatcacctccttaatggaattgaacctaaattcaccttgcatcaccttgttggcaatatcacaattggtatccatagtggtttgaatattcctcattatcctaaccatggggttcttaaccttcttgtatggactagtggcggtgctggaagaccctcgcttcactggttttttacccaatgagcaatctactggtgtgtcgccaaggtcctgtacatcaccacttgcatcatcccctccagcattttctccaggtgcacaagcagaagaaccatcaacagcaatagtaccaaacatttcatccagcaattctaaacattctggtggtccatgttgtagcttcttccattcagaatgtccctaaaaataaaacatcaaatcttcaattattgcaagcacttaaaacattttcatgaaaatcatgtacatgagacatgaattattaccttggtgacttttttccagtactcaacaggtgcagcaactgttccttttgcatgatcccatccaagccctgtgtcgttaaggagaccaagccaaaagctgtacatggatttcagcacatcccaccggttcttcagttgtgtcttattgtgtcttagccctgtcttttggaagtactttttggctatgatctggtaccatctagtagtcattatcccgataggcctattgccgtcttcaatttgttgtacgcatagttcacaaaatatcctattgtgtgtgctagaccaatctgctttatcaagctcctccttctatttgataaatcaaacacatcaaggttcagatttacatgttgttttacaccactagtgtttatatattcacaagtatttctatattagaaatggtaaatacatgaccaattagcatagacacatacacattaatttttcatatgtagtacacatacacgttaaattcaattagattcaacctaatccttgcagtagataaatgcattaaaccttaatttttgaagtagagaaatgaagtagacgtaccattccatgaggcgcactgtccattgtttcttctgtgaagtcattgtctacaccagctgctccctcggcgtcgccgacaacagttgcactgctggatggccttggtggcttgtatggcaccttgtttcctcggccaccacgtgcggaaggttgtgtggccgatctcttaccacgtccaggtccaccaccatgcccgccacgccgtccacggcctctgccagggggagacacatctgccaccgcttggaacacagtggcgtcgcggtgcccggcaccggctccatggaagacgggtgatccgccagaactgccggcgccatggggggcaggcgagacatggtggccgtggacgccgggtgagccatgaag

SEQ ID NO: 39894 - DNA, 252 bp, Oryza sativa
cttcatcatatacctcctctgataccaatgctatgaaacttccagcttttttcttgattttcagatagcacaacacacctgtggttgcatgtacatgtaactatacaccatgtagtcccaccttgcataaaatagttttctaggtttaatatacttgatacagggaggtggaatctagtttcttgtatgcataaaatagttttctaggtttaatatactaatccttttattttcccttttcaatgcaacagg

SEQ ID NO: 39895 - DNA, 492 bp, Oryza sativa
tttcaaacgtcaagctcacatttaaattgccgaagatgttaaagtatatatgaatgaaactctaatagatcacctatacatttatcgataaattttctcctaaaaatttaacagatataattatagtacaatcgtgatgtaattacactgctaattacatgtaacttacaaataactttcaaaaatctctccgtaacatgctatttcggtgaagcggaggttgtggaaatgaattctctcacatatatacgcacagtgacttttttcttgttcacttgcataaatcttgaaacaaatctaacagtttaaaatcatatgaaagtttacatacaatttacagtgtaattacactacgattgtactgtaattacatctatcaaatatttaggagaacatttgtcgacaaatatataacaaaattggtacagagatgtttaatattatacagtgtgatccccttcttttactattcaacagaattgataggaccca

SEQ ID NO: 39896 - DNA, 170 bp, Oryza sativa
ttcctgcagccctatgaataatcggtaaaaagataaaagtatcaactttttttttgcagaaacaacaaaaagtagtaccatctagttcgttttgttcatagtctatttatgggcttggttgtcaagtttcatacagggcacatttatataaattttgttttcgttgcagt

SEQ ID NO: 39897 - DNA, 715 bp, Oryza sativa
ttaaaacaaccacaaaggcagtggccgtaaaactcacagattatcccctttggagagtagttccctcaaatttcacagattatccccttcggagagtagttcccacaactttttttttggtcagtgttgttttaatgcagaccatgtaaatactcctagcccccgaatatttgcaaacttaaatcaaggcggggaccgtaaaactcaagagagattatcagagagaggtttttacttctctatcaatatcactataaaagtaagcttttgccttccttcaaaaagaatattacacggaatatagaatattacttaggaataagctaatgagtaatgagaaaggtggggaacggaatatatgaagcgccaatttgagtttgtaattgtagtacaactttaacgaaagtacttacgtttctaattctgtctttaaaccagtacagcgactatttctttcccaaacgcacacaaagattatttcttaccaaacgcacgcaaagattaataatactactaattataactcatttcgtgtgaagttttccttcgaaattaattccgtccgtcgaaggcttcaagcgaaagcaacatgcttgccgaaaaaagacgtattttatcattataaataacgttgaatccacgcgtttgtgatgtggcaattgcgttgtcaaaggctaaacaattagcaaaaaaaaacaaagtacaaattaaatta

SEQ ID NO: 39898 - DNA, 198 bp, Oryza sativa
gacacccgtattcagcttcccccaacactgatttgtttagggcatagcaagattatgcggttgcgcatgctttaatttaatccttattgaacaagtgtacctcaatagcaccaggatattttatttttgaagtcaatcaggagaaagtggtatgaatgattttctatacgagttagtgggtttgtttcagccgcacca

SEQ ID NO: 39899 - DNA, 200 bp, Oryza sativa
tgcaaagagatatgcaacagttttcaaaagttaacagattcgaatgggatgaatacatagtagtaaaaaagaattgacaagagttgcataccataattgttgcaaatttctgcatctactaatgaatttgatgagctcaggacctcgcacagtagcataactcagattaagtgatgtgaggccttcacatacacaataga

SEQ ID NO: 39900 - DNA, 331 bp, Oryza sativa
atatttaggcccaaaagtgtggtgttaaaagaggggtagacgggtatacggttagcttaaattccccaaattcaccagggctcctttgtagagtatttgttatcctacacactagcatgcccatgcttacagtgggcccatgcatctgcaggacgcacatcggtcttcccttgtgccagtcgcaggcacacccgcactagtgtatacagtgtgcaccaagtggtctcgacatataccactaaacatgtaaaacagtgggccgatatcattaaatgatggttattatggagacgagcagcctccaagtagtcagtgagtcattgatcaacta

SEQ ID NO: 39901 - DNA, 1501 bp, Oryza sativa
tgtgcatactgactacaactttgtctcgttggttaattagctatccatccgcaatggataagcaaaagagtacgcaaggaggaaagaagtgagaggggttattaatttcgtctgcatccggtccagctagggcaatctaagcatggagatcggccaggtgaaacaagcagccggagtacagcccgtccaccgctgctcaccggtgcccaaagggagacgggcgtttgcgatgaagcggcacatgtacgcaggattggggacccacgcccacgcttgcgacatcgtcgtgcgcaaccggttcggcgtgtggtcacggcgaaaccaaaagtacatcaggaagacgcggtatttcaagttcgtcgcgctcggttcggcgatgtccaaggtgagacggaagctccaggagtggatcaagcagcacggcttgttaacgtgggctcagtactcggcgcggcgggaggagttggaggccgctgaggcaggtctgcagaagcttttccaccgtcgcatgcccgctcggtttaggaagctgaagcggcgagtcgtgaaagagcgcgagtgggagcggcgtctcttgttgaagaagcaggcccacgcggcgcagggtgcacccataacacgcgccctattcgtgtatatgtcttcatgtctagttcaactgttttactatctgagaagacttatgcttggtagtgtcacgcccagaaatttccgaatagaatttcaagtaaaatgtgcattaaaatccccgtccaggaccggccggggtacacaaacgacaaagttgacatacagatccatgtcttacaaacattataaaagtcttacataaatgcagcggaaaataaaaagataactggagctaagccttgacttgcaccgcagcgggaacaccactccacaggcatcctcgacggcacggacgaagcctactcggagaagccaccatctgacgcatacttaaactttggggttttggggaaaatagagcaagattgagtactacccactgtactcagcaagtcataccggaataggggtatgatgcagggaattatcaagggatagctataatggttcatttgcataaagcggtcatttataaccagaagttgaaagtagtaaacagttgtaataattaatcaatattaatcatccactgtccaacgctataccacgttgcaacaggcccaaccatccacctatactattcaattccaaaagactagtctagggtgagtctaatcacggtgaatctggttgaccgcccataaccgcgggcacggctattcgaatagttttactccgatcagaggtgtacaactgtaccaacaagacacagccccacgacatgtttccatgcgccgacatgccaccacgacataccggaaagaggccgtgacaggacccttcgcataaccccctctaaccaagcacaccacacttcaggtttcacccccactcctcgcaaggcagcgggcagtcccctctcgtgcctagg

SEQ ID NO: 39902 - DNA, 193 bp, Oryza sativa
gaaggctgtagatggatatgggtgggggatggatttgcaaaaactgatgaagtagttttaactggacaccttcatgtggcaccttacattcgcgtgattccaattgatttagcagtattcaaggacctgttcttagagcttggcataaaggagcaacttgaccctgtagattatgctagtattttgaccagaa

SEQ ID NO: 39903 - DNA, 450 bp, Oryza sativa
tgcagctctgtagttactctgtcacattggcaaatggcaaggactaatgctaaatttctagaactatatttacagtaccgctcaagaagatactacaaaaacaaaaacttaatcactttacaaaaaaaaacgtgcgaatcaactgtcaattaattctgacatgaacctaagtcgttttcgcctgcgtgacagaaacagagctaacagctaccaccctgaaactgaagagcaattctgggccgaacactttgcagcctcctccctgtctcctgaatccaagcgcgtccctcccttttccctcctccattacacctcctcaatagtcaatacccccatctccttggattgcattgccttctccgtccgtcgcgttgctccggtgctcgatcggtctccccgcccggccgccagacgacgcgccacatatgaagccccgctcctcgcgcgacg

SEQ ID NO: 39904 - DNA, 197 bp, Oryza sativa
cgccctcgccatccgtggcccaaacctcatcgccacccagtaattaatcaccattattatacactgattaattactgctaaattaactaaagatattgagtatattactatattactcctcctcccctgtattaaatctcgacgatatatacaaattaatttgttgattaatcggaatcgaaattagagctgatgca

SEQ ID NO: 39905 - DNA, 1501 bp, Oryza sativa
ggattcctcgctgcccctcctgggactccacgatgggcgcccgccggtctccgccgcgttgctcccggcggcgccccgacaccgccgccgcaggggggacggattccgccctcaccgagcacgagctccctccaccgcctcccgccgtccgccgcctcccgccatctgccttgctgcgccggcgccctccgtcggcccgatgcctctggctcctctcataatctcccaaatcaagcgtcggggccagaagatcgatccccacgccatcaatctccatcacagcatcctcggagctagcgcagcaccatccaatcccctgcttgacctcacagagagaggaagagaagggagcaaaggtggggggagcgccaggagcccaggagatggaggaaggcgggggagagcgcgagggatgtcatctgcgatgaggagaagcgggtgagggggagggaagacgatgcagcaccggcggcgccgcaaaggcaggggaagagcaatcgagagaagggtggggtacaatggcggctagggtttcggagaagcgaggggatggaggatggggatgttttcttttgcaagaaaaccctcttactttcttgttttagagcgcgccccctatattcggaatttcttctctttcacatataataataccagtatatagaggaccactacgtaagaatataaaatacagagaagtatgaccaggcagttaggaatgattatcaaagaaagtgagggtttttttgcaaaattgccagctctagcacagggtgacgtggatatcaccggaagcgaacacgccagccaaaaaagccccggagcgctgtggtggctctatttcgcggtcccctttaatctctccgatttaatctctccgatggtggaattttaaaacaagagtgataattgagatggtttataaatttttatctccggatagtgatactatgtgtcaatatataaatagttttcagacacgtgaatacaattacgatgacgatgatatccaatcacaggctctacctactaaaaatctgcttaccaaccagtacgaggcgtatatttcatactccctccgtctcataatataagagatttcgagtttttaattgcaacgtttgaccactcgtcttattcaaattttttttacaaatataaaaaatgaaaagttgtgtttaaagtactgtagataataaagtaagtcataaataaaataaataatatttttaaaaaattttgaataagatgagtggtcaaacgttacaagcaaaaaattaaaatctcttatattatgggacggagggagtatatttgcatggtatcagtgacacatagtactagaacaaaaataattgaatccctcgcacagataggcaaaccctgcagtaagttgtatatattcggctgccctggcctccccactacctccccacagatgacagaatagctcatcaaacctaagtttaattaattgccaacattctcatggtcatcaaac

SEQ ID NO: 39906 - DNA, 235 bp, Oryza sativa
agaacagaagaaagtagataatgctgtaatgagcagatctcatggcatggaaggtcaccatctacaatcccaagattcaggttctcagttccctggatgcaccacagattactggaaaacttccaggcctactgaaagtggttggaggttggctatcatggtgtatcagcttttgaagggcgctgtaacacgaaccagcaaagatctgttagttctaaattgcaattaggtgaga

SEQ ID NO: 39907 - DNA, 235 bp, Oryza sativa
ccaaattaaaaattaaaggagagggcaactctgaattcacaagcagaaacagagatagagtttcagacacagatagagagaggaacacaattctggcccctacgaattccagccattttcttacactttcctggagagaaaaaaaaatccaggaaacatcaataacactctcagaacaatttgttctttggcaagatgcagcaagctttttcattttcttctctttttcctcagg

SEQ ID NO: 39908 - DNA, 483 bp, Oryza sativa
agtaatataggctaaatcatccttaggagatcagttgatcttggaagctctctaagagcgcggcgcacatcttcttctcttcatgatgaggtgattcctgtcataaacagcattttctaagaatttttttcttcgaaaacacaggaggataagaaaattaatgataggaaatgcagaatatcctatatactacttgagtttgtcctaaaatatgagtttgctctcatctatgtttagtccttgattcttgttccagcgaaatgtggtatgactgtttgtatggacttttggatccatctgccaaaagtccaaaacagctatctttctccactttaagattaacctttcttatatgcaacactagtgtgattctttgatgcctcctttgcagattaactcactccaagtggaaaccgagggcatgtacgaaaaagtgagatgaaatcacgattttggatttaatttctgctttaatttgttaga

SEQ ID NO: 39909 - DNA, 1501 bp, Oryza sativa
cgttctgattctaagccgttttgcctaaacctaattataagttcgtaacgcttattgttcctagtgactatgctaaaaagtaaactataataaaaacatgaaaatcaacttctaaaatatatattttgattgcgattaagtgtgtttgagagaaaaggattggagaggattaaaatgatgtgtaaaacgagataaatcattagcatacaattaattgagtaataataatttcatacttagaaaatatatattaatttgtatactatttttgcagttaggtaaacgtgctcatgaaaaatgacagattttttatctcgatgtgcttcttcctaacagctatagaactaacacagctatataaagagtaaaatatgaagcaaaaacctacgtgccttgtacacgacagcagcgacaactcggacttgcagaaatgtcggagttcgtcgccatggcgtccgtggcatacatgtaccaaccagttgcagtgcacggctggcttaatggcattggctttgcccgtcacgtacatcgtgtcaagagtcggtagcatcgatctaccgagcgcgcgtccgcgtcgttcgttcgttcctacgtagcgtagcgctacgtaacgtgtcgtccaacacaatccgagtcggactccgattcaccccgcgagagcgagcaaaagccgcctacaaatactccacgaaatccacgagccccctcgtctcctccattgatttttcactgatcagagctcgcgatcgatcgatcgcgagctatggtggcgaggaagaagagcccgccgccgtggaagacgaagggatcgcagcaaccgcgcggcggcggagaagcggcggcggcggcggggagcaagaaggcgaagaagaagaagaaggagacgccgctgccgccgctgctgccgccggggacggcggtggaggtgctccggaacggcgcgtgggtgggcggcggcacggtcaccatccgcaacgaccgcacctacacggtccgcctcgccggcggcatgaccgtgctcgccacgcggaggagggtcaggccggcgccgccgccggtgacggcggacgtgtcgcctgaaccggacaaggtcgccggcgattgaggagctttggcgttgcgtgtcctcgtgtgaatgactgtagtgatgataggatcagtttttaggatgtgagtgagtccaaatgtaagaaatgcaatttgttgatcagatgagatcagatcagattgcagatttatgataattttttcctttctttttagctgaatagagaaccagccatgttcatactttcttttgtactggcaaaattgagccttcattgtactgccaaaattgagctttgcatgcaagaaaaggattgcacatattgtagcatttcaataccaaaatacgaattctgtatatgagaagaaagagaggacagagctaaggttaacaagtgtacactcaaatgcaatcttttgagccaaagctaaatttatggcaacagaacaatca

SEQ ID NO: 39910 - DNA, 564 bp, Oryza sativa
cttgaatattttgttcatctttcattttctttctgttcataaatttgcaatgaatttttcctagaatgtgaaagttatctctgtcaattctctcattttttttaaagtcagttttagtgttgatgaagttagttcaaaatattttgatttggtttcagtctcatcagttgatacaaagactgctaattcactattcatgcatcacttttttgtgtaattagtgaaatgcaaagtgatgtatgaaacttaagagtgctactagactattactactactccctccgtttcataatgtaagactttctagtattgcccatgttcatataaatgttagtgaatctagacacacatatatgtctagattcattaatatctatatgaatgtgggcaatgttagaaagtcttacattatgaaacagaggaagtattagattgactagctttatcattgtgttgtatatattagatgcaatatatgtgtcaacgaattttcatttacatattcccacggaatggtagagaactattatttttatttgggtttcggtctcaataatttaatat

SEQ ID NO: 39911 - DNA, 1501 bp, Oryza sativa
tcgtgcttttctgaaagcatgattgtactccctccaagttgaaaataattgttgttttgaacaagggtatggtctctaaaaaataactttgaccactatttagtttcatattataagactttctagccatgtccacattcatatatacgttaatgaaggaaaaaaattgaaaatatacatttttttaaatattttgcgtttatatatctgcatgaaaaatatttgcacaaatataccttcaccgcacggcggggacgcgggaccgagtggtgccgctcttccattctgcgggaccggcggtcgcgtagaacggccgtgcggcaccgtctcgctcccgcggcgcggaagtgcggcaccgcctccctctcgcgcccacgcgtcctgagacggtcccgcgtctccgttgtgcgggaccgtgccggtcgcgcgtcgccaatgcgcgggaccgcgccgatcgcgcttcacggttgcgcgggacggctcgttcccgtcctctgccacgcgcttattatatgacagcgaatttatactgcgtggcactatttaggactgtttttttgtactgtttgtcactgttttggcactgttcatgggcgatcccgcggttccaatgtgcggaagcgccccatgcacagtacgaaacagtgttgcacagtgcgaaaacagtgtccaaacacttcaacagtgttcaacagtacgcagagtataaaaatcgctagcacacacggtgccgcgtattggaaccgcgggaccgctacagtcccgcgttttggatgtgtgcatccgtataggacgtgcagagttcatagtgagggctgcggaactgtgggtgggccaatgagtctatgcgcgtatgtacctgcattcgtgatcatgcttatgaacgtgggtaatggtaaaacttcttataatatgacacgtacgaagtattacactattttccactgtatccatacctggtttgcttccccttagggatttaacctccaagaaccgaacaagccctgacggggctgagccgaagaggctattctatgaaatctatagaaggaggaggaggaggagggagaaaggtgatgtcagcggaggaggaggatgagcagcagcgtcggcgtcagcggcgagactactcatcaatcttgcccgccaccgccaccgccgccgcagcagcacagcgtccgccagaaatcctagccctagacatggaagaggaggggagaggggaaggggagaaactcaccggagagaaggtggccaccgtcttggtcgccgtcgcctccgacttgcgcggcaccgcgccggccgccgcagcgtcgccctcgcccacgagagggcttaaccgaacgcaaatctcgcataggccgggattctttccacaccgggttgttgggccgttacccgggccattcccagcccaaccgaacatggcccgaaaccaaagccaggccgcctcgacggaggctattctaggatagcgacccaatctggcctaagagataga

SEQ ID NO: 39912 - DNA, 1501 bp, Oryza sativa
tactgcagcttctcccagaattttcagctctctcaaacaatccagattcttagctatagaatccagaaaatgaactagatgccggttaccaactagctgtttctcagaattttaagctcccaccaaacagcccataccagttgctgtgctgggtgttttccatgttcagttcctctgcaattgccaaaggtcaatatcataccctgtaggaggtatatctgtactaagagttagtgtgctatctaaccaccctgtaggaggtaacatttttgtttggctggttattgttggagaccactattttagaagcacaagtagttcattttgtaaactgagggcattaactgtttcaattaatatccaatttctcatacctgttcaagtaatatttgttttacattggccatgcactgaactcatttcctttattgtgtatattacctggatcagcagagtatgtacagaccatagaggatgagcttagcatgaagcaggatgagagtcaactggatgaacacaagaaagaagaaaaggactgttctagcaaaggcgaaacagctcagaaacacaacagttcacattctaaaaaggtaactatcatgtggacgactcttaatagtttccaaacattgaattgccttgttaaaatactatgttggaaggaataaataggaattatccctttattcttttgcacagggaaagtcaaaaaccaaggaatgctcttgtggatctgctaggaagcacaagccttcttgtaatttagccacaactgtagcatcgagagaacctccaaaaacaactgcaccatcgagagaacctccaaagtatggctttataatggttttgctaaaaatatggcgccacatttttgacttgatttcagtcatttttttcccattcggattgctaccattcttttatactcctatgtaagtatgtttcgctctactatctcctctttcaagtaggtaattaattgttttcatcctaattctcttatatagtgtgtgctgcaaaaaatatggtgtaagtattgagatttggttttaatttttttttgttttttggtggaaaatgtggtgtcttaaatatagctaatcccctttataatgtttctgtccttttgtttgtcttttaccatattctattctacaactgaacttatgtcctgctgttcgcattgtaagcattctttcaaatggaatttttggggggtgaaatcaatatttccagcgtatttgcatagtgcattgctgctgttgtatctggcctatgaaaccttaacagtattgctgcaaaatatgcacttatcccatatgccttaaagtcaccgacctgattactatttcctttttcactagggaggttagttgcattgcatgtttaacacaatgctggaagtgttatgtactaatactatctgcttaatgtgctttactatcaggaccaaaggtggccaagggaaaggccagaaggggaagaagcaaaagaagaaaga

SEQ ID NO: 39913 - DNA, 1501 bp, Oryza sativa
caagaagcaactaaatatgtattcctgaaaaactaggtagaagggacaagatattgacataaatttgtggaggtaaatttaaaacattgcttgctacgcatgagtgatacctgcttataagcataagcaataatttgaattgaaaacttaattttcgagttgattttggtatattttcatcatactagtttattttacagcatttgcctttatatcactaagaacacatatataaaagttttacccataaattattttttaatcactaataaaccgtttcacttataataagtataagcgaaacgacgaggctgctaaattctacacaagtactgaatctaaactttctgaggatgttattctcttttgttgtttatctggtttggataatgccaggatacttcctgtgtttcctcatgattccttttgtaatttatcaacctacactacattttcctgctgtcaccaggtgactccttcaggagaactgttgatggtcctatgaggtcaacgttgacttttgataataatcattctgtagtgccaagtcaaaacattgattacggccagccaatggtaagatatgctaatggagccaacattagatctggcaaagtcagctcatcctattctttataagtaaccgtgcatctgattattttctgtatatttcacaggcttgcatttcatacccatacaacgattctggttcaggagtttgggcatcctacagttcacgctcggtggtatgttcttctaacaagttctctctcaattctctcaaggtcttcaaacttttgcagaggaagctaacaaactagtagtaacattttttttatcaacatatgtaattataagggtataattcatgcatccaggtcctgcttaggagatcccattatttatctatgatcagtccagcctgatttgatttagtctagaggcttaaaatatgtcacttttcccatttgtcgtaaagaaactgcctggttttgcataaaaatggattgagtcatcaacgtaacctcaacagggtagtatgtctgaagctctttatatagcacaaaaagattacctttgagcattattttaggttttgccaacctcacctgtaaatggtgtaggttgatgcattaaattaaactagtgagaagacataactaatgtctatttgagtaatgcagtcacatgcagttcataattcttaagaactagtactagatatacgtgagtttattcactagatcaatattattcagggagaacatgtagtagttatgcaaaccatgtgcacacacatctcttggggcatccagcttatttttatctatattttcatgggtcttgcctaatcagttgtacttaaaacagttccatcctcaaattgtgggaggaggcacatcgccaagagttcccttgccctccctggagatagcagatgatgggcccatatatgtcaatcccaaacaatatcatggaattcttcgcagaagacaactgc

SEQ ID NO: 39914 - DNA, 669 bp, Oryza sativa
tcattaatttacaaagctttttagatatgattttcgcgagtttcaaacacttagctcgttttcacatgatatttcccctatacaatgacaaataatgatttggctaatttactacataaacattttgaacctgaaaaactttgagagactctcatctgacgcatttgaaaaatcttcaagagcggcctgaaatgcagggtaaaaattaaagataaatagtacatgaaaaggaatgtgttgatttagcagtgaattacgtacaaaccttcgagtcatttttctgagtaatgattttaagccagcaaagtactggcaatcgagataggttccaacagaattctgatgaaagtatgcagcccaatgattcaaagagagagatccactggagtataaaggtaattgagccgtggaatcaatcgttgcaagtaagaatatacatgcaagtagcctgcaaacctgaaccaagagagttggatttcaacacaagaaccatcaacagtaaaacatatacttgaagacggaaggaaactatagcctgaactcagcaggcactcagagatgataaaattaagaatatgcaatgagcatttaaaacattatactgcatggaaacatgactaaaggaaatcacagacctcctgaaaaagtgagggattctctctggacagc

SEQ ID NO: 39915 - DNA, 1501 bp, Oryza sativa
tgaaaatgctacacttgtcccgcttctctaattgtcaaatccaaaacgttttatttactaatcgagctgatgcggtcaatatttatttttatactgtcacgtatcaactgcagtatgcatctgtatatgtttgcaagaaaagggtatgggcgttgtgagctgtggtcaaaagcaacagagaatttcctttccctatcatgtaaaacagctggatttcgtagcggatcatggcgcgccgcttagattaatcgcagtgtccgtcggagaagaaagcgaccggccaaatctcaaaaaaaaaaagagagggtaaaaacgagaggaggcacgtatcggtctcgtcacgctcgagcccgaatccgcatttcgcggggtaatgcgagttcggatctgaggaaacgagcccgacccgttaaaggcgcgtcgtccagccgcccgaatgcccgatccacctcgtccatagcagcctcgcatccgaacccgagaggccgagacagcctcgcctttgccctactcgtctccttccttccttccgccgccgccgccgccgccgcgagggccatggggtacaccaaggagcagctcctcgcgcgactccaggttggtgccgccgccgccgcccactgggcgccactgctctctacctcccaactcctcgactgttcgctttgcgtcgtttcctggtagtggggatcggctggattggtggtcgtggatgcgccggtgctacggattgtagcgtcggcgagatgcttcccgttccgttctagcttgatttggttttggttagcatagttataaatggaagcgcgatagggcgtttttgctgccgaatttagttgggttgtgctgcggatagtttttttttttttttttaaccccggatgtgcgcatgaatcgaaggccggaattgcccagttatattgtgcgattatcgagaattgtcacatcctatgtgtggcaaactagaattgcttgccttctggcatcacagtggaccgcgactcaatttagtggtattgtcttgtgcaggagctcaacattgaattctcgtgctacgatcacccggttgtgttgacggtggaggaacaggtttgcaaaccgtgaagttcacacttcgttctacaatacttttgatggatttactgtaagtgctaattgaacttccgcaatgttaggccaaacatgttgggcatttaggaggtgctttgagtaaaaatttgctactgaaggtatgtgtcttaccaagtgatggacagttaatttcttggaacctattttcatgtattgatatttttaaattctgagtttcaggacaaaaagcataggctgtacgttgtttctgcccttgctggcaccaaagttgacatgaaaagtaggtgcatttcttgaaaactatatcctctttgttacttatttgaatgtatgccaactaattttctgttttccttaaacccattagttttatcacagcgtcttggtttgggaaaaggtggtctgcgga

SEQ ID NO: 39916 - DNA, 1501 bp, Oryza sativa
accaactgattaatcgttcggatgctaccttatcaactcgcagagttcattgaagggacacaataattgtgaattgtaatcctctaaaatatcacaataaatttctttttctaataaacacacaaacgaacatagtaaccgtttcattctatcaaatgaatatatggtccttatcttagagctgtttttttcagaaaaattatgtaggcatggcatgtttctatatatctatatgagaacatttcgattatggttgatttgctagaaaattccaacttcaaccgaaggcacaccaccattggtagcctgaagcatgagtgaaagattcattagtttttttttattttttcgagaaaacaattttatttatttcatccgtcctaaaatactgctataagtgaacaaacacttattcagatttattagcaacatatattcatgcattataacagatcgaacatacaattgagacgagtaagaaagggctaggaaggtaattgaggataaagtaccgtatcatacggaggttgtgtacatgatttgagaaggagcggacaaatagactgcacgagcggtgggagaaggagatgaacggaggatgactcaactttaatactttctccgtttcatattataaaattttctagcattacccatatttatatggatgttatgtctagattcattaacaatggtcaattgtagaaaatttttacaatatgaaacagatggagtggtaatatagagataacataaatgatggtatattttggaacagagaggaaaattcaccaaatccaatgaccagaagccacattcagttcaaaattagcagtatactaggatgtgtttagtttgtgtgccaatttttttaaggatacagacacatatttgaagtattaaacgtagactaataacaaaacaaattacagattccgcctgtaaactgcgagacaaatttattaagcctaattaatccgttattagcaaatatttactgtagcatcccattgtcaaatcatggtgtaattaggctcaaaagattcgtctcgcgatttacatacaaactgtgcaattgttttttttcatcatatttaatcctctatatatgtgtctaaatatttgatgtgatgaaaaagttaaaaaaaatttaaaaaattttgaatctaaacacggcctggattgaaaactcaaagatagcatgaactcctcaagattagctcacactgatgacacgactcaactgaagaatccgccttgtaccaataacaagtccaggttcagagaaccgcccccttccgcgaaagcagcagctgttacaaaacccacacacctccgcgcagcgcagcctcccacacacgcgcactcgattccccactcctctcgcgggtcgcggccacttcgccgccggcgctcgcatcggtcaactcgacgccacggccacacacgcaccggccatggccgcggcggcggagcagcagcagcagcagcagcagcaggg

SEQ ID NO: 39917 - DNA, 788 bp, Oryza sativa
atctatctagattcatggacatcaatatgaatgtgggaaatgctagaatgacttacattgtgaaacgaaggatgtaatatatataggtagttagtagtattagaaggagagagaaagcagagataaataatatattttattctatataggcaactcatatgtttatgggtgacttttgctatttgcttgatatggactagttctacaatgttgttaggtggctgaatgaaatattgtattctttatggactagttctactatacattatgcatgctcaagtgtggacgctctgcaagattgatgtttttttttcaccacttggctaagtttgtaagaatcagtcggttgaatggcaaaagcttccccaaacaatttaactttttatctagattcaaaagaatcttaataaaagctaaaaaactggttttccctgcttttttatgctctcacaactagatttccatttctcagaatttaatctacaaagtaggttttccttagcttcctcgtagatttttttttcgagtaaagtgtacgagcggtacttaaacttgtagcggtatgtcatctagatcccccaaactctcaaaatgcatatccaggccctagaacttatcaaagtgtatcatctaggtcccaaatcgacacatcccctcttggatcctacgtggcgctgatgtgacctgccacatggacgtgacatgtccttttttttcttcttttctttttcttttctgttttcttcttattcttgtttttttcccctctcttttgctcgggtcacaga

SEQ ID NO: 39918 - DNA, 474 bp, Oryza sativa
ataaaattattcaaacttgaagtagtctgactttgactaaagtcaaaacttcttataacctgaaacggagggagtaggcattgaatagaataggttatggatcctttggagaataaggttagcaaatatccttcattcatcctactatttctttggatctccttttgggagctttgagaagaggtgagaggatccaacatcaaaatgtcacctcagaaagctaggactattcatcattggttctcagctcgctatggtgattatactcccttttatctctatcatcttaatggaaaacactgaacatttaggtattcgttgcatattccgttaaccagtttactagataatttattttagataatttataagtatgaaagaaatgtgtaagcttacagcagcttcagttttgactcgttcccttcttgactgtagagatcgttcatttgcccacttgaagactgccctttcagc

SEQ ID NO: 39919 - DNA, 1501 bp, Oryza sativa
cattcctgtactgttataccctcagctccaagctcgtcgatacattagattaggtaacaccgtatggtaatcctattttatattttacaagttgcattcttagctagatgagatggttactgaatcaacaccttacttttgtcgtggtttgtaggtgcttccaggaaattgctttgtactatccttacaggttactactatttagaaatgttttgttccttcgtaatgtttttcgctgccgcttgtaccacttgtattatagtaatgctgttccacgcatgaacttatctcgacagtttttttaagctaaataactggtctgtagcatcatgagctactagttttgtcaaggtcgatggatacactattattcattagcaaagataactgtgctgcataggtgcatggagccgtagacagttcactaataaactgtttaccaatgctttattgcagctgtgtactgaagaacctgcagtgtaaacctcacatcttttttatttgactctttatatgctgcatgccttgtgttatgccatccctgttgcttccataatgcatcgttgcgctccattcttctaaatccatcttcttgtgcagggcttgttctagcctccgtcgccttagttgcagtgtggataatggggttggttgccactgcaattgaggctgcaataggatgggtggttgagagcatcctcggaaatttcttcactggacagatgcaagtgtggactcgtgaagttggcctttctgaagaagtggaggagcttgagactgagatgaggagcatgcagatggtgcttgcagctgccgagagtagcaagattgacaacaggccactgtccgagtcacttgatgagctaaaagagctgctttatgatgctgaggacgtgatggacgagcttgattactaccggctccagcaacacatcgaaggtggtaacacactcatcaaccttccattccttgtttcttgcttcatgcttcttttgcatttgtgtatttgtgagcttactgtgctactaagagcagctaaataccataatccataggcaccagtcaccgcacatcagtttttatcagttaattgtgattacgttaccatcatttcaacttccattatttaccatttttaagaaaccttaattattagcagtggattgcacaagtggctttcttttgcttgtcccttaacaccaagtttttttcttatccagggaaaggttctactgctgcttcttgtactaaccctgagggaagttatgtgtcttcatccactccatcttacttccaacgagtaagcaacagcataaatcaaatattagttggcctatgcatggaaagaaaaggaaaagagaggaagaagaggagcaaactcatagcaccatgctgcctcttgagattaaacatgatatttctaagaggatcaatgaaatagtgaattgtttacgcactaggtgcaagcctgtgcaaggagttcttcagctggagattttac

SEQ ID NO: 39920 - DNA, 1131 bp, Oryza sativa
taatttgtaaccactagaaatagaaggaataattcttgaaatggcttgctcaaaatagcttccccgctgtgttcaattttgtgggtcttgcaaccggagcttgactgcataagtgtgaacattagactgcatcatagtgagtaaaccttgctacttggtagaaattttggccagttgtgtgtgataagaaatcatttcttgagcaaatttgccgatttttgaaaagtgacaagcagcccttgtaacaaaaccaaggcagtagtatcttcagaattcagcaattatgtttttccggagggctaaatatggcagcccatatactctctgattgatgtgagttgtgatcctgctcttttttctaatgacaagttccaaatttccaacagctagaagtatgaatatgcaatgaattactttgcacaaaatgaatacagagagggaattattgtggccataaaatactgggaaatgtcaaaagcactaaaataccaaaattccattccatggaatggaatatatgcatacgtgttgacctgtcagtgttatgacaggctgttcatcctgacttgtgtgtggccgccgcccattttgacgtcaaaagcaacctccatttctctcatgtctccggccaaccgaccaaacatccatccttccttccgtccagctccagccattgttgattgctggacacagcccttgcttatctttgatgagaaatttaacgatatcccttaaagtttttttggtccaaagaaactacacaagaacagggcagaatctttgtacggcctccaagaaatgcactaacagagaaagaatcatcacgatgcagtgtctcagttcagggctctctgaatcatctgcattcagaagtcgctcaaatataaaagtgtagagtccttcattttctttaaaaaaaataatcagtttccacgtagagttaagaaactggaactgtctagacatctctcgtatgattttttggtatgcaaatatgagaagaagaaaatgcagccttgaagaagctggcccaatccaaagctccagcccgatatagaatgaaaccatgagcgcagcataggacgaaaccactatccaaaacagtgacttgatttgctccggtcttgaaga

SEQ ID NO: 39921 - DNA, 1501 bp, Oryza sativa
agcaaaaaaccaaagcggaataagtccagctgtccctcatcttcacgttgagtttaattggcatcccaaaaatcgatattataaatcttcaccccttgtattgccagaaccgtccaagacaggtccagggcagtacagacaactgattccgctgatgtggcattctagttgataaaaagaatttttttaagaaataacatacggagctcacatgtaagtgagaagaaaaaaatatgttgagcccacgtatcagctcctacttctttctctactctttttcctcaaccacgctctttttcctcaaccacgcacgcgaggtcaacagagcatgccaacgatggggagaacatgccctctaggccctctctgggctagacctcaagtttcaatcgttattatcatgcaagcggtgtcgctccggcctgaacaactccaccataggaacgctcctggtgtttgggttcagtgaaaatggaggggggggggggggcaatgcagggagggaccgcgcgaccaagggcgccgtgtaccttggcgttttcgacgccgcttagcatatcttgaagtggctcaaggaggacctactcgcctgccacgttgtgctgtgggaggcctgcctcgatggcacttgcaaggagatgcgtccctctactgcaccttcttggccttccaagccttcaccccttgtcctcttcctctccgcattcatgtctaaggaggcggtggggcggaaagagagggattcgaaccctcggtacaaaaaaattgtacaacggattagcaatccgccgctttagtccactcagccatctctccccgttccaaatcgaaaggtttccgtgatatgacagaggcaagaaataacgattgcaaaaaaatccgtgctgcgctcctggatcgtatgcctcgttttgttgctctcatcgttagccatgctctgggcgcagaggtacaaggcagacatggagactagcgaggctggccgccgccattgcgagctcgataggatccctgcctagagaagagatccgaggagcggttttcctaattcgcgcgtacacacgcgtaagcttatgttgcgcgtgtttcttgcccatcccttgcacgcggcccaaaccctcacacgacagtccatcgtttcctttttttttttttttgctttttttcgcctggggagaccacgcgtcgttacgcatagggttaaaatcagaattaaaaaataattaacgtcatgattagcgctagtttaggtaattaggttgtattaggaaacgtgattagtatcgtgattagtttagattttttcccctctgtattagcgttcggttgttttatttgactttccaaatataatttaagactatattctaaattaagactttcaactttaattcgaaaacttttaacttttcatctcaaatttgaaaaactttcaacctagatttgaaaattttcaaccgataattaaaactttcaacccagatttgaaaactttcaggtc

SEQ ID NO: 39922 - DNA, 1501 bp, Oryza sativa
ttgtctccaccaaattattggatggcgatctcggagccaatgaagatggtggcaaatactaactccgacccaatataattacagttgtgaccgtctattttatttagtttttttttaaaaaatagtcacatataaaatattattcatgttttaacatctaataacaataaaaatattgaccatatttttttcaagtaatacggacggccaaacgttggacacgggaaaccataactgcacttttttttttacggaggtagtattagcaagggattatttgttagaccatcaaagttcaaagaaatatttaattatttgttacgagtggtaaagtagtttcaaatttcatcaagtaatctaactctagtagaaattttattgggtcaacaacatatagatgtctcatttagcactggtattgctagtttattgtaaaggcaatggtatcccctttgatagtcaaacattatccaacatctatattcttcaatgtttttcttgctaactgcgaaatagccacatcacacgtgacaactcatgggtatcagacataaatggctaacataagtcaatacgtttttctactaacatattttttttctaacctaaacgaatgaggaagaaagatagatgcttatagaggtgtgcatgacagtgcaataaccctagtgacatccctacgtatctctctgagattccaaggtttcaccatattttatgatgtagattctcccacatagattaccatggtcacttgtcaccgtgatacattattcatgcctaatcggtagagatcagcaatggaaaaaaaagggtgaccattctaacttttgttagagactaatctcgaatgcttttctcttgacgtaccctttaaaaatgtaaaccttacatatgcaaccgatatggatgcctctaataaatatgaactcaaatacaatacctgatcagtcccaaaatataaaaacataggaccagataaggcctgtctaaattcctagtattaggaaatatcctatccaattatagattcttatattttaggacagatagagtacaataaaatggtgaagtgtaatatttatttccaaactgtcaaccatttgtttttttaaaaaaacacatatgggtgtgttcggcgttttccgcgcgcacgcttttcaaactgctaaacaatacgtttttttaaaaaagtttctatacgaaagttgtttaaaaaatcaaattaatctatttttgataatatttaattaatcacgtgctaatgaatcgttccgttttccgtgcgtaatatgaatccgaacacagccatagtctaatcgttgacttttttttttttttgtaaatactaatcgcgtgggccggtgagttcagtagtactcgtagtgtattgccaatccatcgatgaaatcccttccttccatctgcaccgtccatccccacgcacacacccccacgccaccgccgccgccggtcgccggagggagccggccatctccga

SEQ ID NO: 39923 - DNA, 1501 bp, Oryza sativa
attatgatcatgtctcaacatttatacttaccatgtttgtgttcatggtcatgaactcatgatgatgatggtgatgacggtgttcatggtcatgtataatatgttcattctctgtgcggtcatcatgtgactcttcagataccgcactttcgatcctggaacagaaacaaaatcgaatcttttatgctcaacgtttacctgaaacaggtaaccagagctaaacttgaaaaacaatagagactcgaatgtatgtgtaatttattactagcacaatttaagaccaactttatcatattcaaccatagtacttgaggttatattgcagttcataaagtgttttgtctaaggacaacagtagcagtaaatagttttaatctctcaatgccgtcattcataatatacggtgtctactactagttcatttagcaattaacattgtagatttcattgtgcttgaacagctaagatcatctcgtccaagagctaccattgagcactaaacagatttgatttttcaatgctagaagattactagcagaaaccatatgcctgatacagacatacagtgatatatattttcacttctaagcttctagcaacctgtcatttcattatatttgaaatgctcagcacattcaaactctgttgtgtttttatcttcccttcctgccatcgaggggggtaactggacacttatagggcacgtaatcatctaaaaggatagtattatcttattgtagacggatgcacttatgcaccgtatcagagtaaataggcaaacacacagcactagtccagcaaaaaatgtacatacatcagtgtgggagagtgtacaaacatctctactgtgcaaattcacgggctcctttcacctaaagccgatttttaagcctgaccttctcggagcggaggaagccgtcgggatcatcatctctaacacctgatccctcttcctccgtagtcgtggaagccgccgacgcgcctgccaggatggggtccccaccgcagccacagcccacagcccgcggtggagaggcgaaggcgcagtaggaccgcgaggcggagcgtggccacgccgtcgccgagagctgccgccgtggagatggccggggaggcggagcagagcgccgccgccgccatggtctggtctggggtgcgatgcgagatggcacgacgaagcactccgcagcgcacgcgcgctgcacgtgcgagcagcccgagcccgaggcccaattatgttcgccagcatgggccaaacaatttcacgtgggctaaatggagcccccaaccccgtgtctgattctgactcgttttcctcttcctgagcgggcccagcccgactgctaccatcgactaggccagcgacaggccgagaggtattcgtattcggccacaaaatcttatatattcatcagagcctctctcaaatctcaatcgtacttcagccgccgtattattgcgtctaggctagcgagagatattcgtattcgcccaaaattca

SEQ ID NO: 39924 - DNA, 1165 bp, Oryza sativa
tgcgctagcttctgcatcatatgctggcctcgtggttccttcacttgacggatctgatggatacagagcgacctaattgattctagtgatagttagcataacaattttttgttcataaacaatttatgcatggtttagataaaaaatcattgttagtactagagatcgaattacttgtccctgctagctaacttctttttctctacataaaatagagataaaattgcacagtgccattagtgccatgcgtccttagattttcttacctcgttatagaaaaaaaagaagaaataagaatgtttacgtgttatgataccaaataagcatcattatgaaatatatttcttataatttatttgtttgatgttattactctactttacaaaacttaattaaactaaacttaggatagtttgacataggacaacagataatctcttatattttagaacatatatttttaaaagttattagagtctgaattctttactagtttattttttaaaacttttggagagattagattgaaacatacatacatgcatacatacatcgatcaaactaatacgtaccttgataattttggattcgatgaaacaggatgggagggcaaggtggagaggcgggaccgcgaaatagagcccattttcgacctcttcctgcctatggaccgtgatagctacactgtcttcatccctaaagacaatcaaggcgttgctcggcctctcgcacaaggctatagcttcaatggcaccgaacgtcaccatgtccgtgcacacctggtcgagcgcgctcaccttgttgagcttctggaggaagttcgtgaaatcctgggctaggacacaatgtcgatggaggtcgttgtacctgtccctgtcctcggagatcagttggcttgcgatgggtaccatgagatctcgcgccagggtcgccttctcgatgatgtcgccgcacatgtcgcgtaggttttctagagggaccatggctggtgatcgacttgatgatatatctttggaattcttgagactggagctgaattgcacgtatgatttttggccgcaataatccggcggctcggctgtgattgatttgagagagggtgctgagtatataagattttgtgaccgaatacgaatatgtcttggccactcgctggccaagccca

SEQ ID NO: 39925 - DNA, 1501 bp, Oryza sativa
aacatgctccggcgatgcgtattcgatgcctacacgggggccaaccaaaatgttctccggttctggcccgtctagtacctccaacccacctaagacatgtaatgtcaggcgaaaacatgttgatacgatctggcagttttgaacgatgttggagatcactgaatcataccaggtgtgtacagaggatggttggaccagtcagtggaaagccccagagcttgaccaacctgaataacacattcagagacagttataattcagttgtgtgggaacagtgatgatgcagaatacaaaacttggtattgaaaggcataaacctttcctggtccagtgagtagaagtggcttatcagtctgctggcctcgacgctgctgaatagttgccagccctacagtattttgcaagacaatgagaaaagatgccatcaagctcaaactagatgttacacaatagaatttacaggaggaacagacatttggcagtaactagtaacctgactgggtttttcttacatgaccaaatgcagatgatttatataagctctatggtctaagcatatagttgcttttgtaaaattggaactccagtagtccaaacaaagaaacagattttactttctgaagttaggagggacagacggaagaaaaacaattgccgaaacatgtgaggaaagattatcgcatatcctcttcctcttgctcacacagcaacgtcctcgtaaacttcccttgtgttctttaagtaaaacatattctctaatgcatacttcatatcacattaagtctgaagtgaaacatacatttcagaagtgaaaattattgcgattacagtatatatcttccgatctaaactaaacaagcaccaaacgaaactgcagccgaggtttataaactgtaagtcacccaaataacttggtcatgttcacttgttgttacttcaggaaaaaagctgatcagatcatacatgatgctccataatgctcaaaatacttgagagaaatcagaaatgcatactgctcaaaatacttgagagaaatcggaaatgcataccactaacgggagcacatgaccgaatcagaacagcagctccaactccctccttgtcagcgacgacattgagcatcatgtgcagtccatagcacaggtaaacatacgcatgccctcctgatccaaactacaccggatgaaggaaaacttcagcccacattgaagttcaagagactccccccaaatttgctaagcttatcgaagaatttaaggcaagagaagcatcggccttaccacaggagcagtcctcgccgtgatgccgaaccggccgtggcacgcggagtcatttggcctgtaagcctccacctggaggaacacgcaggaacaaatccacagtaatcgcacttggccgcagtgattactgattagtaggagtggtaaggtgaaagaacaagcacctcggtgatgcggaggacgacttcgtcgcggcgcagcagcttgccgaggaggcgtgg

SEQ ID NO: 39926 - DNA, 1501 bp, Oryza sativa
tgggggacaaatgcattgaaatttgaaaagtggaggacattctagtatttgattttgtattgggacggaggtagtactggctaattgtgccaggccggcccaagataggccaaccagtagctggttaattgtgaggagtaccaactttttcttgtgagtttgcatgttttgctcctagtaagaattttgaaatcttgaaccgattcacaatgcactcacttgaagtgaagttcattaaaaaaaattttcatactgttattcgtctcgggatgttaaaagggaaaagggggtaaattgtaagcttgttcaatttaatattttgaacaacagttgtctggcagatcaaagcatttcacattgatcttactttcctgaggttttattttgaaaacccatggagacaacatcatcgtattgaaattgacctgaaatgggcatgcaatcttccaatagaacatccaaatttgatatttgggaacagctttgtagactcttcattttgatatttaagatgaggtatttagagtggcttgcactatgtatacaagctcagtcttgattctttttttttttggcaagaattattatgttgttacttcttcctgaagaaataaagatatatcatgaacaggtattatcttgtcagtgtggtcatgtatattgacgattcctataagtaattatagtaattactatgtcatgccctgtgcatatgcttttttatttgctgtataaataattaaagatagccacacagcggaaaactgtaattagtttttgttgctttggaaagagatatatcaatactctagttaagttgtatttctttctttttcagagaaaaatgagttgcagaccctggcttttataccagttgcaaacgggactcgcttagtcacagtgaaatcactttttgctcgtctgacaatcaacatgtcgccttttgcttttgaacttccaagtctttatcttccatttgtcaccatcctcagagaaattgggatgcaggaaacccttacaaacacttatgcaagggaacttcttttggatatacaaaaagcatgtggttaccaacgcctgaatccaaatgaactccgcgctgtgatggaaattttagacttcatgtgttctggtgtcaaccaagccacagatggatcagaagacatatttgattcagtaataccggacgatggttgcaggctggtatcagctgtatcgtgtgtatatattgacccatatggttctcatttactgagtaacatagatacatccaggataagatttgctcacccagatcttccccagaatatttgcaacacgttgggcataaagaagctttctgatgtcattgtagaggtactactattataggatctttctttttttatggctgtaagtttaattaattttgtatttttcaaataaacataagttttttcccttgtcaggaactggatggaaaagaagaactaaagatggtgaatagcatttgctctgttac

SEQ ID NO: 39927 - DNA, 495 bp, Oryza sativa
tgtgcgtgccgaggacttggggatcgacagtgaaccggtaggcgccctcgccgtcgccggggcgggggcagtggacgcagaggtaggacaggcgcggcgggcgggcgaggcagaaggagacatggatgtttacgccggtggtggtggtgcagaaggcggtggtgagagttggagactgcatcgggggagtacgtaagctctgtcttcgaggtacacccagcttgggctcacgccgccggtggcgtcgtcgtcggccggcagcggcggcggaaacagcaagggtagtagcacaccctcatccatgacataggggacgggctcatcaccatcatccatggcgaatcaagcggcgatccgatcggagatcggcgacgagggggcttgtttggattggattgcgtcgttcgatcgatccgaattttttggaatccccgcctatgtcgctcgctaattgcgatgatgatgtcgcgcgaagccatgacgatgctatttccg

SEQ ID NO: 39928 - DNA, 151 bp, Oryza sativa
gtgttcctagggttcctcatatatatcatcaatcagcataaagatggacgcagttggtgtggtgaattttctattgatgatctactagtcagaaatgaatcaacatttggaatcacgaaggcagcttcttcccatgcaagttgtaaagcaa

SEQ ID NO: 39929 - DNA, 491 bp, Oryza sativa
tgaaaaaaaaaccttcaatacaattttcaaacatatgctatggttgtgtttagttcactaaaattagaagtttggttgaagttggaacgatgtgacggaaaagttggaagtttatgtgtgtaggaaagtttcgatgtgatggaaaagttggtagtttgaagaattattttggaacttcacacggcctatatatatatatgctgttctttgctaccatgaaaattctgaacttcaaattcaccttgtacggggaggggaaaaaaggcaaatctcatcagggtagatgtcacaccccaatctggtaccgccgtacaacggcacctgacaggagcgtgtcgtagaaaaacggcttgaaccgcgtcctacgaaactgcgatctcagtaccagtcccaggacatagcgctggtacccacggtgacaaacatgaatcattacaaatccttataattaatagaggacttatttaccttaacttaggttgcagcttaga

SEQ ID NO: 39930 - DNA, 909 bp, Oryza sativa
aggttaaatagactttcatagagagatttaattgggaggttttagggttggggtctggattcgagtttcgaggttgatactcggtctcgggagaataggaaggagtcaaggaagggaacaatattcagagacgagtcaaagtgagatggataatttagagaaagagagtgtaacttgggagtttgagtttgactactcaacgagatatgtgggtaaggattttggagggaagtctaaatagaagggttcggacttcgagattatttcggaacggaaatcattttggggagaactcaaggcgaaagggattgaatcttggggtttagagttcaagggtggaagtgatctcgatttgcatattcagacttgggtcagaagttcgagaaagaaaacaagggtagattgacgaaccaatacagagagaaatatagatgaaacaaaacctgagaggttgaattcgaatttgagaatcggtttgaaggaaccaaggagagagtttatgacgcgaaggtgaatccttggacggagttagggttcgggcatttgacaaagttcacggatggggttccatgaggggattccgaatagaaggaatcgagcttcgggactatattgggatggaaactttgaggagacgatctttgatagcacaaagatggaccaaaggagggatgtaaattgagatctttggcacaacttagacttcaacactcaaagaacgaaattttcgcaattaggattttcagtaaattagcttttaacgtctcgcgaaaagcggggcgttacagtagattaaaccggttgaaatgttttagtggagtaaattcagacgaagttttgtcaggaggcttgctaagtggataaattgaattgttccaggtagtaaatccagccgaagttttaaatatg

SEQ ID NO: 39931 - DNA, 1215 bp, Oryza sativa
cctgcagcccgcatgcttaacgactaacgtggtatgatcagctagcaataattaatactcctagaacagtaagcttttgctacatgtacggaaaaggatatactatagtattagagcaagtttaatagtatagcaaattgctaccttcaaattatttatagtcaacttaatagctaatttatacaatagttactataaacatatactacataattaatatttagtcccacctgtcatacactacacatgtattttaaagtccgtactgtagctggctacaaatctgtagcccgccgctattctctcacatcttctatcttctcaaaatgagtctatggctaacttatagcctgctattgtacctactctattgtacctgttcttagggcatgtgcaatggtagtctcttaacgttactaattagaaatgtttgctaaatgatagagagagagagaaacaaggagaggcaaacattatttttactatggttaacaactttttagcgacgactttgaacatctataaaatgaaaactttgctgcataaagatgtgaacaaggaaataatagtaataaaaaataattttgtagattaatggtttagagtgtttgctgtgttcaccgttgtaaggacatggtatctaagtaaacatatgttactaaacccttaaatactacctcccgtcccaaaatgtaagtatttttagctagtgcccagattcatagctaaaaatgcttatattttaggacgaaggtagtatttaagcgtttatatatatatgggctctgatttgaacatgcctaacaacggcttttagccttcatacaatgaaaacatagttgtatgagggtgaaaaaaaaaggaaacaatggaaataaaagaatcttatttttaattaatggttatattagagcttttatcatctcactgttgtaaagacatggtttctaaataatcttatattgcctaagcgaccatactcgtctttactattgaacgtgcctttactctctctctctctcgcaatatattcttaactaaagcaagtttaatatatataagagagctagcggttgtctccaaagttgttcacatcaaaggtaggaattgctaatatatacaataactagctattggattactatacaaaaatttccaaaaaatctatcatccaacttttaaatataatcaaatttaggcccccaccactttagg

SEQ ID NO: 39932 - DNA, 1501 bp, Oryza sativa
gcttggcccttggacgaaacccgacgtttaggacgaccctaaggatattaagttcaaaaactacttgtgaaaagctaagccttctttttgctttctttattttcagtagtttgttgctaaaatggttactgatcttttctccctctttcaaaattgtagatggcagtgaacgccagcttcagttcccatggttttggtgagggtcaccacgtcgctcagcttcgtgacctcgcccgcttccttggcttctcgtgtcccgagtacacggggtactccgtggaccgtgttccccctcgttgtgagctttcggtatacctttacccttgtggaggtatacacggggctggccttcgcccacaccacttcactatggccaggcccactctccagatcgcgtaccaggacctctcctggactgcacttcgtcgcttggcccacgactacagccaccgcctcgggggctctgccttccggcagctcccacgccttccttctggccgcactgacaccaggtacccttgcccgtacaacgagtctcagcctgtgctgactcgcatggttgagctttctaaggctcaggccacccagcacgaccttctccttgaggcttaccactcccttgcacgccgctacgctgcactcgagacccgcctggccgaggacggtgtcacctcagttgacactacctcttgggactttggccgcctctgccacgccagccacctgtcttcccacagctcccgcggctctgctcgcactcccagtggcccgcactcccccggctcgcgtgcgccgtactcaccagtgtactctccctacccacacccagttagccccttctacacccccggacacactctagttgcttcctcctgccgtggcccacgcttcatccgcactgcgcggaagcgtgttgttggctcttccacagtgttccgcttcgactacccaactccccctccgccagcggcccgtgctgttgccggccctcgacaggttccgccggtcccttcgcgtgcgccgatctacgtttcttcgactgaggaactgaccacaggaggcagccaggcaggcgaggagtagaggaggcagtcttcagcagttgtccgtgtgttaggcccttttgttccgccgccaactctttcggagtcgtggcgaggtagtgcgtccgtgtgtttgatgtgggtgttgtttggtagtctggttctcctaggtggtgtgcgtacagtcaagctcggcgtagctctgtgacttgtccacatccgttgtatcaggtgtctttatgatttgagaaaaccagtttatgcctagtgtgtgctatctgagctgttatttattttgctccttgtcttcattaagtgcttgtccgattctcaccccgccctttttcagggagtttagatggctagccgtcctcgccgcgctacccgtgcaccgaaccgttttggttttgaagaaggcagagttgagccagaggcagatcacgagtcggctgatgagc

SEQ ID NO: 39933 - DNA, 718 bp, Oryza sativa
cccccctcggggggactaagaggagggcgaacgcatcacccttgggcccgacgtccctcgggggtaccaggccacgtgtgcgattgtgtctgcctcaaacctctagtcatgatactcctgatcccatgtcaccgacagtagcccccggcgttatgccagggcaatcgccctctttaagggaaacggtcgggcgtgacgccactcctaagacctggtgacaggtgggaccggtctccacaattgggcagaaacccaacggtcacaaaccacgcacatcggcaatggtaactcggctgtcaacaatgagcggtgtcttcaagactgccacattacttgagtagcacacgaatctggacatggcgattcgtttcgtctggagatatggtaacgtcgcttcggtcggcgagcgtaattaacgcgcgcacgatatgatctatctcgactgccacaaccgcatatccacctcatgcgccgcaagcgggcgaatgtgattagtggaagcgtgggcgcgagaaacgagggggcgaaatagtgggcgcgagaagcgaggagccgggcacagcgttggcaagagtataaaggcactgaggaagggatctgtttccttcctttcgccattattccccttgtcttcaccgcttgcgccctaactccttctttcctgtgccctaccttcgccacacgcgctcgctcttaatcttctcttcctccggcgcca

SEQ ID NO: 39934 - DNA, 250 bp, Oryza sativa
gaagagaggcaaggttgttttgcaaatcttttgtttgaagtccattttgaaaccactaagtgatttatttctttctaagtttgggccgaaaagtgacttgcgtctcgattcgactttaagagatgtttttcaacaactcaatttgtaatgtaccgacctcccgggtcagatcattacttctcggctcacagagccatttcacttgattaagcggctcctagagccttattcatgttctcgaactcccaga

SEQ ID NO: 39935 - DNA, 1501 bp, Oryza sativa
tgatggaaaagttggaagttcgtgtgtaggaaagttttgatatgatggaaaagtcaaaagtttgaacaattattttcgaactaaacacggagtaaacttccaattttatcatgaactaaacacaccctatgtgtaaatgtctcactgttaatgagaagtgaaagatctataaatttctatccggcctagaaacagttgaagtaataacatcactaccttaactaaagatgttgggtttttttttaaaaaaaaacacattataaacgtacacccacctgtaaacatatacactcactttgcatattcggttatattccgacaatataaatggcaaaacttgaaaggtgccatgcatagggaaaaaaactgtcatgctaaacaggaaaatacatacttggtgtcaactacttcgtgggttattatattttgacgaacgcattagtgttaattcacactataatatatttgttgaaatacttttcactaaaaacaccctaatcgctgaagcggtaaaaaaagattagatcttatttggactatagggctcgtataatatgtttgatatgtcattttaaagtttaattaattagataattaccttctagtttacaaatgtctagaacttcaataacatatctggttcatatgatgtcacaataaaatgccagtccgagtgattttctttctaaccgtcgtctaagccgtacatacgtaaaatactccatttgtttctaaatatttgacaccgttgactttttagcacatatttgaccgtttgtctttttcaaaaacttttgtgaaatatgtaaaactatatgtatacatataagtatatttaacaataaatcaaatgatagaaaaagaattaataattacttaaattttttaaataatactaatggttaaacgtatttaaaaaaatcgatggcgtcaaatatttagaaacggagggagtatatataagttagactcatgataatccaactctatacgttaatattgcaattttaaaaggtaaaatatactttttatgcaggactaattgactgtattgaaagatagttgatgcatttacgtagtagtacagtaacgttttatagaattcacattcgtttaattaaaacccaccgtttattaattagaaaatgtattaataaatggccgaaacctgatatttttggcaggcaggagcgcatttcgcagtattaccctcgggttttcttctggatccggaaacagcctccggctcgcaagtcttaaatgcgcacggacgtcgcttcccaccctcaccccacccttccccgcccattacaaaaccccagccaccgagagctctcccgctccactcgccgcacaccaccaccctcacccctccccccatccgcgtgatctcccgagcagctagagcgcgcgcccgcggcgcctgtactgcgagaccgcttcgctcgcttccggtcggtgaagaggcggtcggtcgcagctgaagtagttgttgcagaga

SEQ ID NO: 39936 - DNA, 1501 bp, Oryza sativa
ttctgagcttcccggatttgcgattccaatgtaggttgcactgtcaggctagcagggatggccgactgtaccactatcagccttaacttttctaattctctgcacagacgatcttggtctggccatactttaactgcattgcagtaggtcttgcgactcagtgcatcagcgaccacattggctttaccgggatggtaatggatcccaagatcataatccttgattagttccaaccaccttctttgcctcatatttagctctgtctgagtgaagatgtatttaagactcttgtgatcggtatacacttcacacttgtacccgatcaagtagtgccgccagatcttaagggcatggatcacggctgctaattcaagatcatgggtgggatagttgacttcatgaggtctaagctgcctagacgcataggccacgaccttacgatcttgcattaagatatcccaagccttgccttgacgcatcacagaagatttcaaagtcttttcgtatatctggcagggtgagaactggggcagtggtcaatcttttcttcatttcttgaaaactgtcttcacaggctgctgaccattcaaacttcttttctttctttagcaactcggtcataggtctggctaacttagagaaaccttcgatgaatcttcgataatatccagctaggccaaggaaactgcggatttctgacacattcttgggggaattccaagcaagtacagcttcaaccttcctgggatctacttcgacaccgttagaggagatcacgtgccaagaaatgctactcggtccaaccagaatttgcacttcgagaaattggccaacaattgatgttctcttagcttttccattatcagcctcaggtgttcagcatgttcttccgcattcctcgagtatatcaagatgtcatcaatgaataccacgacaaacttgtccaagtactccatgaagatcttgtttatcaggttcatgaagaaggccggagcattggtgagtccgaaggacatcaccgtgaactcatacagaccataccgcattgaaaaagcggtttttgggatattctcagatctgattttaagctgatggtaacctgacctgaggtcaatcttttagaaaactttcgctccttcaatttcatcgaacagatcgtcaatccgaggcaacgagtacttgttttttatagttacttcattcagggctctatagtcaattaccattctctcagagccatcctttttcttaaccagaagcactggggctccccaaggggatgagctaggtcgcacataacctttactctccaattcttcgatctgctttttgacttctgctaactcattaactgccattcggtagggtctttttgcaattggtgcggtgcctagtgccagttctatggcgaactcaatctctcggtctggtggcatacccgttaactcttctggaaatacgtcgggatatccacagactatgggcacttattccaagggaa

SEQ ID NO: 39937 - DNA, 1501 bp, Oryza sativa
atctctgagtgtaattcagtcgcccatgaatgaattagctcatcagtttattggagcttacatggatccggcaagtgtcttgttgtgactggactggatattgtgaacaatgtttcagctttttggtgttctttttttctttcaaaaagaacagattagtgtaagatatggccgatgaattagagattcgtatagtcgatgagatggtgagatcatccagttcgttggtgcaggcagccggacaaattcatcatcagttgttcggatttgctaatcttatacggcgggcgcccgcgacttgtgttgctaacgggcgcttctctgcactgcagctatttggtcaccgtgctcgctcaaagctgccgcgaatggccaccgaggaatgaaaccctagttcacgcccaccggggatgctgcgactgcgaatctgcgattcgtcgcgcggcgttctcgcgggatccaccggtggtgtggtggtggggattccgcgccggcgaaaatctccgccaaatggactggttcaaaggttagatccaccttttctgctatttcatccttcagtccaagtgaaagctgaaaaagaaatgaatctgaaaccggatattttgtgtaggattggtgttttacttcaacagttgcgactattggttggatcatggattgggaggtccgaatcggctgttcattgtaccctcggcccctgtgttggcaaggtcatgtgatacatacacaggtaggagtaacactcaaaacactgtgtgctgattaggtgatctacaagttgcctcctcgactactagaatctatagtgtgtgttcacttcactgaccgagttcaggcctagttcggtcattgttagcacttgctttcacgaaattggcacaaagccgtgccagtggcagagctcgagctcgacgggtattggtggaggccatgtccttgaagccttgtttggatcatggactggcagaatcggtttcattgtgcgctacgcatgccgctctcttggctacatatgttcaggacttcagatcagctccgagctcgttgatacataatggaggtaacacgtgatgtcgcaacaatctttttccctctgcttatgtttcttaggctcaaaagatgaactgctgaatcatactcagcgaccttatcatcttcttatcctcaacatttaggcaacagcatctagtagttggtatgtaacatcacatgcttagattttctgcatggtcgatgtcacagtttgctccactagctcgtaatcacagactcacagtactaccaaatattacaactgtggagccaaagaagacttgacttgcagtctcccatcggctgtgcagactacacatcattcttctttggctcttatctcatttgctccgtaccttctcagttgatcccatcttctttcattgcgccactttcgtctagatccatcctcttgtgcaagggttgttcttgctgctgctacaacctccttaggtgcattggggaa

SEQ ID NO: 39938 - DNA, 319 bp, Oryza sativa
tagagcatcaactacactatgaaccaattttttatgctcactcatctattgtgaaatggtctgtggaatgctttagtgctcttaaagaattcgaaagcaccggtaagaaaatcaagggtttatcagcattggcccaattcaatttagtttctgcaagaacatagatgatagaagcactactttttttcaagttcaagaactaataaactagatactctgctcattgttgtttctatatttgcattgatattaagagactttcactgcatagattttgagtagtacctttctattcacacttaattgtcatctctgcagc

SEQ ID NO: 39939 - DNA, 484 bp, Oryza sativa
ttttttgccggcggccgcgttgccctctatcaggaactccaacacactagatcgaatttttcaggctatcaataaaattcgaaagataaactgccaccgccctcaatgttctctttcaagaatttcaaaagatacgcaagatttccaggttcatttaaaatgctgacgttttacagaaactgagcaaatataaaatactcctggaggaacacataaacacaagattgctgctgcgtttcttgagcacactgctcatcggcaaaactctccacggttacgtcacatctttgaccccaaaaggctcaaaacaattagacacgtttcagcaatatgaacggagttagcgatcatacacagttacacagcatgtcagcacggttgatagtcacgtcctttgattgataggttttcctgaagagcgcgtgtttcagcttctattacagtttcgtcaggctaacagaacgtcttagattaacctttaagt

SEQ ID NO: 39940 - DNA, 1501 bp, Oryza sativa
agtcctttattattatcgctctttttttttcgcaagatgtataaagtcctaaacagttactgttactattactgaagttattatctatctttggatatgagttctcccaagtacagcatcacgtgttgttacagctctatcgtttgttttttagggtgtgtttagtttacgaaaaaaaaattggtatcacatcgaacgtttgatcgacgttgaaaggggttttcggatacgaatgaaaaaactaatttcataactcgcttggaaaccgcgagacgaatttattaagtctaattaatccgtcattagcacatgttggttactgtagcatttatgactaatcatggactaattaggctcaaaagattcgtctcacgatttccatgtaaactgtgcaattagttttttaatctatatttaacgcccgatgcatgtgtccaaagattcgatgtaatatttttagagaaaaaaattgggaactaaattattaataaacgttacagctgacaaatgggattgtagcttttgactgagttgacaggaacagcttcctccatatggagaaccctgtcctgaaatatcaggagaaccatctcgtatttggctcatcccaataatccttctttctataaaactaatacctattaaacacctaaaacttaacatcaaaatatactacctctgtttcaatttataagactttctagcattccccacattcatataataaatctatatatatatatatatatatatatatatatatatatatatatatatatatatatatatatatatatatagattctactcattaaacacgcaaaacttataacatataaacatatagtaattatatttacaattatttcattataaaactaaatatatacatgctaaaccatcatccttcaatcattttcataatatttcagttcaaatcatttcatcgtttcttcaatatctaacgtatatattctgcagcaaagcgcgagagatcatccagtgcatgttatgcttgtgctttgaacgatagtttcagcgcaactaattgcattggtactctgtttcatggtgtggaataaaactgccatgtttagtttccttcctattcccaattttccatcacatcatatcacatcaaaaaaaaacttttctacacatataaacttcaaactttttttctaaactctcaactttctttgaacttttattttttttcaggaactaaacacacccctgctagcatgagtttccaaaatataaatatcaggagaatcctatttccaacaaagatattacgtacactctaggagggttggacgagccctcctattttcggaaaaagatacagtagtacacagtaccgtggataggtgggacgaatcgcttccacaaaactacaaaagtgccccgtctcaacgagaaacccgcgcgcgccccgacaaaaattcgcggtggcctaccagcgatttcgcttcactgcagtccgtctaccgaatgg

SEQ ID NO: 39941 - DNA, 1501 bp, Oryza sativa
tcgctggggaggccgcctgcatcgatcactctgggtccgtgcatggagcttattcttcaggcattgttgctgcagaggattgccgaaggcatctgtcgacgcagctaggcatctccgaccttttccaggttgggaagattatcatgagggaggagatgactgaagtcatggtccccttccagatatccaggctgtgaaagaagaacaaagcctgcctatttagcaccgtgtttatcctgcagctgctatggttaatattgtagctgctgctctgtagtttcctaattatctcagatcctgtaccgtttcacagtttgatcgtttatgtgtattcaaataaaaacagaataattatatatcaacagaccttgttctctgaatccatggatattgcttttcatttacacattcccagtcagtactgctgaatttattttagttttcagtgtttgccttgagactggagggctgtagtaaactagtaatcgtctgatcgaacttggcttgcgcccccatttgcttcattttgcatgtatatagggttgtagatgcaggctagttgcagttcaatggtcataaacagtggaggtttttctttctttactttcatacgtagatctccactaataataaaccatacagcatcctgcatattcggaaacgattccaccatcgtgtgaaccatatcaaacgcattcattccactgtaacatctgctgccacaatttgcaatgtccatcccatcctgtagcatcagacttgtaaattgtaatagccacaaacagagaatacattaattccctcccccaccacctaaaaatcattttttttctttcaaaaatacatatttcattaaaaaatctattatttattttcattgtattttgttttatcataaaatgcattttaccatgatttgtattttacatatttacacaaaatatttaagacgaatattcaaacatatatgtctaaaagtcaacaaccacatattaaaaaacggactcaatactacctcctttttaaatagatgacgtcgttgagttttgaatacacgtttgactaatcgtattattaaaaaatacgtaattatcatttaccatattttttagttgttttatcattaaaattacttaaagcattatttatatgttacgtatttgcacaattttttaacaagacgatactcaaacgtaacgttatctattaaaatacaaagggagtatatatattatctgtgttctagtagttcctcttgtaaaaggaagaaaagataaaaacaaactggtgccgacgccaactatttccaccgcatttgggcccacatgtccgggagccaaacgcggctacgcgacccaaacgcaaacgcaaaggcggaagctgggatcccgtgtcgtcgccgactccgactcctcctcctccgctccatataagactcgccccaaccccctcatcaacttcataccaaaccgaaccgaaggaccccacccaaaatcacacg

SEQ ID NO: 39942 - DNA, 1501 bp, Oryza sativa
atactagaaaaacattcaattttcatgcgaaatctttatcgtgtagaaaagagatagtaataatacatttgttgcacaaacattttatccgtcgctattttagacaactacttggttcaaagataaaactgaagtcgtttcaaacagagtttttttttcattcgttgagagttcgagaccaaattctctcttaaattcgactgggagaattcctattagaattgtataatgcattttagtggccgtttttctcttagatccgacgtgtgaaggtgatgagtgcatcatcaaagcagccacgatgacccgacaaggtgcatatatttccttttgctttgatttatcctgaaataaaatcagtactcctactcctaatcaaaagtggttagtacagtaaagaattgtactcctacagaggttatgcgaaagcgatgagcataataattcaattcaagtcgcattcacgatgatttcatgatgctcctctccagtaaggctatcatcataaatcttgtcgcattcctttgaaatttggtttctagtgcttctcttttcgggataaaaatactttcgaaaaaaaacacgctaattatacgcataataaaaggtccccaaggacaaatcttgttatacaatacaatatttgcaagttattcaatattgtgttttattttctatcttttttttcctttcctcatatggtatggctgctttggcgcaccattttctgtcataaaagtctggttactgtagttgaagacgactacgacaccataatctcgagaaaaagacatcatggcagatcgtaatcgtatcatgcaagcctgaacatgaaaacaacaaacttgaaggtcgtccatctacctgaccacatgtgtatggggatatgggctggtattttgatctaatcaaattattaagctcatgcacgttgatgtgccacaattttaccttttttttaaagcatagattaagatttaagaaaaaaaactataatacccttaactaaatattgtatggttggatgtaggaggttggttaggggcaagaaaaaagataaatttgaattagaaacgattgatggaacaaatagtattttattatgataaccattttgagacaaagtttaaatcttaaagagacaagtaatttgtgacggagggagtaagttgtttaatttataccgtttcagttctaatcatatcattgtgttgcttatgttcttcttccaggacgagcaaacacccgttcttcttttctataatccttctccaacaccaatcacaaagagatatcatctattttaaatttttatgcaaacatttgagggtatgctcgagcataacgaaacctagccattaaatctgtttctaaaatatagtactaggatttaccatctcattttaaaatcgaagtacacattgtttgatttacggctcataagccatggaaaaaagaactaagcataaaaataataatgttcacaggttttttttaagtc

SEQ ID NO: 39943 - DNA, 1501 bp, Oryza sativa
ataaattaaacaacttactccctccgtcacaaattacttgtctctttaagatttaaactttgtctcaaaatggttatcataataaaatactatttgttccatcaatcgtttctaattcaaatttatcttttttcttgcccctaaccaacctcctacatccaaccatacaatatttagttaagggtattatagttttttttcttaaatcttaatctatgctttaaaaaaaaggtaaaattgtggcacatcaacgtgcatgagcttaataatttgattagatcaaaataccagcccatatccccatacacatgtggtcaggtagatggacgaccttcaagtttgttgttttcatgttcaggcttgcatgatacgattacgatctgccatgatgtctttttctcgagattatggtgtcgtagtcgtcttcaactacagtaaccagacttttatgacagaaaatggtgcgccaaagcagccataccatatgaggaaaggaaaaaaaagatagaaaataaaacacaatattgaataacttgcaaatattgtattgtataacaagatttgtccttggggaccttttattatgcgtataattagcgtgttttttttcgaaagtatttttatcccgaaaagagaagcactagaaaccaaatttcaaaggaatgcgacaagatttatgatgatagccttactggagaggagcatcatgaaatcatcgtgaatgcgacttgaattgaattattatgctcatcgctttcgcataacctctgtaggagtacaattctttactgtactaaccacttttgattaggagtaggagtactgattttatttcaggataaatcaaagcaaaaggaaatatatgcaccttgtcgggtcatcgtggctgctttgatgatgcactcatcaccttcacacgtcggatctaagagaaaaacggccactaaaatgcattatacaattctaataggaattctcccagtcgaatttaagagagaatttggtctcgaactctcaacgaatgaaaaaaaaactctgtttgaaacgacttcagttttatctttgaaccaagtagttgtctaaaatagcgacggataaaatgtttgtgcaacaaatgtattattactatctcttttctacacgataaagatttcgcatgaaaattgaatgtttttctagtattctcccgtttcatattataagacctttgctttttttttctaatctggctttgttaagtttgactaaatttataaaagaattaataatatctaaaataaaaaattagttttattgaatccaacattgaaatattttaataatgtgtctgttttattgaaaatattactatatcttttacaaatttaacttataatatttttaactaaaatgaaataatatgaaacatagtgagagaggtgagagagggagtagtaggtttggagtggataggtgagcctgaacatgaatgagtcagcgacgagtggaacaaacatgtggt

SEQ ID NO: 39944 - DNA, 1249 bp, Oryza sativa
tgtaaaaattaagttgtcgtagtgaggtgagaagctggagggctcgctcttgttcctctgtcagactaaccatagacttgccactatatccatcccggtgtaatcctaagactcgtagagacgtgagatgtttgcaaaggggcacggaaaggacagaggcatcatcaaccgttagagtttccagttgagaaaagatgtcagatgccccttgctgctgcgacataagctgcagacatgggtatacgctgggggagtcacctactctcaaggacctaaggtttctaatggactggaaaccctcgattgatgcaagcgacttgcagctgtcaattgccaaatctaccagcgctgtgcagtatcctaactgtagagacttcaaatctggactattccacaagtctaatttcgtaatagaagggaggccagaaagcgagaatggacactgccttcaagatttgtgataccaagatgtacaagtgacaggggaaatagtccaacctgattgctgccttgttcttgctcctgcagtttgtgatcccatgccattgacagttcatgattcatctcgatgtccaaacttacaagggagctaaggtgttggaggccctccaaaacactcagctgttgacactccaataactgcagacactccaatgctgtacaggatctcagctgcacagacttcaaatattggctgcaaaatacgcttaacactctgaggcaagttaggccctcaggggcgaagagctgcatgtttgccgggagaggactgatagtgagatattgaaatgatgttgggagtaaccaattatccttggtttcactcaccaatgatgggaccagcctggggcaatccctaatttgtagctccacaagagaggtgaatcctccaaatccttcattgactccagaaaattccaggtctcggcatgcccaaataattaaccactttagagaacggaggagattatatggaatttgcaaaaggtatttgtccctggcagaggttgtctctgctgaagccaaactgttcggtgcttctatttttgtacattgacttgttgataaaagttttatctgtgggcagtctcgtaactccaagttctcaagagactgcaaatgaggaagcattagagttagccatccaccagctatgccacacgactgaatgctgagagaattgacagatgggaggacagggtaactcgtaataggtatactgttatcatgaacaggctttgacatgaca

SEQ ID NO: 39945 - DNA, 1458 bp, Oryza sativa
tcctgcaccccatcctgattgtttttagcacgagtacacattaatgatctttatataccgaacatcaagtcaccacaaacaagaatacactacaaatttccttcgtgaatgtatattaggatactatcgatacaacaaagtacataccaggacagtctactgaattactatgcctttgagtaaacaattaccacgataaatcaagaatttacgaagcaataactaatcaccacgccgattctccatgagtgtggaaatctaatggccccaaatctcacaatgtagcatctaattgcacacaattacaaggcaactgaatcccaattgcccgtacagtgaacaggatcaattaacagcggagacagatcaggaaaccgtaccacacacttgctgaagccgctctgcagcgcgcccagcgccgccaagtccgcatcggaaaccctagcgccgccatctgcacgcacgcacaaacgcatccatcccacctcagaatcgacacacgcaaagccaaaagcagaagaaaaaaggcgcgcgcattacatgaggagaggccggagaggtagacgaggatggcggtgacgccggagaagatggcggcggcgagcgcgagggggagcacccgcatggccggagcagccgaagccctagccgcgctctgccggctttggcccccgtgctctcgccggagtcgagtgtgagagagaggaagcgagcggcggggatcagttcgccatttgcgaagagttcgagggggcttttcgcatattgtgcatttagtgagactttttttcggttttagatttttttaaaaaaatatttacagaaataatctatcggcaaaaaaaaactacaaaaatagaccctgccgcccacctctggggtggcaagctgacgtggcaaacggggggaggaacgggcggtgacggagggagggttttttttgcatgaaaacccttgccgccctctggtggggcggcaaggggcccgaatgcaaaaaagccagtcggggccggctattttgcaggcggccccttgccgccctctggccgggcggcaggcctcgctgcctataaaaggcctgctgcccagccccagccctcattcttctctcctcaattccagtgaaaaaaaaaagaagagaggggaggagaagataagaaggggcgaagccctgccggattcagacgccgatttcaggtaatattcatagatcctatatgtgactattgagttaaatagtgtgtattctttaaaaatttgtttgaataaatgcattatatttttagggttttagttgtactaatctagaagtgcgtattgtagatatcggtaactacgtagatctgctagtttggaattaatacattaccgttgcattggcttacacaagaagatattacgttgtagatgtttattgcatgaaagagtaatatgatctagttatttcgttgacagata

SEQ ID NO: 39946 - DNA, 426 bp, Oryza sativa
attctgttgcatcctagacattcaactgaaatgcgtaagaatagtctaccttgaaccacatgtacatttgtcttttacaagtaactagagtgttttcccacgcaatttcgtgcggagctagattttataagaaatggatttcacatacaactcttagattttgtttctatagatataattatattttgcatacaattgtaagtgatctataaccccacttctattactatacatacaattgtgttttgcatataatagattttaaaaagtagaattggattaatatatattttttatcttctattttcatagatataattatattttgtatagaactatatcaatcgatctacaccatcaaaacattgatataacataatctactggttaatattttttttctttttctccgtggtaatttatagg

SEQ ID NO: 39947 - DNA, 1501 bp, Oryza sativa
tgatattatatgcaaaaacaattataaatcaacccagttgttggcccatgactcaccagattggagacttggagtgtacaaatgtgcagctcagcagcatggtcaaaaatattcaacttgtatcgaccgctcgcacatgaaaatcaagcaaactgacattcatgcatgtgtgtgcttagttgcttacatgttggatatataaaattaaaccgtatgatagcccatatgtaggttggtctggtaggaaggtctaaatttgcaatgtacgatcaataattttttcagtctcgttttgaataagattaagatcaaacttttctaatttcgggcctgttcactttgatgaaaaaaaaacttaccaaattttggcaatggatttcttatatagttaccaaaatttgacagcaaactaaatgtagccattttttttagcaattttactaaaatttgataaggttgaaaataataacaaagtgaaaggcctttcgaccataataactctaaaagtatttaaagtaatagtgctagaatacataaatttatattataaaatactaaaataaaaaattaaaatatatttattatgtattataataaaaaaacataagttcaatattattttagagacgatattgttgttaagaataatatggaggagtggtcatctgaatgatgatgagatcacgatagggagagggggccgcagcatgtgcatgtgccaccgtgctccttttctaattaaaatccacaaacattgtggcggccacggtttctgaatccacttcagctttcgtacagttatttaggccaagcagctgcagggcggggtgagccccagagagaactctgtttaaatgagactaaaaaagtctctatcatattagatgtttggacattaattataaatattaaacgtagattattaaaaaaacccattctataaccctgaactaattcgcgagacgaatctattgagcctaattaatccatgattagcctatgtgatgctacagtaaacatgcgctaatgatgaggacatcctccactattacccgctggcaaagacgcaaaagtcggacggcgaccgtgtgagcctctgaataatcccaccttacttagcttggtaggaggaagccggcgaccgtgtgagcctctgaataatcctactttatttagcttgggagaaggaagccaccttaaaagggagagctacccttctcctattggactagtcttttagggagattgggcctttcctccagtgggtgtgcctatgaactgttggggtccgggcaaccttaagttattgggctataaactaaattgttggggtccgggtaactttaagttattggcctataaactgttggggtccgggcaatcttaagttattgggccttagccaaccccacctggaccagattgttatcagctaattatagattaattaggcctaaaaaatttatcacatgaattagctcatatttatataattagtttt

SEQ ID NO: 39948 - DNA, 1501 bp, Oryza sativa
tgacttaattttcgggttgttttttttagaatttttatttatcgtactctgttttttattcactggcttttaaacagctaataagatgcatatagaagtcttggtcacacattattatttgttactaatatgttcattttgaatggactatcaacgtatctcaggcgatcaagcccgccgccatgatgcgtgtatatatggatgcacgaacgaattagaaacatcatgcattgtgtcggcgtatgcagagttggtggtggtcaaaataggcagtagttagctggtctctgtttcttgcgtacatactgttacttgctatagcatgttgctaaatactttattcctcgagcataagactttatactttattcctcgagcataagactttatagcattacccatataacattcacattatatgcctaaattcattagcatctatatgtatgtgggcaatgctagaaagttttataaccttaaaaggatgcagtattatattattatacatggtttttgataagatttaggtggtgttcttttcttctgaagatgaagatgaagattaagttttttttacgtaaaatgatgtggtattaacgtataattgattgagttttaattattataaacttaaaaaatagattaatatgatattttagagcaactttcatatacaaagttttcgcacgaaacacaccgttcagcagtttaaaaagcgtgccacgaaaatcttaattttcgtccaactcttgttggagaaaagaacgggaccttactagtgttacatactccctcctaacacaccctccatcctaaaataaaataatctcggactaagatgtgatatatggactaactcatattcacaaagccctagattttttggccgagctggatttgaaccagcgtagacatatcgtcaacgaatttatagtctgtccccattaaccgctcgtgcatcgacgctggaaggatttattctagggtttttgataacctacaattaacatactttcataatactcctaccctcaaggaagttgaatcccagctgctccttgaaagagagatgtcctgaaccactatatgataggggtatccatgtatcacattttagtacgagattaatttattttgggattgctctatgtataaatttgttgtactaggatatgtacgatgttggtttattttgagatgaaagatgtacttctaaacatttctgtgatttcaagtgtacaactctgcattccatagtttccatctcttcataaaacaatgtacattcgacggcccatatttgagtcacaacaaaaggctagtttgggcccggcccacctatacaactcctacgtaattggcccacgtgtccgcacatgaatcaccgtaccaaccgcacacgtcatctcgctcttgaatccatctcagccatgaaaaatcccttttctcctctgccgaataaataaataaataaacaaacaaacaaacaaatcaaaaaagt

SEQ ID NO: 39949 - DNA, 534 bp, Oryza sativa
ctgcaccccagtttctcatgccgaagttttggtgtcagcattcagcaatcctgtgagtcatgcatagctgaaggttcatactgctgcctgtctcatcaaaagttcagattttgcaatgttgtttgggaaggtaaggtctacgcattgtccctaaaacacagcaatttttgtttctcacaggaaacacgtcagctgctgagaaggcaatactgaagacgaaatggtctgtcaactgaatcttgaccactgcagctatttgtaatagacaaaagccaagattgatcataaatcaaaatgaagtgcatggcaagagttgtaacgtgactaaagaagaatgcaaggatcatggaaaaaaagctgagagaaactggcggatgcattgccttcatgtcagtatcaacatatagctgcgatgtgcctctctggtcaagtgatggcctctgtgatggatgatcttgtagaacatccaggaacatggcaatcccgattaggcgattaaacaaggagatcaatctcgcgtgtcatccagcaaaa

SEQ ID NO: 39950 - DNA, 1501 bp, Oryza sativa
ggcataaccaccttgacaggctaaccatttcagacagaacatagaatgaccagattagcatcagcatgacagatgagatggtggctgtcagggtcatgcattgcaatggcagggcacaagaaacatcagtgtgaaggcaaaggcagcagacagacatgctatgcgtgtataacagtatatgtaaccaccaaggattgagatactttactggtcagaattcagtaatggatggtgagtgaggaagctgtttatgcagtggattgctgtcctgtctccatggaagcctgcagggtgtccccatggaccatggtgcacatgtggaatgagcacaaaatgttgaaggatagtactcaatctgggttactactgatattctgtgtttgcatatgtttgtgcttgatctctgatttgtttgtttgtttcagtttccataatatgcagagcatgtcattgcatttaaatatagaaacatagattgagtaaatttatatttaccttcaaatgcaattttacaatggatttacctcaagctagtactatatacaagatggcagaggtaattaggaggataatcctgcaaaaatccatgtaggtgcaggtcttaaaaaagagagatgctgtacctgtgatgtctgtccttgaggaagatgagttgacaccatgtttgatgctctgtactccttggcagtgttctcttctcactgtgtttgtccccatggttcattcaaccactcttatgatgaacaggggcaactaaagctcaccttgatcagtacccttaaaagcatcctgtttggtgagatttcagtcatgattcatgaacatggactctacttgaacctgaaagatcggagtatcagtttctgtatgtggagatggcacaaaattgcaggcagtttactgagctgagatgacttagcctagcttagcagattcagagagttcagtctcttagctctattctgataaagcgtaaaaatatgaacgaagcaacggaaaaataatttatggataaaacttttatatccggattatttatgattttaaaagccaatgttaaaagtagaccactaaaaaggacccccaaaattaactatacaattattaagtttcgaaattcaagaggtttttcagacttttgagctgtggtagacggtagacagcaaagctgggtcaggtacagtattgtactgtactgatgatcaggttgtgatctccaactccagcagctagagagacaagaagacgacagaaaagtacacgagctcaactccatttgcagcagcagcagcagcagaagcacagctcaccacctgtctttttccgatccaatcgccgctataaattcagcagccaatgctgcccgccatgtgcagcagaactcactcacagtctcagtctcagtctcactgcttcagctcagctctcctctcgtagctcgacgagctagctagcccagctacgacaatcatgggggacgcggcggcgggcgggaggaagg

SEQ ID NO: 39951 - DNA, 1501 bp, Oryza sativa
tcattttcaaacttatgcttacacttataagtaaaaatttgtattttaaaattaatttcggggtttggttttatgttttttttctcatagttcattttatactagtatttgcttttaaattgctaaggacacgtatgtaaaaaaatacctacaaattactttttaattactaataagacgtacgaataagcataaccataaacaaaacgctgagtccagtagtatttcaaacatgacacaactgagaaatttggaggttttgtttgaggtggtttttcagattaagtccatcaaatcagatcgagttttcagtcaggtttgaagtagccgatcccaaagttcgttctttttcatccggtcacagaaaaacatcaagggaacgaacttgtttctgcactgactttcaggcaatatgtcattaatcacaaaaaaggaatactgacaaaataggagtactccagtaactgcatttctgatcccgaggatgaagagacagctactacagctgacaaaaataactgcacgcattcatcactctgctgcttgctgttgttttctgtggcagctaaacgctactgtagatttccgtgattctctccttgcagaaaatacaagtgcgaaattaggaatcggattataccggtcattgggggtcaagatactccatttcagaatttcagacagagacaagtgtgacaggtacttaacctccaacttccaaatgcgacaatttccgttaatcaccggatcaaagttccaaatgcgacaaacactggatcaagttccagctacatccaaatttttttgaaacgaccgagtgatctagagtagagatagagagatcagtttcagtatgggcatgtttgtgctccttaattgcttgctctatgtgagtcttcgccagtatcagtcctggtagttgtagcatcatcaacagcaatgagaaattgatgctagtatgacatatccacagttaaccatgtgtgtgacaaattgccatattccttgccaatctacagtctgttcttctattttctaaatttgtttcatgaccacgtcctatttttgctaatcaaatacggttgatattactcaattgttctagaatttttttcttcaaagcccatggttagatattccaatatatcacgatgcagaggtcggaagtgtgcttttgttatctagagaaaatgttccgatctgttcaatatgttcttgcttcctaccaaaccatatcttcgatcgaaagttaataatggaaaatggttaaattccagcttgaaatggagatttgggaatcacaattttacagccttgatttaattttaaccaaacaggatatattccaatttggggattacaattctatagccttgatttaattttaaccaaacatggatatattcctttcctgttgatacacaaacccgagttagtacactcatatcatgcaaatatcattaatataaggggcctaaacgaaaaaaatatccctacccgt

SEQ ID NO: 39952 - DNA, 268 bp, Oryza sativa
caatgcactgtagtacaggtgggttggttgggcctgttcaacgtggtgtagcgttgatcagtggagatctaatttactttaattactcaacagttttactgttttgctcaataaaatgttttacaaccgcctttatgcaaatagccacaaaccatccttggatccccttgcacgtctgcatcgttggtgtggcttgctgagtacggtggttgtactcaatcttgctattattccccctttttcagaagcgtagtgcttctgagctgaa

SEQ ID NO: 39953 - DNA, 272 bp, Oryza sativa
tttggaactgtttattacttgtcgttttgtgtaccctggctggtcctggacagggatttaatacacaaaatagtctggaaatttgggctaaatttctgggcgtgacaaagtggtatcagagccaacttgactgtaggttgagccaaacggtcaaaccctaaggacaagctttctgaaaaccctatttgaaaaatgtctcctctcgcccttcggcatttctttgtcaaacggtttttcaaaattctcctcccaatctctccaattcttttagt

SEQ ID NO: 39954 - DNA, 743 bp, Oryza sativa
cctcaactactgcttttaaatgctagctttatgcaaaagaacctctagcctcctttggttatatcctgcatcatacctcctcttccggtatgacttgctgagtacagtgggtagtactcagtcttgctctcttttcccccacaccagagctgaagatcttcctagttggagctgttttgtcaaagttggtttcgtcgctgccgtcaaggattgcctgtggagtggagtcgcccgctgctgaagtcaagcttcccggtttagctcgcttttatcttttccgctgcatttgtaatcttttctatttttgtaagacgtggatctgtatgtcaacaattatcgtttgtgtaccctggctggtcctggacagggatttaatgcacattcagcttagaaattctggttcgagaatttctgggcgtgacacgggctccgaaactacacgcgaaacgggacaactcaacaaactgcgaaaataaagccctattaatgacctctaagcgtgccattagatagatctcgagatttgaggaattttggaagttgaacggagtcaaacggatttacggttgggaagatattgaatttctaagattattggatttttggtctaaaggaaaaggatttaattaaatcctttttggaaaagaaaaagaaaagaaaaggaaagagggagggattatagacttttcctcgggcggctagggcgcggcccaagggaaaaggagcggaccggccgagctaaa

SEQ ID NO: 39955 - DNA, 393 bp, Oryza sativa
acatatttcatccagccagattatgatttaggcattgggtcttgtaatgatcaggtcgtggactaaatcaaagagataaacgccttaagtctaaccatatagcgtccctaatcatatttattcagtagtcattatcgtttagagttgggttttgctaagttatttctgtcatcgtagtttcgtcgctagttcagtttgtgcaaccccaacttcgaatgcttaatcataatatgctaattcagttgttgtctaccttgttttttattgtgttcatcgattcgcatgcagggattaaccttcttggtgagattaaccgggcagcgcacggtttataacatgaggagacggttgcctggttgataacctgagtaaacgtggtgttgcgattgcagg

SEQ ID NO: 39956 - DNA, 1501 bp, Oryza sativa
gctcggttcactttgggacaggtcatacaaaattttgcttgcatgaattagttatgtcattttggagttgtggtgtatgatgttccgtgtttttcattcaggctaaggaagaactgttaagagttcttggtttgcaagaagaacaaggaagctcactagaatttctcagaagaggatacaaggtttgcatctttgtctcactttaattgtaaaatgcaaaaatgattagcataatcagcttcatatcatcatgctgatttcaaatgattcgttcgatgtacttctatccctgccacctcatgtgcaaactccaaattcaatatgaaagtttaaacttcattatcgtagcaggctagcagcctgtctcaaaataaaactttaagctctattatggttgcacctccaaagtaccttttgcaaatctgcatttcgtcaagagctagcattgttttaccatctaaagagttaacctgtaataatgcagaatgctacttggtgggaagagaatgttgatcaggagaaatcgtcagcatggcgaacttgaggttgaggccctgctgctgccttgtctgggtgctgatctgattggcggcgagtgcagacaggaacagaagaaaaaaatggttgtctgaaattgcagagcccaggcgacaaggatgcaaattgcctgtgctgcaattgtacattttgtgattgtaacatgttactgtgtgagtaacaggcattagagttttgagaggattttcctttctttttcgatgattatatatgtgttggactctgcttctttgaagcatgaagcaacttcacattttaaatggaaattcgtgttcatccaattgtactttctccccctccctaaaaagcaatatgaatggaaattatccttacaaaaaattgtttcggccactctggagattattctttttcatgctaaaatatgattatgattatttttattttttatcaagacaacattttttttcctttgtgatgttctcaaacacgataagccgtaggaaaataaacaaagcaataagaatagttcattaataaaagtgaatgctggaaaatagaactatcataaaaaaatcccctaaaattaccttgaaaataaagttttaaaattcgaattttgactttaactggtaagctaatatggtaaatatggtaaggttatgctcgttaagtattttagctttaaaaacttgaaaaattgattaatatgatctttttacaacgaaaaattcgcaaaaatgcactatttaatattttgggaaatttatgcgtcaaaaatgaggaattagaagttcgaatctagtaataagtattggcaataactctcagaactccagaagcttctattagtagggacctgtataaagatgcgtgagagctcaaggtcccatctgcaaaaacaccaccgcgacgaacgagcgaagaagtgggaacaagacttcaagagagagaggagagagatcgcggccggggacggagacga

SEQ ID NO: 39957 - DNA, 1501 bp, Oryza sativa
tgagaacattcgaacatgagacaaattttgcatactaaaattacggttgaaagcaacacagttaactgattcagggggacttttgcaaaacgcctatttctgatgcaatcatggtttgcaataacgattggttttttgcgaaaatcacttggttttcgtgaagttgctggggataggtttgtaaaaactgagttttttttagccaattattttattatgggcttgaccgaaagtcattggtttttatcgggtttcattcggtttgcggcacaccgacagaagtataactagatcttgttctgttttcagatatagtttacacgaaggtttcccagtgtttaagaaatcattcaagttctgcactgaagaatttccacattccaaatgggctccatgaaccaaaattgtttttcattggaggtgtagtgtataactacgacgcattcctttcgcatgtacccatgcatactatcttgtgaaatgctcgttgaatcaccaaattatcctccattaattaaaaacccaaacgatctcgtagtaattcctattaaattcatgtaatattccaacagagcccatagtaattttgagtgcaaatgcagcaatactttgttatgtactaccaataaaaattccaacttgcaaaaaaggaaaaaaaaacagagaaaagttacaactttgaaatccgagaccaagagcacgcggaagttgactttgaaattcatcaatttgagtcctccgatttttccgaggggcaatatgcaaatcgcacaaaaaaaatgaaatttatcaactcgatttcccctcatttattgactgctactagtagtaccactatagaaaaagatcaggtcagaattattattacagtaaataaaaaagaaaataaatgcaaagatagaagagaatagtagtagtatagtgagtctcgtcgcagtgagagagagagaggagtcgagtagatagatagatagatcggcgtgggagaagacgacatcgccggcgacgagaccagatcgatcgccgaggtatcgcctccctccccgaccgagcagggtcgccgccgttcgttcctcttgctgcttccgccgcatccatcctggtgagcacatcctcccgccaccgccgccgatccccatccatcgcgcgagcgagtcagggtcgccgtcgttcgcccttctgcttccgccgcatccgttttgcgttagcccacgcacttttttttcctcagatttgcgttaaccctagctctagctgctcctgttctagaaatttgccttggccataatactaatagcagtttgtttgttcccaaaaaggcccatgtcccatgttagatccgccgccactgtgctactgatcttctccgaattgtataatttaacgcatatgctcttttgtatctcagcggggactaaaccttgaagcatctgggctgttgtttcaccattgtagtggattccacttcggaactgaacttttctagttgtttccgtgacaa

SEQ ID NO: 39958 - DNA, 1501 bp, Oryza sativa
gcaggacaaggcatgaaacttgaacttacaatacaagatctagtccccttgagttccttaagttttctggcaacagcaagagcaagctggatgttggcgtcgatgaactcgtccgaggaacccttgaaaacgaagcaaagcagggtaggatggttagaaacaagcgttcatcacacgtatgtggcaacaaaagctaaaccctttttaacttgaagccaaggaaaaagagagattctgctttgaaacaacattatacagaggtagcagcagcattcaaactgaaactagagcagtctatataatatacatcaagattagtctttgcattgttacagaattcactcataacaaagcaagaaactagaacaatgagtgtgagttatgagacgagcttgagatagaaatgcaaagtataccttgtaagaagagatgttgctcggcagaggccttttcacaagcaccaccaccaaaaaaaaaaatgagacaaggaggatgagataatgcaagcattattaataaccaactaagtaaaagattaggcgagatggtggcgcgaatctatggaggaaagggaatgaataggtcgcgggcgtacgggaactcgatctcgaggcgggtcttgccctcgtccatggcgcaggcgagggagcgggcggcgtcggagacgagcacgtcgtaggaccgcggcttgtacaccgacacccccgccctaagcgcctccacgtccccggcctcggcgcgcggcgagcaccgtgccgccccaccacgccgccgcgggaacgccccgagccgcggggccacgaccggcggcgactggccgcacaggcgactgcgcgccgcgggagcgggagcgggagcgcgcgggcggaggccggagagcggcgcgggtgtcgccatggccacgccgccgacgacgacgagtggtggagaggaggagacgaagtgacgagcagcgccactgcaatccacgcgggcgcctcgaggccaccacctgcctcactgccacgtggagcccgcaccaccgcaccggataaatccaccaaaaataaattaaaaaaaagagagaagtgaggtggaggtgcggggaatcgaaccccgtgcctctcgcatgcgaagcgagcgctctaccatatgagctacacccccgatgctgatctcctcgggaatcgagccccttcatatccccgccgtcgccggggaagacgacacgcccgccgtccttgtcgccgaccactcgccgccgccgtcgagtagtaaacggatggacggtccagatcaccccgaaaggaacacgctcgtgcagatcgagccggcccaatgcgttaatgggcctagcctgttagcgaatcggatcgtgagtccagcccgttaagaggcgcctctcgccgccttggtttcttttcccctcccgagtccagactccgcccgcagccgcatcgccaacgccatagccgccgaggttgaggtgagccaccgagaggggagagagagcgcgccgaga

SEQ ID NO: 39959 - DNA, 1501 bp, Oryza sativa
tatctgcctgtctagaagttagtaatgaattgaaatccaacctcatctgttgtatctgcacttctcagttattacttattacgtattaccgtctctgaaatgtgtaactctcgtctctgtttaaatcaagcagagacaaatattcctttttagcaaggcgaactgatttttttttgttatttcacttaatctgttgcaacacactgtattttgctagcactaagaaatgtacagagtaactccactgacggattaagcgataaaaaattcagtaattctacatgtattcctgttttatctagaacatttgactagactgattctaaaacagctgaataaaggaagaaattgccacgaagaacaagttacaaacaacttgccactagtatgttttgctactaattaacaactttattgatttcttcttgacaccggaacgtacgggagattgggcgacttactaccatctgatcatcttatgttgacctgtgctaatccctccagtgcaatcgccaaatggaggccatccatttcacagattaattatagctgttaattaatctctgctactgacactagtgtcatccactcacatccgctgacttattccctaaatcaccgcctgctaaaaggtctcctctcctccatctctattgcccactaaactaagctccatcatgatgtactataacattagcaggaaaatgacatgaaacaaaatgtatatccttgttgtgcttcctaatggatccaagaaaataagccaaacttactaacaaaataacttaatccctggtttcataattcttgatattttgaataagattaagatcaagacaataagaactttgactatcaacaaattttaaattatttaatttaaaaacactaaaacacgatgtatagattattctcgaaaagaaatttaacaaaatcaaacatttttacttattttttatgtgttataatagaaaatcatagttaaagatatattttagaaaccatgtagatatccaaaacctgaagaactatggaaatggagagagtactctgatacagagactacgtctgaacgcaacaatttcacatgaaacaaagagttagatttactccatcatcttaaaatataaaaagaaatagtttggtccctcttcctagttcatttggtctatagagttacatgacctagaaaatgaaaagacacgtcagtaagcaaacaggctttgaaaacaattaacctggagaaataggagtttaggacagctcatgaagctagtatcaaacttaaccaaagagtcaaaccccagacatgctagtagtcagttagttaaccaaccttctccctcctctcttccacttcgtgcaagcatgaagcttagcaagctcaagctggatcggatcatctgatgtgaattctctctcacaccaattcaccatggatggatgcccatgaccatccttagctccaggaagaagaagaagaagtgaacagtagctatag

SEQ ID NO: 39960 - DNA, 1501 bp, Oryza sativa
atgcttggtgttttaccataaacttccatcaatttggatattgcatagcaatttaagtatcaattcttctttttttttttgaaacaacctgcaccagtgggacgtttcaagtatcaattcttccattcagatgcatcatactttgttaagagtgaacaatccgatttgctttacttgtccatctctgtacaagtacaattgttcttgtacgatcaatttgggaaactacactgcccgtggctaatggatgtttccatggcttctgtttctccaggtcgacgtggaaaggatgcgagcccgtgcgcaggacaagctgatgagccagctcgcatcggcgagacacactgccgacgagaagcgggccgcggcggagctgaaacggagccgtgcggctgcaaagacggcggagcaggcagaccacatcaggagaaccggcaggatgccgtcctccattggctgctggaactggtgctcgtagtagcgtagctaagctcaagcaactgaagcaagcaaaaagctctcctcactatgtctcgcaagacttgaagcgccatcatctgtttttaccgtgatcttgtagaatattgtcttttgattggtttcagtagatataagtcagaagaagacgagtcacttgtaagtaactatggagcagtatataagatgcaagcttcttgcctttttctgtgctgtgtgcttgttatcttgtacttggatgtcaatctgtcacagtgagctacaagcagctccaccatgctgaggaggtgttgaggctcaattcggattcccggatcaccagtgcagtacagagtatatgtgtgccgatgttcatcactgatgtgagatagaagaacaaagtttttacggaaattcttacccctttagtcctttttactcgtagcgattacagtggaatcatgtttggtcttcacatgtcaataaaactacacaaaaattagtacaccattcaattgttgcaaatacgtggtaaggtaacctctttttaaaccaaacagaacaaagaaaatctggctgggttgtttcctggacaattttttcttcatcctgtgcaacggtttcaatcaataacatactggtaaaatcctttttttaaaatcacacatgaataactgatagtaaaatggaaacatcactcccagagatcatacataacagaaagacaaacataagataaaaggagtgattatatgaatcagtactccaattcacctcctttttcttttcaaaagtcactagatagatattgacttaatctcggttttcatgatctcactacattcctcctgaaggtgatacactgatacacagcagaactttggatcgatttgatatcgaacaaacctcaacgagcattcaaatcaaatgagccctaattatgattcaccttctctcaagaagataacacagatattaattagacagttcaccagcaaatctgataagctacagtcctactactcgaacttcttgataagggaga

SEQ ID NO: 39961 - DNA, 473 bp, Oryza sativa
tcctacaaccaatagggcatatttatggttttggctctaattgactatcataaagccacagccaattaggtttacccgtatcggttggtcctgacaataagtcatcggccctatcggccgattggctatcgttcatctaattacgtttttgtctttcttgctggtgcaggataaaatcagcctacatgctcttgacacttgagacaagccttggacctgcactggagtgaagcaaatctcctaagccgccgtgttttcagtcaacacacacgcgaaatcaatttagggtttgcctcctcctctatacagtgttgtcgcacatagtttattccatcctgctcgccagcgtgcaccagtgattgggagagcaggtctccggaaccctcgccttcgacgtactgcatcgggagaaggtgacaataaggtttttgggaagcgctttgcgcgactgcttgctgttcatccacaatagc

SEQ ID NO: 39962 - DNA, 923 bp, Oryza sativa
attggttataaggccaggcttgaaacaccagaggggatcatgggctcaggcatacgaaaggagcccagtgggctgagcatctgtggctggatttgtacttggattggatcttctcttcagtaacattgctccaggtacaccaaccttgaaatttgaagtataacactgccatcatttgcttgaggattatcagccgcgagtaaaatttaaattttgaaacttagttttagttttatagttatcttttgcatcgacttttaaatgactaagtttatacatatataaaaattttactcataattttttccatacttcaatcttttttcacatcttatcagttatagagcaaacgacgagcttgggagcatttgttttattttaaaaaaaaaacttgaggtatatggtctacacactcacacaaaaaagaattgtgctaacaactctacaaaacgcatactcaactagtcaactctatgtttatattattaaatcacgagtcacaccactctctttatgttaggctaattgacatgaaacaaacttttctaaacctaatcagagtaaacaaatcgagaacagatgcagtagccagtagatgacactgatcaagttgatcacatgaaacacaaatccaaaaataaaaaaaacacaaaaaaacatgatgaacaggaccacatcctgtgctatacacgctcatcatcttatctccccttttttcccagcatcttcctcagccaccaacctattctcacttttacacccaacccctccaaaaaagtataaaatcacaacatcacccctctccaccacagctaaaaactactaagcgaggactcgttagacattacagttatatccagggtgcaatctgcaaaagtctcatccccaaatccccaattcttccccgacctctcgctcgcgga

SEQ ID NO: 39963 - DNA, 509 bp, Oryza sativa
tgcagttttcttcttggtgaggacttagtgcctcttaagtaagtatttatcgttttagttaatttgatgaatctgtatattaaattgtcagtttgtgtacctcggctgattcctggacgaggattttatgcacaaataagttcggaaattactagtgaatttccgggcgtgacagcgcccaccgtgcgcaggaggtggaagtagacctgcgggttcgccaggaacgccgcgcgggagatgacgtagccggcggcgcccggcgccttcatcatatcatcgccgccgccggcgccgaggccggccacagcaagtacaagaaggcggtcgacccgacgcccacggccacggcagcgatcatcgacggcgccgcaaccatcggcactacaagtttgtaattccagatcgcgcgcgtggagaccaacgaacaatggaggagatcgacgaagagatcaagcagagtgaaaggtgcggccactggtggtaaagctagtggtaactggttttataga

SEQ ID NO: 39964 - DNA, 159 bp, Oryza sativa
tttctttctgcattcaggtatgcttttgtgttattgtgagatataaggttaatatgcattattgaaataactatggttcaagagcttcacaaatatgttctgttttcctcccaaactttacttggagagaaacctacttgattctctttatcttacagg

SEQ ID NO: 39965 - DNA, 444 bp, Oryza sativa
attttttttctatatagccctttaaattaaaggaattgatcctataaaatcctatgaaattcctatggattatctttttccatacaagttttgcaagttttggaggaaatttgacatgagatagaacctcatggaaagaatcctttgagtctttatttctcctcaaattcctatgtttttcctgcggcccaatcaaacagtcatttctatgtctttcctgtgttttgcaatcctctataaaaccagttaccactagctttaccaccagtggccgcacctttcactctgcttgatctcttcgtcgatctcctccattgttcgttggtctccacgcgcgcgatctggaattacaaacttgtagtgccgatggttgcggcgccgtcgatgatcgctgccgtggccgtgggcgtcgggtcgaccgccttcttgtacttgctgtggccg

SEQ ID NO: 39966 - DNA, 1501 bp, Oryza sativa
aaggcgattagttgatgtactagtactaatgcgtacgttctagcagccatcattttctgttaggcattgatatgttaccggttttgttttccttgcagctcacatggagagaggagaccatccatataagctgaaacgtacgtcctttctttcgtacgagcgtgacagatgatcacaccatctactcctatattgcaggcatcaaaattcactagctttaattgaaacaaattgtttgcttcagtgcttcacactttatgttcttttttttttaaaaaaaactttattctactgtatattatttagaccattgattttaattttattttcaaaatattcaattcatctttacaattaagtaaataatagtatggtgatgtgcgtgtagctgtagctaaggtccatggcgtacgatgtggaaaggcgtatttgcgtgtgtaatcttcaagtaatcgcgcgcagctcgtactcaaagacgtttttctgactggttttggtgtctctagcacgcattctagagtggcaaaagggccgttagaacttagaacttagaacgactggctgtccgtccaagagggtaaacgaaatgatataaaaattgaaggaagagtatatcacaaatttgcagcatttttttcttggctaacatttgatcatgcgaccatatatcgtggctaactttttaagccacgtaaaagcaagcagttgtcattgcaatctaacaagtataatgactctcaaaataatagcctagatgtattgtatttgtttgtttataataataaaataacctcttgatttgaaaccgaaaaatataatgattgtaaaaactaactgcataaaaactgttgtaacatagtttcccgagtgatcggactaatcaaacatatttgattgtctgcggtgatgaacaacgcaaaacgtacttatgaccaataacctagcaattatgcttataatgagaacaaacaaaataagttgaaatgttgaatcatacgtacgcaacaatgttattgaccaaaatgcacttaattgccaagttcatgtaccggtctgcatatttttcaatttgttacactaaatcacatccacctgccaagttcctacactacgtattaatttactctttttgaaaacatgaaacaaataatctattccattaatccgataaataaataagttgaaaagaacatcgccgttactagggatgaaaacggacggaaattcccgatcgaccgggcgccgtttccgtttaaggggtacagtttccgactgtaccgtttttggctatttttaaattttgttttttctaatttctttctacatcgtattaatgtcgatactgagtagtttaaatgatagatatggtcaattaccggctgatcgagcatcgtttccgaagagattctaccgatttcgaccctttttacccgtagccgttaccatatcttcccctcttgagccaaccatcccagatgttgttggtaggcaccatgtccat

SEQ ID NO: 39967 - DNA, 1501 bp, Oryza sativa; identical to SEQ ID NO: 27305

SEQ ID NO: 39968 - DNA, 327 bp, Oryza sativa
ttgacgcgaaaaaaaaaggtttgggagatctgtttagaccgagtttagttttaaactttttctttaagtttttaacttttctattatatcaaaacttttctacacttataaacttttaactttttcgttacatcgttttaattttaaccaaactttttaattttaatgtgaactaaacataacatacccttagcttcagttgtagtacaggtttaaactttaatacgatatcagatatgtaaattgatgaataattaaagacgacggctagctggtgaaggtgtagataataataagaaaaatgaagaagcggtgcacttgacaagc

SEQ ID NO: 39969 - DNA, 290 bp, Oryza sativa
atactcctatatacacggtactcctagcttgtggttcaactttagtactactagtagcttgtggttcaacacgtctatccgaagtatataagaacccacgccggcctcagtgcggatgaggccgaggggttttttactttacccattgccctcccacctgctccccctcctgccctcccaccctcttgtgcgcattccgtcgagcacgtcgcgggcgcacctcccgccgctgcctcggcttgccccaccgcggatcgcagagcgaagcatccccgctaggctactaaaga

SEQ ID NO: 39970 - DNA, 348 bp, Oryza sativa
aatgagagtccaagtaggaatccaaattaaaaatagctgaaattcggaattaaaaatacaaatattaaaagaagagtccatgtaagaacccaatacaagattaattaaaattcagaataaaaataaaaataaatctgaaattagaaaaagaaaataaaagaagagttcaagtaggaatacaataaagagtaggccgcggacgggctatagagaggcataatggcatcgtttaatgggacttctaaaaattataaaaaatgaaactacaagtctaatttttaaaggtttggaacttctaaaaagtaaaaaaaaaagcaatgataatcatgttcgatattaaaatctcaa

SEQ ID NO: 39971 - DNA, 1501 bp, Oryza sativa
  unsure (1)..(1501): unsure at all n locations
gcaccagattcgtgaattttttttaaaaataatattattttaatggaaaatcgcaaaattataggtcggctagacgaaatcgcaattttagcgccctgtcgaactggggcagttcgataggtacccctgtcgaactggggcagttcgacaggccctagttcgacaggctagttgtccaagaaaaaaaataaaaaagttcttgaacagtacccgatagggacgtattaacagggggagttccatagggggcgtgggatggacgtttctaacagcgggagttcgatagcaagggtcgctccagtgtcgctccagtgttttccctttttttatgttattttattacctgtcgaacggtaccctatcgaattgggncagttcgacaggtaccctttcgaactgcctccgttggacagggtgttaaacttgngatttngtttaantnacnnataatnnngngntntnccattaaaataatattatttccaaaaaaaactcccagattcgttgccggttatctttcctagcagcataacgtgacataagcatacatgacatcaatcagggaatcccatcttgcgtcacacttccatttcaccttcatgctttccacagctttggtttcttacctttttcgatttcgtcgttcactgttgttagtcaaggtgacctttcactgttgctttgcttgtgatgcgtagacaagagctcatacttttgtttcgttagtgctggtggtacatggtgcacctcctatctttaagacctttttagccaaaggaatcaccttgggaccgtgcaaacaatcaatcaatgctgtagtatttaccaatgtcgaattccttcgtttccaagtaagctctaatggtgtatactacacagagtcaaaccttgagctcttaaatcattaatagattcagaaagttattaaaaatccaatatatagataaaattattagatttatttacttttatatagttatattcttaataactttataaaaatataattagaacaataatgatgatacgtatatattgggactgctccattcgtttcataaaaatacaaggttagtatgggatgtgacatattaggccattcctaacccaataattaggatgatgtccatagcattaaataagttgttacctagaatgaaacatgatgtggcaatgacaaaagagaaggaaaccaggtcttgcgtgagacatagtttctatacaacatttaaaacatcatgtgagataagtagcattaaatttaagtatgaaagagtggtgtttgcattgagaaagtagtgtctagggagtactagtttttaataatatggagtttatgaaaaccatgtctagtgttttgggttggaactggtattatgtactagatttttctaataagaatatgtttttatttttttaaattctttttggaagttgcaactttatagaagtttactatattactgtagccatggccttctacataagcaacggaagactc

SEQ ID NO: 39972 - DNA, 1501 bp, Oryza sativa; identical to SEQ ID NO: 27301

SEQ ID NO: 39973 - DNA, 913 bp, Oryza sativa
aataccaataatgaaatatttaaattcctcccattaaacaaaagatattagcataaacataagcagtttgcttaattgaaaaccataaacatggttatacttgaacagtatagctatgtcaatcagtttattgttgtcctaaaaaatccatttcaagaaataaacaccccaatttgtgagagcaagttaatagcaatgggcaatggcaacttgcaccatgtatagctaacttggtgacagtacacactaaagggacaaaagaaagttgtagtttcagttaaagcaaggccgggtattaatttacttcccattatcttaaaaaaaaaaagggaaatgaaaccgaatgcatcaaatgaacaagttaagtaagctggtcaccttatattccacctcgaaattaactaaacaaaagtatcaaaccatatgtcatgtaaagctggccgcgccatttataccagtccaggagttgtcagtaacttaagaccttactggcctggttagaggagccgcttaattagcaaggcgtccgtgcatatttcaactgaagtgctgctctaatgatttccagaaataacgagacaaataatacaagtttaccggcctagctaggctttggtaataagcatcacttgtatatgctacagtacacaagagtataagcatatgataaacctagataagcacactaattaaaatttaaacatatctttctttccgcccgtactgatgaagcacatgaattttttttcacctattattccattcctttttatacaaaaaaaaatggaagtgaacgtgttcaccaatgctacgatgattgatgagtccccaagaacaaaactgagcagcatataaagctaaatcagcaacagtgcatgtaccaccactgtatattactagcttctgatatgca

SEQ ID NO: 39974 - DNA, 490 bp, Oryza sativa
tatgtacggtccgatcatgcggaagggatagtagttagggtttgaattaatttctaacttcattctacggatttgtatggcaaccatttgatttaaatcagcaaaaacttggaacatattttgtgcggtctaatatttaatttctttttttttgccctttatactcttttttgaacatattaagtaataggcctattttatagtgaaacttaaatttaagaaagaaattgtaatttataattaatactgtataaagttacatttatataacacgcttatctctacttattataaaaaaaattgaatgatgtttttgcccgtaatttttttaagaaaaaaaattgttccaatagtcaaatgtgccgaatttaatgatagaaccggcacctatttgtgttagaaccggtaccatctcctttacttaaatatccctcactctctctctcatcccttctcccttatcccttctctcggcgcggcgccctccagg

SEQ ID NO: 39975 - DNA, 378 bp, Oryza sativa
ccacatgacattgtgaaagaatgcaacatttaatagaaatgcagggtgtttgttaattgggtacaatatgatcaaatgtaaagcatgacttgccttgctctcgaactgatgagacctcagcaacgtcttcgagaaaccgcggatcgacgaaacggccgaaacccacgcgacaaacaaagcacacaagcaaaacatgctataagactactgaaacaggaaacaaaaccatttttaatggattctttgcatttttcttgatttactgagacttgaatggacttaaacggagctcggatgaattacttatgaattttagaagataaactgtgtttttactaataaagaaaaagtccttaattaattattgcgcaataatac

SEQ ID NO: 39976 - DNA, 1501 bp, Oryza sativa
agctctttatctaactcatcttgataacctttatgccgattcaatataactccatattttttgctcaaaaatttgcaatttttcatatatgtgcccccctaattttacaatgtcaaaagcattgataaaattataatttgtactaagggcgatatagcaatatcagccattgtacatcggcaaaccatatccgattacaatatgaaaccaactaagggcgatataacatcggccatctcaaggcgatgtgaatacatcggctataatgtatcggcaacaccagccgatcatgcattaacccaaacacttgagtaatatttcttcaaatattttacatttagcgctcgtccataaacttctccatcgagtccttgcaacatgtaagatcccctagatacaaccttatagatttggaacggtccttcccaattcggtgaccacttgccaaatttactatcctgagtcccaatcggcaaaatcaacttctatacaagttcaccatccgaaaaagtcttgggcacccccttcttgttgtaatgttgagcaactcgttccttatccttggtaacctttgcaagggctcgcaatctagattgaaccaagtcttccctttcatcggctatgagattataatattcatcggctgtcaaatcattttgcaactccgttcttcttgagccgattctaacttcccatggtaaaacagcctcatgtccataaacaagcttataaggagggacttggatcaatccacgacaagccatccgataagaccacaacgcttcggccaatcgagtatgccactgccgaggataatcaaaaatctttctcttaatcaatttgatcaaactcttgttagatgcctcggcttgcccattagcttgtgcataatatggtgaagaattcaacaatttgatactcatgctttcggcaaactgaacaaactcatcggacacgaagattgaaccttgatcggttgtaatggcttggggaataccaaatcgataaattatatgctcttgaacaaattgtatagcatccccagaatcaaccttcttcaaaggaatcgcttctacccacttggtaaaataatcggttgccaccaatataaacttatgccctttgcttgatggcggattaatcataccgatcatatcaattccccaacctctaaatggccatggtttaataataggattcatagccgatgcctgtgccctttgaatcgctccaaatttttgacaatcttgacatcccttgtaatatttgaaacaatcctccagcattgttgtcacgcccagaaattctcgaatagaattccaagcagaatgtgcattaaaattctcgtccaggaccggccggggaacagaaacaacaaagttgacatacagatccacgtcttacaaacattataaaagtcttacataaatgcagtggaaaattaaaagataaatggggctaagccttgacttgcaccgcagcgggatccccactccacagg

SEQ ID NO: 39977 - DNA, 459 bp, Oryza sativa
ctcagtagggagttgtaccttgaagagaaagcgtccaaggaagttgatttctgcaagtcagctggtttgaaaagcctagacaatctagatgaacttgaagaggccccgattgtactgcgattccaacttggtcaaccgatggtgcttgacacggaaattgaatccttaggaactcaagcgcattggctgcatgaatggtatttggaggaggccaaaaaagggggtcgggatgttcggtgcctactacactgatgtggattttcaccaccccagtaatacatgctttgtagaatttaaggaactcttccagttgtaccaaagaagggaattcgatatctgcctcctgcaattgtggtcattttgagtcctttgatatcttgtcgttcttaatccatagcattctacgtactcagtaattctcaactgtgttctccttttgcgggcattgctcttatcagg

SEQ ID NO: 39978 - DNA, 1168 bp, Oryza sativa
actaatacctggatacaatactacatctgtcgattatgctaaatattaatattttaggacagtcgtttctcactgtgcatggcctagcatggtttcccagggtgatttttgatgcagttgcctatttactgaatcgacacgctattgtaatgtagtaataggcagtgtctaatctgttactatattttgggatggagatggagagtacacttattttcctattgtttcaaatttaaaattttgcctagttgatcagaattgtctaaattttaatcataaactcactaaagttaaggccactttgttctgtaacaatgctggcctgcaattttttgtcaggacactaggagagcatccgtcttacatattaccagtattttgtatgatctcatacagttgatcagatctatggtattatgataagagtacagtttttcgtgtgagccaatacttatatgagcatgctccctggattgctaatagcttttttttatgctgctgctgatttaaaatgttgcttacttaggttgcttacttgcttacttaggttatattactagtattaatatgttcatgcccttaggttctgtttccatgatccatcatcctcatttcttgtttggtaaaggaaaagtatatcttggaatgcacatctgaacatttacccaatctttccaaactccccatgtgaatataacttgctgctcgatgatgaaattcatatgatgggagattatgtgtggcagtatttcatttatttgtgtgatttgtgaattgtgccggattagggtataaaaccggcacctatctcctactatttaattacccggccaaccacttacccacttcaccctctatctctcttatccacacgctctctcccttattctcttttgttcactatttttgaattgccctttattctcgtctctgtttatactgccacacataatcgatgacgacctagtacaccatggcatggaggccgtgcaattggcagcctgccatattttggcgaggaggccattaagttggcaacccgccatctgagagcaaatatattcctgttttgtgcttgtagcagttccgagagcacaaaatatcttacacctttagaccatgttatttttcaacattagtaatgttattatgctcgatgatgactaga

SEQ ID NO: 39979 - DNA, 502 bp, Oryza sativa
ttgggcctgttgcaacgtggtgtagcgttggacagtgattggttaatattgattaattactacagctgttttactgctttcaactactgctttgaaatgcctgctttatgcaaaagaacccctagcttcctttggttatatcctgcatcatacctcctcttccggtatgacttgctgagtacagtgggtagtactcagtcttgctctcttttcccccacaccagagttgaagttcttcttagttagagccgtctcagagaggttggtttcgtcgctgccgtcaaggtttgcctgtggagtggcgtcgcccgctgctgaagtcaagcttcccggtttagctcgctttaatctttcccgctgcatttgtaatcttttatatttttgtaagacgtgggtctgtatgtcaacaattgtcatttgtgtaccctggctggtcctggacagggatttaatgcacattcagcttagaaattctggttcgagaatttctgggtgtgacagt

SEQ ID NO: 39980 - DNA, 1382 bp, Oryza sativa
ttcggcacatttgactattggaacaattttttttcttaaaaaaattacgggcaaaaacatcattcaattttttttataataagtagagataagcgtgttatataaatgtaactttatacagtattaattataaattacaatttctttcttaaatttaagtttcactataaaataggcctattacttaatatgttcaaaaaagagtataaagggcaaaaaaaaagaaattaaatattagaccgcacaaaatatgttccaagtttttgctgatttaaatcaaatggttgccatacaaatccgtagaatgaagttagaaattaattcaaaccctaactactatcccttccgcatgatcggaccgtacatacaacgcttggtcattctcttcagcagttgcctcgttttccgtctcgatatcaattgtgggtagcggtggctcatcgggctgatcgtagtcatcttcgtcaatgatattctccattccgacaatacttcgcttgccttctaatacaacatgacatggcctcatgagtgatgggtccttaatatagaatatttacttaacggactttgcaagcacgaatggttcatcttcgtagccaacatcattgaggtcaacgatgatcgttccatgcttgtcaatcttcaaaccccttggaattttgacccatttgcattggaatagagggactttgagggctccgtaatctaactcctagattgactctatgaaaccgtaataagtctgcttattgccgcctcatcgtaggcatcgatgcgcacagcactgttttgatttgtactcttgttgtcctgagtcttggtgtaaaaggtatacccgttcatatcatagccctggtacatgtggattgtgttggatggcccccgagataatgaaaaaagggcaccatcgatgtctgcagttgtcaggtactccatcaaccatttcccgaattgaagtttatgcatcttcgcaagccatgctgctcctttcctgggattgtctctgcggagtacatccaagtgcatgtgcacgtacggagacaccaaagctgactgtcgtaacactgcaaaatgggcgtgtcttatggtttgtcgatcaggggtgaaaattctcctgtgacctaatgttccctttccaagcatcctaccctcatgacgaggcacaggaacaccgataggttgtagatccatgtaatctatacagaattcgaccacctcctctattgcataactgtcacacccagaaattctcgaaccagaatttctaagctgaatgtgcattaaatccctgtccaggaccagccagggtacacaaatgacaattgttgacatacagacccacgtcttacaaaaatataaaagattacaaatgcagcggg

SEQ ID NO: 39981 - DNA, 298 bp, Oryza sativa
acgagggtgagtatcgttgggtttgtctcgtcgtcctctacgtgttcatgtcctccaaatccgcagccggtcgctctatctccggcgaggtcgccatcttggtccggccattgatgatgtcatcatgacgtcatcatcttctccttttccagttttttctaatagattaaatcttcggaaattcataactaaatcatcgtaactcggttttgagtggttcaagttgctaaattcatctaaaatcatgatctacatgtttgtttactttatatgtactgtttatttggtttttattagt

SEQ ID NO: 39982 - DNA, 208 bp, Oryza sativa
tgaaattaattttattcgttaagttattattatgtgatcttgaggtgtaggttcatgacttcatgttaagtagctccaaattattcttcattccccctcctccccctgaaaatcttgttctgaattccaatagaaaagttattcttcctttttcccctgaaaatttcgttctgaattcccaataaaaaggttataaatttatatgcat

SEQ ID NO: 39983 - DNA, 1501 bp, Oryza sativa
aggataatcagaaggtgaagtggatggtaaccgccttctgaggtggtaaaaaacgtgccaaggaaagagatgttgatgagaagaagaccggtgaacttgccggcccaaaatactttggaacagatgattgtctggcagtgtttgaaaatggcaaagccttttggctggattatgcacttgaagaaggtccgtgggagatgagaagattacataaatggtacacggacgccaacaagaaaggcctaatgtcattagctgtttgaacatcacttgatgctttcatggccgaggaaggtttcttgtggctcaatttcgctgatcttcacgccgtctgtcggtgacatgggatcaggagtatcatgactagaggtttgaggcagacacaatcgcacacgtggcctggcacccccgaggacgtcgggcccgagggtgatgtgttcgccctcctcttagtccccccgagggggtcgggccgcacccgcctcggccccgagggccgaggcgccccgacccctcgtgggtttttgctccgcgtgtatgggttaggtgagcacaatggggctcacctaaccacatttattgcggtttggctgagcgcgtcatgccgcatgtaacgcagtgcagtgcactcgtttatccggtctgtgaccagtcacagactggtcagatcgcgggtttggtggcgacaggcgatctgacgcacgcctcgccccatcccgtcaggacgagggcttctaggcgctcgtccccagctggagctagcgtgttacctcccagagatggcacgttagtcctagtcagatatatgccaggcttcatcctaaccattacaggcaagatgttgtgtgaagaagggcgaacatgtagattgctaagctgacacgtggtggacaagaatgaccgacgtgactggtctgacaccggtcatgtcgtcagcagacagccacgattccacgtcgcatctgctcccggcgaaagtggaggtagttgtgggccgtctcatcagatggtgactcggacggcaactatacaaatctccgtccatttatgaaaaggtggggtaagtccccacaaaaaagagagaaatggtgcatgtggtatccccttaagatataaaaggaggaccttgcccactgggaggggggactggacttttccagatggggaacccagaacaagggagaggctggctcatactttgtagctccttcatacacagatctcccaaaacacaggagtagggtattacgcttctcagcggcccgaacctgtatacatcgcccgtgtcttgtgtgtttcctgtctcgcgagccttccacatacagagagcttagaatctcaccctgagtccccggccgaactggcaaaggggggcctgtgcggtctcccagtgaggagccccacgctccgtcatctggcgcgccaggtaggggactctgcgagggattttctgagctctcgcactctttcgtgtgcgccaagcttttcctgttcagcccaa

SEQ ID NO: 39984 - DNA, 1501 bp, Oryza sativa
cttgaaatcattcatatgcttgagataagagttagagtagtccaaagtataacaaaggtaagattacctggttgaaagtgaaaacaccggttaaagggtggtccaaagcgaaacaccagtaataaaaaggtggtccaaagtaaaatttactctaaaaattgagtaaatttcatcttccatcactttatattaccctagttacacgatgaaataagaatttataaatttttcacttaataataccatctaatcttaccaaaacatagtagcttcgaatagggtactgagttgagttattgcttgagtttctaccatggctatttggtccatccatagaagaagaaagaggtgaacacaagggaatatatgtgtagtgcgacattaggagtcagcccactacttgttcttgtgcagatatggcaaggagctcaacattgcttgccctattgcctagcccaaggttcatcactagcacctctggtatgccaacactcgagctaaaacccctccaatgttgctaatcccatacgttgatgctcctatctccaaatagggcgcccgatataatgaaccactatctctactccgtcctccaaatcaggacacaaaccatcgcccattgggactggggacgctcgctgctgccctactcctgctcccttgtagatcaggttgccaccatcaccactctcctctctcggttagatccaagttacacattgattgggctgcacaacaccgatagtcatgcttggtgatggcaatgtgtgcacgcgagagagagcacacacgcaatggtgtaggtgcatgggtgatgccatgatgtgttaccagatttggaaaatatgaggatgtggtcttgagtgaaacacatagtaaatagtaaagttacacggtccaaagtataaaatatgggtaagctatcagaaacaagggtaaaaatatacgagccaaactacaatttacttattttttttctttataaaacagctttacaaacacatattttgatgatctaattatgtgaaaaacgatcactttttttttgacagctttgatgccaaagttgcattatacatcgtggctttgtgtttctaatgatgcattttctattagaatttaaataattgatatgctaataaataattagtcccttttactttattttttattttttatgtcatttgtaaatttaaataattttttatttgttaactaactcgaaaaaagaatgtcgccgacaaatggcagacgtcgccgcgggtgatgggacgacggcccattacacagcccggcccggctggcacggcccacacggccacacctcaatcctcaataggcgcacgtgcgacgcacgcatctccctgtacaaaaccctagccttccccatcctcgcctcctcctctctccccccgcaccaccgcctcccctcctctcctctcctctctcccgccgaccaggagaaagaaggaaaaagaagaagaaaaatcctctgcgatgg

SEQ ID NO: 39985 - DNA, 1102 bp, Oryza sativa
ctggagtcgttcctcgctccaacccatattggagaccatcttctctattaaatcaacggttcctcgaaccgttttagagaagaatgctcctccagctgcctcgaccatgtgatggcgggacattggggtgagtctattataaaagttctgcaggattaatcagtcttccatcccatgatgaggacatgcggccacatactcctgcagacgttcccatgcttcccgaatggactcgtcccttgtctgctggaaactggaatccgtccatgaagggcattggttttgcccgttgggaagaatttcgagaggaatgccgtagaacatttgtcctaggtgttgacagcagcatgattggcgtagaaccactgcttcactctcccgaggagggagaacggaaacagccttagcctgacggcgtcgggaccgacgcccttcatggtgcacgtgctacagatctccaggaactgctgtagatgagcgttggcatcctcgttaggcttgccacagaacgggctagcctgtgccaacgtaacgaggctggacttcaagtcgaaatccacgtctcccatgttgatctgtggccaaatggccacattctcagcagagggagcagcgaactcgcgaagggtcttgtcagccatagtcttgaaggatgatggcgttggtacaactggtttctctgtcggtagagttttctgcggagcaatgactcgcgacctgatgctccggatgaaagcttctagattttccttgaagtttcccggcaagttgaaaccagtcatgcacgaccctgttttcacaacaaaagtgaaaacaaccaaggttatacagaggtaaatataaagtattagttcagttaatctctgttatgaatcttccccttcaacggcgctagaaatgcttgttggtatttcttaacaacattattagaaatataattcccagcaatggcgcaaaaatacttatggtatattatggttatagagtttatccgcaagcgcacggatataccattgtagcaattcacccgagagtattccaagggtatcatatttattttatcccgtgggaagatcatgtagagagaacttgactaataatt

SEQ ID NO: 39986 - DNA, 1501 bp, Oryza sativa
accacttgccggttgggcgctccctgttgggagcgccggcctcgttctttttgcctcccgcaggcctcccctttcgggtggcccgcgaagcgccctcgacggcgaggacatgaccgtcgtcgtcggtatgggctgacctcttcttcctcctcctgtcacgccgccctatctgagcggcggatccgggggcggccgaagctgccacaccggaaccggaggggttccaggtccatgcctcctccttacgagccactcggtccgcgagctgaaaaagctccgcggtagtctggggctctttggaggcgatcttttcgagcatgcggttgtgccgcacaccccccctgaacgcgtaaatcaccgcgtgtgcagggatgcatggtatggtgttgcggacttgacagaaccgctgaatgtacgagcgaagtgactcatcatcccttcgctgtactgcgtgcaagtccgcttcctcacctgggcgcggatatgtgccttggaagttcatggtgaactgttggcacaaatcctcccaagagtggacagacgcgggtggcaagttcattagccaaccccgcgcctgtcctttcagggccatgggaaagaaattcgccatgaccgtgtcgtcacccccggcggcctcgatcccggtcgtgtagacctggagaaactcggcggggttgacgctcccgtcatatttttcggcgatggtgggccggaaccttgggggccaacggacattccgaaggctcgccacaaaggctctacagccgacaccaacaaccgggggcacggagggctgatccccgcgtccgtggtgaggtgacactccggacgaggaggcgccctccgttgcgtggggagcacgtcggccattacgccggcgctcgatactgatgcgggcatccggttccccacgcagatctttccgggtcggaggcgttgacgaaggagtggcggccgaatggcgaacagcggctgccgctcgccgcgccctccgtcttgacgacgcggagccggtggtagcagcaccagaggccttggtggcggaggaccgcccaccagcatctaggcgctgccgtgcagtcatgatcaatttggccacatcgtccagccaacgttgggctggagactccgggtcatgggcgacgggcgggtgacgtaggagcgcgcccgcagcttggagcgcgccctggggcgtgctgccatcgccgtagacgaggaggcgacgctccccatctcgccgcccttctccacctcctgtgggtgtcgaagtcgcggatccttcggccctctcgagcgccttctcccgcataggactttggcgtggagggggcggtggagtacgagctcgacggcgtgggtttggctccccgtcgtcaccgctcatactcggggagaggtcgtgcgcctttgctggctcggccattgggctgaacaggaaaagcttggcgcacacgaaagagtgcgagagctcagaaaatccctcgcagagtcccctacctgg

SEQ ID NO: 39987 - DNA, 522 bp, Oryza sativa
tgttagtgatatgccctagaggcaatcatagagatgattgtatcacatactatgtttacatatttatttgacattgttccttgaaatagataactccttattggttaatgaatatgtgattctttcatgagactctttatgttgtttgttactatttctaaaggatccttgatcaaatatcatatgtggaacaaatatgtttatatgatcagcacatgtattaattgatgatcatgcctcatggatcatggtatagagataccaaattaataatgtggacacatgttggtgaacatgttgttggatagacccaacatgagacactacaagagccctatgtgttgtgtcatcagtgatctcatttagtgttggtgttgaatccttagacctgagattatcatggttctcaacatgtgtagtagcttacttagggactgctaaacgctactccgtaaatgggtagctataaaagtagttttcggatatgctatgaaacatgtagtgggatatgaataatcaaga

SEQ ID NO: 39988 - DNA, 614 bp, Oryza sativa
agatctatgtaccccgtgacatggtaggatagattccctcatatctatgtaccgccgtgtgcgttgccccttagatttcgcttggggtttttatatctatcttactttactgctgttgtatattggatatgacatggtaggatagattccctcagaaaaattaagtgtgatttatgctcttccagtaattgcacctaatacggttgtgatcataagtgatgggtttgtcatagcaaagtgtcactttttatcatgataaaataggatagatgtcggacatctatgtgcggagattattggtttacttgacaaggttattaaaacagttttggaccttggggcataggttgggttggacatggagatgtcaccccaacagcacaagagtcacatatgatgtgattagcaaggtgttgcttacctattttgatagttgtctagctatgatgccaaagctcactagacactaataaaatgaggatcttgactcactatgttactagagggaattttgtttcacaatacatagtggaagtatcttttgttaaattgtttaatgaaaggttaaatgtaaacatgatgctgattttgcatacatatatttctattgtaga

SEQ ID NO: 39989 - DNA, 742 bp, Oryza sativa
attcctgcagcccagatcttcatgtagacttgggctactttagtggcttccaccgatcaaagtttcgtgtgtttcagatagtgacagagtgatacgagtatcgtgatcatctgttgtgccattcatgtcgctaatcaaatgttgatgccggtaacttggtcgttatattcatgcaacatttccaatatcgcatgcgcgacgatgatgaccttgttttgttgcgattgcatgccatttcttttttctgaatttagttaatgctatgtttcgttcatagatgagtattgtcagttgctggcatcatctgtgtatgttcctgtgttgtctgttgtgattgtggtctgcatggcgtgcaacatgctgctgcactgttatcattgttctggcagttttgttgttttttttatcgctgttcttttattatttttcttgataagtatggtcatgcataataaagttttttttcttgacatgtgtgatccttgcttcgggtttaaatttattttatttgataaggttatgaattgggggcctgcaagggtacattggtttactacgtaatcgcatcttttatcttgtcatcctttgtttttgatactactatagtgttattgttgcttgtctatccgtttggtctatatggatgcaggtctctttatttgtctttggtagggttgaaaattatatatagattttgtcattgtgaagcatatgtcttcccactcatgttaataatatggtt

SEQ ID NO: 39990 - DNA, 1501 bp, Oryza sativa
ttgtatcggcatccataccctgagtggttttagagagttccattgcctaaccgattcaaggttccatatttttcaaaattctcaggcaggacagtgtttcaacctatgaacacgttagccgattcttagctcagagtggtgaagcatcggctgtggatgccttggttttcttccttgccatgtggatcaatcaacagttgggccgatttggagaagcattttcatagctatttctatagtggggttcatgagatgaaactgtcggatttaacggcgagtaagcaaagacatgatgagcctgtgtaggactacattcaaagatttagagagatgaggaataaatgctacagcttgagtttaattgatgcctagttagccgatttggcttttcatggtatggtagctccgatcacggagaagttctcgtctcaagactttgatagtttgtcacatcttgcacagaaggtaaccctgcatgagcagaggtttgcagaagccaggaaaagcttttaaaaggtcaatcatgtctgtccctacatgtatgggtctgatgacgatgatgatgatgattttgaaatagcagcagccgaatgggttagaagtaagaaggttataccatgccaatgggtgaagaattctggaaaagaagagaggtatgactttgatgttaccaaggctgataagatctttgatttgctacttcgggagaaatagattgaacttcctgccggtcatacaatcccatcggctgaggaattaggcaagaggaggtattgtaagtggcataattttgggtctcattctaccaatgattgtaaagtcttcagacagcagatccaagaggctattgaagggggcaaaatcaagtttgatgactccaagaggccgatgaaggttgatggcaatccttttcctgtcaatatggtgcacacagctggccgaacagccgacgaaggaagggctagaggttttcaggtgaattcggctaggattatcaataagtatcagaagaaatatgacaagcagcgggagaggcattatgaagaagacgatggtagctttaatcctcattggggttgtgagttctttagattttgctggaatgaaggtatgaggttgccgtctattgaagactgccctgggtgcagctatgttacagaaagttcaagccgatcgtataatagaggcaatcggctaaggcaaataagagttcctgttgatcaaagattgggtccagtgaaccaagatcgtggccaagaggacaatgaagacaggaagactcaatggtgtccttctggtatttttacaaagaatcagaagagaagggttcaaatgttgaggaacagggaacgctttcaggaggttgagcaagaaatcaaccattggctgaaggagacgaagccgaagcaggagtggcgcgttaagaatcaagttcctacagcagacgaagccacaaccgatgaagcaaaaagattggctaaagggaaaagtgtcgtgactg

SEQ ID NO: 39991 - DNA, 361 bp, Oryza sativa
attcctgcagcccgtcagcatagcagcaaaagcagttaatttcacccgtagcgcctagcttagcggctgtttgtaacgcagtcttcacagctgaattatgtgtgggtacctgctttctgttatgggtacataattctcattttttcgtatgaaaaagtatcatcaaacccagatcttcttggattagaaaacggactagaccaagagagaattgtagggatgacactggaggggcaaggctttagtgtcgtttcaagtggattatgcttaagtgtgtttactgtggctgatttataacatgaactatacaatccagattacttccttgtggttttactgagtgatgtcattttgttccaga

SEQ ID NO: 39992 - DNA, 1501 bp, Oryza sativa
ctgaatattttattctataacctattttgatgaaaaatccacttacccaatatatgtgagtagttgattcggacaatttcctccgatgtggatttatagggaccgtaccaagtaggttggactcgtccaacgtggttatgaggtgagttcgactcgagtttgtgcttagactgctcaaagtagtaagatgactataaatgatgagagagccgagcgcggaggcgataagaatcggtgattggcaataaatccacattagaagatatggacatattcaattacttatgtgcacggaggggtcaattttgatgtgaaaccatatcatgtgggtaggcttttacaacaaaataggttatggggtaaaaactcaaaaccagagtaattagggtggtttatacaattttatctattcaataataatttgtaaagaaccacaacatttgtaatttctctagctcaaaatcaagctataacctatgtccaaatttatattatatacattagtttatttttagtacggaggaagtggtatacactataactacctacagaactgacattttccacggattaccagaagtcagtaatctcaagttcacatgatgaacatacatcgacaagaatatgcccaagcccaactgcgagtttgcgacatgctgtcatgatacagtgatacacaacaggtcaacatctgctgtagtttgtcccccgtcggtccatggcctaattcaggcgaattcttgaatgtcacaaacttctgctgattagaacctgttgccgcttgatgtgtgatgaccccaataattgagcataatatacccgaccggcgacagccatcctcatagtagttgaatactgacatcggatgattcagagtggggtgtgtttgagaggagagaaataaaacgattgaaaagatacgtaagctattagcagatgattaattaaatattaattatataaacttgaaaaataattaatattatgttttaaatcaacttttcttttagcaattcggcaaaagtacgtacgcgtggaaatgagagactttgtttttcaatccactactaataacacaccacgtccttagaagcatagaaataagatttcatcggatgagcactaaaggactaatactatctctataggctccgtggctccgtctatgtatatcatatagcaacatagtatccgtagttttagatgtgttttatctaatattagattactataatattatagaatatgtagttctaatatatattccattaaagtattaggttgctactttcaagtaacatttacggaacacttgaacattatgggacagatgagtagcattttcaaggaacatcttgtgtcttccggggcttgaaaatcctccatgctcagtttctttctcagcttgatctatcagatcgatggtgatagaatgacagtggtgatgaaatcacagctcctgcaatgttacacctcttctttctcattctctcttcctaga

SEQ ID NO: 39993 - DNA, 1344 bp, Oryza sativa
cccaaacgaatgaacatgaacactgaacagtaagctgcaaactacatgtacatatgcattgcatacgggatataccgcgcatatggaaaattaaatatagttgattgcattcagagaattatagatcaatatatttttatctgcttctactgtcattaaacaacttgtcaaaatcagacaacttagaacatgcaagtttaatggaataaaaaaacacattcaatatgtaaaagatgatcagcaaatagttgatcattccaatcaaaaccataaattgagtgcgtcctaattaaatagactgctaaatatgtattgcaaattgaacacgcaaaccatgcaaattcaaaggaatacgtatatatgtatattgtagatgcagcaatagatctgtagcagatgcagtgacggatgtgcaagtaattttttattttgtagcaaacttttttcccccaaaattcatttggttaaatttcgtttcaggttaaaatttattcaatctttatggagtaaaaacagtacgtcaaaccagagacttaacagggatgaacgatacctctggagcgatcactgattcactggaaacttttaacttctcctcatgattgaggcaaattgtcgctgatcgggaccacagtctgggatcaaggtcgactgcagcctatgcatatctcatcgccctcgctcacgttcttctcgatcgcgttcgccgtttctttatcgcttcttaatttccaatctgatttctcacgatggaacttggagataaattagatggattctgtccttccatcgataactggatagataggatttgcaaggagcccactgagtttaagattgattggcccacgatgttaaagtattgcaggatctacggtgtagattaaacgacttatctaattgatgctcagatctttctggttaacgtgagagctccaaaaaagtgtccgattagtataggtatagatagatagataaatggtctcaaggaaataccggtgtaaagcaagagtaaaccctaataaattaatgcaaataataaccggatttggcatgtggaatttttcttgagttctacatgtcgaaatacgctaacaagatttttagtggaattttgagagctctggaaataattttaaccaattaaaattgatcacaagcaatatttaatcccaggaaaactcatttccttttttcctttttttctttcttttctttttcccttttctctttcgaatgggccgccggcccattctctcctccctccccttcccgctgggccggccgaaggccgaggcccagctgagccggccgcctctcctctctctcggggtcgccgacagg

SEQ ID NO: 39994 - DNA, 1501 bp, Oryza sativa
agcacagaatggggaaaattatatttaatgtatagacttcaggttctagtgttgatgttggattagagccaccgtcctggtgtcgcttcattaaaatttgttaaatggtgggctatgggtgcatggttttgctagtcgcacccatggcaattaaggaccggttcgcgggaaaccctggaagaattcctcgtacttaccacaagccagcgtgggcaacggctgggcttgtagtatagctttcctctagttgacgcatccaggcaagggtgggcgtgatggagtttggatgggccctgcgatggcctatacggcttccggattcatctaggcatgagaggggactgcccgctgccttgcgaggagtgggggtgaaacctgaggtgtggtgtgcttggttagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccatgcccgcggttatgggcggtcaaccagattcgctgtgattagtttcaccctagtctagtctaatggaattgaatagtataggtggatggttgggcctgttgcaatgtggtgtagcgttggacagtggatgtttaatattgattaattattacaaatgttttactgtttccaactattgtttataaatgctcgctttatgcaaatgaaccactatagctatgcctcgatacttccctgcatcatacccctattccggtataacgtgctgagtacagtgggtagtactcagtcttgctctatttttcccaaaccctagagtttgagtatgcgtcagatggtggcttctccgaggagtaggcttcgtccgtgccgtcgaggatgcctgtggagtggggatcccgctgcggtgcaagtcaaggcatagccccatttatcttttaattctccactgcatttatgtaagacttttataatgtttgtaagacgtggatctgtatgtcaactttatcgtttgtgtaccccggccggtcctggacggggaatttaatgcacattctgcttggaatttgtcaaatcaagtcagtctagggttttagtaaaattatttgagatttatttgacagtcagtcgggatttgatgggaggaatgcattaggtcctaactcaggaatatgggttgcaaggtctttatgctcttattgttattattagtaagtatctaatttctcattattttatcgctatgtaagtctatcttatttattcgctctcatgcaaaaaaatgatctatgcataaaattccgctcttattcgcttatttaatttgagtcctttactgcttcatttaaattggatttgagcatgcattgatcctacccctttgtcttctctagatggccgaccacccaaccaactaccgcggagaaggcattgacgattttgtggcagagttggctcgca

SEQ ID NO: 39995 - DNA, 1501 bp, Oryza sativa
cgacggcgcagcggcttgaccatgctggcgcacctttcactcgatccacctgagctcctaatctactccccgccgattcctctgtcactctcatctcctctaccacactggccagctcagcctatcacctctgccttcgactcgtgcagatcttgatgccgccactgctcgacgattctatcccctgctccgcccgacccactacttcttctctggtgtccccgtctccagcttcgccatatcctcaatccggccgccactacacatgacataggagattgggagaccttccaattcgccgcaatcactgcccctctccccgtcagtcgctgcccctcccaatctgtcgtgtgatgagcgggcaacgtcgacactttggcttgtaggcagcaaggcacacctccattaactattgggcctcctccactgccgccgtcgggcacaccgcgtgttgaccatcatctcctcgccgattacatggtgcctccaccgcatttgctaccgctgagtccaaaagttggggagggagatagataaggaagaatatattgtttcacaaacatacgggtctcacttgggttttaatttttcttctagtgccacgtcagccaaaactgtcctcaatactgcattgggatctcatttaacctggtctgcaaagattagggatgggttatatctggtattatcgtgaaggacattttcaaacttgcgctcaacttgagggacccaaatgaacttattagtttatatgatggcctctttgaatcactgtcaggaattttaatttagctttcatgaggagctccttttaaatctgtgcaagcacataacactactatacacacctaatatagggtacccatatgtttatacctacaaatataatccctgacatgtttacatagaccaaaatgaatggaaattccaagccttaattaatgaatagtattgaagacgtgtatgcatgtactcctctgtcccataaaaaaactaatcctaccatggtccaggttcatagccaggattggcttttttttaaaggacagattagtacaaaatattcatggtcaatagaatttatactgcagtgtatggagtcatacaaccacaactaacgacttcatcacagcactttccaactttcaaaaattacagagcaggaattttacatgaataaatttgattattatgaaattctgggaagaaatcctccgtttgaaaggaaatattcatatcttttccaattcacgtagggatgaaacgatatctatactattttaaatattagcagtggtgccaccaccatctcatatcactgacgtttgttcctcccaacttctgagaaattttgtgccccctaattcaaatgcttcatattctcagagtatagccaactactaactccaaatcatctatagtcaatttaataaccaattcatacgatagttacatataaatatatactacactagtaatatttgtagtctgtgctgcagct

SEQ ID NO: 39996 - DNA, 1501 bp, Oryza sativa
aaggaaatagtgagatcaagggggagaatgttagatggatctccctccccttgagcccaacggctcaagggggccttgacccgcgccctgatcaggggcgcccagcccaatggctggtgggcccccgtcacactgtgccatataaagaggggtggaggacgggacgacataacgacacaaggaacgaggttcgtcgccgccgccgccactccaccccataaaccctaaccgatcgagggggggcagccagtgacgggaagactccaccgccgcgccacgacctcgccgggatcccctacgaccaccactgccgcgcagcaccgtcgccgtcacgaccgccatcgccgccgccgcccacgtcaagcagagcgacgacaacgacgatggctgggacttcctcttcatccaacgcgtcaaccggtcacatccctaaaccctttcccttattctctattgttgttcaatcatccatcgcaaatagaaccacccgactagatctaaacctaggtgatccaatagacaaccctaacactttcaggactcccaaatttcactgtaagtttgtgcttgttctcttctatgacctaccgttggaacttcatctaaggggtacaatacaaactacatattagtgcattctatatttctttactccagcgttattatgtatctgaatataaggagtatttagtacagaaattatcctgatatcttgattccatatctgtatgtttcaattttgcttctcagatcactgatgaactctttggtttctgctgatgtacgagacactactcttccatggatggaaccagagctttggagtggaagcagcagccgagtgatggagcaattctggttggctgatcctgacaggttatgaggcatgtgatcaactattcaggcaaagggacagtctcaggggatcaaataaaacctattttatgaaccgacaaaatatttggctgcagtgagatggttattgaatgaaatggatcaagtctatactatgcttatgctgttgtattctgctctgttgctcatggtgtgtattctattctggtgtactccctccgtttcacaatataagtcattctaacattttccacattcatattgatattaatgaatctagacatatatatttatctagattcattagcatgaatatgaatgtggggaaatctagaatgacttatattgtggaacagaggaagtatgtatgtatgcttgtgtctctctgaagtgtaattacatgctatctgagcaaacatgtcctgaactctcttacaatttttgtgcctgaccactgaataatatggattggcacttgtagttatatgacatatgaactgacaatagattgcattgtcacttttggaaccttaaattgaggaagaataataaatggattttttttattcattttgcttaacaaaaccatgagttgtctactatcttgtgatgtgcaagtcttgtggaaaaatgtgtttgtggcgtt

SEQ ID NO: 39997 - DNA, 1501 bp, Oryza sativa
gagagaccggcgacgacggagatggtggcgccgccgcgggccccctcgccggcgcgcgcgtgcacccgcgggtgcgcacgcggctgtcgagtggctcctcggcggtgcctctttgcccctctccccctccgtggccggcgtcaacgacggccggcgacgaggtaagattagggttagggtttcgatcttttcgatccgttggatcgtttgcttttctttgcctttcttttggatttctttccccaaccaatctaaacgctaggatggctctgataccattgttagggttgtctattggatcacctaggtttagatctagtcgggtggttctatttgcgatggatgattgaacaacaatagagaataagggaaagggtttagggatgtgaccggttgacgcgttggatgaagaggaagtcccagccatcgtggttgtcgtcgctctgcttgacgtgggcggcggcggcgatggcggtcgtgacggcgacggtgctgcgcggcagtggtggtcgtaggggatcccggcgaggtcgtggcgcggcggtggagtcttcccgtcactggctgccccccctcgatcggttagggtttatggggtggagtggcggcggcggcgacgaacctcgttccttgtgtcgttatgtcgtcccgtcctccacccctctttatatgacacagtgtgacgggggcccaccagccattgggctgggcgcccccgatcagggcgcgggtcaaggcccccttgagccgttgggctcaaggggagggagatccatctaacagaaaggtcactgaattatgcgtgtcaagattgagctacttcctgccaaacatttgacatgcctcaaatcatctgagaactttgaacccagcaaaaccctgatgcaattctgcctaaagaactggcagacccacattatgctacagccacaacaagtaaacaacccgatatctctcataaccagcccttttttttttgagaaagaggggcagaacgccattttattaatgaaatgagcaaaagctagaggttcatataatcccaaatccatttctagcagatcaacaaaatgaaagagcaacacaaattccgattcccaggtaacatgactaagacttttcattatcagcacgcccacatcatcgcggcagagattcaccaggcgatcataaaaataaaatattcaaaataaccagccaatttacaacaggaaagaaaatatccacacgatcatcctctaccagaagagggcttcgatcgcaatctcgtattgagataaaagcaaagtttagaatcactggcaaatgacaatgcaaacaggcataattcctatgcagcagtgcaccatatttctacaacagcagcaaaagacatagcatgattatagaaggcctcacctatcatcagacatttccatcacatcagaaaaccaaagctgtatccaaacagaagtaaagcagaatagcatggtagaactggtaagcttgtgaattctgaatt

SEQ ID NO: 39998 - DNA, 535 bp, Oryza sativa
tttttttgtggcgtttgtgtcacgcccggtaattcactagtaatttccgaacttatttgtgcataaaatcctcgtccaggaatcagccgaggtacacaaactgacaatttaatatacaaatccatcataataataacgttacacacttacaaaagaaaagaaaacagcagcggaattaacggtctagcgatggcttcagctccactcccacaggcagctcaactggggtataagccaaacgtcttctccttctggatcctttttcttcaactgaggttgattgattattgcaagaatgagcatatgacatactcaacaagccacacagcaaatatgcaagtgcacaaggataccaaaggatggcataatataggctcatttgcgaaagcagcatttagcaaagagttaagagtagtaaaacagtagagtaattaattaaaaattttaatcaacactgaacagcacacccatgctgtacaggcccaaccatcctgaacaaccatacccggctgtacagatctaactccaaaccagg

SEQ ID NO: 39999 - DNA, 1501 bp, Oryza sativa
aatgaactaatcgtgcaatacattttcttagaattgtgtgctatacattttttaaaattatgtgatatatatattaactgtttatattagttcatgaagtatggcactagttttacgatatcatgtaaagaagaatggagggagtatgtaagtgtattgacacttctcatttcatcgagtagattgattatcgtagtattagtctacttttgtttccaaaacgaagagcaccttcatgaaagttcaagcatattatgctcctagtcaagccacatataatcccaacttgacttgacttgttatggttacgagtttaaaaagagtcgatctaaactacgagacttggtacttttgcttttctccacctgacaatatggatgcaacggtgccgttacaacttttactaagcgcttgtacgagaagatagctctagcaacaagacaaccataaaaggaatcatatgtagttatcccggaaatatgaagagaggaaaacgctaggacttcccaatacatgaagatgaaacacactagcggtagagttttttttctaaaacacttttaaaaagggtaaattacaatttgagtcattttttattatcaaagttttactttagactacactttatccaatcttttcatttatatcaacaatcccgagcgtatcggtttcgccctagcgatctcccctcacctataggcaagacatacatttgaggataagtggatagatatagctagagaagagaccaggggtggaacagagtaacaaatataaagttatctagtgattggactaagagtgatcgaaagtaaaactttggcattaaaatatgactggaagtacaatccagtcttaaaaccttactttatctgggtttggatccaataatttaaaattgtttctttatttgctttgtaactgtaacttttccttctatattgttctattgtatgtatatattgcggtaggagactctcgttttcgactttaagaatagaaaaataaaacattaaatatgtatatgtattgaaatttctccttaattacttcacttcccaagatgaacaatcagccattttgccacaacaatagcccagagcacaccaaccggtcgatttcttttttccccctcatgtctagagatctgaaactaaaaaaaaaaaaaagaaattaccatgcagtaaaaatctaattatagcaactttcagttcagctagctcattttcaagtgtgcttcttttcagacaacaatacgtgcatgtaaatggcattctcaacaccaaaaacacattaaaaaccatcaagaaaaaatagcaaaaaaatctagctaggtacgaagaaaaaaatagccaacaaaaaaacatgtttatttggagcatgtctatttatctccttcctctttagtccagctctcacctctctatataaactcctttgacccccatcattctccacacctcaaagcatctcttcttcctcctcacctctcctacgtagt

SEQ ID NO: 40000 - DNA, 1501 bp, Oryza sativa
atattgaagcctaaaggtaaatattcattatttctcgcttcgtttaactcttggttgttgatttgaattgtcgtgtgctgcacgtatgcatgtaaaatacgctatgggtgttgtttttagggataattctttttatctcttttgtgtctattgttggatgaaatgctaaatttgcgttaatgttttcttcgatctacgtcatggccattagtcaaattaatgcttgtcaaactatgttaaggccacgaaaatatccattgatagtttgatttatctcaaatttatgttaagggtgcccatcgatccgctagaggaggtggaagcggttttgcttgatttttcttgggttttggttgaagattaaagcctacaaggtaaatattcagaatttctcaccccgattcacacccgctcgttgaattgaactgccatgcagtaatacatgtaaaatgcactagtcattaatttgtatggatccataagtcattcgtagatctgttctcgggtgttatgctaaatttgaattaatggtttattccatctatgccatcgtcattaatgtttcacattagccaaatattatttcggattgacaaaaaatagaatttttttaatatttttgttagccatgactatctaattaaggtgacgtgggtgtgtgcaaaaacctctattttgtcgtagggtaaaatggtcattcctagttgtttttattctaatgtgcttgtaaatgatgaaatcttcattgtttttttccttcatggtttgtaataaatgataataaccgcaggtacccactggatataatggatctagaatggataactatagcggatcgtgactctgtggagtatttcaggggagtaacggctctcgttgccacgtccaccagcacaaacttagtcgatgcaccagaatatatttggtgtccatgccatgattgtaagaaagacagacaacttccagctcagcgggtccattcacatatccttacaaggggttttatggacaatttccttagcgaggagaatcaaggtgagggaagtgctggcaactgtcatgggcatgatgcggatgtaggctacgaggaggaggaggaccaaacatgtgtcgatcacggtgaacctaatctagatcagatgttgcgcgacggggagagatttgacactgatgatagggaatatcacaagttcacaaccatggtgaaggactccaaaactccaatttacaatggatgtaaggcagagcacagcaagctccaagtggtcctatcgctgcttcacttgaaggcgagcaacggatggtctgataagagcttcatgagttgctagagctcttgaaagaaattcttcctacagacaatgtcttgccagaatcgacgtaccaacccaaaaaagttacatgtccccttagtcttgacatacagaaaattcacgcttgtctaaatgattgcattctgtatcgtggtgaatttgcagatttggagtaatgcccggtatgc

SEQ ID NO: 40001 - DNA, 466 bp, Oryza sativa
ccgccagtcgccccgcgctgctcttctcccggggtcgccgtgaagaagatggggaagagagatggagagaggaagaaagaattggtcgttcacatgtggggcccacatggtcccatgctgactcagatgcaagtcaatacggggtataaatactgtcttagacctctggtaatccggttttgtttctggtaatgtggttcagggataaaattaaactcggcgacaaattgaggaacttattattacgcagttcaagctacatgggccgtagaagaaaattctctgagaaaatgaaggcccacaaggcccaatactacctaaagggcctaaaacccctcgagctctctcatctcttctcctcactccgcggccgcagcgaacccttccctcctctctcgccgccgccgccgatccccacctggaagcagcgagccgccgcctcctccccaattcctctccagaatgg

SEQ ID NO: 40002 - DNA, 835 bp, Oryza sativa
atttgctgtgtggcttgttgagtatgtcatatgctcattcttgcaataatcaatcaacctcagttgaagaaaaaggatccagaaggagaagacgtttggcttataccccagttgagctgcctgtgggagtggagctgaagccatcgctagaccgttaattccgctgctgttttcttttcttttgtaagtgtgtaacgttattattatgatggatttgtatattaaattgtcagtttgtgtacctcggctgattcctggacgaggattttatgcacaaataagttcggaaattactagtgaatttccgggcgtgacaagttggtatcagagccatcttgactgtaggataagccaaatggtcaaaccttaaggacaaatcttccgaaaacataatttgtgaaaattttcctttcttccttatctagaattctttgcaaatcgttttgtcgttcttcccccttcctctttcaacttgagtagtcgttaatcttgatggagaaactcgaagacgtcgatgttgtcaacttctgcaagtcaagtggatcgaggaataagaagatgatagtcgaatcttaagtgttcagatagagtgaagtttggaacctatcttagaacctatgccgccaaagtgtctttgaagaatagttagtagggtagaacgcttgttgtttgctttgtgtgtaggtatggttgcattcccatcattggagtagttcattgatgagtgtgtaactatactaggttgcttgcttaatcaacttgaacaatataatggtctacacacatcagatcagtgttaacctggttaaggtcttgtctttagtgtaacccctct

SEQ ID NO: 40003 - DNA, 711 bp, Oryza sativa
tcagtacgcacatcttctgaagaatagcgagccagacgattgaactcatgaagatactctgccacggtacgatccttttgctccaaagccctaaactcacgcttcttcaaagcaacaactcctacaggtacgtgtgtcttcttgaatccttcggtaaactcttcccaagtgattggttgtcgttctgctctgttcatccggaaatgatcccaccattctgatgcagattagaaaaggtagaaggagaggggttacactaaagacaagaccttaaccaggttaacactgatctgatgtgtgtagaccattatattgttcaagttgattaagcaagcaacctagtatagttacacactcatcaatgaactactccaatgatgggaatgcaaccatacctacacacaaagcaaacaacaagcgttctaccctactaactattcttcaaagacactttggcggcataggttctaagataggttccaaacttcactctatctgaacacttaagattcgactatcatcttcttattcctcgatccacttgacttgcagaagttgacaacatcgacgtcttcgagtttctccatcaagattaacgactactcaagttgaaagaggaagggggaagaacgacaaaacgatttgcaaagaattctagataaggaagaaaggaaaattttcacaaattatgttttcggaagatttgtcctt

SEQ ID NO: 40004 - DNA, 471 bp, Oryza sativa
ttgggagcagtaaaacatttgtaataattaatcaatattaaacatcccactgtccaacgctacaccatgttgcaacaggcccaaccatccacctatactattcaattccattagactagactagggtgaaactaatcacggtgaatctggttgaccgcccacaaccgcgggcacggctattcgaatagttttactctgatcagaggtatacaactgtacccacaagacacagccccacgacacgtttccgtgcgccgacatgccaccagacataccggaaagaggccgtgacaggacccttcgcataaccccctctaaccaagcacaccacacctcaggtttcacccccactccttgcaaggcagcgggcagtcccctctcgtgccttggtgaatccggaagccgtataggccatcgcagggcccatccaaactccatcacgcccacccttgcctggatgcgtcaactaga

SEQ ID NO: 40005 - DNA, 1501 bp, Oryza sativa; identical to SEQ ID NO: 21421

SEQ ID NO: 40006 - DNA, 157 bp, Oryza sativa
atgcacaaataagttcggaaattactagtaattttcggggcgtgacaagttggtatcagagccatcttgactgtaggataagccaaatggtcaacccttaaggacaaatcttccgaaaacataatttgtgaaaattttcctttctcccttatctaga

SEQ ID NO: 40007 - DNA, 1501 bp, Oryza sativa; identical to SEQ ID NO: 21422

SEQ ID NO: 40008 - DNA, 1501 bp, Oryza sativa
cagcagctgaatcgcctcttggacaggtcgacatttcatcgaacaggtggtgggcatctcctccaaagacaccaccaccaagttgttggcagttcctctgaccaccagcgctctcccacttcatctccacaccagaaaccccacgaattgactgctctgataccatattgtcacgaaccaacacaatcacaccaaatctctcacataaatgccaccgatatattacaatctactcaagaatataagtgtttagggatacaaaattgaggagaaagagaggtatagtctaggaagagagatcagacaagaggaagcaggagattgggactagagaataggaattgagaggggaagcagcagcaaggaggaagaagctatcgtctgaggcgttctggtaattgattcatcgatgaccctggctgctggctgctttgcctcttttctagtctccttctccctagccgaatgggcccaaagccagcccacttgtctagcctcctggaaggacatcacagtagcccatgtacatgacacaattccgggctagtacgggaccaaaagcatggaaaaatcatgctttctccaacgaaaggataaggctcttggaaacagctactcgatcgtactcccatgaaacctatattcaaatacgtagtaatagaatacgtcacatccaatactatgttgttatattatggaacggaggtagtagtatcgatggtgtttttaagaacttctcccaaaaaaataataataataaatctctaaacagtttttctttttatttcattatgtaaaaaaatagttattgaattaaaaaaaaggtaattttatcatccttaaatttaccagaatgtatcacactttctaatgtaaaatttgataaaaattagtctaaactttaaatacatcgaaatactttttctaggatcataaaatttctcactaaaaaaaactaaaagctaaaagctggctttctcatcttcttcaaattgctaggagctaattaccgatcaataatttgccataatcttttgcggatctaaggagttgttggtacgaatatcgccgacgaggcgcgccaaagatcacccacacacacaacacgcacctcacctcacctgccctccgctgatcgaaattagagcaagcccagcagagcttccatccggacatccatcccatgtttggcgtatggaggtgaaaaaacacggtccagcagagtctccattacacacgccattttagatgtcctccaaaccaagccctctccatgccatatttggcgtttctctctcctcacgccattcccccaactgcccagctccgacgaactcgcgccaccatccgaactgtgccaaggggaatagagaggatggacataccgggtctgcagttggagatcgccggagtggaggccccgccgtccgcgccgccccactgctcccgccactgctcctccgccgcgcgccgccaccatccggactccgcctgcgccgcc

SEQ ID NO: 40009 - DNA, 1501 bp, Oryza sativa
gctgtctgagctgcaacctaagttaaggtaaataagtcatctatttattttaaggattgctatgattcatatttgtcaccgtgggtaccagcactatgtcctgggactggtaccgagatcgcggtttcgtaggaagcggttcacgccgttttccctacgacacgctcctgtcaggtgccgttgtacggcggtatcagattggggtgtgacagctagtttgtaataattagctgtagctctttcgagtaaaggccgggatgctatttcattccattatctaaagaaaagtttatccgtttggtaatattgtagtacgagttaagggtgtgttcggaggtgggtgttgggaaccatctcccatgcatgaaaaacggagctatccattaacacgtgattaattaagtatttgttaacttttttaaaaaatggattaatttgattatttttaaacaactttcatataaaaacttttttaaaaaagcacactatttagtagtttgaaaaacatgcacgtgaaaaacgagaagaggggttgggaaactatagtagtaggactcaattatccgtacaagtagcgtgtgatgcaggggaggaatagcgtgctgggataaaggccggcgaagcagacggctggccaagcccaagcagctagcgtgcgtagcgtaacaacgacgtcgttcgtccgaggcgccgcgcgctggcagggcgcagcacagcgaccggcaacgtgtacaggcgcgaggctgatcgaggcggcgccggattgggccacacacacgcttgcatatcatcgtatcgtgggccatcacgtggcggcggcgccatcgatcctgcagagccgcggcccgcgattcacctgggctagccgcgaaccaccccgtgaactagcggcaccgtcctgcccaggccgccgcgccgcgtgcacagcttgcgcgaaagaacgagcgcatcgcaccatgcgcgcgcgtggggcgcctctccacgagcgacggctgatgagtcgcccacagtcccacatgcatatccctcccctacccgccggccgccaccctgcgtgccacgcttgtatggagatttgataatttgacacttccgttttcagagtctcttcttgtgatgctgtcgtaaacctggcgacgatcgactacgcatagcagggtcgttttagtgcttacgtggttagcatgtggtttctgtcattttttttactttattccttcttaatatatttggatggtccccttggccttaaaaaaaagaaaaaaatatttaatatcctaatctacatttatttactatgatctcacaagtcactctcaaaaattaccaattaaagcaagtcgacaacgataaaagtgccaaattatcaaatttcttgtagcaacggatatttgatacgcagcccagctgattgtatccatggtttgttaccaaatggaacagctcctcattccacagaccacagcacagtatatatgttcaagagagagagccacaaagg

SEQ ID NO: 40010 - DNA, 1501 bp, Oryza sativa; identical to SEQ ID NO: 21419

SEQ ID NO: 40011 - DNA, 1501 bp, Oryza sativa; identical to SEQ ID NO: 39990

SEQ ID NO: 40012 - DNA, 406 bp, Oryza sativa
  unsure (1)..(406): unsure at all n locations
gcgcccttgaaatgacatctacttgccgcangcctgcaggtcgactttagaggatcccctactaccgcaaaagaggtggaccagtacatattccatcccagaagaagttatccgtcaggactggctggccggtactatcaaatttataccaatacaactaagtatggaacagtacatatatactaaatatatctactgagatcggtccccataattatatcgcagtgctacaaacaaccaccaggaaccaacttgtgtggttattacgtgtgcgagatgctcaaagtaaatggaaggtacaaaacaaccagtaaccgagcaggtcatcgaactcttctctacaaagaaacccatctcgcacacacttctcactgagtaccattttattttcctttctgtgtgcaga

SEQ ID NO: 40013 - DNA, 946 bp, Oryza sativa
cgccaatgttgattgggtttagattgagaccgagagagattgtcatctactgttgggccggcctccccttttatatttagcactgtggggaatcgggggcgactcaatagaaataaattgggtgccaccgatcacggcgcatagttaatcgggaattaacagattggatcgctctgattttgcgtagacaacgggtggaaaacggtctagcgtgatctttcaaaccgagagatcaattttcccaacaatatactcgtaacgctacctagctcacttttttttagaattacacagtacaacgcaaacacttaccgatatgaacatatacacacaccatatctttataagcatattaaaaaaactagactagttgacgaagttatatggacatctcgttgttgacaaatacgccgtcttactactaaaaggataaatagccgtaaatacgaatgctcataagtctatgacttaacctgtaaattagagtcaccgtaaatatgccctttccaattcatatagtatttttttatccatatataaaaacacgaggcgtgaaaattactccctataaaaaactgtgcgaatcgtaagataatcttgtctatatataaacataagccatttatattgttccaaccatcaaataattatatgagatagtaatatatatcaaaactgattcgcagccatacaaaaaactacgtccccctgcctctctgtgttgtctggttatgatatacaaacgcaatgcaacaatttatagtgtatgttaaatttatatcgttgctagtacatcggcatgtatcactggtggagaaaccatctttcgtcggtcggccgatttccacaatagtcccggatgcaataaaaaccagggctaaagatgatctttagtcccggttcaaaagggtaacgggcatatttgatctttagtcccggtttgtgt

SEQ ID NO: 40014 - DNA, 412 bp, Oryza sativa
  unsure (1)..(412): unsure at all n locations
acgtttgatttganatcctctacnccatgcaaggagggcgactgtagaggatccccgaatcggtaacttatatcaattactcctaattgatggatggttgatggttgtgtattggaggatggatcatggctaggtgatgacaattagttgctctattcctcttcctattccatttgtaacctacatcaattactcataattgacggttggttgatggttgtctagtggaagatggttgatggctaattgatgagaattagttactctattactcttcctattccatgactcttactcttcatcttccatttctcatataaaatgagaatggatttgatcttccaaaagagaaagtgagacacactttcatccattttccaacgctgttgatgctacggtaatcccatcccga

SEQ ID NO: 40015 - DNA, 1501 bp, Oryza sativa
gcctcctttgtggctctctctcttgaacatatatactgtgctgtggtctgtggaatgaggagctgttccatttggtaacaaaccatggatacaatcagctgggctgcgtatcaaatatccgttgctacaagaaatttgataatttggcacttttatcgttgtcgacttgctttaattggtaatttttgagagtgacttgtgagatcatagtaaataaatgtagattaggatattaaatatttttttcttttttttaaggccaaggggaccatccaaatatattaagaaggaataaagtaaaaaaaatgacagaaaccacatgctaaccacgtaagcactaaaacgaccctgctatgcgtagtcgatcgtcgccaggtttacgacagcatcacaagaagagactctgaaaacggaagtgtcaaattatcaaatctccatacaagcgtggcacgcagggtggcggccggcgggtaggggagggatatgcatgtgggactgtgggcgactcatcagccgtcgctcgtggagaggcgccccacgcgcgcgcatggtgcgatgcgctcgttctttcgcgcaagctgtgcacgcggcgcggcggcctgggcaggacggtgccgctagttcacggggtggttcgcggctagcccaggtgaatcgcgggccgcggctctgcaggatcgatggcgccgccgccacgtgatggcccacgatacgatgatatgcaagcgtgtgtgtggcccaatccggcgccgcctcgatcagcctcgcgcctgtacacgttgccggtcgctgtgctgcgccctgccagcgcgcggcgcctcggacgaacgacgtcgttgttacgctacgcacgctagctgcttgggcttggccagccgtctgcttcgccggcctttatcccagcacgctattcctcccctgcatcacacgctacttgtacggataattgagtcctactactatagtttcccaacccctcttctcgtttttcacgtgcatgtttttcaaactactaaatagtgtgcttttttaaaaaagtttttatatgaaagttgtttaaaaataatcaaattaatccattttttaaaaaagttaacaaatacttaattaatcacgtgttaatggatagctccgtttttcatgcatgggagatggttcccaacacccacctccgaacacacccttaactcgtactacaatattaccaaacggataaacttttctttagataatggaatgaaatagcatcccggcctttactcgaaagagctacagctaattattacaaactagctgtcacaccccaatctgataccgccgtacaacggcacctgacaggagcgtgtcgtagggaaaacggcgtgaaccgcttcctacgaaaccgcgatctcggtaccagtcccaggacatagtgctggtacccacggtgacaaatatgaatcatagcaatccttaaaataaatagatgacttatttaccttaacttaggttgcagctcaga

SEQ ID NO: 40016 - DNA, 1501 bp, Oryza sativa
gaccggccggtcggccacctcgcgaggcgcgcgcggtaatgggcgaaggcggtggaggttttgggcggcgacggcgggaagcggtgtcggcgcgagagtgaaaccgagagggagagagaaaacgagagagagagaaggaagacgagagagcgagagaaacagagagagcgagcgacggctctctctctcggctcgcatgcgtgcaacgcacgtgcgagggggaaagatgatgggctgggaggggagatgggccgggggagaaaatcggtccatccaaaaatacagggaggtaaagtagacttttacagagaaaaccgatttggatagaattgtagatatttagggtttggattcgaattcaaatttgacattcgaacttgagggtttagggatgtatcaagggaaactcaaggagaagtcatggaaaagattcaaaaggaatacttgggtatttgttctcgggaacatagggtggagtcaaggaaaggattcgaggcgggatttgaataattctggattcgtagaagtatttggtgaggattcaaaggaaggatttgaatttcagaatttgatttcagagactcgaatcggaagaggaattttcgaggtggaggattttgatttcgatgagagggaacaacgggattaaattgagatccctggcacaacttagactctcacacaaagaacgaaaattttcgtaattaggattttgccgagttagtttttaacgactcacgaaaagcggagcgttacactagcactctgtaagagtgaagttcaaatagaagcaaacacaccaaccaaactagacaaaataacattattccagtctattggtaaatctccatccatgattggcaaacagttgcataaccgtcgtttcaaccttacgacatgcaacaattaagaaatctgcatcttcatcacacttttgtaactgtgcccacagacgaagccaatatgttgccttgaaaatgacctgcatataagtaatagtaggtgatttgtcaaaaaccctatcattcctactcagccacagtgcccaacacaaggcagaagctccaacaagtatcagtttgctctttttgtttatgactccctgaagccaatcatcaaaaatatgagatatgctagtaggaatatataaaccaaaagaaaactgaactgccctccaaataaactttgcaaaatgataatcaatgaacagatgttggatagtctcattttcgtacaaaagcaacatcttaaattaccagtccaattccgtcttgctaaattatccttggttaacacaactcccttaagcaaataccacataaagatcttgatcttaagcggcatcttgagtttccaaattaacttatttctgtcaatgtaaccattattaattaaggctaagtacattgatctaactgagaattggccattctgatgatagttccatctaaaataatcaaaagtattattcaattgaatatgaacaatagatgcacacaat

SEQ ID NO: 40017 - DNA, 1501 bp, Oryza sativa
tagcacagaatggggaaaattatatttaatgtatagacttcaggttctagtgttgatgttggattagagccaccgtcctggtgtcgcttcattaaaatatgttaaatggtgggctatgggtgcatggttttgctagtcgcacccatggcaattaaggaccggttcgcgggaaaccctggaagaattcctcgtacttaccacaagccagcgtgggcaacggctgggcttgtagtatagctttcctctagttgatgcatccaggcaagggtgggcgtgatggagtttggatgggccctgcgatggcctatgcggcttccggattcaccaaggcacgagaggggactgcccgctgccttgcaaggagtgggggtgaaacctgaggtgtggtgtgcttggttagagggggttatgcgaagggtcctgtcacggcctctttccggtatgtctggtggcatgtcggcgcacggaaacgtgtcgtggggctgtgtcttgtgggtacagttgtatacctctgatcagagtaaaactattcgaatagccgtgcccgcggttgtgggcggtcaaccagattcaccgtgattagtttcaccctagtctagtctaatggaattgaatagtataggtggatggttgggcctgttgcaacatggtgtagcgttggacagtggatgtttaatattgattaattattacaaatgttttactgcttccaactattgtttataaatgctcgctttatgcaaatgaaccactatagctatgcctcgatacttccctgcatcatacccctattccggtataacgtgctgagtacagtgggtagtactcagtcttgctctatttttcccaaaccctagagtttgagtatgcgtcagatggtggcttctccgaggagtaggcttcgtccgtgccgtcgaggatgcctgtggagtggggatcccgctgcggtgcaagtcaaggcatagccccatttatcttttaattctccactgcatttatgtaagacttttataatgtttgtaagacgtggatctgtatgtcaactttatcgtttgtgtaccccggccggtcctggacggggaatttaatgcacattctgcttggaatttgtcaaatcaagtcagtctagggttttagtaaaattatttgagatttatttgacagtcagtcgggatttgatgggaggaatgcattaggtcctaactcaggaatatgggttgcaaggtctttatgctcttattgttattattagtaagtatctaatttctcattattttatcgctatgtaagtctatcttatttattcgctctcatgcaaaaaaatgatctatgcataaaattccgctcttattcgcttatttaatttgagtcctttactgcttcatttaaattggatttgagcatgcattgatcctacccctttgtcttctctagaggggcgaccacccaaccaactaccgcggagaaggcattgacgattttgtggcagagttggctcgca

SEQ ID NO: 40018 - DNA, 1052 bp, Oryza sativa
agtttagaaaaatagcagaacactttctagaagagatatttcagtattttttcacatagtcaacagtagaaagaatgagatgcctacacgcattgtcttcaaagaaacatatattgtacccattggaaaattgatcagttactgaccagcgaattagaaactataaaatcatgctcaatcaccttgagctctctattggagaactatgtctctgcttcctcttctttttaaggattaactgaaagtaaatataaactttgggctgcgaagatgacaagaacctctattttctgtaatgctttagttttgccctgaacaatgaacaaattagcacaatggagtatattgttaatgaaactcgataaagaaaataatcagcttatcccttgtagcaaggttgggttcaccatcctgattgtgcagcagtaagtgtaatcagatcattaacaggcattgttaattcaaaatcaatatctacccttaaatcttgaaatgttcctgagccacaaaatcataattagcttcaatttggatagcatatcaacgcatcagtgctgaagggtacatagttttaccttaaaactggagagggaatgaagttcataactatctcctacaacacacatttttatttagtggtaattcatggttcttttagttcataagttgactagttgataattattaggatttactgattcatgaaatacgaacacatgaatccataaaaaacattcctaattactacccactttggtcagaaacttgtggaactttaagtatcaaaatctttttcaatatttagattggaaaataaaaaaaacatatatgtagaatactagagttttcttggtaagtttcaaccaaaatactgtatttctgcgggactctataaatattttaaaatagaatcagttgttaaggttctgtgtgggaactgtgtcaatgtccaagacaatgtttttgtctaaccatgtaatgtatttatgatcacaattttgttacatattccttataccaatcctttaatttatggctaaatatttcctgct

SEQ ID NO: 40019 - DNA, 1501 bp, Oryza sativa
ctaaaatatctcgctgatacaaccaaatcacaaattgcagtgccagtgtccagtgtccaatttccagcaagaagaatattgcgaacgatcgtctcaccgtgcaaccggcgaaagaacgatgatgccaaggatcgagttccgagacaaggcggcagcagcagcagctgggcaggtttgttccatgcggctggttgcatgaatcatacatgttacagggctccaggcgatggccactcaatatcaatccagtatcttatgttatcttgtcaatcggggtgacgtggagacgcgacggcacgagagctgatcgatcggccggcccgggtcagccgggtagcttccgccaaatcgcagtgaccacatcgccgccgaatgcggaatctctgtgtgcagcaacgggcaaacacgggatcggggtggagaaagcttattgggagaagtttgtgtttagctacagtagctttttaaacttcagtttttcttctggtataagtcagtctggctgattgtgttgtgtaactataattttttttttaatatattaatgcgtaatttttttacgcgttcgcagaaaagaaaaaaaaaagcttcttaggagccaatggcatgcgtgcttgttcggcaagatcagatcaccgccacctgcgatgatggatcgatgatcgatctgttccataataatagacgacgattatgtacagtcttcattacgcatgttcgcattggattattgctccacgattatgatgctcatgctgagtcattcacaaatcgcaaccacgatgcctatcgtcttgggctcttggccgacatctccggggtaaagaaatttgtaccagagcattgaccacaagctaaattaagttccgatcggttaagtttatcccagatgtggttgatgtggttattggggaccacttgtacgaattatcttttatagtggagcctgacaatgggtctgacgagcctgtaccaatggatatggagaatctggatgatgggactttggagaaggaggaggggaatctgaaccaggatttggggaaggaatctggaggtgatcctggtaacaattccttaataggttctggtggtcaggttagtgagaggggtggtccttctataccggctgctcatttgagtctgatacctgaatctgatggcttgaatgtatctgatgaggaatttgatggcttagatgaggattctgtaatggttaagaaggttaatacccagcaaagtctaggggaaaagctcgctgctattcctgaagcagtaatttctctctccaggaagagcaagagaagggcaagtgacagtgatcaacttgttctccaaagagctgagaaattgaaggctgataagaatttggacaacttgcaggcaaaaggtaactttcatgataatgtttcttttttacaatttacaaatgaacaaatttctgctgctcttgataatcttggtgtgatcactttgggtacgaattttatcttagatgatg

SEQ ID NO: 40020 - DNA, 1501 bp, Oryza sativa
tttgacagtcagtcgggatttgatgggaggaatgcattaggtcctaactcaggaatatgggttgcaaggtctttatgctcttattgttattattagtaagtatctaatttctcattattttatcgctatgtaagtctatcttatttattcgctctcatgcaaaaaaatgatctatgcataaaattccgctcttattcgcttatttaatttgagtcctttactgcttcatttaaattggatttgagcatgcattgatcctacccctttgtcttctctagaggggcgaccacccaaccaactaccgcggagaaggcattgacgattttgtggcagagttggctcgcatgaccctggtggtgggctaccccaatgcgtcggagtactcgactgttccgccgctcagtggcaagcttcctcaccgtgttcgtctggaggttcatggctaagtgggcacctgcctcgctaacatggtggttgtggcatctggaggcacagcagatcacgcctgtcaggaggcagcatatctgatgatggccagacttcgtgagcgcgacaactacatcttctgcaacacggcgtaccgtttccaccctcgccgagcaagtggtgacggtgtcagcaccttccgtccgacagccggtgagaacgacaccaccttcggtcacatgtgcgcaatgatgaggggaatggacaggatgcactcggatctgcacaaggcgtccaaggccttgaatgatgggaagctcgtgaggatcatagctctgaaggatgagatagcacgcctgaagaaggagaatgctcacttgaagggtctccccattcccggaggagtccggatccgcaccatgccccgcaagtcgacgactgcacccgtgcgcatttagcttgcgcccaggaacccacctccgcccgcagctctcgcagctcctccagttccgcccgcagttcccgcagctcctgcagctccacctccagtcccggctccagtcccagtgtcagctcccgcgtctgctctctccttcgctccagcatcagccgccaggggtccagccagtggcaacggaggttggttgcctgctactcccagtggcagccgcgaccacagtagcagcagttccagtggctcagagctgggcagcggcgagacgtatctgctagactccaggagccgctcagagggacctggcgacgagcaggaggacgccttcgactccaccgaccgcaggagccgttccgagcattaggctcgctttcccttagtttaccgactgcttagtatttgtctgttagtttgtgtgtttaggtttgttcgcttgtgggtcagtcgacatttgatatcatgtgcctatgatatggctgtcttaataaggatttgcttgctgtttaaagtgtttcaattcagatcagaacaattgcagtttaaattcctataaaataaagcttagttcctgagcatctgtttttcttcttttccaccccctccgtctgctcttccttcaga

SEQ ID NO: 40021 - DNA, 1501 bp, Oryza sativa
tcaatcgatagatcaaataaaatccctatcaggcaagcgccggtgtttttaacctaattgcattctgaagtcagtctctaggctccagtccaccgcagggtttacaatattgatgataactgcttagttgttgcggttatttcgagttatgaacgtataaccaaaaaattgatagtattaaaaatggtaaaatatcttaatatgtgtggtaaatatcagtttacagtactaatgatagccacgtgtttattgcggttattctgacctgttgaccgaaaacgtatgggtaaaaatttgatagtattcaatagaattattatgtaaagatatcttattgtcgttggtaaatatttattgtcccactctttacctttaagcgcaactcatttttaaataaaattttggtaaaaaggatgtagctatgcaccacactcttcggcttgcgtcaatattctacatttcacctaaatttattgtgcatactcaacgtctcccttctcatacgcccctcttaaccgtaaccccgttttcgtagggcattgatggtactccaatctatcatccaaattacttcatgacacatgaaactaacagaagcaccttatcgtattcacttcgtttttttacaagccaaccacagtgccatcaccactcaactaatttatctttattctgttttttttattttcaaaaattatccggtaaatccatttccaattttctcgaatatgtaaaagaactccaaaatcatttctccaaagttcaagggcctctggcctccacctcaccaaacgccgaaacggtgaggtgaacaaccacgcgtctataaaaaacacttgtctcctccgccttccaccttctctcttttgtactcgctttcgcagctcctcttccccggcttctccgttgaccgccaccggtgacctccccgccggggaggtctccctcgccggaaacccccccgcctcccaccttgtcttcgcggcggcgttctcccgtcatctgatcggccggcgcctttggtcttcgactgcttccgggggctactcgattcggttcctcttgatcccgctacggcttctcttgttgctcgccatggcgaaccgaatcacggtgtcctactccggctacgtggcgcaaagcctcgccgcgtcgctcggcctgcgctgctcctccgcctccacggcggcgggctaccgcttcttccaggacggcgggtggcgccccttatgcatgctcacctccttctcccccgggcacgccgagcaccaccggaacggcggtgggggcggcgaacaccgccgtgaagccggggaagggcgaccgcccgaaggccctgccgctttccgccgccgcagggggccactcgctgttcctctcgccggcgtacgcttcgtccagggcgcagccgccttcgctgcccgtgggtttgctgtcggtgctcgcgcagggggcgacggggtcgaagggtgggatctacggcgccgcgtctctgtcgggc

SEQ ID NO: 40022 - DNA, 697 bp, Oryza sativa
gatctatgattgtttcttgtgggtctcattttactggaattatttcatatgcttgtcgaaatagccgcttcctttaagctgtactgttgcttagttgctgctgttgctgtaatctgtccggcccgaaaggctttctgaaaccatgaacctttaacatcaatatatattgaaaatgatactatgtttgctttgtattgaaaatggtactgtgtttttgtattgaaaatgttactgggtttttctataaagtgaatcaaacttaaataattttaaccttataaaaaggtaaagctttctataatatgaaatatactaaagtgcatagatttaagacgggtagaccaaaaccgaaagaagtcaagaatcatgattgatccaatcccggaagaactgattgcaatctcgacggatccaaaacagggatgagcttgcaaaatttacgaccgcgagcaatggtagcgacccacagtttcaccttccctccatcccaaatcttattccagccccatcttttcgcttgtgcttatgcttattagccaactttaaattttcaatattaaaattagagtttgaccttaaagttttctcatctaagtttattatgtagcctttacttttagatacttaagaacacgtatataaaaattttactcacaaagtatttttccgttacaaatataccgctggtttattcagc

SEQ ID NO: 40023 - DNA, 1501 bp, Oryza sativa
ctcgttaattgcaactttgctagatcaatctgcaacaatggattgatcgtttttttttttgaatttgtctttttcatgttagccgtgtatagatacgtgttacagatctatttagactaggccatgtagtatatctgagactgaacaaaggatatactaattccttttcttttcgacataaaagggatactaagttttgtagcaattccgatccgttctaaaaatacagtgtgatatttaaactattcatgtatagaatatctatccgaggaatataaattctaaacatacacccaattctgcatgcaaatctttattcgctaactgttctacactgcagggagcaaatcggaagatccactcatccccgcactggacaagggcgccgcgctgatggtttgcaggatctgcaacgccaagggcaagcactggacatccaagtgccccaacaaggacttcgcccctctgcagctcgacgctctcgtcgacaacaatattcctcccaactctggcggcgacaatggcggcggatcccggccgggcaagtacgtgcccccgaagccgagggagtcggaaatgcggcggaggaacgacgagaactcggtccgcgtcaccaacctgtcggaggacacccgcgaggaagacctccgcgagctgttcggcagcttcggcccgctcacccgcgcgtacgtcgcgttggatcaccggaccggggagagcagggggttcggcttcctcagcttcgtctacagggaggacgccgagagggccatcgctaagctcaatggctatggctacgatagcctcatccttaatgtcgagtgggctgctccaaggcccaactagcctttactagcactaaaattttctattccatccgtttcaatcatattataagttgctttgattttttctagataaaaaattaagtttgatttaaatttatagaaaaaatataacttgagttgtaaatgctaaatgttagttttagtgaaactaatttggtgtcatagatgttgctaatttttttctataaactgggttaaacttaggaagttttaactagagaaatggtcaaagcgacttataatatgaaacggagggataacatagtattatacttactactatctgctttgcatgtttcatactatagtgttggattagtgtgatattttgttgaatcaatggtttcatcagttataatattttgaggaagttgcatggttgaatgttggtggttggttatgtgtgtacaaatccaaattagtgagaacactaatattactaggcccaatagaatgtctctgaggcctaacttatccggcccgtagactaaaaagcccatcaacgtggataccgccttacagatcggggcgcacaaaacgatccgagccgctcgttccatttccattcctacgccgaggtcttcttccccactctctccctcccacgccgccgcccccgcaaaccctagcgaacgcagcggagagaggagaga

SEQ ID NO: 40024 - DNA, 187 bp, Oryza sativa
ttgatttctgcaagtcagctggtttgaaaagcctatacaatctagatgaacttgaagaggccccgattgtactgcgattccaacttggtcaaccgatggtgcttgacacggaaattgaatccttaggaactcaagcgcattggctgcatgaatggtatttggaggaggccaaaaaagggggtcggga

SEQ ID NO: 40025 - DNA, 1501 bp, Oryza sativa
gtgcttatgcttattagccaactttaaattttcaatattaaaattagagtttgaccttaaagttttctcatctaagtttattatgtagcctttacttttagatacttaagaacacgtatataaaaattttactcacaaagtatttttccgttacaaatataccgctggtttattcagccaaacaatgagtccgaaggcggcggaactcgccggtggtggtgccgcttcgcgccgccgcggcacgacgtgtcgacgtcgccttcgccctccttctccactcacccgacagaccacaccgcaccaccaccactcgtcaaccccgatccactcgatctctctcaccatcctgtggcccaagagaagaaaaagcaccggcgaacattggacggcatgaggcagatcgagctttcgatgccaacaaaacaaacaccaaacttttttcgagctgaaaacacaaagggggagaaaggccaacaaagttgtgacctgatgaaaagagtggagggctctcgtctcagttcggcaaaaggaaaggctggagactgaaaaagatggcgggaattgacatggagccaactgggaatccacgaaggcacgaacggaatggatgccagtagcgccactaagagcaggtacaatagcagaagccagttgcaaatatattttaaggaggataatgaggagagagaagagcagtgggctataaatttgtagctagatgtagcacggactccaagacgcagtgtatatatgacaagtgagactaggtattaataatgtagtatgtaactattgtataaataagctattagtagattggctataaatgaattggagttagtagttgactatactattaaacttgctttaaatataccaccagccgcaaaagttggtgaatgtagtattctgagcctgtgttcagtagcaacagaattggctatctttatgactcctttgttgcaccttatagtttagtgtgttaactttacagatttagcacataccaggatcttttctcctgtcgttacattttgcttaatccagtcatccagataatcacaccctcctaaaacgctactcctagctacaactttgtttatttctgggagtgctaagtttcgttcacgtttcattgcaatctgaaacagtaatacgcaaggaatacctggatcatacgatacgaatatctagagacaaaacatgatttgagtgattgatgatcgagaaagaagctcaaaaggtcttgaaaagtcgaaacgtccatcactgaaattcggtttcatgccctcagatcccattgctgagtaggacgcagattttcttccttcctaccatttcctttctcttgcttcctttttggtcatttgagatagctttatccatcctttagcaaaaaggaaaccaatagctagcaatacttgccatcatatatacctgggcaatggccggccaagcaaactcagttctctacattgaacacttcaggtttgagtagaca

SEQ ID NO: 40026 - DNA, 1501 bp, Oryza sativa
ctaagtactacctctgtcgattatgggggtgcacctggatattatctagatacaatacttccactgtcgattatgctaaatactaatacctggatacaatactacatctgtcgattatgctaaatattaatattttaggacagtcgtttctcactgtgcatggcctagcatggtttcccagggtgatttttgatgcagttgcctatttactgaatcgacacgctattgtaatgtagtaataggcagtgtctaatctgttactatattttgggatggagatggagagtacacttattttcctattgtttcaaatttaaaattttgcctagttgatcagaattgtctaaattttaatcataaactcactaaagttaaggccactttgttctgtaacaatgctggcctgcaattttttgtcaggacactaggagagcatccgtcttacatattaccagtattttgtatgatctcatacagttgatcagatctatggtattatgataagagtacagtttttcgtgtgagccaatacttatatgagcatgctccctggattgctaatagcttttttttatgctgctgctgatttaaaatgtggctacttaaggttgcttacttgcttacttaggttatattactagtattaatatgttcatgcccttaggttctgtttccatgatccatcatcctcatttcttgtttggtaaaggaaaagtatatcttggaatgcacatctgaacatttacccaatctttccaaactccccatgtgaatataacttgctgctcgatgatgaaattcatatgatgggagattatgtgtggcagtatttcatttatttgtgtgatttgtgaattgtgccggattagggtataaaaccggcacctatctcctactatttaattacccggccaaccacttacccacttcaccctctatctctcttatccacacgctctctcccttattctcttttgttcactatttttgaattgccctttattctcgtctctgtttatactgccacacataatcgatgacgacctagtacaccatggcatggaggccgtgcaattggcagcctgccatattttggcgaggaggccattaagttggcaacccgccatctgagagcaaatatattcctgttttgtgcttgtagcagttccgagagcacaaaatatcttacacctttagaccatgttatttttcaacattagtaatgttattatgctcgatgatgactagatggaacacgaagaattcgctagctccggatctgagggtgaacataatgccagccctagcgcattcttaaacttaaatcaagagcattccgaaggcagcgaggtaatttcgacgtatatttcacgcaatagtgcattagcaaattccaactctaatggaccattcgaactaatcgaatttgcaatttccaaggaggttggcacttccactggtggttcgggccaggattcaaccgtctcatatgggaggtagc

SEQ ID NO: 40027 - DNA, 1501 bp, Oryza sativa
atagcggtcgatttgatactagagccttctcttgggttgtgtgtttgttttgttcttttcttgttatagtttttcagggttgcagtgttaccttttccctttctgtattaatataaagctttgcacagcaggttgtttcaaaagtttgagttttttacagtggaagtagagagatttaattatagattaatagatacattttctatttgtttgataaaatcaataacttctcgaagaggtgaaactttttaccgtcattatcattggtatagaacaagttaaaggaaggaaaatatgtggaaggtgtggtgccacaatattaaaactatactttatactcttttgcgcccaaaggttgattccttatagccttaactaccaacaaccatacaataaatggctaattaatcaggtcattggtaaagaaatgttattgtcaaaccatgtctatcttgaaagttaacaatcacaatcacgcgcgtacttattaagaaaacatctcattgtttgagcttgcgatgagcatgatagcaatgtcagtgtcgattatggaaatgggcaataattaaaaagaatagcacatgagatctaaaagttgattgatggatgcagagacaagaattaagacaaattcagggctctctcgataagaggtaataccttactattatttcggaattgtatctgtcgggtgtatatattgatatgataatctaattgtgacttatcttgctatctctggttatgtctttggagagcttcccgctcaccttatataggttaggggtagtgttacaaagagtaatacctagccggacacagtatcagtttcctaatcaattacttaataccggtcgggattctaaattatgttatagaacataagacaacattgtgatcaagtcctactctattacatagtacatggatttggctcacctcctatctctagtcaaatatagaagtcgtgtgggtacccagtaccccatattctccatagtcaggttgtattggatcacttgctctatcaatacctacagttatacctacatagtcaatccgttctatgcaattatgcatagaagtgttccgaccgatgtgattaagagtagtgatccagctatccttattttatagatgatgtggctcaacgtatatatgttgagtaactgaattcaaatatataggaagagtagataactaatttgacactgaattttaaagatactatgggagtatttggtagtgatatcagtggcagatctaacaatttctttgagcctgcgcaaacctaacaacggataacacatacacataaatctataaaactctatacttatatttcatgcacgcaaagaaataagttgatagacacaagttgtgatttaggttgagaaaatacgatctaataatttataataacgagaagaaaaaaaatgcaactcccccttaagttatcagtttcacgtcctgttatagtgagaaaaactataacagtgaa

SEQ ID NO: 40028 - DNA, 174 bp, Oryza sativa
acctaacctcacctgatcgatcaaccaaactaaccgcaccaagccagcaaccactcgagcactcgcggctaaacctataacaaaccggcgcccccgtagcgtagctatacggcgtacaccacgcgcgcggagttgcagacatgagagcctactcggcgacggcggccgcggcgg

SEQ ID NO: 40029 - DNA, 603 bp, Oryza sativa
gcatcgatgcgcacagcactgttttgatttgtactcttgttgtcctgagtcttggtgtaaatggtatacccgttcatatcatagccctggtacatgtggattgtgttggatggcccccgagataatgaaaaaagggcaccatcgatgtctgcagttgtcaggtactccatcaaccatttcccgaattgaagtttatgcatcttcgcaagccatgctgctcctttcctgggattgtctctgcggagtacatccaagtgcatgtgcacgtacggagacaccaaagctgactgtcgtaacactgcaaaatgggcgtgtcttatggtttgtcgatcaggggtgaaaattctcctgtgacctaatgttccctttccaagcatcctaccctcatgacgaggcacaggaacaccgataggttgtagatccatgtaatctatacagaattcgaccacctcctctattgcataactgtcacacccagaaattctcgaaccagaatttctaagctgaatgtgcattaaatccctgtccaggaccagccagggtacacaaatgacaattgttgacatacagacccacgtcttacaaaaatataaaagattacaa

SEQ ID NO: 40030 - DNA, 1501 bp, Oryza sativa; identical to SEQ ID NO: 34021

SEQ ID NO: 40031 - DNA, 505 bp, Oryza sativa
attacaaaagtgcatatttcactatgtgaaaggaaattcattaattaccaactacctattacattcgcttcaaattacttgtcattttaaatttgtcttaagtccaacaataaaaacttgaccatcaattattacaaactcatatgagtttaacatcatgagatttatatttttatattcattacgaaaaatacttgcatatatataatttacatgtttttaaactatagaaatttctaaaattaatgataaaaaaataaacatgtttgacttgaattatccacagtaggaatttcgttaactcacttctccatacggtgcaattgtttgagttcgctatcccaacttccaaagtaatcgtccgtcgccgcctgccaattgacaaaggaaaggggaaaaaaaaacaccgtcctttgttcatacacttcattgtgaagtgtgaacgtagcattttctgaggccattaaactagtcgtctctcctcttctttgtttccctccacagc

SEQ ID NO: 40032 - DNA, 548 bp, Oryza sativa
gctttgtttccgcttgttttatggagtttattagagtaaacgccttttcttttccgttggtcgtgtagacgctgcagcttcggaagatccgctcttcgtggaagttgaagccggcgtttgggaaagcgagcaaggcaagtcacatcatccttgagcatattgaatcccagtttataaaattattttgatttaaattaatgcattatcgctttatttaaattcccgcgttatcactgttttatttagccatgcctatttacctttgttaagacattattattgctattgttattattacctcgttcaccctagaataaacaaaaccccaactagtggacactctactcatggtaccactagcatgattttaggtggtttttcaactctagacttggggatattcatatcacctggacactttggaatagttggtttattgtggaattggattcacaccgccccctctattcaaaatccccaaaatggttttaggctgggctcggggtgcatggttttgatagtagcacctcggccacataaggaccggt

SEQ ID NO: 40033 - DNA, 1501 bp, Oryza sativa
gtatattcatacctacgtagagatatcaaaattcccaataaaagatgtgatacctcccgatatgtttttaagaactgtaaaatcattttatctagtgaaattaacatttttttgtgatagagggagtactgcatgcctacagcgacgacagtggcaaaagcagcagcagatgcaacatgtattgtacagctacaactccagaatacgtagtgcccagtgcttactgtttggtgttcagtgagctggggccagcggcttcttcaggagtcgctctcacacagatagatgcaaacaggcagtgcgagaattaacgctgcgtgggtcagattggatgtcgaggaatagtaatgtgaaattgattgaggcccttctactctctttttttctttaaagttggtgacagtgtatgattgttactatttatgtcggctaatattgttttcaaaattatctggttgtggtcagtggatgatggttacatatgcaatgcgacgttctagatagtatttcaaattttactagcaaaaatactggtcaaaattaacttctaccatgataataaatttatgaaaatatccattttactccctcaaactattttatcaaagcatttaacccattaaactacttttcgacttttttttacactcctaaactattgaaatcgattcactttactccttaacggtatttgtttcttttccctgcataagttgtattttgtatagaaacttaattggatgatgatagatgtattacaacttgcgtccagtcatttagaagcaaatcgaacagataaaggggaatcactataagtgtggtggttaagtcatgagtcgatccatcaaattcaaactatagtggtcacgaatattacgaacacatagatgtgcgttcaataggattttagtgagtctaaggatttacagatggtctctttgagtgtgtgttagtgatacattagcggatatgtaagtaaggtgtgagtgtatagaggtgtttatgcgtgtgtttcttctgtgtaatcgtaaaaatgaaaaagaaaaaaagctgatggtttttttcactcctggcatactgtggctttggggccgataagtgggctaaatagatgggccgagcaaaacggcccaagaaacgaagaggaggatgaaatcataggtccagggtaaaaccttacccaaatccacactgatctcgtcatggcagctccaaatccttctgctactatggcggcggcggcggcgtccacgccggcgagggcttggtggcgggcggctgctccggcgagtgcctcaactgcagctgtaagctgcttccgagttggggccaagagcctgtaagacctcctctctctaagcttcttagctttcaagcttaattagtggggtactggggtttcttgtcgaaacattgggttctggtagttttttagcgtcgggatacacgccactttagggcaaaggaggtatcttgtgttcatgaatcttgctatcggctc

SEQ ID NO: 40034 - DNA, 560 bp, Oryza sativa
cgtgaactatcattaagccatccttaaataatagtgagtcataagttatcccaatagtgtgctattgtttctaagcatggctaagcaatcataactaatatctagctgaaccaatatataaagcccaactagtcaagttataataacccaaggtatcaaggaataaagtaatcaatgcaaattggccataacaaaggaataagttcacaccacccggtgacattcgaaaataaatgcacagttgaaataaatagagaatttaaatataggatcaacatgctcaaaggattgtgtttaggatctgtgtgacttgccttgcaataatcggtcttcaagtaatcttcttgatcacttccgacgcactcacgaaccttcgcaacgacggaaacgacaagctaacacgcaaaacgaagaaaaagactaataaaaaccaaataaacagtacatataaagtaaacaaacatgtagatcatgattttagatgaatttagcaacttgaaccactcaaaaccgagttacgatgatttagttatgaatttccgaagatttaatctattaga

SEQ ID NO: 40035 - DNA, 841 bp, Oryza sativa
tatacatgtatatatatatatatatatatatatatgttactcgcgcatttatcctaatacatttttttatcttgcagaaaagacgtgttgtcggagtcgtccgtcaagcctgagtggaagagctagccctagaaggaattggagcaggcaagtgacgtaataatataaatgattgttatatttgtaatgcaatgtaattaagattattagacctggaattagacttatcatataagattgtgtagtgttctaatattatttgagttttaatataagattattttattgcaaattagacttagtatgacattattgactacggaattggtgcgactcctaggaattgactattgtagtcttaattagacttagcatatacgcacgaaacacttagcatacattactattttagtcttagcatgtaatattatttgagttttaatataatattactttatttgtaattagacttggtatgtaattattgactacggaattggtgtgacaagtagcaattgactattgtagtcttaattagacttagcatatacgcacgaaacacttagcatatacatgactattttagtattagcatgtaatattatttgagttttaatataagattattttatttgtaattagacttagtatataattatttactagctagggttgtataatatacgtcacctagacttagcttatatcacgatttgtaattagacttagcacgtaaggtgtgtagggttctaatgtacgacatttacacttagcatacatgaattagattggtaaaacataaatgtctcgtgacttagcagatgtttcttgtatcaacaga

SEQ ID NO: 40036 - DNA, 1063 bp, Oryza sativa
cccaaactgagctttacagcaaaatatattcttctataacttcatataatttgcataacaaatattctaaaaaaattacagcaaaacactatggtacaaggtataaactattagtgctttcactccatcatcagtacatactacatagtcatcaatcatcacataacagcaacacatatcagtccatcaatattcagtacttagagcgtacacagtaacaaagagtgatagaggtggagccgtggaggttgaggaacacctgctgctgctgggctaatggctgctgaaaggcgaggcatcgtgcatcggtggtggtgaggctgtccgcggtgtggccagtggccggcgtcatcggtgtcgtccgcgtcggcggcgtcggcatcgtcgcctcgtcggtggtggtggtggctgcgaaaatggtgggggcgaggaccgagcgagagagaggaaaggcggcgagacggcgggggcgaggtcgcgaggagcccactagccgaggacggcagccaggcggccggcggtggcgtgctcgaccccctggaggctggatgcgccgcctctctcgatctgtctctctcctctctagcctctgtagggttagccagttagggacctagggacttgggttgggcgggaacttgaggaggaattatggactatttggatgggcttttttttacttcggaaattccgacaaactttccggaatttttccgaccgattccgagttccgacggaaactgctattatcatattcgattccgtttccgagaaatttcgaccggctgattccgttttcgaaaacaggtccggaatccggaaaaaatctgaaccgttttcacccctacgcccagcccacctaccacagctgagtcacccaagaaagggagaaagacaaacaagacgccgaaactggacttcgcaatcaagaacgttccactctttagtgccaaccccgacaagaacggcaagatcggggcatcactaggcgagaaataggaactcgtgctcatcaccttcctccgggacaatgttgacgtgttcgcttggcagccgtctgaca

SEQ ID NO: 40037 - DNA, 1501 bp, Oryza sativa
ccggttcgcgagctactgttgtgagacatttatcgtgccaaccacaagccagcgtgggcaacggctttatcttttgtatagcgtgattcattatagtgcgccagactgagaagtggcgagaagtccacgggggtcgctggggagtccatgcctctggtttttgagggggtgattatgatccaagaaaggtgcgctgtaatggattatgttgtgcaaggggtattgtcacaactcctttccgaggtaccgtggtggtattgaggcacatggtgacatgatgtggggttgtgtcttgtgggtacagtggtacacctctggccagagtaaaactattcgaatagccgtgcccgtggttatgggcgggttgagcaatgtttttcgtgattagtctcacacctctcacaataattatggatgttaatacctgataataatttgcttagctcctggtttggagttagatctgtacagccgggtatggttgttcaggatggttgggcctgtacagcatgggtgtgctgttcagtgttgattaaaatttttaattaattactctactgttttactactcttaactctttgctaaatgctgctttcgcaaatgagcctatattatgccatcctttggtatccttgtgcacttgcatatttgctgtgtggcttgttgagtatgtcatatgctcattcttgcaataatcaatcaacctcagttgaagaaaaaggatccagaaggagaagacgtttggcttataccccagttgagctgcctgtgggagtggagctgaagccatcgctagaccgttaattccgctgctgttttcttttcttttgtaagtgtgtaacgttattattatgatggatttgtatattaaattgtcagtttgtgtacctcggctgattcctggacgaggattttatgcacaaataagttcggaaattactagtgaatttccgggcgtgacaagttggtatcagagccatcttgactgtaggataagccaaatggtcaaaccttaaggacaaatcttccgaaaacataatttgtgaaaattttcctttcttccttatctagaattctttgcaaatcgttttgtcgttcttcccccttcctctttcaacttgagtagtcgttaatcttgatggagaaactcgaagacgtcgatgttgtcaacttctgcaagtcaagtggatcgaggaataagaagatgatagtcgaatcttaagtgttcagatagagtgaagtttggaacctatcttagaacctatgccgccaaagtgtctttgaagaatagttagtagggtagaacgcttgttgtttgctttgtgtgtaggtatggttgcattcccatcattggagtagttcattgatgagtgtgtaactatactaggttgcttgcttaatcaacttgaacaatataatggtctacacacatcagatcagtgttaacctagttaaggtcttgtctttagtgtaacccctctccttctaccttttctaatc

SEQ ID NO: 40038 - DNA, 1501 bp, Oryza sativa
taatctaaaaaaagaactgagctcaaatctaatgattatatcaaaatctagaagcagtataagatgactacaatgaattccaaaatcacattgctaaaatggaatatggctaaatttgtttagcgttagtgatcaaatcatgctccaatgagattaaaaaacaccccagctctcgtaacctcgtttctctcaaacccttaaaataataatcttatgctcttttgtttctcgtcttatctctttttcctctccctctaccttctacatccacccaacccacaaccgccagatccggcatgccccaaggctcgacaccgctcggtggtctcccagacgatcaaggtctcccgcagaagatgaagagtacggcgggctagatccatctgactacatcgtggtcctgcctttctgagccgcaacccacagccaccggatccaagaagctcaaggctggccaaaaccggaacgggctcactaaaggccagcctccaccagattagatgcccatcgctgcgcatcctccactcccacctgatccgccttcacccctccgctgccagtgccaccctcgtgtcaacatcgagcatgctggaggttgttgtcgtcgctgccgtcatcgaaccgcaaacctagccaccgtcgccaccaacatccgacatcgtcctattcgtcgcccgctccgggtggcttttacttaaccagtacctataaattataggtacaagtttttctaaaaaaaaccgacacctatagtatttgtgttgattttcctctacaaccagcatatatagttacccaaaggtgacgtttttgtattctttttcatcctgtggatttagggaaaggtttatatgtgccggttttaaatgaactcacacctatgaggcttttgcagtaatgatgcgctaagggttcagtactgtagctgtagagaaagaaactattgacttaattaccttcggtggaaaggtgggtaaattttacaattaatataccatttaaagaaatgcccacgcaaatgaatggttagaatttactcacaccagtgccccttgtcacttgtaccgtgtatcgtaaaacaactcctggtaacgacgatgggcacagatcatgaccaatttattaaagcccaaggcctctgcttcttgcttctgacaatctcataaaggttttcatgagcggtgagccggtgactagttcatttaatcatgatctaatagaacttatcaactagttgtattatagaatcagtagggactcttctttaatcgtggagttgtattaatttttccactgttttaattatgtaaaaacacagacaaatactcagtcgtcgattgaacggtttaatttgggagaaaattatttgacagaatttttatgctcaaatcatgcagattttatagccttaggataaagatctaaccgctggaaatatttgacataaaaaacaaactgaaaaaataaaagagcaaatttcatatatgattttattggaggc

SEQ ID NO: 40039 - DNA, 1501 bp, Oryza sativa
ggccagggtacacaaacgacaatattgacatacagatccacgtcttacaaacattataaaagtcttacataaatgcagtggaaaagaaaaggtaaaataaaactaattcttgtcttggatagtgagcggcgctattccacaagcatcctcgacggcacggaccaagcctactcctctgagtagccaccatcaaaagcgtactcgaactctagggttgggagatagagcaagactgagtactacccactgtactcagcaagtcataccggaatagagggtatgatacaggatataaccaaggatagctaaaggggttcatttgcataaagctagcatttaagaataatagttgaaagcagtaaaacagttgtagttaattaatcaatattaaatcatcactgctcaacgctacaccacgttgagacaaacccaaaccaccacctgaactaaccagttcattaagccaatttattaagtgggattaatcacagtgaatctggtcaaccgcccataaccgtgggcacggctattcgaatagttctactctgatcagaggtgtacaatggtacacacaagatagccccacgacacgttttcgtgcgccgacatgccaccacggcatatcggaaagaggccgtgacaggaccattcgcataatcccctctaaccaatcgcaccgcaccctagcaggcaacgggcagcttcttcttgtgccacggtgaatccggaagctgcatagacgtcgcatggcccatccaaactccatcacgctcaccctagcctgggtacgtcagctagaggaaagctacactacaatctcagccgttgccaacgctggcttgtggtaagtacactaaattcttccagggtttcccgcgaaacggtccttaacctccatgggtgcgactagcaaaaccatgcacccacagcccaccatttagtgtattttagttgattaacaccatcatggtggtacatgtccaaagttatgctaaaccaatgtctaagcatttagcgagaatcccccattgtgtgctagttcgactaagcaaggctaagcaagtcctaatccaacatctaatcatattacaacccaagatagcaaaggaataatagtatacaagtagtaaagttgagtacaataggtaaataaaagaatgatttaaaggaaataaaagagcatttgcaaatttaggagcaacatgattgatgaaccagctggagggacctcggctactatcttgaagtaaatcggagcgtcggacgagctcgattctatacgacgtacgagcacggtgaggcgacggcgagcgatcggggacggcgacgaccggcggacaagctccggaacctcctggcgaaacaaatgagatggattagagagagagggagagttcaagaagggcatggacgtgggccgaaggcgtcggccatggcattgctcatcggcgcatggtgaaaaggggcttacggaggcggattcggccgaacggacggcgga

SEQ ID NO: 40040 - DNA, 804 bp, Oryza sativa
ctgcagcatccaagtagggtgttgcaagctacagcctacaagaggctacttttttagtatcagccattgatgtacagcaccctggtagatgcatggagttatacattcatgattctaccgccacacagaaaatattatattgctatattgtaaaaggtctaatgaagtatctttaaaaaaacctctcagaaggattaatccaatcttttcttttttttttagagcatggaggacttctaaccatgtcttagcatgattttgataccctgtggcccatggggagttggatcctctaaccatgtcttagcatctgtttaaaagagtttttttagtggctacaacttcttctaaaatttacatctccgctatgcaatttaaattctcatctaatttgttagactctatatttataaaatctagaaaataaattaacagttagaaactatgaaacccaacctttttagattttcattactcccttcatgtcaaaatataagaacctagtcatatcggttgagatgcattctgtactatgaatctgaacatattcagcactatattattatattttaggatagaagaagtagatgacttagtaatcactagctgcatattataatctcgagctccacaaacaatgtcttaatcaattgatagtctcggataacttcaggcgtcgagttgtaccatcaaactgaggattttggaggcgtctgaacatgtaccaacatgcctaattgcctatcaaagtagtcctaatgatgcaacatcaatgtctggattgggtccaatcatgtctggcca

SEQ ID NO: 40041 - DNA, 1501 bp, Oryza sativa
ctctatcaacttggttctaaactctgcagataaattcttactaataaatgtcggccttggtcgatcacatggacctatatcaatttcttccaaatcatcagccgacataaaaccctgttcttgcttgtcatcgagatcatctactgtgtccttggtgtagacgtttgaaccctccacgacgccctcaaaataattgcttgggttctccatattcaactggctatatattagaatcggacacttttagaatatcttcatcccaaactttcccggacaaacaatcaagacaatccatctcccaaagagccaaatcggcactggcaatatttactgacctgtcggctggcacaatttcaatcttgtcaccttgccattgaattaagcattgatgcatggttgaaggaatacaacaattggcatgaatccaatcccttccaagcaacaagctgtaagaacccttcaaatcgatgacaaagaacgatgtagggatggttttgttgccgactgtcaactccacattcagaattcctttagtctctaatggattgccactgaagtccttgagcaccaggttcgtcttgatgcgatcttcagtatttctgcccaatttcctaaatgtagcttaaggcatcaaattcactgcagccccacaatcgaccatcatcttggacatcggcttcttattgacgtaaccatttatatagagtggtttaagatgccgattctctgtcccttccggtttctcgaagactgcttgttctggcgacaaaaacaacttagccgattcctcctcaacctcatcgacatcagcttgcttgacccccaaacttagcaggcaacgtgaaaaccatgttaaccgatgcagtcacaacgctttttccctttggccaatctctttgcttcatcggccgcagcctcatcggctataggagcttgtttcttaacgcgccactcctgctttggctttgttctctttagccgatgattgatttcctgttcaacctcctgaaaacgttcccggtttctcaatcttttgacccttctcttctgattcttagtaaagataccagaaggacaccattgagttttcctgttttcattgtcctcttgaccgtaatcttgatttacaggacccaatctttgatgaacaggaacccttgtctgccctggccgattgcctctattatacgatcggcttgaactttttgcagtattgccgcatccaggacagtcttcaatagatggcagcctcataccctcattccaacaaaatctaaagaactcacgaccccaatgaggatcaaaaccgtcatcatcttcctcataatgcttctcctgctgtttgtcatacttcctttggtacttattgatgaacttagtcgaatttacttgaaaacctcttgtacgacctccatcggctgttcggctagctgtatgcactatattgacaggaaaaggagtgccatcaaccttcatcggcctcttagaatcacaaaattta

SEQ ID NO: 40042 - DNA, 1501 bp, Oryza sativa; identical to SEQ ID NO: 34034

SEQ ID NO: 40043 - DNA, 1465 bp, Oryza sativa
ctcagcaagtctcgcagcaaatatgcaagtgcacaggataccaaagcatgcgctaatagggtttcatttgcaaaagcagcatttagcgaacatttgagaatttaataaaacggttaagtaataattaaacaatattaaaccaacgctatacaacataccctgttgtacaggcccaaccattctgaacaaccatcccggctgcacagttctatctccaaaccaggaatataccattccaaaccaggagctaatcaaattattatcaattatagcatctgttattatgatgagaggtgtgaaactaatcacgaaagacattgttagacccgcccataaccgcgggcacggctattcgaatagttttactctaatctgaggtgtaccactgtacccacaagacacaactccacatcatgtcaccatgtgcctcaataccaccacggtacctcggaaaggagctgtgacaataccccttgcataacacaatccaccgcagcgcaccattcctggatcataatcacatccttataaaacaaggcatggactccccagcgacccccgtgggcttatctccgccacttctcagtctggtgccccgcaatgaaccatactatacaaaagtaaagccgttgcccacgctggcttgtggttggcacggttaatgtttcacaaccgaaactcgtgaaccggtccttaattgtcatgagcacgaccatcaaaaccatgtgctcacaacccaccattatcaggttttagttggcacattaattaattaaccaatcacgattgaccatcgtgagctatcattaagccatcattaagtaatagtgaatcataagttatcccaatagtgtgctaatgtttctaagcaaggttaagcaattatatctaatatctagttgaaccaatataaataaagctcaactagtcaaattataataacccaaggtatcaaggaataaagtaatcaagaacaaaagggctataacaaagaataggttaattccacccaatgacattcgaaaataaatgcaatagttgaatagaaacaatagctttaaataggatcaacatgctcaaagggttgtttgggatctgggtgacttgccttgctggccttggaactcttcaaactcttctgctgcgaaaacggactctccggaaacgacggaatctaatcagaaagaagcaaaatcaccaaaacagcacataaacaagcatgaacagtacatgtggatatttttaacatgtagatctcaattttagaaaaattttaattgaattatgacgcaataatgaattatttttgaaaaggaaaagaggatttattgtgtcagcggctagggtttcggtggaccgggcgcacggcggcggttcacgcgaacggacggccgagatcgacttgatccaaaatggacggccgagatccatcggtccacgaccggcccacagcgaaaagtcccga

SEQ ID NO: 40044 - DNA, 1501 bp, Oryza sativa
ttcaacaccaacactaaatgagatcactgatgacacaacacatagggctcttgtagtgtctcatgttgggtctatccaacaacatgttcaccaacatgtgtccacattattaatttggtatctctataccatgatccatgaggcatgatcatcaattaatacatgtgctgatcatataaacatatttgttccacatatgatatttgatcaaggatcctttagaaatagtaacaaacaacataaagagtctcatgaaagaatcacatattcattaaccaataaggagttatctatttcaaggaacaatgtcaaataaatatgtaaacatagtatgtgatacaatcatctctatgattgcctctagggcatatcactaacagtgcatgcctcgctgacgggtctggagtcgttcctcgctccaacccatattggagaccatcttctctattaaatcaacggttcctcgaaccgttttagagaagaatgctcctccagctgcctcgaccatgtgatggcgggacattggggtgagtctattataaaagttctgcaggattaatcagtcttccatcccatgatgaggacatgcggccacatactcctgcagacgttcccatgcttcccgaatggactcgtcccttgtctgctggaaactggaatccgtccatgaagggcattggttttgcccgttgggaagaatttcgagaggaatgccgtagaacatttgtcctaggtgttgacagcagcatgattggcgtagaaccactgcttcactctcccgaggagggagaacggaaacagccttagcctgacggcgtcgggaccgacgcccttcatggtgcacgtgctacagatctccaggaactgctgtagatgagcgttggcatcctcgttaggcttgccacagaacgggctagcctgtgccaacgtaacgaggctggacttcaagtcgaaatccacgtctcccatgttgatctgtggccaaatggccacattctcagcagagggagcagcgaactcgcgaagggtcttgtcagccatagtcttgaaggatgatggcgttggtacaactggtttctctgtcggtagagttttctgcggagcaatgactcgcgacctgatgctccggatgaaagcttctagattttcttgaagtttcccggcaagttggaaccagtcatgcacgaccctgttttcacaacaaaagtgaaaacaaccaaggttatacagaggtaaatataaagtattagttcagttaatctctgttatgaatcttccccttcaacggcgctagaaatgcttgttggtatttcttaacaacattattagaaatataattcccagcaatggcgcaaaaatacttatggtatattatggttatagagtttatccgcaagcgcacggatataccattgtagcaattcacccgagagtattccaagggtatcatatttattttatcccgtgggaagatcatgtagagagaacttgactaataatt

SEQ ID NO: 40045 - DNA, 1501 bp, Oryza sativa
gcgggaaaccctggaagaatttagtgtacttaccacaagccagcgttggcaacggctgagattgtagtgtagctttcctctagctgacgtacccaggctagggtgagcgtgatggagtttggatgggccatgcgacgtctatgcagcttccggattcaccgtggcacaagaagaagctgcccgttgcctgctagggtgcggtgcgattggttagaggggattatgcgaatggtcctgtcacggcctctttccgatatgccgtggtggcatgtcggcgcacgaaaacgtgtcgtggggctatcttgtgtgtaccattgtacacctctgatcagagtagaactattcgaatagccgtgcccacggttatgggcggttgaccagattcactgtgattaatcccacttaataaattggcttaatgaactggttagttcaggtggtggtttgggtttgtctcaacgtggtgtagcgttgagcagtgatgatttaatattgattaattaactacaactgttttactgctttcaactattattcttaaatgctagctttatgcaaatgaacccctttagctatccttggttatatcctgtatcataccctctattccggtatgacttgctgagtacagtgggtagtactcagtcttgctctatctcccaaccctagagttcgagtacgcttttgatggtggctactcagaggagtaggcttggtccgtgccgtcgaggatgcttgtggaatagcgccgctcactatccaagacaagaattagttttattttaccttttcttttccactgcatttatgtaagacttttataatgtttgtaagacgtggatctgtatgtcaatattgtcgtttgtgtaccctggccggtcctgggaatgggttttaatgcacattctgcttggagttctattcgggaatttctgggcatgacaagctggtcttagagccgaccttgatcgtaggacaagccaaatggaaacctaagagccctccgaatcctttttattgcatttgttctgtgcaattggatttgtttcaggaaaattgggattcgttccttcggtttatgggaaaaatcttgatcgctcgttcaattgaaatttattaaagaggtcagtcaagggttttagtaaaattatttgggacttatttgacagtcagtcgagatttaatgggaggaatgcattaggtcctagctgaggtgtattggttgcaaagtttatttatgttgtgattattattatgtatctaatttccgcattactttattgctcagttatgtcagttatatttattcgttcatgcaaaataatatatgtacaaaattttgctcttatttgtttgttttacttgagtcctttatcgtttcgcttatatttggatttgagcatgcattgattctctctcctttgtcttctatagatggccagccgccccaacacgcaccatggtcaggacatggaaggtttcgttgctgagctcgtctgca

SEQ ID NO: 40046 - DNA, 382 bp, Oryza sativa
gctgatgaaagatttagattaggtccgaattagatccccggacatcactcttcagagcgtctagctagcttcagaatatatttggccttgcagcaggaatcccagcattgctcttttcaccgggaggcctaaaattttgcaggattcgcctcagaattcggcggtcacatcaagaatttctagccgcgatcgctgtggcctcgccggtgagttacaggtcgccaacacggcgatgccccaagagcattggtgcgaaagactgccgtgcagaaaaggaattttataaagcctcatggccccttttcctttcgccgttgctttcgtgcacagctttcgcccccgatgcgttcgcgacggaacggtgcaagaatatttcgaagcc

SEQ ID NO: 40047 - DNA, 937 bp, Oryza sativa
ccctaaccacatttattgcggtttggctgagcgcgtcatgccgcatgtaacgcagtgcagtgcactcgtttatccggtctgtgaccagtcacagactggtcagatcgcgggtttggtggcgacaggcgatctgacgcacgcctcgccccatcccgtcaggacgagggcttctaggcgctcgtccccagctggagctagcgtgttacctcccagagatggcacgttagtcctagtcagatatatgccaggcttcatcctaaccattacaggcaagatgttgtgtgaagaagggcgaacatgtagattgctaagctgacacgtggtggacaagaatgaccgacgtgactggtctgacaccggtcatgtcgtcagcagacagccacgattccacgtcgcatctgctcccggcgaaagtggaggtagttgtgggccgtctcatcagatggtgactcggacggcaactatacaaatctccgtccatttatgaaaaggtggggtaagtccccacaaaaaagagagaaatggtgcatgtggtatccccttaagatataaaaggaggaccttgcccactgggaggggggactggacttttccagatggggaacccagaacaagggagaggctggctcatactttgtagctccttcatacacagatctcccaaaacacaggagtagggtattacgcttctcagcggcccgaacctgtatacatcgcccgtgtcttgtgtgtttcctgtctcgcgagccttccacatacagagagcttagaatctcaccctgagtccccggccgaactggcaaaggggggcctgtgcggtctcccagtgaggagccccacgctccgtcatctggcgcgccaggtaggggactctgcgagggattttctgagctctcgcactctttcgtgtgcgccaagcttttcctgttcagcccaa

SEQ ID NO: 40048 - DNA, 1501 bp, Oryza sativa
aaatcatgaattttggaaaagctttgttgcgggtaataaatcgggtacttatgtatcgcgtgccatgcttttgcatgattattatttcgcatcatgtgggtaagtgtacaaactctgcagagttaaaactaatcgattagccgtgctcgcggtcatgagcagcgtgtggatatgtattgagtatagacttgtgtttattcttctaaatgatgaaatttaccttcaaattgtgatgagatttgagaatgatctccttgctgccatggatggcaatgaggtgaatatttatacatgattaatgcctaccttgatgcccaatatgtcaaatactagcttgctgaaattttatttgaaagtaagcctgatttagaaatgttttatgcaaataaaacttgctttatgctaaaaagaaccatattatgccttccttgattatatgccttgcaagtagggtcttaggcttgtcttggtgcttgccagtacattatttctaataatgtactgactcttgctattgaattaaccttttgcttgcaggttttagatttagtctttgagtaatgcgggtattcgactgcttcttctaggacttgagcttaatggggtaaacccctagtcggtgtgcttgtggattgggtagacaagcttccgctgttctatatatttatttggccagttggccaatgtaactaaagtagatgtagtttataatcgctttcatcttatttgtgtttgctatgtataatcatgcttgagatgaaagtgtgaatctagtgcacatcctgggaactagattcacatgagtatgagttaagaatatttgagatgttgtagatctttagccatttttgtcaagtctcctgaatgtgtaacacatctggtcaccgccttcgagtggtttgacgggcacatctcaagctgaagttgactggcaggctaaaggcccggcaatgtctccaatattcctctctcgaggcgtcggatatttcattatacttgtttgatgacttgaattatacatttcatctctcaattataatggaaggtccggagagcctacgacagcaagttttggacttgcactggagttaagcagatctcctaggcctcgtgttttatatcaacacgcttttggcacgcccagtgggaccgattagaagtcagaagtcttttctcatggacgacaagccgccgacatcaccgtccttggctagcccaggttctgttaaagtgaagatccagcagttagaccaatacgaggttaatgaaggcaacatcgtgaacattactccagacaagctgacacccgatcaaaagaaagattttgaagcgatgatgcagcaagcacggaaccagttcttaaactcatttatgcagacccgcaaggggacaatggtgcaaaagtacaaggtaagagaagtggctgatgtccccgggaccggttcttccaaggatggaggagtgaaacaagctccagatggctcggctcaaccgagcaaca

SEQ ID NO: 40049 - DNA, 1501 bp, Oryza sativa
aacaaagttccttacccttctctgatgataaatggggagcaatgagatcttccccgatttcaatcaggtaatattcctgaaagttcatttttctgctctgtacagcatctcgtttgctgatagctccctactcaccggtcgtcagttttgcatttcataccagggtcgtattctagatcgttagattatgtatagttcgggagcagctgcagggattagccatggccggagcacaatcgggcaaaatgtactgttgtatcatataaattatgttgtgtcgtaggttatttcagtggaaatcaaatataacttgatttgtaatgtatttttaccgtcaaaacaaacaaaaaaaatcaagtggaaaaacacaatgtactgtaaattactcagatttcccctcctgttatgccaatttggaaatcttttgctgctgggcttgaactgaggatatgttcagtttgtcgctattttcaatgccaaaattctggtagggttgtgaattgagtgtcgcccagtgagtggaatgtagtagaacctatttagctggtttaagtactagacttaacatgagtgcatgtatgtactacttcatatcgacaataactcaatattaagatatataagcttagtctctaagatgtgtttagggaaaataagtatgactaacggaaatttatcaatttttttagctggtttaagtactaaacttaacatgagtgcatgtatgccctgcttcttatcgacaataagtcaatattaagatatataagcttagtctctaagatgtgtttagggaaaataagtatgacgaacggaaatttatcaattttttaagtagttaagaggtagtataccgatgaacatgctttcatgtatgtatttgattcccaaaatacatctacattaatcacatattattgttgccatattacactttacaaagccactgccaatgcttcatcggtcaagttgctgaatttctcatctactggtagtagtacagtagtactaggatctatctacaggcgaggagacggttgcacactacttgtacttgacctgtcaatgttcatatcctaccggacacgtctactgggagaacttgccatgtcacatgtacatctaccgcggttgagatgttcccgccaccaccgctgcccgatcggacgagttatcgaactccgccgccgccggagacacggcgccgttcctctcctccgagctcgtggagatgctgaacgggctcatgccgccgacgacttcctccgggatccgtccggcgtcggcgtcggcggcgccggcgacgttgcacgggctctcgtcgccccacctcggcgtccggctcgcggcgtactcgctgccattcctcacggactcgtcgctccacctcctcttgaacgtcggggacttgaggtccttctggtcgtagtgccgcgcccacgcgcgcagccgccgcagcgaccggctcccggagccggagccggagccggaggcggcggcg

SEQ ID NO: 40050 - DNA, 1501 bp, Oryza sativa
ataatagggtttcattttgcaaaagcagcatttagcaaacatttgagaatttaatgagacagttaagtaataattaaacaatattaaatcaacgctatacaacataccctgttgtataggcccaaccattctggacaaccatcccggctgcacagttctatctccaaaccaggaatataccattccaaaccaggagataatcaaattattaccaattaaagcaccttttattaagatgagaagtgtgagactaatcacgaaagacattgttagacccgaacataaccgcgggcacggctattcgaatagttttactctgatcagaggtgtaccactgtacccacaagacacaaccccacatcatgtcaccatgtgcctcaataccaccacggtacctcggaaaggagttgtgacaataccccttgcacaacacaatccattgcagcgcacctttcctggatcataatcacccccttataaacaaggcatggactccccagcgacccccgtgggcttatctccgccacttctcagtctggtgctccgcaatgaaccatgctatacaaaagataaagccgttgcccacgctggcttgtggttggcacggttaatgtttcacaaccgaaactcgtgaaccggtccttaattgtcatgagcacgactctcaaaaccatgtgctcacaacccaccattattaggttttagttggcacattaattaattaaccaatcacgattgaccatcgtgagctatcattaagccatcattaaataatagtgaatcataagttatcccaatagtgtgctcatgtttctaagcagggctaagcaattatatctaatatctagttgaaccaatatatataaagctcaactagtcaagttataataacccaaggtatcaaggaataaagtaatcaagaacaaaagggctataacaaagaataggttaattccacccaatgacattcgaaaatagatgcaatagttgaatagaaacaatagctttaaataggatcaacatgctcaaagagttgtttgggatctgtgtgacttgccttgctggccttggaactcttcaaactcttctcctgcgaaaacggactctccggaaacgtcggaatctaaacagaaaagagcaaaaacaccaaaacagcacataaacaagcatgaacagtacatgtggatatttttaacatgtagatctcaattttagaaaaatttagagacttgaaccaactaaatccgagctaagatgaattagttatgaatttttgaagatttaatcggattaaaacacttatattgattttaattgaattatgacgcaataatgaattatttttgaaaaggaaaaaggaattattgcgtcagcggctagggtttgcggtggaccgggcgcacggcaacggttcacgggaacggacggctgagatcgatccatccaaaacgaacggccgagatcaaccggtccacggctggctcacggcggacggtcccga

SEQ ID NO: 40051 - DNA, 668 bp, Oryza sativa
agaggaactatctacctctgtaatgaaaatttattcgcttattaattagagtaataattgtactctattatcaatttgttattgtgtgcctcggctgattcctggacgagggttcacacacatgtaagcgtttggaattttggatagaaattccgggcgtgacaagttggtatcagagcctccttgaccctaggttatgccaaatggttacccatagaagccctctaaaaatattggaaaagtagaactgttctcctccctttctcttttaattaaaccaaactaatggcacatgcatttcataatatttttttttgtggttctcattcaaaatttattccagtgttattagtactgtacatctattactgtactaatggctcatttaccagcaaaagttttacaatattgttttatttaatcttgctgcaataaaataaatttagcatgttgattttataactttcttttatttctttagaacctgttgttcaaaagtacaaaatttgtgaccttatttccaactatttcaacttatcttgcaagcttggtttactttatttacttacctttttaccttgattttctaactttatttaaattaatccaaaaacttgtgctattaattggataaatgccttaactctctcctttcacttgtctttaga

SEQ ID NO: 40052 - DNA, 637 bp, Oryza sativa
aaaagtaatttacatatattatagaagtaacttataaaaaaaagatagaaagtaactttgattaataccttttttcattgaacaaattatcatatatttaattatcatatatataagttacttttagatttgattaaaatatttcctatacattcataatgctctgaggtgattacttttattattgtttttagttaattccataatttgtgctgattaatttaatttctagatagagtcatgtttttatctctataacggatttacttcaaatgacatgtcaaagttacattcgttttgttctaagttacttctataatatatgtaaattacttttaggctttactgaattaacttttgtatgtctaagaagtaacttagtgaaatctaaaagtaatttaaacatatcataaaagtaatttgtgatttttcatcaaaatataatcatatgagatcttgttgtaaagatttaattgttacgaacacaacgatgtaatcggattatagatcggataagtaatttaatagaaaatttcataagaagaaaaaaaatatgcacaacctaatagcaaaaactacttgcatgcatgtacgctaatagtacttctcacgtaattgtctgcgtcgctcgttaagt

SEQ ID NO: 40053 - DNA, 1501 bp, Oryza sativa
gttgtgaaacattaaccgtgccaaccacaagccagcgtgggcaacggctttatcttttgtatagcatggttcattgcggagcaccagactgagaagtggcggagataagcccacgggggtcgctggggagtccatgccttgtttataagggggtgattatgatccaggaaaggtgcgctgcaatggattgtgttgtgcaaggggtattgtcacaactcctttccgaggtaccgtggtggtattgaggcacatggtgacatgatgtggggttgtgtcttgtgggtacagtggtacacctctgatcagagtaaaactattcgaatagccgtgcccgcggttatgttcgggtctaacaatgtctttcgtgattagtctcacacttctcatcttaataaaaggtgctttaattggtaataatttgattatctcctggtttggaatggtatattcctggtttggagatagaactgtgcagccgggatggttgtccagaatggttgggcctatacaacagggtatgttgtatagcgttgatttaatattgtttaattattacttaactgtctcattaaattctcaaatgtttgctaaatgctgcttttgcaaaatgaaaccctattatgccatcctttgttatcctgtgcacttgcatatttgctgcgtggcttgctgagtatgtcatatactcaccttgcaatcattcatcagaggaagagttctacagtgaagctgatggtgtggaggattaggtgtagccctggtcaagctgcctgtggagtggagtcgtctgcgccgtttatcttattttccgctgcttagatctttattgattgagaggaactatctacctctgtaatgacattttattcgcttattaattagagtaataactgtactctattatcaatttgttattgtgtgcctcggctgattcctggacaagggttcacacacatgtaagcgtttggaattttggatagaaattccgggcgtgacaagttggtatcagagccccttgaccctaggttatgccaaatggttatccatagaagccctctaaaaatattggaaaagtagaactgttctcctccccttctcttttaattaaaccaaactaatggcacatgcatttcataatattttttttagtggttctcattcaaaatttattccagtgttattagtactgtacatctattactgtactaatggctcagttaccagcaaaagttttacaatattgttttatttaatcttgctgcagttaaatgaatttagcatgttgattttataactttcttttatttcttttgaaacctgttgttcaaaagtacaaaatttgtgaccttatttccaactgtttcaacttattttgcaagtttggtttactttatttacttaccttttactttgaatttctaaactttattcaaattaatccaaaaacttgtgctattaattggataaatatcttaactccctcctttcacttgtctttaga

SEQ ID NO: 40054 - DNA, 661 bp, Oryza sativa
gtttcatattataagacgtttattttttttaaatcaaacttttttgagttcattaaaagtatagcaacatttacaacaatgaattaattttattaaatttagcattaaatatattttaataatatgtttgttttgtattacaaatgttgctatgttttatacttcctccgtttcacaatgtaagtcattctagcatttcccatattcatattgatgttaatgaatctagataaatatatatgtctagattcatcaacatcgctatgaatgtggaaaatgctagaaatgacttacattgtaaaacggatggagtagtaacttatcaaaacatcatatagtgggaaacggaggaagtaatagttttgtgacaattatattactaaatctatagtttatggtaatttgtgttgggcatatagtttcatggtaaattcgatgttaaatctttaactttaattagttctgaaaaaaaattctgtagttatacaaaatatattcattaggaatcctcctacatgccgcggctgttgggagtgaagtagtgaaccactgaaccctagtcggccggccacatgcccacacaaggtgtctcctgcaccatgattcattgattcttttgggggttagcaagcgacagttgttagtttataataagctcaaa

SEQ ID NO: 40055 - DNA, 1501 bp, Oryza sativa
aacacagtattgcctaccacgcgttttgaaacttaattacacgcgttttcgccctcttgttatgttcatgctccaatggaaacaaacaaatcggatataacacttcaatcctgaggcaggattttgtatgcaaaatggtactatactcagataaatggctcatcaattataatgatgggtttacaattacaaatgaagatatttaagcaacttaatttattcattctagttgcataggtctagaactcgttgcatttggagtgagatggagtaaatattatttcacattttgtcaattcaaacatttacacgttttaatgttttttcgagaatggatggcgtgagctccgataagagtagctataagattataaaccagctataaacatattttaagaagataaaagaggagagataagagcaacggattataaatttatagccagctgcagcacagactccaaaatacatgtgtgtatgacaggtgagatcagacattaattatatagtacatttttatagataactattgtatgaattgactttagaagatttggagccaacagttgaatatactactcccttcttcccaaattaatcatgtaagaataggtacaacagcaaattattagccagctataaacatattttaatgagataaaagatgagagagaagagcagcaggctatagatctgtagccagctataacacggactccaagacgcaatggatgtatgacatgtgagaccatatattaatagtataataagcaactattgtatgaattggctattagatcggctatagatgaattggagctagtagtgggctatactagtaaacttgctctaatagaatttaaaatttttcaaattggtcattatataactgcatggacacggatttcatcggaatacaattaatacagtatgggagaatatgtgtatgctagggtgtaattggcaggaggttttaatcgagtatgggagaatgtgtgtatggtgtcttgattgatgtgatttaaattgtcattggtcttggtgcataaaattatactccctccgttccataatataaggcacaactattttttttatgttccataatataaggcatacatgtatgcatacaattaactaggacatcttctccattaaattattacttttttaaatccttcactctcaagatctctaaatttattggatgcatacatgtattatatttattaggatgatccaaattagaaaataataataattgtttcttgaaaaagtggttgtggaacatatggagtatgatgattaatttgggaaggagggagtattaaacttgctctaacccaattgtgacaagtccattaattaacctgtcagctagtaggctagtagttgcacatatatatacaggagtgcattgtttctgctcctacccagctaccaacccagcaataccatccactcaactcaagtcaagtcaaccacagctagctagcaagca

SEQ ID NO: 40056 - DNA, 1501 bp, Oryza sativa
cttcgtcaacgattggtccgtcgggtgcgacgtcgaaggctgggctatggaggagctccgcatcgccggcggcacgacggcgaccactcgccccgacgacgacctacggttgtaccgcctctaccggttcccacggggatagatgccgcggcatccacacgaacccgaacaaaaattatcgagtgaggtcctctacattactgtatatgggcccacataccttcaggctcacatgtctacatgtacagtactgtggagggtccgaattaaaaattatcgggttctatacatactaccattaattaattatcttagtattttacgatgttatatacctactttataaaaatactaaataaacattgagatggcaatataatgcattattgcatccgagctacatatgggattcatcaagtactgtgcattcaagttcgggcccaactaaacaaagtgcctctctgaaagattcagagaaagcattgctttcacttcagctttctgaatgtaaaatggatcgtgaaaaccttcagcttgtatgaatgcaagaacgaccactaatgtgtactggttaccctttcactcggtatattgccaagtttcgataaattgtgtatagattagctcatgaattcgaccgagcaaacacaaaaaagagacaaaaacaagaacatgctgggattcaggaggtgcatggattcgtacaccatgtaactaatagcctcaatccaagaaacatgtcaacagtaccagatgcttcatacaagcaagtgagcaacatctgttataaaaccagccccgaaatagacatcgatagctaacactggtggagaaaccatctttcgtcggtcggccgatttccacaatagtcccggatgcaataaaaaccggggctaaagatgatctttagtcccggttggtgctaccaaccgggactaaagtcccacccctatatatatatgtctttttcctcctccagctgcccgagcaagcttcaaaattttttcaaaaaagaggggaggtcatgccaaaatttctattgaatttattttggtgattacatacaaatcggaggtgcctaaaaggtttgcaacttcatcctccaatgttttttttgtcatactacatttgcacctatgttttgcacactttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtacggtttttttgactcatgtagatggat

SEQ ID NO: 40057 - DNA, 1501 bp, Oryza sativa
tgctaatcatagaaaaatttcatataagacggacaatcaaatgttggacacggaaacctagaaattgaattttctttgggacggagagagtaaatattttccatacctgccatgccttgcatcaatctccaggagcttcttttccatttcttggattgcgtccgcgatggtgacgcgatgcttggtcttcttgaacagtttcttcacctgcttgccgaggcgcctgagcacatgtgggtcggctggcttggggccatcgtcgtcgacatgaaccaagaaggcgtcgatgatatcctccatgtcgtaggacgcctccctgaggtcgctcgcccagagcttcaccagctcgttctgctggtcttgtggcacctcgctgaccatgcggaggacggcttgcgctcgccggagctccgccgagagagactcgatcttcccccttatgttcttctgcagattgtacttctccttcagcagctcgcccagcttggggatcaggctactcatcgccccagtgacgaactccatgcttgctagctagctgtggttgacttgacttgagttgagtggatggtattgctgggttggtagctgggtaggagcagaaacaatgcactcctgtatatatatgtgcaactactagcctactagctgacaggttaattaatggacttgtcacaattgggttagagcaagtttaatactccctccttcccaaattaatcatcatactccatatgttccacaaccactttttcaagaaacaattattattattttctaatttggatcatcctaataaatataatacatgtatgcatccaataaatttagagatcttgagagtgaaggatttaaaaaagtaataatttaatggagaagatgtcctagttaattgtatgcatacatgtatgccttatattatggaacataaaaaaaatagttgtgccttatattatggaacggagggagtataattttatgcaccaagaccaatgacaatttaaatcacatcaatcaagacaccatacacacattctcccatactcgattaaaacctcctgccaattacaccctagcatacacatattctcccatactgtattaattgtattccgatgaaatccgtgtccatgcagttatataatgaccaatttgaaaaattttaaattctattagagcaagtttactagtatagcccactactagctccaattcatctatagccgatctaatagccaattcatacaatagttgcttattatactattaatatatggtctcacatgtcatacatccattgcgtcttggagtccgtgttatagctggctacagatctatagcctgctgctcttctctctcatcttttatctcattaaaatatgtttatagctggctaataatttgctgttgtacctattcttacatgattaatttgggaagaagggagtagtatattcaactgttggctccaaatcttctaaagtcaattcatacaatagtt

SEQ ID NO: 40058 - DNA, 1501 bp, Oryza sativa
ttctcctgatgagtgtcatgggttttttcgttttgctcataaaaacataactttactcctcaattgattctcttgaatcactcaatgtgtatgattattcaccgagccatagtgttgccggtcgttaagtgcaaacttttaccatcaactcctgcataaaagaaataaaatataatttcaaaactttgtggtaggggtttataactaaccatttccactagctttggtaaatatatgtatgcatgtgattttcggtagaaaacacacccaccaagcgatagaaggaacctccggacaatcagacatgattacatggattggaagcctcacatgtcaatcaaaactacctacaattgagcctaaccaaggtataacatgtagggggggccaccaggcaacctcactgccgaaggagaggccgagaggtgggccaaaaggtcggccgaactataaggtcgctcgaacggaccttggctcctctcaccatctgcttccacgtgtatgctcttgatgactccccaatggtggttatgaaggtttcatcggcagctatcaccgatgtaaagcattgtaattatgagctataaaacgaaaaggtatttgcactctcaaattgcacaacaaagtagagtacaactcactttcatatcatggtagctactttagtatgtgggattaggaagagagtgaaggaaagctccggaaggtgtgtcccaaatatcggagttttctccgagaattcttccatcagagtgccggagaagcgcatgagttgccggctttcttctctcgctttacctcggtggatacttcttttaaaaagtaagtattcaagtttccttatggtatttaattagtttatttaagtgagatatattctcatcggtgcggattcgtcgcttagtatttatacttaatgctttagtactaagactctggataaacaagatagttcttggccgaggctagagtagtaatcgataacgtaggtgtggtgtttaggttagaggttatcttcatttgttgtgtgctacacagaaagtagggtagacgacaggtggtgataaccctgcccgtcctttgtatgcctctatattcgggtacatcataaagctcaaggccggactcaacctgacagactaagggagggctggttcctgatgtattcgataaagttttgcctttaacttaagtcagctaaatacgtccataggaatcctctctagcctatcactcgtcatgttgtcctttgatagaatcctgttcataaaaagtatatgcacgttccttatatttgataccctggaatactctgtttggtttgggctttctttcaaaagccgggctaatatatgatcttttatcgaaaaaaaatggtggagatcacttggcttttttggatgtttatcacttggctcgagcacttccccaaaactatgtaagactgtcaaaatagtggtgtctgatcacatgttagttgaagtaaactacaatccgttgg

SEQ ID NO: 40059 - DNA, 894 bp, Oryza sativa
tttctgcagacaatgttcggcggttgactcgtttgagtcagcagttgagggaggcgattcaatccagaggaaaagataccaaatatacttatattctaaaagaaaactagaggtgaacgcgcgctttgcgcgccgcgccagtggcatcagaagatgtgagtttttcattgatacgttcgtgtagcaggttaaatcatgaaaaaagacacgcaactacaagaatttgcattatggtagaagactatcaattctacaagaataacaagtcaaaacatatgtaaacctctaacactaacctttttacgctatttctagcttattcgaaaaaaagggtaaagcttgtgctttagctccagcaatctatcaaaaagattcgcgcaaggctaaaattatacataactgaagcgtcgcaaatatctagagtgtgcaaatggaattgaagtttttttaataaaccaatatacatatatatttggcatttcaaaccaaaaaacattatacattccaagctgcacgttcattccaaaattactaaaactattacaaatgtaagcaactctcaattgtgaaattcaactctcaacttgccatgttacaaagtactcatgtcaacatggtaatagcgaaccctaaaaaaaacatggtaatactgaagaaattacaccttttgaatgatgaagcgaagaaaaaaaatagaaaacaccttcaactacttacagtgaaaaattaaaaatgtacaagttcgtcattttttgacataatctaagttctatcaccgccaattattttttggagcctaagagtcacatactattgacctggctggatggatatccaaatccaaggtccaattctctcagagcaatttgattttaaccctgctgtggcaaaatc

SEQ ID NO: 40060 - DNA, 1501 bp, Oryza sativa
tggatgacatccttggactcttgcacgagcatgtcatgggcaaggatatgcccaagcaaatcatgaggtgtgagagtcttgtagtccggacgctcacgaatgatggtcaccaaggtagagttccttggagtgattgctcgaaccatcttcttgaccacaacctcatcggtcatgtccttggagccaagtcccttgatctcattgacgatcttgctcaaccgatcatacatgtcgcttgggctctcaccatccaacatcacaaacctctcaaattgccccttgaggatctccaccttggactcacgaacactattcgtgccttcatgcaagttctgaagcgtgtcccaaatcactttggcactctcaatgccatccacacagttgaactcactttcactcaaggcgctaagtattgcattagcggcttgagcgttcttgtgctcgttctcgtcgtcctccttggtgggatcttcgggattctgcaaaacatagcctttttcgactattctccaaatagatggattaatagacttcaaatgcatcttcatcttatgcttccaagcgacatagtccgtaccattgaagtatgaagctttgccgctaaatgtactcacataagatgtagatgtagggggatagtcataaggaatcttagctcccttatcaccattattcccatcccccacttggcccgacatgatctctccaagcggttaagccgaattaggagattaggctctgataccaattgaaagtgtcaataaggcctatagggggggtgaataggctaattcaaaaaattcaattaaaagcggaagcaataattttcagatatttccgaaattttcggatatatccgaaaattttcggagtcagcataaatagcaaagtaaatcctagatctatttgcctacaacaagaatatgctagcacaaacatcaactagacctatagcggctcaaataagcaaagctagtggagagggaggaagtaaagtcaccaaagatgaagctcacgaagttgttctcgaagttcgaatccttgaggggattctactctccgttgaggagctcactaagagtcgggtcttagctaaccctttcctcaagagattgcactaagcactcctccttccactaagggtatctcttccctttcggaggtgagatccgaccttcacaaacttttcccggccaaccacatgtagatcggtgggtcgggagcgacacctagccgcctaggagtcctcaacctccaaaagtaacaaatgaagcattgaactcccggagatgatgcaagtgctcacaaatcttcacgaagtcagcaacaagcactcacacaaactcgaatccacaactctcacacacacaccaaatccgaatcgaacatgggtgagaggggaaacaagaaagtaaggctcaaaagtgaatctcaacaagagcaagccaagggcacaaaaatatccaatgtgaccagcagccctcacaagtgaggggagggg

SEQ ID NO: 40061 - DNA, 1287 bp, Oryza sativa
tgaggttattgtttgattaggacctaattgattgaattgcgtataggctagtgaagtctgaatattcgaattgaaacctttagatgttattttgcggagtgaacagcgtagtgtcatggtcacgttatctgcaatgtactatttaagaaagaaatgttatggtgagttgattgtttctgagataacaagttgtttgtggatgaatggagacattaaacttcatgctgagcagatatgcatttaggcaaatgcccaccgacatctccaattccctatgatgtagttcagctaggatgattccaatctacccttcattttgtttattctagttttcttgcttttggattttaactgccatgtataaaccatattagatcgagttccatcttcctgaattgactaaaatgttgattaatctgaagagtttaaatcatccagaaaagccataacaatgctttcttttggtggacattgcttttgaatgtttccatgaagttatagacacttgttctactgaactcattgattacactaactttcctgagtttaaattgtcttaattttggactaatatatcatctttggactttgtttctatgatccactacatagtgaatgcatgactgacatccatgttaggatgctacattatattttgcatggttaattagaatcctgtgtgcaatgggagacagaaggggaatttaagttgcctcaaaatattccctgcatagtgtaccagattgtaaccgtactacaaaccatgtttctcaagaagacaagttcagtgcttgagctagataaaattgcttcaagaaatattaacaaagctaagaaagttttgaacaaagtgaatctcagtatctaggcatagactaggttcacccaagccctttgtgctaagaaaatgtaccacaaggctgaagactttctcatctatgttcaatatggagcttagggttttagtattgtggatcatttatttgtgcagaatcttgaacttatgaagtatactctaaactaaaataactctttagttgataagtgctaacgttgtactttgtgcctttgtggtagcatttaattttccctcagcaagtcaccacaaaagcaatttgtatctccaaatcaagcacattttatagacattttctgccacaatattttaagcctctttgcttcgtttagagacccaacagcccaatcaaatacacttgcaaatggaatttgcaacgaagagatattttctcctgatgctgtactgtgtctttacaatggttcttaatt

SEQ ID NO: 40062 - DNA, 1501 bp, Oryza sativa
attttttataaatttagtcaaacttaaagaaatttgactagaaaaaaagtcaaatgactcgtaatatgaaactgagggagtaattaatttagataaaaaaactagtatcattgttagggttgtatgaatgtgttaacctagctagcaagattcagaacgtgtaaggccttccacgcacatctgctatgttataacttgcattatttaactggtaattggtcacatgtaaccaagtatgcaaatttttaatgatgatcataattgaccaggaatcatgccatcgcaatgcgtgtcatcgtctctcgcaggcgtacaaacatgatccagcagtgatgtcggtggcctaacacgtgaagaagtcccaactggaccggattaactctcgaccacgaaattactagaaaacttattccaattttctataaaattctaaattacccatttatatactgccaatatattgtactgcaatagtttgtaaaagttctgtaactttttcaatacgtaccatgtgctgaaatagtacaatttcagaccaaagaaaacatattcttaccattttttcaagaattagctattgactttgttaaaccactataacacttaaacgatgttattcacatatacatcggataactcagcatcatgtgccatctcttatataccagaaaaaaatatatttgtgttgcaacgggtaaagatattttttcactgatacaactataaattgaaacttttggatcgttatacactataattgaaaaagttgaataaaaatcttccttgtttttgggtcttaagttcatttcttatttccttttcaccctaacccaattcgctgcatcctaccttttgctcggcttgcctcttttcggcccaaccataagtggagtcgcagcccagctagatgacagtctcatgcatgtatgatgccagaccgatcattcacatcaaatcctatcgaaccttctcttaatacgtgaaatggtagctcttgctcgcttggtcaaaaaaaatataatgaagatgagtaacaagctaatagaatctacaaatggaatctacctatttattaggaactggtacaaacttcattaataaccatctaatggaaatgccccaagtcatatagtagcattaaggcttgcaattttataaaattagtcaattcgtagttgacctcgagatccacgtaacatatttaataacaagtaaaatgggtgactcgtataaatagtactcgtactacacttaaaattaaagtttcggtgatcaatcccactgttaatggagatcgaggttattgataagtgcgtcaatatttctctaggaccaagtaagcaccgaagcagttgaaagtcttgaaaagaaactccataaatttactgtgactgacgatgtgctagctagctgcataaagccctaaaaggcatcgtcattaggcgaagtaaagctatagttatacaaaagctaacacacgatcgattcaacaggtagtaga

SEQ ID NO: 40063 - DNA, 417 bp, Oryza sativa
agtctcttctacctgtgactaattttgtactactaaataagttcaatcacaaaaaaattggctaaatagtgtaaatgtttcagctaagtactgtacattagttatgatatttttcatgtagacttttcaaaaaaacaagccataagcacctattaatcaagtgcatgcagttcgacctgagaaaactataaaatcacactataattatcatggagacacactctaatcaaggttgcagagatctagggacagttacacagtggttagaggaaatcttgggtatgtgtgtcttgggttggttagttgctggaattgttgtcctcataatggaagaattgttggtgactttcttgttaatagaatctgagctgaagtgtcctgtatcatgtttgtgtcctgaagtgttattggtcacca

SEQ ID NO: 40064 - DNA, 1415 bp, Oryza sativa
aaaggggtggctatcgagctaggaaagtggatgggtttggagacaaggaattttatacacgttcaggccttcttattcaagaagtaataccctactcctgtccggggatgattccgccgagtgggttattgattgatgattgggaaaaaaaagaatcgtgccccaagaggcacacggaccctccttatataggggaaggaatccgtaatatccatatcctaacggaatatgggattacagataaaatacaatcgtaaccgactaggatcccaggtactttcttgatatacaagtttagaatctaacccgagtcctcataaagatattctatctatatttggtactgtatatccagctggaatataactgccatgtagatatggggtaaccataatctccacagtagcccccgagaccttcgcagtcgaccaaaacagtcttctcgaaacaaaaaataataatccgagtgcttcaattcaacttgctccggcttgccgagtgctaaaagactgtgaagggcgaaaataaaacatggtgtatcgagtagatgcacctaattaagtgtagcccccgactatgtgattagttgaaaaactaaacatatagtcaagaaccgagtggttttacagcgaagcacgcatggtacttagtaagatacccagccgactacttctcaacttgaacatatcaaggacagaaaatacaagaagggctgagtgatgaacactcaaaaggtccaaaaatagacatatttgataggaatccgagtaagaaactcttaaaatgattcaccaaacatgataaaaaatcatggtaattaatgagtctaatagcctaggctgtgacccttaccataactaaaataagcatataacatgctaaaagaatgactatgaataaaccagtcatctcaaatcaacccaaacagcttttgcagcctaataaagcttacaaaaacggtataacacctttctgtcagacaccttttgtttgcatcgtgttaattctaaagaattagcaagccgcattaaaaatgatttaatcagcattgggccacaacattgtgagcacaaattgccaaagcaaaaagtgcctaagtccctaaggatcacaacgggccacgctggaaataaaattgggctgaagtactgtacaggcccaggcccattagcactcccgatactctaacaaaacaccgaagtctaagcgacgcttcgtcttccccgccgagactctcgccatttccccattcctcgctacagtacaagactgcgccgacggagctagggttcaccaatccgccccaatccattctcaaaaatcccacgaaacttctccgcgcgtccaccgcaccgattcccccatctctttccagccttatctcgaaccaaatcaaaccatccagttcacattca

SEQ ID NO: 40065 - DNA, 813 bp, Oryza sativa
caacaaagtctggcaagttgagacattcagtactacgaatctggacaagctcctagtctagatccgcagcactcgaatgtgtcacatctaactgaaatcttttatattttggtacggtggtagtagtattttgattaactctttcttataaacaaatcaatcatctatcaggtttcatccgcatccggtcttaaaaaaaacatgctttagccgaagctatttgtctaagatctacttccttcgactcgtattaagttaatatagtacgagatgtgacgttgcatattaccccaaatctagacaggatatgtcagatctcgtactagattaacttaatatggaatggaggaagtagcaagtgtggctataaagtttataaaaacccttaaaacttccatcaatttataatgccaatagaattaataatatttgaagcatttaggtagcaatatatatttaggtttccctttacaaactttcatttgatggtagtaggaaaatgaattttggtcacaccaaaattttggagacgtggcaagggttttttttttttttgtcacaccatggtgaatggggtggcactttgttgcacacgctgacaactcaccaacatatctactagctttttttttgttctaaatgtttaaattttaattttaccaaaatgcctcattttacaaaattgaatttgtccagagccagaggtacgcccatgtgagcagtcatttgtgtcctgctcagccaggctgtgaatggaccgagctggaggccctgccattatctttgacgtggttgaccctcattggttgcagc

SEQ ID NO: 40066 - DNA, 1202 bp, Oryza sativa
gaattacatcctctatctttacttgataacaaaaaattggtgtatgctttatcaacacattatagggctaccatgattcagacatggttttgagggggagatatgatttaccaaatgtgatgtctctatcatcatctaaacttatgatttgtgtgaagagcatatatacctccctgagtttaactatcatttttaagttaaccttggagagaaaccttggtttgatatttatgctgtaaactttgtcacttggtgcagaccaatagtttcgtggactgatgattgtcaagttgtcccatttggttccagtgagagtatgacatgcggccggcagccgttgacatgcttatgcagatgtgcaggtattgatattatgatatatatgaacctagctggatcatccttaatgctacaaggctatatcattggtgttgcatgtgcgtaccagtgaatatctgaattgattttgaaccgtatgtttcttttaaaatccctcctttgcacgcggaacttcgtttgcgctaaatattcttcagatcatgacgtgtctgagtgcatgactagtgtttgcgtttttgctcgagctcatattctttagcttagtttcactcctttgattagttgaaccgtcatttcactcgtcttacggtttgatcccctgaactttcatcatattgactggaagttatgttagtcctgacttataactccaagcttgcaattgccattggcgccacactgcacagcgacaggacgattctgatagtgatccgaacgttgggaggatcaacgaagtttaggtctcctcttggaacgcaggagttttacaggattttcgtatgaaacgattcatttcctccaaagttcctctaaactctaaaggccttgccatttacgtgaactggtgcgtcgaaattcgaagtgcaagtgttgcttgactgcctgtagaactgcacagcgaccatctgatggaactatttcagatcagaaagcatattcttcgtgctaatctaaaccatctcgacaaaccgatcggagagaccagtacaataattatctgtcccgaataattatttgccacgcgtagcttggcggtgaggcctttaagcaaatttcatcttcagtatacaccaatctgtcacgcgacataaacaacaaacatatatgggtaccttctgaggaggtaggaacaataaaacata

SEQ ID NO: 40067 - DNA, 1357 bp, Oryza sativa
atctatggtacttaccgatgacctccctaagggtgtgttcggcacccccttttcccaaccacccttctcgcttgtttttttccgtgcacgtttttcaaactactaaacggtgcgttttttgcaaaaagttactatacgaaagttgcttaaaaaaatcaaattaatccattttttaaaaaaatagctaatacttaattaatcacgtactaatgaaccgctccgttttccgtgcacactatttgtgttgggatctgggatgccagcctaaggaccggaagaaatgcagggctgggctagataggataacgtgcagcccgttttatgttgggctagtccgctactgtgacatacgtgcggtccaattaattggtccgaaacaaatgtgatccacatacggcccatactaattaggctgtaaagggagtgtggtagttgggccggaacacacctttgctcacgcgcacggcccaccgaagcgccatactagtgaaccaataatgccttgatctgagccgcacagcgcacaagatcggacggctcgcagggacccacgtcgggtggtgtcgcatttctggcctctcctctccggccggcggcgacacccggcggccgcagaacgccggcgagcggaggcaagcagccgcgatcaagacctgaaccgcacgcgcgcctccgtcgttcttggtgagaagttctcctacctgattttctccgagtagttcattcttccgcctctattcgtcgtctagggttttccatcgcccctgctccgccttagcttcttcgcggcctctgctaggaaccctgaatcaggaaatatagggttttcccgtagttgtttttgacggagattcttgcatttgagccaaatcgtcagttggttgcagatgctctccacggcaatggctattttttttgctgcaactgtggttggtaggctcctgggactggaacactgggggaaggggttgctccgaggaaaaagaaaaataataatgtgatttagtcatgtttgatttctatgacgattgccgcaacgaatatctagattcattctcctctcacggataaaaaggctaaaagccatggcaagattgtgtgggtgttggtgtttctgttcttgaattgccaccgaaattgttgttaatttttttcatgtttcaatctccttttccattttctgcttacgacaatgaattcttgactgcatatttactagtgcagtgtagttttctgtcttacttattatcttcctttgctcaggattgtttaattttgtagagacaccagtttgctccacacctgctcgattgaatgcccctgatacaacaacttcttccagatacagggatgtcca

SEQ ID NO: 40068 - DNA, 245 bp, Oryza sativa
ggggggggggtgtttttatagctacgggaggggaaatcgtggccgagaggggcagaatcgggcggcaaccggccggcgatgtggggtggcgacgtggagctcgagggaggtcaaaccggcgtaatttttggggaaaagtgggggaaaatgaggaggagtgggtggcaaccacgtccacacggttggacgtgcgtgcggaaggcagaagacgggaggcggcggttttggcagcggtgtgggcggca

SEQ ID NO: 40069 - DNA, 209 bp, Oryza sativa
tgaacaaggaaattatctgaagtagagtcggctaatggatacaaatgtattgaccccctccggaccaacttcagatcaatatacagttagataagccccttttgtttttttaattctgtgatgtggacagtatgaaattatgtaattatcttttgacggactcaaaatcttatattctgaatgtatgcatcttgcagctattaccaaga

SEQ ID NO: 40070 - DNA, 1501 bp, Oryza sativa
gtttgtggcagcgctgcgaatggtggagacggagatggaggcggcagcgagggcggtgccggtcgccgtcgtggtcggagttggcgcagctatgcgggagctagcgacggcgaggcttgtggcgaaggtgttgctggatgtggggcccacattggattcatttgagccaagggcaaatttgtctttaatgattgtttctctctcctattcctccgaaaataataaaataatgtcgcgggtgtccagcagctaattaccagttttttgcgatgccctacagcaaatacgcgtttttacggtgtcccctagctaattacacgttttttagatgtcctgtagcaaattttgccaagaacattagcattggtgatcagcaaaattggctttatttttagtgacttcgatttctatagatcagtgcaggatagaaacaaatctggagcagatatgaatgatatctttttcaatgacattatcagctcccttggcttgcttgagatccctcttaagggtagaaaatacacatggagtaacacgcaacaaaaccctcttcttgaaaggttagattgggtgttcacttcagctccatggaccttggctttcccaaacactacagtggtgcctttaactagaaatatctctgatcatgtgccatgtgtagtgaagattgatacaaaaattccaaaatcccctatttttagatttgagaattattgcgtgcagatggagggattttttgacattgttcagcaggtctggtctttggatccagggtttgaggaccctgctaaatgcatttcttttaagcttaaattgctaagaaagagattacttgcatggagcaaaaatctgtccaaattactgttgcttctgaccaactgtaacaaagtgattgattttttggatttggtggaagaaacaagaattctctcagtctttgaatggaatctaacagaaattgtaaaagtgcaaattctcaagttgcaggaatttagaaagatctattattagaagaagaggtgcactaacaggtggatgatgcttggagaggaaaatactaaatttttccaatctattgcaactgagagatacataatcaatgcagtgtcacaagttttggatcaaaatgggtagattgtgcagctacatgcacaaaaggcatctctttttcttcacagttttaagaatagaatgggagttacagctggtcctcaaatggcctttgatttgagtactctcttctcccgaagcacagatttggaatgtttggtggacatgttttccacacaggaaattgacagtcttatatccattgtcccagcagataaagcgcttggaccagatgggttcaatggtttctttatgaaaaaatgttggcatataatagctcaggactactacagattggcatctcattttcatgctggatgcacaatttggaaatcttgtagttcttatataactttggtttcaaagaagaattcaccagagacggtcaatg

SEQ ID NO: 40071 - DNA, 193 bp, Oryza sativa
gagaccattcagatcctgtactgcaccagcctcatatatgttttccctttgaacacagcaaactccaaggggacagtaagcaatgatgctattgatttcccaaagctgaagcacgtccacctgcatgagcttcccagcttgaaagggatatgtgaggcaaaaataatgtcagctcccatgctggaggccatca

SEQ ID NO: 40072 - DNA, 160 bp, Oryza sativa
caaaattgtgagatggaagaagaaaggtatgtcaaacaacttcatgcttatctttgcaatttttttcagtcatcttgtgtatgcgctttgcaaattcttttcactatgtgtgtacacaagtcatatacttgatgatgatgtttttctatatagagagagg

SEQ ID NO: 40073 - DNA, 1501 bp, Oryza sativa
ccctcccccttgtgtcactgacatgtgggacccgcctgtcggcaccggcttcccttgctgacgtcagcggcggtccttttcctttgtaaaaataaatattaatcgcgcaataatgcgttaataattatagaaatttatttaaatggctcaaaacttctaaaattcatatctaattcattcgaactccaaattgggccgttcaacttgcaaaattcatctaaaattgaggtctacatgattgtttacttttttatgtactatttgtttggtttttattagagtttttcctcgttttgcgtgccagcgagtagaatccatcgtttcggaagtccgcggtcgctaggaaaagagttcagaagatcaaagttaagaagcaagcaagtcacacattccccttgagcattttgatcctaatttacaaatgttttaccgtttgcaaataaaatttcatgtcttgctaattacatgggatcagggtttacctatctgctcgcttgtgccatgtttacttgatatctgtcctttgtcaaccgtgggtaataaatcgcctagcttgtattacttatgtgacctagctagaactttatgcttagccatgcttaattaccactagctcaattgatgggataattacagttttagacatctagtatcttgacaagctgcgtgctcgagacatctagccatgtttcatggtcgtaattatccaactaaaatgcaactgaatggtgggctgtgggtgcatggttttgttagttgtgcccatggcaattaaggaccggttcacgagaaaccctagaagaattacagtgcttaccacaagcgggagtgggtaactgcttgatctggagtatagctcgaccctttcctaggcaccggtggcgagggtgggcgtcatggagttgggtcggccggggtgtccggttgtccagctgccggattcaccgcggcgcacgaggggactgccggctgccttgcgaggagtgcaggtgaaaccttagcgtggtgtggatggttaggggagagttatatgaagggtcttgtcacaatcactcgacatggtgacgtgttcatcatgggcacatgatgacacggtgacatgccggtggattgtgtcttgtgggtacagttgtgcacctctggccagagtaaaactattcgaatagccatgcccacggttataggcgatcaaccagattcaccgtgattagtctcacacttaataaatcgacccaatgcactgtagttcaggtggattggttgggcctgttcaatgtggtgtagcgttgttcagtcgagagttaatattaccttaattactcaactgttttactgttttgatcaataaaatgttctacaaccgcctttatgcaaatagccacaaaccatcctcgtatccccttgcacgtctgcatcattggtatggcttgctgagtacggtggttgtacttagccttgctattgttcccccttttcagaagtgtagtgcttctgagctgaa

SEQ ID NO: 40074 - DNA, 279 bp, Oryza sativa
agactgtaaatctgagtaacactaatgctttactcgtgtcaactgtacattttgggcgggacaattttcacaatgctcctttggtgttattacagtacattttagttgaagaaaaacatcgtttgtggtctttttaggagggatgcttttctctgggaaataaaactactttgtaatctagatattttgcctcaacgtgttttccttcaaataaaaatctatgctttatgctgttgtctgttgacaaaacaaactggagtaattgtggatttgtggata

SEQ ID NO: 40075 - DNA, 1501 bp, Oryza sativa
ggaaagaagacgggagcaagtagtaagaagataaaaaagaaaatgaaaaaggtgacaacagtggcatgattataattttataaaattttagtggtacaactgctaatagatgaattatgatgacatttttttgaatagataaatttgtaatgacatggattcaattaaaaaaaaagattttggcgatagaggtgacagcagattcagaatagttaattatgagacggagagagtagtaaaatgcccccggcagattctcccctcaccgccataacgagggccatcttttgtggaaacgctgcagcgctgcctgtggccgcgccgtcgtgtgcaggtttgggctcctcgccggccgtcgcacgccggtgcgcggcgcggaggtaggcggaagcggcgccggagcgtgcagtgttgctggttggatagctggtggtgtcacatcgtccccctctttcctctttggcaggaggcctctccctccgacggctgccgcacgccggtgaagaacggaggccagcgcgagcaaggccacagcccgccgccggttcccttgggtgaggcgtttcgtcttgctgacttcctgaggcaattactgtgttcttccatccgccattcgcccgctagggtttttccccgcctccatttgggggcttgggtgttatttcaatgttgtgtttgatttggatgaataaaatgaacccccctatgccatgtttctgttgaccgtagccgtagtgtcgattagcacttgagccaaataatgagatctttagttttagccattcagcttcaaagtaatgcacattttttttttttagcaatagctgcagatgttgtttgtggtgtgaattggtgatatctggttcctatttccagtcctgccaacaggccggaacaaaattgtgtgcgatggttttcatatcttggggttaaaattaaagaagaagagggaagcccctccatttccattaatagagggtaaaaaggaaatgccacccaagttgtttaagagtacattttattccttgttcgagtgccaagtactagtaagtcttatgtggatgtgtcgctttttgcattggagaaaaggatgcttcactgctgtagtacacttcctgtaataggatgccagggtctcttctctccaaaatggaaaagatttatttagccattgccgcagctgtggttactagcgttctctgtactgtgattagcaatatctagtttctatatccagtcctaccaacagggcggaacatgattgcgtttttgaggttttctttttcgggtagaagagaaatgccccacaaaatttgtttcttttcctcgcacttcaatcttattttgtttcctgcttacaagaacaaatttttgattgcaaattactaacgtgctgtatccaattttgcttgtgtggatctatttctccattctgtggatatggcagttggcaccctcgcacaccaactactcgattgaatgcccctgataaagtaagctc

SEQ ID NO: 40076 - DNA, 289 bp, Oryza sativa
gaggaaaagaggaaaaagaaaagaggggaaaaggaaaaaaagattttcatgggatttaaataatgcacatgctcatttttaattggttaaaattatttccaaggctctgaaaattccactaaaaatcatgttagcatattttgacatgtagaacccaagaaaaattccacatgtcgattccgattattatttgtatttttttaatttagggtttctctcttgcctttaaacaaataatttcttgcaacaatttattaattaaattttggctagggagaataacttcagg

SEQ ID NO: 40077 - DNA, 218 bp, Oryza sativa
ggacaatctgtatacatgttaagcctcactctcacatgttcaattcagcaacaccagcacattctactgtcagcaacaacaactgtctcaaatatttggcttaattcaatttacaatcacaatccatatcaatttatattctcctctcagcttctcgagcagttgctgtaagcctccttcagaaggcagaggtgatgatattagcctcctctagaaaa

SEQ ID NO: 40078 - DNA, 484 bp, Oryza sativa
cccatttgtggtacctaccgaccagccaatgtggttctattgtgagtgcattatttgttctccaaaaatgctctcttgttgatctataggcattttcccagatgtgcatctcttgttctcttgtggatgcatatttgcagggagccatactgttttcttgcagcaagccaagtcttggttgcagacttgcagcagaggcaacgtgacttgcagcagaggcaacgtgattatctgagttttgcctagaaacggataggcgatgcagtgatacacaccccgcggttttacctgcactagatgctggggcgcgccattggcgcgccgcctgtgcacaatgcatctgtgtaggaacgacatgatgagttttttttttttttttgtgcaccctgcatataattgcacacgcatagtatgtaacagcgcgaaaatatcgagcagctagtgaaccatggatggtataatacgaaggaccgacggggcatta

SEQ ID NO: 40079 - DNA, 1501 bp, Oryza sativa
tctcgtgcaggggaggccgcgggcaagagatgggaatgagggtggtgggctggtggtgaaaaggcttccctagatctatggtcgagctgaacccgccccaaggaaggcggcgagcttgcgagcaaaagcgagcagccggcggccatggagcaaggcgagaaaggagaggagaaaggtcgcatcgtcggtctttgattgttgactgtgcttctgtgggccggattttgttgtcatgggccgtgtgagccagttcattttttcacactcactgattgccgtctgatgcagatcgtgcgctccatcttgctgctacttccctctgacgtaacttcgactacgtcagacgatccgaatccctttgcttgtgttggagttggtcattgttgtggttatactcgtctgctcacatttttacagtgttcaacgatgtggattatctttgttctttcctgataggtctatttttctcgaacgctttcctgataggtctaatatttttttttccaaaacaaggttgtaatcagctcttatatttaatcaggcttgtttcggaaaaaaaagattaggtcaatttggaaccaagatggctgcaaacctgcaaattacacatgaagggtgtgtttagttttttgtgtaaagtttttgaagtatacggacgtatatttgaagtattaaacgtagactaataacaaaataaattacagattccgtctataaactgcgagacgaatttattaagcctaattaatccgtcattagcaaatatttactgtagcatcacattgtcaaattatagcgtaattaggctcaaaagattcgtctcgcaatttatatggaaactgtgtaattggttttttccccacatttagctaaaaacatttgatgtgatatttttagttaaacttttttggatctaaacaaggccgaagtgaacatggcacaaaccctccaagtatatgtctggcacatatatagactcccaaatcatatctagcataaacttcagattgttttttaggcaaccacagaaattttcttggcttcaaacccaacccctaatttcacgctcaaatcatacatttacacacacaataaataaataaataaataaataaataaataacaagggaatagaatccagtggactgaaactcgtcactttcacgaacaagtctttagtggcaagataaaattgcatccagtgccagtgaagtcctcggaaacacattagactgagacctcttgatttctaaaattccaatggatcatgccagctgatgtgctccagtaaaaagcttgctggaaaagacaggaaatactgcaggctgctgctttcggcgagctgctttggataagaaaacgcattgctatcgttggcactgttacgactcggtctgtggttctgacttccgatcatatccacaaatccacaattactccagtttgttttgtcaacagacaacagcataaagcatagatttttatttgaaggaaaacacgt

SEQ ID NO: 40080 - DNA, 1501 bp, Oryza sativa
caacaacgtttgaccattcgttttatttaaaaaatttatgaaaaattttaaaaaaattagtcatacataaagtattattcatattttatcatctaataataataaaaatagtaatcatatttttttaaaataagacaaacggtcaaacgttgaaaataaatagtgtaaaacttcacttattttagaacggagggagtagttgtcataatgtcatatcaaatgcaaacatcctctactaggaaaaccattttttgtcgaatatgaggatcaaatcctccacaaatccttattatccttttgcttcaaaggagacctaagcctccaagtcatccctttcctctacatttcaaaaccctcatagatcctcattgcacatagcataatactgccgcacaaacaagaaaaatgcactccagtacagattaatccgacccggcaaaaaaatggatcaggtaaatttacagcaccctcccctaacattgcatgctgaagtaaaccccactgttaatccatttgagccaagatcattcatgcagataacactagcaaatgcgaaagtcattcacctgattctacccaaaaaaaaaaagaaaactaagagatgacctaggcagcgaggaagctacaggatacaggagcaacaggaaaaaaaaacccggaataaggaggattaggagcacagagagcacgcacccaaggtgaccggaggagcgcgctccgcttccgcttccgacgacctccgcacggcggcgcgcgactccggcgagatcgagatggcccggaacccaagcagaagcagccgtggcaccagtgaccgagttgtgatgggggacgcgagcatgagccacagacaagtgggtcccacatgatgaaggcgcccgcatgtcagtgagcaaaccaaccacatcaactatagtgggccgcacgtctccagcctaaatatttttatgggccgagaatttccgttctcattccatgggctgatttggaattttttttatttttaatttttttattaaaagttttacaaaaataatttttcattttgaaaattgacagaagtggtcgcctaccgtcctctgggagggcgatttttaaaaatcgctatcccagagggcggcgaaagtgacgtggcagacggccgttcgctctcgggcgacggccctcaacgaaatttgcaggcggcccccttgccgccctccgctagggcgattctgtggcgtccggggggccgcctgcaaatgggcggcggggggcctggaattttgcaggcggcccccttgccgccctgggggagggcgattttatactgtgctttatatttttgtattaatatcaatagttatcaaatctttttatattgaaaactatacaagattaaaatctccaagactggtaaaatacaattttattatttttagggcctatttggaatgttaccgtacaaatattttgttagtgccaaaatataagcaagttttggcactaccaaatatttggt

SEQ ID NO: 40081 - DNA, 391 bp, Oryza sativa
aaaaggaatgatttgccagccgttccaacatttcatcaatgaagggtagcaggaaatgatccttttttgtagccttgttaagtttcctgtaatcattgcgggattagttcattttgagcatttgcaacgaccgtcattcctcccttctttggcacgacctggactgggctaacccactcgctgtatggtacgggatagataatcccggcatgctagagtttcaagaccactttctttacaacctctcgtgttgcattattaagccatcgttgaggttccctggaaggagtactctcggggtcaataggaatacgatgggtgcaaagcacgggattaatccccctgaggtcttgaagcgagtagccatgaacagaacgatgcttttccaaca

SEQ ID NO: 40082 - DNA, 1501 bp, Oryza sativa
gctctgcgatttccaaccaccacacgccggccatcaccaagtgcccacatgtcaaccgagttctccagctttactgttaggttcctatgcacaaatccatccatatccactagatagagcaaacaaatgttttgccatatgaaccctagcctaatataaagatcccttctgattacatttttgggttcttgcaattatcagttttttacggcctcactcactgccaaatgatttctcctgccacaggattagggaatccatgcactgcagttgcccgcggtttctcatcaccaaacatatttgcaggtacagtttactaccgttgtcttctacgaataacggcactgacaataaaaaaaaaatactatactgatatgaactgaaaacaatcttgctaagtgtaaaattataaacccagaacaaacaaaatcaattgttattttatttgcgcctacaaaaggatatgttatattaataccttttcttagcaaatttattctagatcccagccttcgtcatgcacaaagttctatacgatctttttccactatcaatatcgttttacatattgattaaatttctcctggtacatcaccgtatatattaccatatccatatacatcgattgtaacgcaggcctatttaacatgtcttataagttaacacaaaagactatggtgcccatcattacatagtttatagctagcgatgcgaaagtaattaaggctagaataaataaaataatctcagaggcgattagagcagttgctacccctctactgtgatcactatttttagacaagctcaagtcctccaaacatgatcagtataccacacggatcttaaaatatcacagcacagtttgcaacctttatagcaaggtcttaccgaccagtcctctaaccaatatatgattttgttcccactctgtgtaattgtaatttaaagttattccttctgttaaacctcatatcatagagatcatgcttactgtttaaataccttcacaaagaaacatatatcagaagtacctaaaaccttgctatagcagccattggctcttcttcttcatcgtcagccgcagtgcatgcatcacttagcctaatcttcttcacctttacttattattgtatccttagatttctcagacgttgctttatcttcccgtgcaaacacacacacacacacacacaaaacccaacataaatatgtattcacagattcaatctgcaccttgttttgcatagttatggatccaccaacattcttcacgatctggatgaccgcggcaaatcagcactgtgcggtaaaatctaagacaaaactatcctattcaatatataaagtatcctatatacaacaatgttaatgtatgttctttattggccagtgtattccacccgcaattgtgcaagcatatgaactcaaggacggtcaaaaaagttggtgacagcacatcaccttaaggtctacattgaactgaggaaagcatctaacaaca

SEQ ID NO: 40083 - DNA, 1501 bp, Oryza sativa
gttgcatctttggtggcatcaacaacaaggcaatggcggcatcaccaatcccccccttcttcgttgccgacttagcggaagagctcgtgtcggcgggaacctatcttgcctacctcctatgcctcatcgcctccccttagggcggaagaggcaaggagagacaatggctcaatgaggaggtttgccagcttttccagctcatgctcgccagcttctatcaacttcttagggaggaggagacagcgttagcgaagcttgagctcaagctctcctagaagacggtggcggcgacgacgatgttagatctaggcatagagccttgggcagtacctagatcgaggtggcggattgataatggcgaagaggaaatgttgacagtagctgatgttgtgccgccaaggagccaagctagcctgttgctactactccgcccatcgctatcctcgagctctatgaccggataggagagagagagcactcgactaccaccttccgggagctcaagcactaccttgttgccagctacttctactgttgcatagggacgagagtaaggagggtgtgtgtagtagaaaagaagatgtttggttactgacatgtgggtcccacgttgttcgaagttaggtcaacatgccatgtaggcgccatgtaagacaaaaccactgttcaaatatgtcaatgttatggataaatcatacctaataattcttgtgttaagctcagtgaagcctaccacatactaagttttataagcaatcaagcctcatatacattagatgttttggataagaaaagagaaacatagtcccgcttcggcacgataaggaccactcggattatatctacacttacaaccttatcttttcgcttgtgcatatgcttataagccaaaatttgaatttttaaccttaaatttggagttcactttggggggttttttaaatcgtggtttattttctagcctttacttttagatcgctaagaacacgtatataacagtttttattaacaaattatttttgtttgcaaacacaccgtttagcttattccctaaataagttaaacgatgaccccgttagttctctagttctacttaaataaggggacatccgggggtataaatacaagaccatcgagagaggcgaagacaagccaagacggatctagccaatccaagacaaaccaaaatataccaaaggcaagccttaaaaaagccaatatggagccacataggccgacaaaagggatctagctagagctatctccaatctcatcgagttcatattcgaggaaccagactacgctaaccgtcgatcacatgtgagagcaccacgtcattaggttgatagataatagattagatcatctcaaatattgtactcatgtgatattgatatatataaaggcagcactggttcagtcaccagaagtagggttagatatgtcaattaaggggcttgaacttgtataaaaatccatgtctactgtctcttttgctcaa

SEQ ID NO: 40084 - DNA, 438 bp, Oryza sativa
ctggtaattgggcaacatatccaatgcacacaggccctcacgtgtacatacgtgcacaccaactaaaaaatgtaccaaaaaatctagaaaaaatcatacacatactttcaattgtattacacctagggttaaaatcttaacgtcaaattcattatattttagccgtaacaaaaaaacaaaaaatctgacagttttaaggttgcaattttgtcagaattttatcttttttgttattctgtatgtagaatgaatttgaagatgcgactttgcacataaatgtaatactattgaaagtacatgtataaattttcctagaattttttgtgataatttttagttggtgtacacggtgtgtacacgcgagggactgtgtgtataggatacgctccctggtaattgatggttagtacatcccaattgaatgctaatggctgaaaa

SEQ ID NO: 40085 - DNA, 234 bp, Oryza sativa
ttgaggaacataatttaaaggcaaagttatcgacccttgcgtcaaataacagaagtagctagcacccggagaccaggaaagttaatatgaggcagttggtagcaagttagaagcaaatgacaagcatgatattcttatgatgacaaacatggtatcctagtaatgacgagctgatctcgacgcatgacatgaagtgggtaacttgtatgaggttgactccaaagatatgaacta

SEQ ID NO: 40086 - DNA, 291 bp, Oryza sativa
gagaaatccggccgcctcccggcctcgtccgtcccttccttgcccataaaaagcctcccctgagactcctctctcttttcccccactcgccgccctctcccgtgctctccactgcgcccgcgtcgcttaccctgccgtccgccgctcgctgcggagctccggccgcacgccgtcgcagctagggccgccacgctgtgcattcgccgccgctagcttcgccgtcgtgggagctatcctggccgccgctcggttgcccccctccgccgccgcaccgctctccctacgccaagc

SEQ ID NO: 40087 - DNA, 307 bp, Oryza sativa
aactatgtaatgtatataggtaggcttgagccaagcaggcttataggtaactggtagttagttgtgggatgagttgtctcttaagttagctctattttaacatgacaaaattttggagctggctgctagctatactatggaccttggtgtgagacaagactaccaatattgtaaggtgacagaggagcagacagaataggtgtggtgcaggatcctgtgggctgtgagcctgtgaccatggcattccaaggggccagatcatgatactaattggatgaactacagttattacattcaagaatcaaga

SEQ ID NO: 40088 - DNA, 154 bp, Oryza sativa
ttccaggatccttttgcttccctattacttccatatgttccttgtgcctagcagcgttggcctccatctgcacctttgcattcagatcgaagctttgcgagtgcgcctcgccgccgcgtgtgtgccgcaccgccctgcaagcgccgctccacca

SEQ ID NO: 40089 - DNA, 197 bp, Oryza sativa
cacacactgtttagtagttcgaaaaaagtgcgcgcaaaaaacaaaagacgtgagttgggaacatgaagtgccaaactcagcatggacaattatgcatacacgcttttcaaactattaaacagtgtgtcttttacagaaattttaaaacgatgctattactacgacggcggtgcccctccccgtcgaccgcctccaga

SEQ ID NO: 40090 - DNA, 1501 bp, Oryza sativa
tttgtattcatattaaaacggatagtccattttatttttttatatgtatatgagtatagtcaagggcggatccaacgtgggtgcagagggggactcgagtcccccctacacccacaagacccatggataccctctggagcacccccttcaattttttcatcataaatgataaactaaaggtctctagatggctggagattgaataaactatgtaattgagcacccccaatttttttgttcctggatccgccccaggtatagtatacgttgtgccgtgtacgcaaaaattatcacgtgtgattttttatataactgaatatcgccaatacttgtataatcagacatggattttgaccactttcttttacatatttgccaaacaaaaattatatttctaaaaaacaacaatcatgtgaattaaactgagtacatgcaggaatgcagaaccatttaaaggtcgtcctcacctcaagttgagaccaccctgaagctcatccctcatcaaagttacgcaaatacataatccaaatagcgtagttaatgagttaattaatgcacttattatatggttcatatagaccaattcaaatctaaatttcaacaaacttaacaaaaagaacacttgtacataattttaggtactgccatccaaacagaattcagttgtcattagagaatcctagaagtaatatttagtgttgtcgtgtgctgcacgttgatccatttcaggttgttcacataaagcaaaaatgttcggtgataccagagagtttcaggcctgctgtccagtaatttgaccatatagctggatttatactaccagcagttagcgtgggctctaatgacaaacataatgggagagttgtgcgggtatatgctgaacataattttcttcaagcgacaacaacaatatctactgtactggatgaatcatttagaatgcaaaacatcagtaaatagttaaactttacaggagcacaggcagattccatgaaagcaaatttggagagaaaccggctagggtttaggcggatcaggatcagtgcatcgtttgagggtttagtgtgatgttgatattcccttggagatgaaacaaggtattcagtgttctgagatgaaacaaggtattcattgttcatctattagcatttaggatttacctagctagcatggcccatttagtagccacttctgcatgtatgaagcactgtgaattgcctcaagccaaatgtcacaggctattatatacatttttcgttgtttgtattaacatcatatgataactacaaacatgtgatataattattatttccgctacaattatttaatattatcttactgtttgggtttaaattggtgtacaatttttacatgttgcaacccaacgcgcaggcatttgtttgctaacatggaaatttaagtaagacaatagaattgcaccgtaggaaattaaaagttattgacacaagagaatgtttccatgcctcaccttggagagaga

SEQ ID NO: 40091 - DNA, 280 bp, Oryza sativa
gtttttgtagacagtgagcagtgtatatgtgtgtcaggcatgctgctcatgcggggaaacgcatgctgcgagcttctcattttctcagttctcactgactctgaatcaactgctaccctgcagttttatgcacctcaacaccttgcatttctgcattggcatcaaatctcgatctcatcaagttcttaactatgtttacatgaaaatgatatcacacccatgcattgcacggatttaattgctgcaggtgttcttctctgaaaacttatatcaacagcca

SEQ ID NO: 40092 - DNA, 1175 bp, Oryza sativa
gctattcgaatagttttactctggccagaggtgtaccactgtacccacaagacacaacctcaacatcatgtcaaccatgcatcacgatacttatcaagtacccgaatagagattgtgacaatacccttcgcataacacaattcaaagcagtgcaccgttcctggatcataatcaccccttataaaacaaggcatggactccccagcgacccccgtgggcttatctccgccacttctcagtctggtgctctacaaagaaccacactctacaaaaggtaaagccgttgcccacgctggcttgtggttggcacggttaatgtttcacaaccgaaactcgtgaaccggttcttaattgtcatgagcacgaccatcaaaaccatgtgctcacaacccaccattactatgttttagttggcatcttaattaatcaacctatcatgattaatcatcacgagctactattaagccatcattaagtaatagtgaatcattaattatcccattcatatgagctagtgtctctaagcatggctaagcatcctaattactttagctaaaaccatgtaatgttctagctaatccaattattaaccaagtgacaaagtataggtaatcaataacaaaaggctataacaaaggcaataggttattcccacccaatgacattcaaaaataaatgcaatagttgaatagaaacaataggttgaaacgggatcaacatgctcaaagggttgtttgggatctgtgtgacttgccttgctggccttgaaactcttcaaagtcttctcctgcaaaatcggactctccaagaacgtcggaatctatacataaaaaagcaaaatcaccaaaacagtacataaacaatcataaacaacacatgtggatatttttaacatatatatctcgattttacaaaaatttagagacttgaaccaactaaatctgagctaagatgaattagatatgaatttttgaagattaaaccggattaaatcatttatttagattttaattggattatgacgcaataaagaattatttttgaaaaggaaaaaggatttattgtgtcagcgggctcgggttcacggtggaccgggtgcacggaaacggtctacggaacgaaatggacggccgagatctaactgatctaccgcgggtctacgactgacgtggcgc

SEQ ID NO: 40093 - DNA, 1501 bp, Oryza sativa
agagatggcagcacgcacgatgggcaaggacttggcagtgggtggtgaatcgtggcgtgagtacggatcggaggcggaggcggaggcggttggttgtcggaggagatcagtgagccgtgacgatgatgacgatccactctgccggccgaggatcagttactgccaacatgatatagttactaaagacagccattcatctcaaatttcatacactctcacggctataacctggcaacttgacagtacctgtgatagagatgctcacattcaaaatgtagcaagcatcagaaaatgggacgactaaatgtattatgatagttctgataaccgaatagctctattatgatagttccgaagcacgcactatgtcgccgaaaatagaagaacagagacaaatttttctaaacatgtaaattataacagcaccaccaaaaatagaagaacagagacaaatcattcagggtaaattaccattgattctgagatggcgatcgttgccaataacaatgaatcattgtgtttactgcattagttttttttcctaaacatgtaaattatgtcagcaccatattattgaatgtgacgacgccgaatattggcaccatattaaaattgaaagatcgacggcgtcggggacatatgggaagagaggtgacatattagggatgggtgaggggatctgtacctttctgcggcggaggagatcatcgtcggtggcgatgctgatcggttagatgggcggaggcgcgcgagcagcggggaaccggccggtaactgtcccggcggcgcagaccgatgcgatggtcggaggggcggcgggcggatagggggtggcctcggcgagcggtgggcggagggggtggcggcggcgagatggagcgcgtgattttgctgggggaggaggggaggcaatccgatctggatcggatccggagagtggtggggagccgttggattcgagtcatcggatattttcgatcgtcggatgtctaatgagtaataaaatcatttgttactatattatagggtacatgtcagaggcagccagcagcaagcatgtgatggagaacaccggctacgaagaacgtgaattgattccaaagcatctagcacagaagaataaataaagggtcctccgtgacaagaatatggacaaaagtaaaatttgttaacagagaaaggtacctgaaattaattaaggtcatgtttggttggaaaaaaattttaccccgacatgtcacatcggatatacggacacacatttgaagtattaaacgtagtctaataacaaaacaaattacagattccgccagaaaattacgagacgaatttattaagtctaattaatccgtcattagcaaatgtttactatagcaccacattgtcaaatcatggcgcaattaaacttaaaagattcgtctcgcaattttctggaaactgtgtaattggttttttttgttagcaaatgttttgttgttggaactaaacttagtttccaaac

SEQ ID NO: 40094 - DNA, 1501 bp, Oryza sativa
atacaagttgagatcaaaaggaagcacatggttgacacctccctggaaatcacctccaggaagctcatggttggcacctccctggagatcacctccaacctggtcatcctcctgatcagccactgctgcttcttcagccactgcttcattgaggtttggtatagcatgttcatctccatcatctaatgctatatttagatctaaacccatggatgtgttttgcagagatatgaagggataaagtgggagggaaacttgtgtttttgcagagttatgaagtgataaagtgggaggttaacttctgatttgaaacttgtagggtttgttgtggtggggtgtgctaaatttgtattacatcccgccaatgaagtggcgcttaacctcttcattcaaattatttggcaccttgacgccttgtgtctgcctgtgtgtttgagtatggagtactactcctgttttattaatgtgtggcagtaataatactttatttgtacctaatgattaggtgtactagtactgagggtagtttagccttttgctctttgtcctaaaactaccttgggcttcccggaatcccttctttctgggacggagggagtagttatgaagcttttgacctatagttttcagtagcggtctgggtgtgaccaagtttctccgctttctcaactggtgattgtgaagctggtatatcaccagcgtgaacctggcaacatgtcgttttgtggccttctacataagccggatccatgcaacccttttcttaaaaaaaaaacttacttaggtagcatgtcactattagagtttcgttttttttttaataaaaggaaaacattttacttttatggagtacgaagcaaacttcaagaatgtgtacggccaggaactcttgtttaagacaacaggcgctaaggtatctgacatcagtaggctaccacatcagttttgatccctttttcatctacagattgcagagagaatgaagttagaatcttggatggatcaactcaggctgtgtttagttcacgtcaaaattagaagtttggttgaaattggaatgatgtgacggaaaagttgaagttcatgtgagtagaaaagtttgatgtgatggaaaaagttggaagtttaaagaaaaaattgggatctaaacacggtgtcaggcgatatcatgctcaaaattcaagtggtctcactctcgatctctcccacagttctactccctccgtcccataatgttgcaacctaggatgggtatatggacatgtatgtccagattcgtagtcgtaggatgggtctcatcccatcctaggttgcaacattatggaacggagagagtattattttagggaagaagaaatcaaaacagaaagcatggattgaagttaaacaccagtaccagtactgtagcacatttcgccaacaatttggtggcagtcgaggagtgcgagccgtcgacttctcgcgggcccgactaatatacggcgctacatattagtttagt

SEQ ID NO: 40095 - DNA, 1501 bp, Oryza sativa
caattaagtttaaaagattcgtctcgcaatttcaatgcaaactgtacaattgattttttttcgtctatatttaatgctccatgcatgtatccaaacatttgatgtgacagaaaagttttaagtttaaagaaaaaaaatagaaatctagacacagccaaggttgaaatcccataaagccaaattagtcatcaggcccttgcacatgttgggcgggcatgtgccgatcgagccagcagccgtgccgtgtggggtggcgtggaagtcgtggagttgacgagaagatgcggttggcgtcgccgaggtcgcagccgatcgatggcgtcatggcggcgacgatacgcggttcgggctaccgggttgcccccaatcccacgtgatgacgtctattgcggtgtttagttccacggcattgtgtgtgtgtgtggcggggtggggggcggcggtgcaaaaagatttgatttttttaaaccaattttagtgttttttttcttctgatgaaggttaagtgttttttttacgtaaaacgatgtggtattaacgtatgattgattgagttttaattattacaaacttaaaaaatagattaatataagaaacacacaattttagcagtttgaaaagcgtgccacgaaaatcttaatcttcaaccaactcttgttggagaaaagaacgggacctaagtactagccatatgcttttaggtgccaatggctttgtttgtttgatgtgtatgcagggatgctctaaactgggatcatctcctactaaaatttgatgttttttttttccttctagctgatatgagagttgatttcaaatatagagctgttaaatttgtttcactagctgcaatttgccggaccttgtaactgacaagaaataatatggtttccagagacaattttattctcgccactaacgttgtctttccaaataatcctcttctttgtggtggtactccctccgtcccagaaaaagcgatttctggggggggggggagactttgtcccaaaaaaaaagcgattcgtgcacaaaacaccagatattttatctgtgtcgcatcatatgtgggcaatagtgggccccgatctctctctcctctcacaccacagaaaccttatcccttccctttcccggaatcgccgcttctctctcgcgtactattcctctctctcgttcctcgcgtattcccctccacatctccctcccgatcctcccgcacggccaaatcaaagccgcgacgtccagatgcgagaccttagcaagcttcctaccccctccgcatctccctcccgatcctccccgcacggccctccccactccacgccgcttcccctcgctcccgcttttcccttcgacgttctgcatttaccaggatgcgggcgctcggatgtggtggcagacagttgcgagggtttagatccgatgaaggaggcgactccggtggaaggattcggctcggtagcagcgttcatggaagcggcggaacggtttatagttt

SEQ ID NO: 40096 - DNA, 263 bp, Oryza sativa
  unsure (1)..(263): unsure at all n locations
ccgccgtgcacngtgcaatcgtgctcgattgcaagtagttcatcacaacttatatatggctgcatagcagttagttagtactcctctaagtaagcagtttaaggaaaacagtgatgatttctagtgtcattagttctcaaagtcaaatacagtaattatactaattctgtatgtttttctttatatgcaaaaatgtccataagaaagataaatttctttccatattgatatagatttgtcttggttccttctgttgtgatgca

SEQ ID NO: 40097 - DNA, 590 bp, Oryza sativa
ggattgggcccacggcctaggaggagattttaaaaactttttcaattaaaaataatttgtgaaatgatgtttcatttattaaaaatacttcctttgctcaaataattcccagaaaaatctagaaaatagaggaacaagcaaagtatttaacaaaattttatctagctcatttttatgttgagatttagcaaattaaaagaaaagatcttctcttttaaacttttaaaatcatttctaataattccttttaaacaacaatttataatttaaggattttaaacaagaaaatcacttaacaattataattagatcattacctgattaatttgatatttaaataattgctgaacttttctttgtatgattaaaattaacaattgagctccgaaaaatccgagaaaattccagagagtataattaatcatggaggacttaataaaaattaaatccatctatgcttttttttatttaggaaattttatttcccacatttaacttcacttgtaaattaaagaacatttaatataaattctattaataatttattaaataatttataaatcctgaaacgaaaatcaggatgtgacaga

SEQ ID NO: 40098 - DNA, 1398 bp, Oryza sativa
gagagggagagaaagagagggaggaaagggagacttcggccgcgggccgaggggagagagggaggactttgggccagacttggcccaaaggaggaaggagggttatttttaggtttttctttttaataaactttgttaattgtttttgttgcttaataattatttccggtgctataaaaattcaagtaaaatttgagggctccttttagaccaaggagaatttaacaaaaattctccgggccacatttgaatttttcttgcacgtattttagtgtttgccaatttcttttcgcattttaattaattctattattccttttagcgaatgatttttaattcgggatgaatttatcaggacgtgacaaaccataatctccacagtagcccccgagaccttcgcagttgaccaaaatagtcttcttgaaacaaaaaacaataatccgagtgcttcaattcaacttgctccagcttgtcgagtactaaaaatcaaaaactgtgaagggcgaaaataaaacatggtgcatcgagtagatgcacctaattaggtgtagcccccgactatgtgattagttgaaaaactaaacatatagtcaagaaccgagtggttttatagcgaagcacgcatggtacttagtaagatacctagacgactgcttctcaacttgaatatatcaaggacaaaaaatacaagaagggccgagtgacaaacactcaaaaggcccaaaaatagatatatttggtaggaatccgagcaagaaactcttaaaatgatcccccaaacatgacagaaaatcatggtaattaatgagtctaacagcctaggctgtgacccttatcataaccaaaataagcatataacatgctaggagaatgattactaataaaccagtcatctcaaattaacccaacagctcttgtagcctaaaaaagcttacaaaaatggtataacacctttctatcgggcaccttttcatgtgcatcataataattccaaagaattattgaatcacgttaaaaaggattttaacagtatcgggccacatcattgtgagcacatattgccaaagcaaaaagcgcctaagtccctagggatcacaacgggccacgctgaaaacataattgggctgaagtactgtacaggtccaggcccattagtactccggataccctaataataccgaagtgaaaaacgtctcttcgtcttccccgccgagactctcgccattttccccatttcctgctacagtgcaaaattgcgccgggcaaactagggttcatcaatccgctccaatccaccctcaaaaacttcacaagatttctccccgcatccaccgctccgattccccatccctttccagccatatctcgaactaaatcaatccatccagttcacattca

SEQ ID NO: 40099 - DNA, 1368 bp, Oryza sativa
ttccttgcacgaatggaacgagaatataagagactaagccaactcaataccagataattcacgactcaataccagataattcacgaagatccacctttccttttctcccttttagctctaaagccaaattgaaacctctttgtatttaactataatgaatgaccaatcggtaattttgtaactcatatttcgcttatttgataatctacccgatcacgcatagcttttggctagtagattgagtaactagtgaatgtatgcttgtgtacctggttgtagtgtagtccaatttattggcttaaatgattttctttgtttggctaattggtacatgttaaatgaacatagatactctgtaacaaatctaagcaacataaaattccataaaggtcctcatgtcaattagacaacctaagatgaccactgtaaaggtttcatcattttatcactctttttactacctcaaatatatcagtcaagtatagtcacagtgattgattaattagaaacctgatcaggaaaatgaagcaactcctaaatgtgcttaaaaattgatcagaaggatatatgttttataatttattcaaatactagattatttatcatgagttaatataatttttctacaatttttacacttagttttgacctcattgaaattcaatttagttctcagcatatcccttttcacctttttgccagaattaacatatttcgaatttttgagtgaaactttgaaaaatggaaactaggtaactcaagctatgcacacacaccagatcacccatttttggaattcttgtagctaggtcaaactagttaaccagaaggagagagagaaaattcctgaaaattcactaatttcattgtgtatctatgtttctaaccttgctttatctgtcctatgggcccagttcgacttactgacctggccggttccatatctcctagatcacctcttgggcgtgcaaccccacctcaggaacttaagacagcaagaaaaacccttcatcttcctcctcctccctttccattgctagccactttacgttcttccttaggctgagctccctccccactttctcccccaaaatcttcttcaaacatccaaaaccaaaccctgcatgtcacacctttggatccctggggctctaggttttccatccatccaaatatcttgcacatgcatggccatttgagagagatcgggaaggaggaacagcaaggagctgcaggctgcgaggttgcagcagctggatgacacgtttcttttctgtgttggtaagttctttctacatccatggctccctacttgagttcctataatgctaacaatcccttatttctccccctccctatgggtcaccg

SEQ ID NO: 40100 - DNA, 760 bp, Oryza sativa
aatagattatactctgatcagaggtgtacaactgtacccacacgagatgaacaaggatcaaatgctgcccaccacacaggtgcgacctacaagtgattcaagctcatcacatatcctttcctagcccgaccccaaccatttaaaccacaccgaggcccccgacgactcagtcacgtgcgtgtgatgtgactaaggcgggctcaccacgcgggagataccccatgccatacctcggccaaccgggcactccgcggatccgaaatcctcacgtttctccgatgggtgtaaatgatcacggtaggtctagtaatcaaacaagccggtcccatgatacggcatgtggtaagtacgtaggttgcttgaatagacgtcaaaatgttcagtccttaacgacccagacggagctactgcatcaggggaaacatacctcccatcatcgccctaccacccgttcaagtcaatcatatttcatcaaccattatttaatgtaagtgcttcagttttagcccattaaccaagttgtctatatcccagaattaacaaaactgtccagccatatagttgtatccccactaagcaaaactaagcataatgaataaaacatcccaactattcccaaccaggagagtaataggtatatggcagctatatataactaaggtaaatgcaccaattaattatataccatgtcacccaaaactattaactaagcaaatgcatatatatatatacatatatatatatatatatatatatagga

SEQ ID NO: 40101 - DNA, 959 bp, Oryza sativa
ttctcacgagacattgcatatccttgccttgagcggttgaaagacagaatagcaattagcgcactaatcacccaatctttattcaacttttttccggaagttttcaaatgattttgcaaaagaaatccaagttcctcaaatgattcactatgtctctccaaatgtatcaatatgaattcctcacctttttacctttttgattcctactctaaggtttgatatgtggagcttggaagggatcaaacatggcatacttacattcacatttattactaagtcaaaagcatagactaaaatagattaccaaacatactcaagatcaagatcgtgcaaagtgtgtctgtgatatatggtggaaatgtgaagaaaattaaagaaaatgttactcctttgtgcttacttcatctcccaaaagataatataccaggagtatttctatgccattgctgggaattatatttctagtaatgttgttaagaaacaccaacaactatgtatactagaagtataggaatatattcttttctattttctttccacttagcttagataatttagtaggagaatgagtagcttcattcttgtgtgtcattctaccctttggattatattaacccctgctttgactatgattattacaagtaatatataaattattagtacggttctctctattatgatcttctcacgggattaaataaatacgatacccttggaatactctcgggtgaaatgctacaatggtatatccgtgcgcttgcggatgaactctgtaaccataatataccagaagtatttctacgccattactgggaattatatttctagtaatgtcgttaagaaataccaacaagcatttctggcgccgttgccggggattatatttctagtaatgtcgttaagaaataccaacaagcatttctgacgctttcttccggagcgtcaggcctcaagtagtt

SEQ ID NO: 40102 - DNA, 1501 bp, Oryza sativa
acttagctggttagagatctttgttagttgtcacttagtcacatgacacggttggtttaagaggtttaggatccatcagtttaattagaagcatcacaataaaaagacgtctagtagagatggcatgagcaattttctggttcttgatccagtttggtaataccaaactaaacacctcatcaaaatttagtcaaacacaatttttgataatgctaataaaatcgggctcaaatgttggccacattttctctactaatagaaatcaagcccttcttaggttgtgttcggcattgcaggttttcaatccctctccctcgtttttcgtgtgcacgcttttcaaactactaaatgatgtgttctttgaaaaaaaattatataggaaaattgcttataaaatcacattaatctatttttaaagctacttttagctaatacttaattaattatgcgataataagctgttccgtttttcgtgccggagggatagactcccaaccgacacaaacgaacgcaaccttaaagggaaaaggtaacggtgccgctgaatctttatagaatagagaacctaaccatcccttaatacaaatttcacatgaatcaatttattccccacatgaaaattcatgacattttaagagtatgtttggttacccgaatgcctttagcttggctcatatgttttatccaaactgaggtcgggactaccagatccaatagtactgaacttacgaccatcagatctagtggttgtgaggttgtggttcaccgtatactacaaatagccaaagaggagggggaaggggatccactggtgagggggcacgatggaggcgacaacaaattgggaggcacaaactagcatttggagaaagagagatgactcaatgtgtgaccctatctcacctcctacaccgacctggtgcctgcacgagcataacctacatgaggaacgaagctcacctcctcgtgtttctagcgattttggatcaggtgtttgtttcgcatgaatggaatgctggaactagaccccgacggtcatactgacaaccaaataactgtcacacataggtgtgagccacccttagatcaagaataatataggagcccaccatcggctctaaatcttatattatagcaggctctacacacttgttctagtattaatattttgttttaatattatgtgggtttagtgtacactctatctcccatctcttgacgtggatctaggttgtcaaagcacctagacgctcatgccaagcggacgattgtaaaggagccagcttctttctctcacatctgattttcctcttccacgtctataccagctaatcgtccacctattagccatagtcttaaatgcagctaaccaaacacgccctcagctgttgatagtactactaggccttattattggcccaaaatttggtgttgggccagaagtaatccggcccattttcctcccaagacgtctcctccccgactcggtcgccgttcctgc

SEQ ID NO: 40103 - DNA, 1501 bp, Oryza sativa
gcattgatgcaattgctatcttcttggaacaaaattggtctttgataagtttgagaaaacaattaggatttgatttttttctttgatatttaccaactcaattctgtcaagagttgagcataatgaaattcatccccttccataatatcagaggttatactagattctagatatgctagattctgcatggatagtttcctttatagtactggtattgacctaaattgtctgtagctcaagcaacatcatcttaatataaagtaggaataaacatgagaattcagaaagcatgagcactgttttcatctatgtgtaaaatcatgaactagaataataagcaaacaatttatatatatatatatattcctttctaatgttttcagctagtactatgttaggttgtacctccaatgttgtacacagagctctaaacttcagcatgaaagtttgtacagaaacaaacaactcattcatgtatgacccaaatatcagtataccagcaaaataagataaaatcacaatcggaagatttgataagaaatgtgtaacacatttggggaaaaataatcatgagcacttccatcagtataactactactgagatggatatgtctttgaccaattaaacctttgtcatataaaaggacacataattcaacaggacatcaaatatggaaccatggatcaatatagaataatctgcatggcaaaaagtattgtttttgtacatggtactcacatggtatttgttattgtagacgatgttgatgtcatggatcaagttctgcaagtaaatggaggtcacaaccataatgcctttccttttgatctcaactttgatgacgatgaggaagacctacaataccatccaggtaagccctttaaccgacatgactatcagacttaaaaaaaagataaaatgtggttttacccaaaggatcattgtagaataatattatttatctgaaaccatgtttttaattagaagttagtaatattatatcatgccaactacctacaatagtccaaccgtgtcatttggttgtattagttgcaataacaattcaggattgtaaattagacatttcagcacatagtaaatcacaaagaataatgagatttaccaataaatacattgatatcttgtatttacatacaattgtcatgtcaatcggttcactaccacagcaatctgaaagaaagcacataaactaaattgtccaatgtctctgtccctcttagatgtgatatgtatggttaaatcatattacaaataaaaccatgtggtgaacctaaaaagttatgccataattttgaaatcatgttgatcaatgacaataaaatattaaaattctgaattggtacatatgactaaccttataattgctgttgtagacatgcaagagtacggcgtgtatgcgggtgatgtggatgttgttttcgaacaagaggagttggatgattcagatgaggaagatgaacatcaaaacaaaaatctaac

SEQ ID NO: 40104 - DNA, 1501 bp, Oryza sativa
acacagtactatcttattgtgcttttactacattttcttgaatctgaatctggatttataaaccagaatcaacaaaatgcaagcttaagtaatgtaagcaggcagagatatagggaaacaaagaaagataggagtattaccgaacatttgagagattatcttcaggcctttgaatattcccttcatctttatcgccatttgtgagtttctccacaagcaagatctccctacatcatgaatgacaatgttcattaccaatgtgaagaaaaaaattagcttgggtgctacagactcatatattttgaatcgcatatggcaaaaggaaagcacagcagcttacctccaaactccaaagctagtgtctcgtttgcaactagcaaagctttgaaaatcacactttatttctgaatcttcagactaagttcagtctgaagaacaacaagaagaaagagatggggaagaaacaagataaaacttgattagcacaagtagttttctgtagatggagaagaggcagaggaggaactaaatcttctgtgagggtagcatgacaagtgcttaaatatgatcacaagttagttagttggctgcaccttcttccccctcttccaattttatattttagttctcttgagagccattcaagccttgctgaaaaaaaaaacaacttgcgcagttgcactgttctagctgtacttagatcttgttttccatacaacgggaactaacatcgaaaatattataattttcctgcataattttcctaagaggctggtgtctgcataatttttccctgaaaatgactggtgatttcatataaatattaactgtcaggcttcaagtttttccgtcttacacctgacttgtcatgcaaacaagtaaaacacaaactttgcagctcaaatgggtaggtatattattgaaagatttcaggccaataggctggttaactctgtaatagatgatatggtacatatcagatgtatagtatagtcctagtacttttaaggatcattgcatagaatggctctttttaggtggtactgacatggcagcaaatcatcttcttatttaaaaaatatccaattttatctttaacagatgaagttttacatcacatttttgtctagaactttcaggagggctgcatatctttatattggataaagaagaaaaccagtggatttttttgtcattgcttgctcattgtttttgcctaagcttgttagttaagaaaacaatataacacaacacatgcagacatttcaaatggaactagtatgacctctttcttcagtgccttatcttctatggctcaaagaaacgtatttcctacacttggtggatgatgatctgtcccattccacttaattcactatgtgtttgaatttttctctggatatctcttcctgatcctgatgacttaattttgtattatgaacaagttttgtttatcttctagggtctatacacaccatgaaattttccaccaagctgcaac

SEQ ID NO: 40105 - DNA, 1501 bp, Oryza sativa
tgctcgctctggcatgaagattggtcgcattggtaaattcagagtttcactcatacaacctaaggatatagagatagttatttgtttcatctatgctgtggatagtgtttgtagcaggctcattatgcttcaatcctccttagacattgtgatgattgtatgtctgatcctttttgcagaggatgtgaccccggttcccacggacagcacccgcagaaagggaggtaggagaggaaggaggctgtagatgtattgtcagccaacttgtcgccatggagcatctcttctttggatagtctcatagctcccaatgttcctgaagagagatttagttttgctcagtgtcctgaattgttgactgtcaagttaattcggctgctatgttttggttcaaggaaatttccagttttcatgcttaacaaacccaatatgtgtaccttcgtggttccttataatatggttggattgtcttatgctatctgcgcatgctttctacatgttacgatgtgggtgtggcctctggcgatatactgcaaagttgaattttgatccatttggcactgcattttctgtcaacagaagaatagcatttccttttcattttatatgaagtactagaactagtcattcctaagctagcattaggaggtgattcattctctctgaggtcctaaaactcgtgcatcctacctaagctagccgtgtttgtcatcctacctaagctacctaaaactcgtgcatcctacctttgttctggggctagaataggcgctcgatgaccatatatgctgtgaaaatgttctgtaaagtttctcattatttaacttcttatagaagtttagttcttttacatctgccgctatccaaggacaaagatattggaaattttcacaagtgtcatgtgtaagatatctcaatgctaactaaccaaaccataggcaaatgcaaatgcaagttttatataagttatagtgtagttataatgtacttacaacgtaattacactttaattatatccgaaagttttttattccaaaaacttgtggcagtttttttaggtcctcccatgttagaattgcatgtcttcagtttataatggtttgtctgaaaaaacaaagatacaatacaagggaaaataacaagtagtacaaactaaaaggtacattgcctttacatcaaacgaacagaagaattcactttctgaataaacgaataaacggcatcttctcttgcaaagtgtcagatattcagatagcaatcgcgacgcaggcaatggcggcgatcagagagccggcgaggccgctcgccgccaccgtgagcccagcgccactcttcgcgccgccgccggccgccccgccgttagccggcgagctgttcgtccccgccggcgtggccggagcacccggcggcgcctgcccggctggagcgccaccgccaccaccaccaccggagggagacgacggcgacgacgaggaggacggcggcgaagcgctgctcccgg

SEQ ID NO: 40106 - DNA, 635 bp, Oryza sativa
gaccgaccttcccggatggagcggtggagctcggcctgccgccggtggctttttccttgcgcggggcccgtgagggcccatcggccgcaaggacgtggccctcgtcatcggagcgggccggcttccttttccccctcctatcttgccgcttagagcggggagcgggctcggggacagccgcacccgccgcgccagtgccgggggagttccaggcccacgcctccttccgagccaccttgtctgccagctcgaagtgctcggcggtggtcttgggctccttgaaggcaattttctccagcatgtggttgtgccgcacgccattccaaaacgtataaacgaccgcgtgccagaatgcacggaatagtgttgcggacctggcagaagcgctgtatatacgagcagagggactcatcgtccttccgctgcaaagcatgcaggtccgcctcctctcctgggcgggggtacgtgccttggaagttcgtaatgaactgctggcacaggtcctcccaggagtggatggagttgaggggctgggtcatcagccagccgcgcgcctgacccttaagagccatggggaaataattcgccatgactcggtggtccccccccccccccccgctccgccacgatgatcg

SEQ ID NO: 40107 - DNA, 432 bp, Oryza sativa
gtttctcgtttgtctctgtgtgtgctgggccttcgctgcccatgtaataagttaactatttacgctgccgcttgttaaactctgatttgtatcaacttttggtgtaccttgcctcctgggacaaggattaatgcacgcacgtcaggaaagcccgttgggttatttccggtcgtgacagcatctacctaagttcatactagtggaaccataaatagagtgtccactagttggggttttgtttattctagggtgaacaaggtaataataacaatagcaataataaggtcttaacaaaggtaaataggcatggctaaataaaacagtgataacgcgggaatttaaataaagcgataatgcattaatttaaatcaaaataattttataaactgggattcaatatgctcaaggatgatgtgacttgccttgctcaga

SEQ ID NO: 40108 - DNA, 1204 bp, Oryza sativa
acatgcatttatttattgtatatattataatagaaaattaaggtcaaatgtatatcttgtagagcgtgtcattgtccaaagcgtcaattaaaatgaaaccgaagggagtataatacagattgtactacctccgtttctaaggatcgttcattttactaccatttttaaccttatctttttagataaagttataaaaaatagctacatttaatttattgtcaaagtttagtaagtacatataaagtcttaccaaaatttagcaaccttgctaaaattttggtaaccttaccaaaatttggcaatgccaaaacttgataaggttgaaatggtagcaaagtgaacaaaccctaaatatttgataccgttgaatttttagcacatatttgattgttcgttttatttaaaaacttttgtgaaatatataaaattgtatgtatacatataagtatatttaacaatgaatcaaatgataggaaagaattaataatttcttaaatttttttaataaaacgaacggtcaaacatatttaaaaaagtcaacaacgtcaaatatttagaaacggagggagtatatgacaaccacgccctctagctggtgatcagttaaattcatatatagtgtgagaaagaaataggagaaaaaacaaagctaatcttatatttaatttattatacatgttagctaaaatataaaatggttaagtatactattataaacatgcttattataaacatgctgtcatatgcaatctgtatattcctacaaccaaattgtaaaaaaaaaagacgcaaatattatagaatgatctaatatcaaataattagaattggtgagacttctaatctatatcatttagcccattaacttatgagggcattcccaacccaatgactagaatggtgtccatagcattaaatgagttgccacctagaaaaaaaatgatgtgacaagtgaataaatgaggaaagagaaggaaaccatgtcttgcatgagacatggttcctacacaatatccaatacatcatgtgagataagtagcattaaattgaagttatggaatagtggtgtttgcattgaaagagtagtgtctagtactattttcttaatgatgtggagtttatagaaatcatgtctagtgttatgggttggtactgtcctgaagctgatacgaaacctttagacgtttcaatccaattgtacaga

SEQ ID NO: 40109 - DNA, 1501 bp, Oryza sativa
gcggaggtgcactttggcgcttgacggatgtgttttcttctcaaaatacctgcatacacatatttcaccaacactagtggaaataattagtaataatacctaccactaagttggataccatgttttatttcattatatgcaggtattgacggtcagatattataatttaaggaccgtcaacactctaacacgtgaaaaaacaggattcttctatttttatattattctgggtaagataaactactccctccgtcccaaaatatattctttttagcatagtgccaagtcaaatattcgtaactttgactattaataataaaaatataaaaaagatcaattatgtaaaattgatgttactagatttatcattaaaaaaactatcgcaatatgaaaatctttttatttaaaacatattacttttatagatatcattggttaaagtagcatctcaatgaccatgtcgaagtccaaaagtgcttatattttgggacggggggaaaagatagtagtatttaggagtactactgtactcaaagcaagacctgacaattgaggaaaaccaactatgtcacttactgaatgggagtccaaacaaaaaaaaaaaacattttctctctctcttttgttaaccaaaagttgcacatatgataaatgaaagtctagaagccttttactcttttttttagacgaaaacttatatttctggaaaatgagtctattatctgaaacaacctaaatatttcattggcatatagattctgtttttttttcttttttcacatcatcgctctgttttacattttcctggtatatgcttagaattcacaatctactagccaagtctcctcttctgaagattaacaaacaagcaatcatgatgcaggactcaatcagctgataatttctgaaacaaagatggacttgaactgctttctacaaattttctgaacatgaatttgattacataaatatgcttgcaatggataatctgaagaataagattagactgattgcagtgccaatgtgctaatggccttttgcaatcatcacccctaagagcaggtacaatagtgctattaagccggctacaaaacttattaatcagcttaatctgagattaatgaaagaaaatcacggggaaaggaacaagcaggcgcttgttttggcgccggcgcttgcacagcacccgaaactgtacgctcacatgcagccaaaaagacgataaaaaatacatttatgtgggtcccacatggaaccatgtaactatttaatgtatatatgtatgctttaaccaatgcagcttatagctaacttgtagttagtttgttgtatgagttgtctctttaagttagctctattttaacatgacaaaattttggagcttgctgctagctatactattgaccttgctctgagacaagactaccaatattgctaagttacagactgacagacagaataggtggtgtgcaggatcctgtgggctgtgagcctgtgacca

SEQ ID NO: 40110 - DNA, 1501 bp, Oryza sativa
gggtggccgcggcaggcgtgctggcaggcggcctccaccctgagcgcgtcgaagtcgggggcgaagcggccgccctcgtccgccccgatgaggcgcttgagcgcgacgaccttgccggtgcggcgatcccgcgccctgagcaccacgccgaacgcgccctggccgaccacgtcgaggcgctcgtagtcatcggcgctcccgaagttgtaccgccgccgcttcggcccgctcgccggggaggatccgcagcaggcacggggctccagatcgtagggcgccgcgcgcttgcggctcgccaccgccgaggacgccatgggcgggggaggaggagaaggaagcggatgggagaagaggatttggatttgggaggagcaggcgcgttggttggcggcggatttggagaattggcgcttggcggtggtcggtggatttatttgggggattggtgagtccgactccgactcgttctggtagataggctgcgtcggacggtcacgatcgcaccaacatgatcggtgattctagaattctggagtgtttttttagataatgtttttattttcctttttgttgcgaacgattattatacacaacctatgcggcacatgtagcggtttaggagatgtgttcatcttgcttttaatctgcttcacacattctgttagatccatgggcatgcatatgctattatttgcaaaattatgatttaaaaaagtctttatgtggttcatttataaacaaattaatcctaacaaaagataactttaaaaaaaattggagaggaaacaagcaatattctttttttactatgcatgatattactaagcatcttttcttggagaatttaactatttacaacttttaggtttggcaattataatttttttccctcctaagaggtggtctgttaactattcgccacttttgcccacatggcatgtcagcgtggcaaactcaagtgaaaaatggtgtgggactcactcatcaatctcttcctccacttcatctctctcctcgggttcgcgtcccgcgcccatggtggctgccgccgtcctgagcccatcccgacgcgcccatggccgtcgctattatcctgagtccatcccgacgtgcccgagaaacccagcacacgccgaggccgctactatcctggcgagccccaggatcgagaggatcatatgctatccctcggcgctcctgcgcctatcgctgtcgcctccaccgtctccacgccatccgcgagctctgcgccgtatttggtggtggtgtaggagctctaggactgcttggtgcgccgacgccgacactgacaccgacgccgaggttgaggttgaggttgagcgcgccgtgctgctatcgctgctaccgaacatcacggcctcggctgccacagcagctgaaccgatgggcgtgacagggacgcgcgtggcgccgggccagcgggttggcgtcgtggatgttggcatcgcaggcagcacatagcaccgcggcgttgaccttc

SEQ ID NO: 40111 - DNA, 1501 bp, Oryza sativa
gtagtatattatggtcaatattttttttataaagcttagtgtcgaaactagatttcggcaataataaaaggggtggctatcaagctggagaagtgaatgggtttggagacaaaggatttatacaggttcatgccttctcattcaagaagtaataccctactcctgtccggggatgaatccgccgagtatcttattgattgtatgatttggagaaaatcaacacatgcccctagaggcacccggaccccccttatatatgggaaggagtccgtgttacaaaagataatctatatccctaacggaatatgcagatacagataaaatacagtcgtaaccgactaagtctcaaggtatttccttgatgtacaagttgagaaacaaacccgagatacaaataagatattctatctatattcggtatcctatattcagtccaaatatcatcgccgtgtagatatgggatatccataatctccacagtagcccccgagacctttgcagtcaaccatcatagccttcacaaagataataatccgagtgcttcaaacttttcatgccaaggcctgccgagtagcgaagacgaagactgtaaagggcgaaaagataaagaatatggtgcatcgaatagatgcacctaattaggtgtagcccccaactatgtgattagttaacaaactaaacatatagttgagaacaaaataatagcacaatcgtgcatcatatgacaaaagcatacacggcgcctaaagaagcattcttagccgactgctttttagccataattaaaaggaatccgagtggttaacactctaaaaggttcacgaatgaacacacttgacaggcatccgaatagaaaactctaaagattacccaccaaatattataaaaattatggtaatgaataagtctaatagcctaggctatgactatttaccataatgaaaacaggcatataacataccaaggaaatgactatggtaaaaacaagtcattccaagttaacccagacagcttttgtagcctaaaaaagcttacaaaaacagcataacacctttctgtcgggcaccttttaatttgcattgcaataattccaaagaattatatgaccgcgtaaaaaggattttatcagcattgggcaacactattgtgcgcataaattgccaaagcaaaaaatgcctaagtccctaaggagcacaatgggccacgctgttaaaagtactgggctgaggtactgttcaggcctaagcccattcgcacctccgatacccttaacaagaaatcccgagatccaagcgacacttcatcttccccgccggaactctcgccattttccccactccctgctacagtacagagctgcgccggcaaactagggttcaccattccactcgaatccaccttcgaaaagttcatcaaaatccttcccgtgatctaccgcctcaatccctcacctctccctagccatccctcgaatcaaatcagcgcatttggaaaaaatcaa

SEQ ID NO: 40112 - DNA, 1501 bp, Oryza sativa
agagatacttcagaaaagttttgatgaagagcaccaggttaattctgatatattctgataacagaacgatagtgatgcctaattttccttgcgttgtgtttttaattagcttgcaagtgatgttattatctgatacacctccagccacaaatggatatttaatatcaaatggtaacacaagcaacctctagtgattggttgcagcttggtggaaaatttcatggtgtgtatagaccctagaagataaacaaaacttgttcataatacaaaattaagtcatcaggatcaggaagagatatccagagaaaaattcaaacacatagtgaattaagtggaatgggacagatcatcatccaccaagtgtaggaaatacgtttctttgagccatagaagataaggcactgaagaaagaggtcatactagttccatttgaaatgtctgcatgtgttgtgttatattgttttcttaactaacaagcttaggcaaaaacaatgagcaagcaatgacaaaaaaatccactggttttcttctttatccaatataaagatatgcagccctcctgaaagttctagacaaaaatgtgatgtaaaacttcatctgttaaagataaaattggatattttttaaataagaagatgatttgctgccatgtcagtaccacctaaaaagagccattctatgcaatgatccttaaaagtactaggactatactatacatctgatatgtaccatatcatctattacagagttaaccagcctattggcctgaaatctttcaataatatacctacccatttgagctgcaaagtttgtgttttacttgtttgcatgacaagtcaggtgtaagacggaaaaacttgaagcctgacagttaatatttatatgaaatcaccagtcattttcagggaaaaattatgcagacaccagcctcttaggaaaattatgcaggaaaattataatattttcgatgttagttcccgttgtatggaaaacaagatctaagtacagctagaacagtgcaactgcgcaagttgttttttttttcagcaaggcttgaatggctctcaagagaactaaaatataaaattggaagagggggaagaaggtgcagccaactaactaacttgtgatcatatttaagcacttgtcatgctaccctcacagaagatttagttcctcctctgcctcttctccatctacagaaaactacttgtgctaatcaagttttatcttgtttcttccccatctctttcttcttgttgttcttcagactgaacttagtctgaagattcagaaataaagtgtgattttcaaagctttgctagttgcaaacgagacactagctttggagtttggaggtaagctgctgtgctttccttttgccatatgcgattcaaaatatatgagtctgtagcacccaagctaatttttttcttcacattggtaatgaacattgtcattcatgatgtagggagatcttgcttgtggagaaactcacaaa

SEQ ID NO: 40113 - DNA, 170 bp, Oryza sativa
cagtagttcatcagaatatagtctacgaaaaacacaggtacgccgacccaaagccagccaacgtcgacgagtgtgtgccgcacggcagcgggagcacttggcaagaacaggtccatgtattgtcttaccacagcgaccagcgccatgtagactccccataacatgacagc

SEQ ID NO: 40114 - DNA, 1501 bp, Oryza sativa
gatagggttgagggtggatggatagggtttcctaaggttattatgggtattatgaataatagttgcatttctttttttattttaaataaaaacttaacggactagtggaaacagggtcaaacgggagcttcgtttttgaaaaggagggtcaaataagcaaactttgaaaagtagggtcaaattggtagttaggatccaaaacggggtcaaataagcaatagcccctaaaaaaacagtttcatctatcataagcttgaaggtgaccataacactgcttgaagattactagtacatatgatccatatctaaaatcactcacccttgtgttccacttgtgtttggggagcctgttttaattatcaacgagtggtccactcatttattacatactaactaataaatggttatgtttttttaaaaaataatgtagatcaaatgatcaatatgtatttcatcactctgcatattacatgttaaaatttgacttctacaagtttaaaaaaacaacaaattcaactacagatatactcatttatttagattctagagataaatctggacacatatttatcgagattcatctttagaattggatttttttgacagagaatgtatcaaatttgacatttacaagttataacaaaaataataaaataagttctaaaatctatatgtactctcttcatcttagaaaaaaatctatatgttcagaaatatctctaggattgggtgttttgtttgggacatttaaccagttaggagcctttgggcctgtctaggagagcttctaactgctgcagcttctcccagaatcaaaagctcccccaaacagtctagcttttgattcagatcctgagaaactgtagttgtagaattcagaaaataaactagaagccagaagctaggaaacccagctttccagattctgagaagctggctaccaaccagctgcttctcagaattttaaactccactaaacagacgttttatttcttttgcaagggtgaaggaacaacttacggaaagacacccatctacattaatgatactattgtttagattgacagaggttattaatagccacccatctaacgagaggttgaagccctcctatgaatcaagaagagcttaaacatctaaaatgggacacacacacatctatatccctatctccactattcaaaaggtgcgtggatgcatcgcttgtgttgataattaatggacgaacaacacgcacgtcgatgtcgaaagggcgaacagcacgacggccagtagcggatctacaagttcccttgacggctgctggtgtcgtagcctccacaaaaagaagtaaataaattagacaattattaagtgataatacattggttaatgcggtggagcctgggcacctgcctgtggtggccgccactgaggaacggacgatgagagcagcatgattagagcagatacaatagtagactattagccaattataaacatattttaatgatatgaaaga

SEQ ID NO: 40115 - DNA, 1501 bp, Oryza sativa
cattttctttttaggttgcttgcatgtttacaaggtgcaatgaacagatatacagaaaaatcatcaaacatggtatccaaacattcatgatgaccaaataatattttttatgcagattttgaacagccaagaagcatgctgccaattgagatcttgccggagaaatctggccaggaggcaccctcctgccctgacatcccaagaggcccaaggaaggtgagaaggaagaagaccagaacatcatcacctacctcatctgcaagatcatcgtcctcgaggtcaagaacctcgttcgcaaccgcatacgacgcattcaacgaatcgcaaagagggtttcgggttgcctgaaatttacagattgtgtttgaaactaccatgaattgtacattgtatgtcggtataggaagagaattgattgtgaattgtttgattctttctttttctttcttttcttttacagtcaagacatagttggaaatgcaaaggaaaatggattaacttaatgtttgaagttgtgtgcatctcaaattttatacttctgactaattcttcagattcttttaatgattggatggcagtcggcagatgttagacttcagtagtataatattttttccccacttcagattgtggattaaaaaaaaagttttctaacatttttcaataacatatcaatataagtaagcttgattcacatcatttttttctgaaacacatacagctgtgagggggctaataatgccattgatcacgacatgcaaggaccaagaacaattcgactaactttttttctacgccaagttgccaattgccaagacaaacgtgcaattgacatgatgcaacgtttcatcatgcctcagcactttgttcaaggactgtaataatgtgatacacagctgatctaatcatataaaaaaaacacttggaaatatcatcaatctttatatctcgtgattatgcactgcactctgctttccttgcatttgggcaaagcataacctgagcatcaagggcaagaaccttttgctacctatgcaaccttacaaaaaaaaagaaactttttgggagtaaattaatcccatttttaccctgacataactattcaggtcttttgcgttgatcaacttaacctgaccgtgagtgcaatgctaagagcaaagtcatggccctgcgttgaccgacgtatcacgctgtgccacgtgtactaactaaccacatgagagtgatttgacccaaacaatcactacattggaaaatgacttttttttttccatgtaccatggactgactcacaagccatgaatattccagtgtcacctggctagtcttgagctctgctgtgaatgtcaggtaggcaaccatggcattgcaacaagcacaagagacagacaagaacacaagatggaagtaaaggtgaggtgtcatatgctttggaagctaatctcaaggtgtccatggaaagcaaagtacaccacagcttgtaaagctcccagccattgag

SEQ ID NO: 40116 - DNA, 1501 bp, Oryza sativa
gagtgcactccgactccaacttcggcgacagatggatggagtaagcgttaagtttacgcgggtcgatttggaaatgggaaatcttttcagcgcgcaaacccctggcgtagtacaattaaaagggttggaatccaaatacatttgcacttaataaagacagcttgtaccaaaacgaagtggagaccaacatagattcgttgtattaggatgtgtcacatccagtacaaagttgctatattttgggacggagagagtattttttttcatacactctcgagggacccattcatctcaggaggcggacagtggtcgagacaaagtgagcagtggcgtcgcacgcagatagagcgaagggagcagaggcggaggcggcggaaacgcacggaggtgcagcagcggtagcgcacgtcgagattggcgacggcggtgcgcgacgagaccggagggagcataggcaaaggcagcggcggcacacaaaggtggcggcggtgataacgcatgccgaaatgggcgacggcggtgtgcggaaggagcagggtccacggcggtgcgtggcgggcacagtgcgcaaaggtagcattgcgaatggcaacagcagcgcatgacgagatcggcgatggcggtgcttggaggtagcaggtgcggcggcaatgaccgccaactgcgcatcaagccaggatagtggcacaaggaaatcgcaggcacaatgacgatgatggcatgacagtggcgatgacagcgatggcatggtaggtgggatcccgcatcgagctcgacatccacctttggctccttctatcaagatctagccgggtcctcatggtgcgtaggccaggtgacaaggtcagtgggcggctgtaggcggagggcgagcaaggggcggtttggcagcgacattggatttttcccgccaagcatccccatcttggagctctatatgtgtttttcttcactgtatgtagtcttggatgaacaaaaatgagacaacatgttgtcaaaattttacaaaaaaaagcccgtttaattttgtcaaaatcttgctaaatttgtcaaaatggagtcaaatctatcaaacctatctctaatatgtcatgcttgattcattacaaatatataaaaagttttgaataaacaaaatatttttatacaacaaggtcaaatgaacaagggcaaaaaaggataatttggcccttagttaactccgttttcttgccattatggaatagggtcagccactctgattttaaaacgaggggtcaaataaacaaaataaaaatattagcagataacaaaatcaaatcggttgccccaaaatcaaagccaccaactgtttccttctggtatagaagtatattgccactcaatttttatagatttgtattgcaatttactagagatgttatttttccagtaactactgaaagtctgaaactacttcatattttctttaaggcaaaatatgcttcaagacatcgcatggagtgaattttaggggaaacca

SEQ ID NO: 40117 - DNA, 554 bp, Oryza sativa
agagagggaaaaacaggggaaacggaagaggaaatcgcggggaatgattcccccctcattatggcgcgcggggacggcggaatccggcggaatccgcggcggcggcggcgctagggcacgggcgaacgccggaaacgccgggaagaaagccgatgacaggtgggccccacccgtcagcgaggggggcgggcgggcccgcctgtcagcggcgctcgcgcggggaggagccgatgggccgcgggggagaggagagagagggagagaagtgggccgagccggcccaagaaaggaagggggggaaagaagacttcttttagggtttttctttttataaacctttttaactttgttcatttcttttcaattattatttgtgctctgaaaattccactaaaatttatttacgcattttaggcttttaggaaatatacaaaaatcctccaagcctcatttgacttttatctttgcacattttaattgttggaggctttcacatgaattttaattattctttgcacaatttcaaggatgtattttagagtcgatttgggacg

SEQ ID NO: 40118 - DNA, 1501 bp, Oryza sativa
ttcgtcttattcaaaaaatttaagtaattattaattcttttcttatcatttgattcattgttaaatatatttttatgtaggcatataattttacatatttcacaaaagtttttgaataagacgaacggtcaaacatgtgctaaaaaatcagcggtgtcaaacattttgaaatggagggagtagttaaaacggacatacactccaattatactacagctacatttaactttgcatttgaaagttcttcataaaaaaattgttgaatgttgtacaggtactcccaattaaaaaatcatcaagaggtcctttgaaaagagtgatttaggttgtgttagagaggaggggttgggaacgccgaacaccacctctccagtatgcaaaacgaagcacacattagcatataattaactataagtattaattaaaaaacttaaaaatgaattaatatgattttttaaagaaacttttctatacatttttaacagtttgaaaagtttatgcgcgaaaaatgagagaggtgaagttgggaacattaacttaagaacataacttttctttttggggaatacagttaagaacacaacttatatgggaaataaatcagctcatgtaaaaatagtttcaaatttctatcctttcatccgaaaatataagcatttatatagtttttcacgtgggttaacgagaggagtgaaattaaacgagaatggccggttgagatggaaaagttggtagagaaattcaataactgatgactgtgaatgattgatacgatgtagtaggtgaagatcttataatctaggataaattttaaatgctacaaaccattgtatcttggaactgatgcaacgcaattgcacgccaactaacgagctgattttctaataaacaagtaaatcatccatcatcgttcacccgcatttcatctacttcaatctacattgttccacccaaattcaaacgtaacttatgatctctcaaatcaaacaggtattatagtttctggtgtttctctgctaataaatcaggatcagactaaaatgatctcacatctttaaaaaataaaataaaaaagagaggcctcctcctgctctctcccgacaaatgacattggctgtcaggcagcctgtgcccaaatcaagaatcatattccggtaaaattatccagcttagccccgagtattattctgtccaactttccaagctcgatcggcaaagcatcgattcgaaaggcgacgcagttgacgcgatcgacgggataaacacagcatgaaaagcgatcgagagcccccagcacatgcccctgcatgcctgcacgcccgagcaaaacgttagcttcagcaaggcaccgtgtggcctacagcttgtaaagcctctccccgatcgatacgcctacaaatacacgcgagaaacctgcaacctgacgaaaccatcaccaaaattcaggcatctatcgacagaagcaagatcaggttagtttgttcgttgtgcatggcagcaa

SEQ ID NO: 40119 - DNA, 568 bp, Oryza sativa
tggctttcatgatcacgaagcaatctgacgagttccatatgatgtcagtgaagcagtaaacattgggccggcgagggtgttgagaaaataggaaagaccagaggaggatgtcctgaaactgaatattgatggatctttagaccaaatgagctgacgggggctgggattatgttatcagagatgcggacgcgcatgtgatccaggcgggtgccggaaactcatcacggttgcaggatgccttccacgctgaagttttggccgcggtgaaggcagtagaagcgatatctcacgggggtatggcatatatccatctagagtctgatttactgatgctggttcaagccctgaaggaagggaatctacaatatgcagcgatgggggttcttgtcctagaagcgaagaagattataacctcggcttttatttctttttgagttagctaatgtcctcgtgaatgtaataagttggcagatgctatagcatcgattggatgtaacagcccccaaaacactgtacaattgccatatcaccaagttccatgtgccttcttctctattttctccacagc

SEQ ID NO: 40120 - DNA, 718 bp, Oryza sativa
tccccaacaccaccactgctaccaccatttcgtgcctctgtggttgagatgcaatcagtagcgttttagaacttcctcaatttaaataactcaaaggcaggggccgcctaactcaatacttgtgcgattagtggaaccttttagatgtctgtggaacaacttttctcgtaattgtgagaattattatcatcagggtgtagttgtgtatgcatcaagttccactgttgttggagcgttgattgttagtactattgctgttcttgtcttccagtggtaggtgtgagttatccatgaactttttattcacctgtcagcctttattctttacctaaatgtttttcaaataaattctagtgtaccaaaaatgttgtggttaagaaaataccaacgaaatctatgttgtgatgtcatatagttcaatcactctcataacctttctcttatgcatgtccctgtgatgtaacatttcctgagttatgtataataatagaaaacaatatcgtaaagagcacactatatgtttagtgttgtatatgttcttgttttcctgatgcaatgttgtcatatgttgggcaagcttatcctgcccatctttctgtccaacttcttcaagtctgaagatattcttttttggggcccatttgtttttattcaacaaaatagttgcacacgtcttttgtgctgcagcatttcattttatatgttctcttctgtcaga

SEQ ID NO: 40121 - DNA, 1501 bp, Oryza sativa
gccgaataggccctatactctttcctctcataagttggatggatgatgatttggtgtcatgataatacgatatatatttaggccaactctatgctaacaagtcacaacggcaaagggaaagtggagatcactgtaatttcttgcaatggattgagcccaagtcaaataagtctcagctaataatcaaaattgatttcaactatgaaaatataaagtagtatgagtatcaaggtacaatagaaacatccctagctatacggctgccatatatacactatttgtttattgtgatagctaagaataggaagtgggaaatgaaaattgttgccgaaaccaatggctcgagtggtataattagcacccaagtatttggctgttttgttttggctaagactatgtattgttatgtgagttccgagcgcaagcatcagcgacacaccccccttatcaaaagttatagtatttgacagctgttagacgacaaataaagaatatcaaggaggtagtctagagaatatgtaggatcaagctaggtttccccgggaggatggtgacaatggattttgagtgggtggaggtggagcacgatggttgatgccattggttagtgacggatattgtaagagtgagaagacctgacctgttgaatcaactcaaccaaaggtgtttcattctcatgataaaaaagaaaaagcaaattcattcttattttatacaaaggcaagaaatgacattatagtggagatgaggtgccattttatatgtcatttgcaagtggtattagagttaaatccatatctaaaggtgtaatcccaaatttcttctcgtcatccgaacatcggatccctagatttagaactacaatcatgtaaaaatcattccaataaaatcaatttaatatacaaacatcaaatctactccatccatccaaaaacaacctaatcctggacatattgttttatttttttacgggagggagtattatagattaagattcagagctatgctaaatactctatccgtcccaaaataagtgcagttttgtactgctcatgtctaagttttattttaatttttattattattagtacttttattgttagtagatgataaaatattaataatactttacgtgtgactagttttttttaaaaaaaattcataaattttttaaataaaacggacggtcaaatgctagatacggattaccacggctacacttattttaggacagaggtagtaaaacctaagttatcaaaattacaacctccaaacaaatgatcctcctatttccttataacttaatttggctctttaggcctttaccaacgtgtcactcgacgcaaccaaagaagaacagataaaatatctgtataatccgccgccctggtcgtggtcgtcctcctcaccgcggtcgcctctctcacttcactcaactcactcactgctgctgtcgtacttgtggccactgctctgctccctcccctcgcctcgccctcag

SEQ ID NO: 40122 - DNA, 174 bp, Oryza sativa
actatgaaatataaaaatgctgggaaatataaaggcactttcttcaaaatagacatgcttttgtttaacaaatggcacttgtggtctacttggttttaaagtgcacatctcaagctgtcttttttctccatatgcagatgattgttctgattcaattgatgccgttagagaaga

SEQ ID NO: 40123 - DNA, 417 bp, Oryza sativa
aataatattcccaaaccaattaacccaagtagaatcttgggcagagtagcgtatgtatctgtggttggacctcagcaaggtaagcttgaaatccatgcccttctttggacactgtgtgctagcatataccttggctgagttccaataggcatttccgtattgtattattcatagtacagaaaggaatattgcttgctgtttacgtagctgacaaccccatttgcagaaacagcataatatcacttcaacagttctaaaaccaactgaaaaaaaactcatggatagagggcgtataatgttatgtgagcattttttttttctattgttatcaaaattaatgattatatcatgcatctacagctaatcatggctaccatagtgaatgatactcatgcgagcacatgccataaagagcaa

SEQ ID NO: 40124 - DNA, 1019 bp, Oryza sativa
atcaaattattaccaattatagcatcatttactatggtgacaagtgtgaaactaatcacgaaagacattgttagacccgctcataaccgcgggcacggctattcgaatagttttactctgatcagaggtgtaccactgtacccacaagacacaaccccacatcatgtcaccatgtgcctcaatacaaccacggtatctcggaaaggagttgtgacaataccccttatacaacacaatccactgcagcgcaccttcctggatcataatcacccccttataaacaaggcatggctaaaagggcatataaacttttcccaaatatccatttaaagagcatataaacttcaaatggccataacttgtccatttgaactcggaattggaccgttcaagtctctaatttttccttaagaagtcaagaacccatttttgtgctttgtttctactgttatatggagttctttagagtaaaagcctttttcttttccgttggtcgtgtagacgctgcagcttcggaagatccgctcttcgtggaagttgaagccgacgtttgggaaagcgagcaaggcaagtcacatcatctttgaacatattgaatcccagtttgtaaaattatgttgatttaaattattgcattatcgctttatttaaattcccgcgttaacactgttttatttagccatgcctatttacctttgttacgaccttattattattgttattgttattattaccttgttcaccctagaataaacaaaacctcaactagtggacccctactcatggcaccactagtttaattttaggtagatgcttcgcaacttaattaggtaacattaggtggtttttcaactttagactttgggaaatattcatatcacctggataccttggaatggtctggatattgtggaattggattcacaccgctccttctattcaaaatccccaaaatggttttgggctgggctcggggtgcatggttttgatagtagcacctcggccatataaggaccggt

SEQ ID NO: 40125 - DNA, 1501 bp, Oryza sativa
aaatatattgaaaaactaagttgggagattgacgaaatcaccaccgacggaataagatttaaatcagctgaggatagtgtagtactccctccattactaaaagaccatctttcaactttaaccagttactggttaatctgaccagtaacttgacccaaatttcaactttttacgctaacgcataaaagaattacacgtcaatatattagcaaggaacaaatttcacttttcaagttgcaacttgcaggtagtacgaaactatttctaatctctgtccaaaatgtcaggtaaagtggtaatggcttgcatgaaatgcgtacaccagtctcagttctgaaatgtcttactagcagttaagccaagtatacttttttctaggtgaagttaagggcatgctcagcttacttggtcacaactgcaaacacaagagagtttttgctgatggttatcgctgttgcatttgtgttgcgctgcagctgcgaccaactcaatcatgcaaggcctagcaagtacttgatgcggttgtgcggaatagtgcattgtctttttggttatgcttatccgcatagtttattaacaaccaaatagtatatattataagtaaaaatttatacatgtgtctatagcaatttaaaagcaaacgccataaaataaaaatacgatgaaaaatcataaaatcatatcaaattaaaaatttaaatttaaattttagcttacaaatataagcataagcaaaaatgataaggctattcgatccagaagctgtctctcggcgaacaaaatgaacacctgagagacaaaatgaacaaaatgaagcaaatcttctaattaagcccaatacgtttcatttccaggaggcccattgctatgggccccatcacttcctcatgcaggccacaaaaacctgggctaattacccacaacaaataaagcccaattgcccatgaggccattcaacccagagattcaaccaagatgcatgacgagttgccctctggtcgttatcgtcctaatcagacggtgcctattttagcttccttctccatcaggatctcgctggaaagtccaacttacctacatcagtatatgacatttttcattcacatcaatcttagcaagcatgacataatttactatatgatattatagaccgtcgtacgctcatactaatgtgattatctgctgatgatggacatcgaccagcacactcgtccttatcgtttgaccaaaatgacctgatccaactaatcatatacatgcgagatcctgtgtactatagtaatgtattgtagcgctaattaaattgagatgatgggcgaagaggcgtgcttggtcgagagaggtaggatgcgtgtgtccacgaacaatagaccagggttcagcttaaaatgtttaactagacgcatgcagatgcagaagcttgcgagttgttcatatgataattattaattcagaatatattacagctgatcgatcgagctggtagctactgtagctagca

SEQ ID NO: 40126 - DNA, 1501 bp, Oryza sativa
atggagaagcctaggcttcgttcgtttgtagtactcttttagttcctaaatatttgatgccgttgacttttttaaacatgtttgaccgtttgtcttattcaaaaacttttgtgaatattattcaaaaacttgagtaatagtagtatatttaacaatgaatcaaatgataggaaaagaattaataattacttaaattttttgacaagacaaaccgtcaaacatattaaaaaaaatcaacggcgtcaaatatttagggacggagggagtagttgggaactcctccctatgcgaaaaatgaaacagtggattgacccccttgattaattaagtattaagtttaaaaataaaaatggattaatatgatttttaaatcaaatttcctatagaaaattttcaaaaaaaaataatcatatcgtttagtagtttgggaaacgtgcgtgtgaaaaataaaggggagactgagaaagttgagagaagaactagtctaactagatcatatatattccgagtgctgctacagcatgactatgtaatattttagggaaactgtatcggtatggttagaaaatttccacaccgcttctacccttactatgtaggctatgtagaaacaaaggacattgaaaagatatgcatctaaggttgtgtttagttcacatcaaaattagaagtttggttgaaattggaacgatgtaatggaaaagttgaaagtttatgtgtgtaggaaagttctgatgtgatggaaaagttaaaagtttgaagaaaacctttgaaactaaacatggcctaagcaagggtcgaacaaaaaataataataaagggagaccaagggatcaatttctaactgatgaaagttatagtctaacatgtcacaattacaacgatgaaagaatagaagggaatgaaaggtcatcagtttcacattggctgagatgacttccttttagggaccgtttagttcacgaaaaaaaaattaggtatcacatcagatgtttgactaaatattggaaggggttttcggacacgaatgaaaaaaataatttcatgactcgcttggaaaccgcgagacgaatcttttgagccaaattaagtaattaacccgtcattagtatatgtgggttactgtattacttatggctaatcatgaactgattaagctcacgatttctccataactgtacaattagtttttttaatatatattttgtgctctatacatttgtccaaaacggccttagcggccaaaacgggattcagacaatgaacaggaaaaatttttgggaacttccttagcggccaaaacgggattcagacgagcaaggattgataggcaagaatgtatcaccccttttccgtttttacccgatcttactattactttcacatgttagcgagacaaaaatgatccgcgttcccagtaggcaggcttactacaccactggatagctcagttactaggccaagtaaaaggtagaaacagtaagcaactcaaggcaaaatt

SEQ ID NO: 40127 - DNA, 401 bp, Oryza sativa
cacaagatatgaatgctgtgaccttttgacttgaggaaaagaatagtcggagcaaaaaacctgtatcagcaacatgacaatcaatcagaatcaaccaaaacaaatactataaacaagatttcccctaaacagttccacaaaataataaaaagttcagctgttcacttagtttcatttctgtaatcatcctgcttttgtaagaactttgtttcatttctgttaaatggaaatggagggagaatgctcccttagctcaaaaaaaaaaaaactgttcacttgttcaggaatttcatcgagcaggtaccgtgcacaggagttagcctattaagcttcattgttagcggttactggaactgtagccccacgatttacacagcgaggctcgcaaacgataagagaca

SEQ ID NO: 40128 - DNA, 444 bp, Oryza sativa
gcctgctcgccctctcgccgatccgtggagaggagaagagaagagaagagaagagaagaaaagagagaagagaggagaggaggagaggagaagagaagaagagagatctgccgggtgggtcccacatgcaatagggtcaaatgagtaagggcaaaagagatattttgtgcttcagttaacaccgttagatgcccttaacagaacagggtcttacgggggcttcgtttttaaaaaggagggtcaaataagcaaactgtgaaaagtagggtcaaattggtagttagggttcaaaacggggtcaaataagcaattgtcccttttttttataggtttgttataaattaagacgggcgccattcgtaataccaacttaataactcgaataaatcaattaccatccacagaacactaagagataaaaaaaatcacaaatctgcttacaga

SEQ ID NO: 40129 - DNA, 1501 bp, Oryza sativa
cataaatcatattttacgttacctttaaaaactacttacgtggtaccttgtggtaccttcaaatccacttacaccgtacctttcggtacgtccatacgttgttagacataattgccctgttatcaattaccttttaatacttagtacctttctacctctgatacctttcataaggtacctttcatcgtgaaccgttagatctatgccattttaggaatgtaaacactgtaaaaggtctcgatagagataggaattccaaaaaaggcatgggtgtgaagaacatggcatattctggatttgtcaagtggttatctccaagacctaagtgggcgagcctagggagcttgctgagttggtagggaattgcaccagtaagattgttgctgctcaaatccagaaaggtgagggtgtgcaacatggaaatatttgccgggatggcaccagcaagattattgccgctcaaatctagaacggtgagagcaatcaacatggaaatatttatcgggataacaccaacaagatagttgctgctcaaatccagaatggtgagggtgtgcaacatggaaatatttgccgggatggcaccagcaagattattgccgctcaaatctagaacggtgagagcaatcaacatggaaatatttatcgggataacaccaacaagatagttgctgctcaaatccagaatggtgagggtgcgcaacatacaaatatttgctggaatggcaccatcaagattattgtggctgaggtcgatggtggtgaggttttcgaatgcagcagagtagagagcgtcaagcgtaccattgatgtcggcaccaagaaggtcgagctcagtgacatggccggcggcgtcacaggtgacaccgaaccaagagcaggtggagttggcaatcgaccatgacgacaacgagttggtggcgtcgatcaaagtggacttccatcggaggagtgcttctgcttcagtttctgctcctgaatcatcagtagccttagctgtgcaaaacagcagactgaagagcatcgtcattgccattgctgcgtccgagaggaaggatccggctggagaatattatatactagtatagcaaattcaggggtgtttagatcgagggggtaaagttttggcggggtgtcatatgaggtattcaggtaaacaaattacagaatccgtcagtaaacagatagacgaatttattaagcctaattaatccatcattagcaaatgtctactgtagcaccacgttatcaaatcatggagcaattaggcttaaaagattcgtctcacaaattagtcgcaatatgtgattttttaacctatatttaatacttcatgcagatgttcaaacgttcgatgtgacatggcgaaaattttttgctgtcagctagccacctagattgactgggactagagtgagtgaggctgtgtttagttcagggcaaagtttggattttggttgaaattgaagatgatgtgactgaaaagttgtgtgtgtatgac

SEQ ID NO: 40130 - DNA, 1501 bp, Oryza sativa
atgctcgattcatgtccagaaaatggcgatctacagcaagccaacatcataaaaattcaagcatgattttgtgcaagaatgaggagttaaggacacatgtgtgacattatcacaatgaattcttgggtgtaaaatgatttctgaaaaattgcatccgatcgcgcaggcgcgcacaccatcggcatcgcccactgctcgtccttcgccgaccgcctctacaacggcggcggcggcgccggcaatgccaacggcaacaacaccgacccgccgccgctggacgccgcctacgccgccaacctgcgtgagcgcaagtgcaggacggccggcgacggcgtggtggagatggaccccggcagccacctgacgttcgatctcggctactaccgcgcggtgctcaagcaccgcggcctgctccggtccgacgccgcgctagtcaccgacgcggcggcgcgggccgacatcgccggcgccgtggcgagcccgccggaggtgttcttccaggtgttcggccggtcgatggcgacgctgggcgcggtgcaggtcaagaccggctccgatggggagatcaggaggaactgcgctgtcgtgaacagcggccactgatcaaaaggggagttgatttgcaattcttcctgggatagcgtgattttgttcttacgatttcttcacttttgtcatttgaatttggtgaaattctagtagaaattttgctgcgcgtgttcttgttgtgttcagtgtcgttgctgcaaccggcaaagctgtgttcttttgctttgaagtgtgctgtagtaatttatagctgatgagaaaaaaaaaacagaatacatacagtttacagtatgaacagaaaataagacaaaattctccgaattagcgtcaaatgaagtctgtatgcatgcacaggtaataacaaagcttgcaaatacatcaaaagacagccatgatgtatgctactttatttggaacttcctggcttacatgctactttcatctcaaacacaaccatgtaggaaattggtctcatcaccaaaacatgttctttttttctgaccaaggatgctacccgacttacactaaaagctagtaacaagagttcatcatcacaagaacaacaagccaaatctggcaacagaaaattacatctcatcgatggctgaaataaagggataatacctactgaaccttagatcttggtgcagtgctgacataatgtgacactaatacacacgctcaggtggactcaatgagaacttgagaagcagagcatattactcagatgagttatgtttgcataagtttctgctgcatggcatcgatgagactgaagaaagcaagcctccatgcattacagaaaaacagtgctccaaaccacagccaaacaccaaagacagctcctgcagttactgagcagtacagccatagagtttccagttcttggtgatgttcttttgccccttctagtgtactcgtagaatttgaatggtttgagcatggaattttc

SEQ ID NO: 40131 - DNA, 1501 bp, Oryza sativa
tggcggcggggagctacaccgtcatgcacctggacctcgcctccctcgacagcgtccgccagttcgtggacaacttccggcgctccggcatgccgctcgacgcgctggtgtgcaacgccgccatctaccggccgacggcgcggcagccgacgttcaccgccgacgggtacgagatgagcgtcggggtgaaccacctgggccacttcctcctcgcccgcctcatgctcgacgacctcaagaaatccgactacccgtcgcggcggctcatcatcctcggctccatcaccggcaacaccaacaccctcgccggcaacgtccctcccaaggccgggctaggcgacctccgggggctcgccggcgggctccgcgggcagaacgggtcggcgatgatcgacggcgcggagagcttcgacggcgcaaggcgtacaaggacagcaagatctgtaacatgctgacgatgcaggagttccaccggagattccacgaggagaccgggatcacgttcgcgtcgctgtacccggggtgcatcgcgacgacgggcttgttccgcgagcacatcccgctgttccggctgctgttcccgccgttccagcggttcgtgacgaaggggttcgtgtcggaggcggagtccgggaagcggctggcgcaggtggtgggcgacccgagcctgaccaagtccggcgtgtactggagctggaacaaggactcggcgtcgttcgagaaccagctctcgcaggaggccagcgacccggagaaggccaggaagctctgggacctcagcgagaagctcgtcggcctcgtctgagtttattatttacccattcgtttcaactgttaatttcttcggggtttagggggtttcagctttcagtgagagaggcctgtcaagtgatgtacaattagtaatttttttttacccgacaaatcatgcaataaaaccacaggcttacattatcgatttgtccacctaaattaagtaattaaccacttgtttaggggagccaaaataaaccttaccaaattttggcaatttgataatattgtcaagttttgacatgatttattttatatttaccaaagtttggttaaaaaactaaatgaatgcgtatctttgttaactttacttaagaaaatagtatggtttgaaatgacattaatacgatccttaattaatccatacgaaaattagaaacaggatggtgggctccaggccggatgcaaggcccagtacccaatccaaccggcccgtttcttcatttaaatgggccgaccagcactggcccattaagccacttctcacgccatgagcgctgtcacaccgtattcgtcgccggaagtcgtcgacgtcgaggggacgaggagcccaccggcgagcggtggcgccacgggggaggaaggcggcgagctgggcgtcggcgagaactcgaggagaccgacgagaggccagtccaccaccgcgcagccacacaggcacggggaagagtggcgcgcgcggccgccg

SEQ ID NO: 40132 - DNA, 293 bp, Oryza sativa
gcttcgagctttactgttctgaacaactttaaaaataaaaaatatagtgaagaaacaggagcatcaagtgcgcctatctgtattatatgccatttaaaactgtattagttaatctgttccaaatctcagtgcggtgttgctgcaaacaggtacccaggttgagtacatcatatgattgtgcaagtgaaatgcctttttcgtcctgattttctagacctcaaaatatggaaattttgcattttgttcattccgattcccctatttactcctgcaatatttgttgtcattttaga
